United States Patent 11,242,544 (MICROBIOMES AND METHODS FOR PRODUCING MEDIUM-CHAIN FATTY ACIDS FROM ORGANIC SUBSTRATES) - sequence listing, part 9

SEQ ID NO: 532 - DNA, 17298 bp, Unknown
  Metagenome-assembled genome
tttagaaaaatgttgcattgctaggtgaatattaggggtagaatgttgtatagtagacatggcacgaaaactcctctgtatgtttgttttttagacgactcaattatacagatacggagtgtttcgtgtctatttttataacaaaaaagccccaacagattgggactcaattgggaatattaactttcaacctttagttatcattcagaattagcactaacccccgcagctatgccaaaacggccacaattctaccttattccgaatatttaaaatcacatccggcatcactattcgtatataaccattatcccagaactaaaatccaattacaaattagcactctaaactttctagtgctaattactggaactttgaccatctttgactataatagaatttgtaaggtaatcaaagacctacaaatacaaaacaaaaactattggaggctttcgttatggcaaatgatttaatgaatcggcacaatgacttaatggattttggtgcaggtcgcttcttcaatcggttagcgcatagcttcttcgacgacgatttttccgacttgacctttaatgacgcaatgcggacagacatcaaagaaagtgatcaagcctatacggcaaccatcgatttaccgggcgtcgacaaaaaagatcttaaaattgattatcaaaataatattctcaccgttagtgctaaaaatgaacaaaataccgatgaacgcgatgaaaatgatcaattagtccatcgtgaacggcgttatggtcaattctcacggcaataccagttgcctaacgttgaccaagctaagatcacagctaaatacaacgatggtgtattaacgatcacgctaccaaaatctgctgaagctacaaaacatcagattgaaattcagtaatctggctctctcttaatgaataaacatttttgtaacagcttttctaagcacccgctaagttaacgggtgctttttttatgaaaagaattaaaaaagatagccaccactatcgttatgtagttcataattctcgcgcggcactaatacttgctaacagtgcacccgacgcggtcaacattaggctaagccaatggatctcctcaacattacgtggcaaacaactgataaataagcctgcaaaaataattgccaaccaaaagtcaaaccgctttagaaatcgcattttgctacctcctcacataaacttagttcctctgccggtccattgaaaccgtctctgtttgagctgctttatttagcttaactaaaaattaagaaaatagaatcgcgcttattaacgattttcatctacgactttagtgggacacgttaattcttccgtttaatctagccgcaatgtactgtaaatgcgtgctaatttagataagtagcgcaaaaccgtagaatccgctaaactaagactaaatacaacctaatttattggaggaatttgcatgggattattaattgattggctgatcatcgtcgtggtcggctttatcgccgcaattttcgttgcggccgagttctctgtgcttaaagtccggccatcctacttaaaaggcttaattagtgacggtaaccgtactgctaaagtcaccttaaacttgctggaaaagctgaatgatacatgatctacaacccaagttgcaatcacctttaccgggatcttaatgggggcaattggggaaagcaccctgtcagaaacgttcattttattattcgcccaattcggtgtgacattgccagaaaattggctattatccactgctagtgtgatcatcctaacttatttagaagttgtactaaccgaattggtgcctaaatcgatggcgatcgaccggccaaacaaaatcgcgttattgattactcgcccggtaagcggttttcaaaaagtcgcctttccactggtttggttcatgaacttatcggccgcaatcgtccttaaattattaggctacactgtcgcgactgaaagcgaagatattttcacccaagcagaaattctcggaatcacacgtgaagccgttcgtggcggcaccattgatcccgatgatgccacctttatctcgcgcggctttgatttcaatgatcgtgctgctaaagatgtgatggtcgaccgaacatcagccagctttattagcgatcaagatgacgtcgcaacggcttaccaacattacctagaaaccggcttgacccgttttccagtaatggttgaacaaaatcgggaccaagtccgtggttacgtttacgcctatgacttagctaaacaaaatgccgttgacgccaccgtctctgtccaagaactgattcgcccaattgcccgtgtccccgaaaatatgttgatcaacgaaatttaccgcatgatggttcgcactaaatcaccgtttgcgttggtaaccgatgaatacggtggtaccgctgggatcatcaccgatgaagacatcaatgaagaactattaggtgatattcaggatgaaaacgatcgcgataaggattacgtacaaaaacaggcggacggcagctaccgcgtcaatggtaaaattacattaagtgattttgaggttgcttttaaaactagaatgcccacctttgaatcaagcaatgcggtgaccttgtccggttatttactagaaaaacaaccgacaatcactttgcatgaacaattggtcgtagaaccattcactctgaccgtcgctgaagttggtgataatcagcacatcacttgggtcaacgttttacgcacgccagaagcaaatgacgaataatgcaaataccgctaataaacgaaaaggtcggttatccatatgaaaaaatatgcttatctgttcctcggtacgatcacttttgcccttggtacattgggaatcgttcttcctttattaccgacaacggtattttatctgttaactggtttcttttggtatcgtagctcaccaaaattaaacgccaaattgatcaaactgccggcttatcaaaggtacgtgaccccttttctagaaaaacggatgtcgccacgcagtaaacggcggatgtttggcatgatggggctcgtttttcttatctcagcactacttgtcgaacatcatctgatccgcattttacttggcattatctatttcagcttagtcgtcggcttaagctggtacttgaaaaaacgcccgaccacaaaatccgaaaagtgatcaatcttatttttaatttataatagttgcctgcgggtaactatttttttacacaattaaaatctgcttaaaattaacaacctgagttaaacctaatctgaaattgatcatcagcgcgatcttcatagtatccctacattctcaactgttataccggtaccaatcagtcagcaaaatgaggctacagtacgatattcctaaacaaaaaaagcatcccacaaatgtgcggatgcttttcaacttttaattattaataacgtactggcgctaaaccactatgttgtgctttacgctgttgttttttacgcaattgctgtacttgtacttcggcatcgtgttccaaaccagcccgtgtccgcttggtagcgtaaacggtttgatcggcacgaaccatctgtacgatcgagcctagtagtaatacacaaacaaagatcaacggtaaaccagccagtgtacagatcgtctgcacggttttaaaaccaccgacaacgacgatccccatggaaaagagaatgaacacgccgacccagatcatccggttaaagcgactagggtcttggcctgcttttaatttcaagctggtcaatgaggagacgataaatgccgatgaagaaatcgttgtggctaagaaaatgaaggaggataatgcatagaatatcaaaacggcaactttaaatggcaaagtactcaaaacacgagcaataactgccgcttgaccttgcgtattcaatatttgaactagattaacgatcccactatgctgcaggtataatgaataaccacctaaaatagcgtaaaaactcatacaacctaaagcaccgaacaataacataccgacaatgatttggcgaatcgtccgccctttagaaatgcgcgcgatgaacaaaccagtaaatggcatgtatgacaaccaccaaccccaatagaaaatcgtgttggcattcgtcgtgactgcccctttacctactaaaccagtacttaatggaataaagcgcgtgatcaaatgacctaaattaccaagttctaattgacctaataacttagttggtcccaacaataaaacaaagaccaaaaagccgaccgcggtccaaatatgcgcggcacttaagcggtcgataccgccttctaagccggcaaaaacagtcaccgcgaagagtacaaataaaatcgcaaataagactaatttcaacatgaagttatctggtaccccagtaaaactgtgaaccacggttgctaaaataggaatttctagaccaactgatgaaccgatcccacccataatgccgacaacaactaggaaatcaacaaaagtacgtaatacttttttgtagccttgttggccatcaagtaaggtgatcgcctcgcttaaacgttggacctgacgatgtttattgtacatggcatagccgatcgcaattgtcgctgaagcaaacatcatccatgccattggtccccagtcaaactgaccaaacatgctggcatcaaagtaagccgcatgggaaaatggcttcacattaaacgctggatgagctaccgcccgtaatggatcaaccatacttaacattaaaatactagcatcgatcgccgtggcaaaaaccatactaccccattgaaaattattgtactttggtttgtcagttgctttgccaagacggatattgccaaaatgactactagctaaataaacaaaaaaagcgaagttcaagagatacacaccgaagaaaagccaacccatgttagtcgtaataccagtcattaatgacgccaaccagtgctgcagtgaatgcccaccaagtaataacgccgccgacatcaacacgaaaagactcacggttggaacaaaaacggttcgatcaatttgttttgcttttaaaattataaacctgcacctgaaaacacgtccacaaccgacgtgccctagaggaaaattactgattcgtcctggtgccattggtaaaaaattgaccaataactatggcttcattaatgtggttaaatggcacttagtcatttaaccacgcgctcccagtccccagtcgttaattcccggattcatccttgatcaccggtacatatagtgccacgcgaggttgcccccgttctaggtgagtttcagtcgcagtattgccttctttctattttttggaattaagattactcatttaaaatgagcgcaaggaattcgtgaccttctacagagtgttaaaaaaagcgttcatgttttgagcattagcttagcttggcgaataattcacgcagtggactatttgacaagcgtagctaagcggaaaaacatgccttttttaacacgtttccgttaaagctgtttgataatacgcgctggattaccggcgatcacgaccttatctggaaaagattttgtcactacagagccagcaccaaccacaacttcgttacctaaagtaacgcctggcagtactgtcacacgaccaccaaaccagcaactattaccaatggtgatcggcttacctagctcaacatcagcatcacgctgcgccgcatccagtggatgaactggcgtatacaagccaacattcgggccaaaatagcaatgactaccaatggtgatcgggcaagtgtccaaaaacgtcatatcgtaattaccatagaaatgatcgccaatgtgaatgttaaacccataatcaaacttaaattcactttcgacgaaaaagtcatccccggcatccgctaataacgccttaaaccgctgattacgttcttcattatcgacaatttggttgatttcttttagctgctgacgaattagtttccgccgttcgatcaattctgggtcgaactgctgataagcttcgccggcagtcattttttctcgctctgtttttttcatcatatatacaccttaccatacttccaactaaatgtttaggttagcagaaaaatgcccagtgattgtagcggctaacctaacaaaaataaccaatgttatagaaaaagccaccgtgcaaataatacactgtggccaagcaactattttataaatattggcggataatattttcataagttgccaatacattgagataattagcaaccgccaccgactcattgatctgatgcgcatcatgccaattaccagcgcctagtagtaacatcgggcaatcattagcagcaacataagccgaggcatccgttgcaccatgaatgatcaacttttgtgctggcgtcccaaacgccgcggtccgggcagcctgaactaaattgacaaacggggaatcagggtcattcgtaatcgcttcaaaacgatctctaaccgttaactcaagttttacttggggacgctgatttaatttggcaatgatctgctgtaaccgctcaaggacttgctgggtatcgaactcagggatcggacgaatattgccctgtagatacgcctgatcaggaatactattgttctgctcgccacctttgatcaccgtaatactatgtaccaaagcacctaatagcttacttttaggcacatcattaaacgccggccgctcggcattgataaagtcatttaaatgatagatcgcattaatacctttatccggtaacgaactgtgcgcgctttttccgtaagccgtcaccgtataattaaattgcccactatgcgcgaacacaatattgacactagttggttcaccaaccaccatggcggtcacatcgtcgatccgcccttgccgcgtcagctcaacggcaccacgcgcacctagttcttcactggccgtgccgataaaacgtaattggccatttaacttcacgccactttccttgatttcaatcatagcgatcgccatcgcagccaagccagatttcatatccgcagcaccacgaccataaatcgaatcagcactcagttggccaccaaacggatcaaattgccaattagcgcgattgcctactgcaactgtatctaaatgtccagctaacgccaatactctatccgtcgtgcgctcaccaatctcagcaatgatgctacaacgttctgtcgcaccattgaagggaatcaattccacagatgtgattccatgtgctttaaaaagttgttgcaaataattagcgaccactcgttcattgccattaactgaattgatctggatcaattgttgcaagatcttaattttctctgctcgttccatactaaaccttcctaattaaaaaaatacttaggccgtgatcgaatggtcttcagcccgcgtatgcgcacttaaattagcgaaaaactgtgtgatcacttcgatgccgctgagatagtcagcttccgttacgttttcatttggggcatgggcgccagaattgggattactgataccgattgccgcgatcggcgcatgtaaataatgattaaaattatatgaaggtcctgtcccagctgaagttggcaatacttcaacactgtcggtgccgccatagaccgtttgcgccgtggcaatcaattctttgatcagtggtgcatccatgtcggaacgataagcggtaacgcccattgtgtaatctactttaagatcgccaaaaccgttgttgtacagctgagcggcgactttatcggcaacatcagtagggtcttgaccaggcactagccgcatatcaaacttagccccaccatgcgcgggcaaaacggttttgacactggcgccttcgtaaccaccactaataccctcgatattaaaacttggggcaaatagataagcttccttaattttttcttcattatcaccttgtaaaaatgggtactgcaactgatacaatttgcttaatttggccgacgaaaaatacattttatgggctaaatttttagcccgtattgtgggtgcggtgatattatcataaaaaccggccacaccgattttgccgtgctgatgcaagctagaaataccatcgatcaaataccacaacgcaccatcaataatggccgaattagatgagtgtagatcgcgactggcagagtcagcagaaatttcaaaacagctgatacctttattcccaccggtgatccgcaactgaccacgttcatttttagtccctgactcccagatgatcaagtcgctttgaaacagttcactatgttgtttgaaataatcatctaagccttggctggcaatctcctcagccccttcgaccaagaacttgatatgcactgggggctgaccgtattcgtctaaataatttttcaacgccgttaaacgaacaaacagatcacctttacagtccgcgattccccgtccaaaaaatttaccgtcttgcttagtcaacgtccacggatcagtccgccataacgcaagcggctccgctggctgaacatcataatgattataaaatagtactgttgttgcattagccgccggcgtcgctgcaggaaaatcagcaaagaccagcggaaatttatgctcgtcaaaaacacggaccgcgccacctaactcagtaaaaacttgctttagaaattgtgccgtttcttgaatatgttggtattgtgctgaaacggaacctagcttaatgtactgcgccaacttagcttgataagtcgcaatattttgttgtttacccatacaatgacccccctaaaaaattacttcagcttaatatcccaagcagcggtctcagcgcctttaaagatcttctggatggcttttttcgttgcttcttgttggaaagcttgaacgacttttttgtaagtcttgttatttttatcttcagttctggcggcaataatattgatatacggcttcgatttcttattgatttgttccgtgtacagtgcatccttatggttcaatttagcatcggtcgcaaccccactattgatcaccgccgcggaaacatcgcctaaagaatgcgctgtttgtgacgcatcaacttctttgattttcaaattcagcttattttgcgtaatatcatgaaccgttggtaacgtcttatttttgattttgatcaagccagcattttgtaaaagggtcagcgcacgaccttcatcagtaacgtcattggcaatgatgatcgtgtcaccttttttgatctggctaactttggtgtgtttgctggaatataatgcaagtggtgcgatcacggttttgccaatggcacttaatttagccttatgcgtttttttccaatcatcgaaaaagtattttgtttggaaagcatttaaatcgacatcaccgttgactaaagcagtattcggctgattgtaatcgctgaaagtcacaaattttaatttgataccttccttcgccaaagttttttctgccggattccattgccggtgatcactaccattaatcccaattgtgactgttttagcagcgtgtgcgggtacgattgcgccaccaaatacgaaaataaatgctgcaactgctaaaccgatcagtaaacctaatcgtttatgtttaatcatgactaattcctccaatattaactaaataattgctgaaacaaaaaaaccgtcctcataattctattttcaagaattaaaaggacggtttttaccgtgttgccaccttagcttatgccttcttcgcaaaagacacctcagtaagttctgccacaactaatgacaaaactctgcacgaataacggatgcaaccccgttgacggcttagaattgacccttaccgacactttgctaaggagaccatattcgaaaacgcgactgcattcgttcacaccacccacgaactcgctgccaagttttgtcttctactcatctcaaacatttatctagatttaagttgaggctattatattaataaaattttaatttgtcaaattgattaaaacaaaccacagtcgtttaccacaagtaaaattattcaaattgcacaacttgctcaacggcataacgaacggatttcatttcatctttatcgtctggtgctggcttgccgattgcgatcgccattactggcacgtaacgatcaggatctacacctaatgcggttgcggctttagtcgtatcgtagccgccgatcggattagtctcataaccatgcgcccgcgcaactaacatgaactgcatagccgctaaggtactatcaacagtggcatcagctttgagcatatcctgcgaggcactttcatataatggcaaaaaagtcttaagtacttcatcacgtttttcagcagtgatctgtttattttcatacgctttgttccataaatcacggtatgacttgtaagctaacgtgtcaccaaaaatcatgaccatcgctgagcaagtctccaattgtggtttattaaatttcatgaaaaatgaacgtaacttatccttacccgctggtgtatcaacaacgacaaagtgccaggcttgtaaattacagccagatggtgcagtgattgcttcactgatcatatccgtcatttctgcatgatcgatgctaaccactggatcaaaattacgaatcgactgccggtttgccataatatctttgaaatcattattaactagtgtctcagttgctgttgccatattgaccactgatcctttctatatagaaattatactgtaagcattgttaacaccgtttacattgatcagtataggcgtttctgcggcataattaaaccaaactgttgttaaaaactagtcgttctgacaaaaggctaaataatagccgactgccgccactgtttgggccgactgaacagtgccatttctgactaaggtaaccagttccgagaagggaactaattgactattaacaaattcatccgcatcaaaatgcgttgctacccgttcagttgcatcaatgtgagccaacaccaaggttacccgctcatcagtaaagccctctgatgaagcgaccgtggtcaatacttttaaatcatgggccacgtaacccgtttcttcacttaattcccgtggtgctgcggtcaacgcatcttcgttttcatttagtaaaccggcaggcaaggcaatgctttcctggttaacccccgcccgatattcgctatttacaaccacttgttgatctgcagttaaagccaaaattgccaccgccgggcgatgcaaaataacatcacgcgttaccaccatatgatcgggcgttttgatctggcgctgcacaaagtcaaaaatataaccatgataacgctgattctccgtctgtactttcccaggccgcccggcatttacaaaatttaacataatgatcaacctttcccactataataaatttatcatcaaaaaagctgccagcatttaagtctacggcagccttaatttctattataacgatttagcaggggcttttaaatgttgtaaaccaacaccagcaaaaccgcttaacaatgacatcactggacaaagcaaactgaagaaaacaaagggtaagtactcgatcgttggcacacctaatgtgttagccaggaaaacaccaccaacaccccacggtactaagtaattgatcaccgtaccaccatcttccagtacacgaccgagcgcctcatcacttaaccccccttggttaaatgcctgcttaaacgcccgtcctggtaagataattgataagaattgttcaccaacaaataaattaacgccaatacaagccaccaaaccggctaagatcaatttgccactattatttaaatgctgtgcgatcggcgtcattactgcttcgatcaacccaaatttcactagtaaaccacctaatgacaaggttaacacgatcagagcaacggttggcatcatactaacgataccaccgcgggataataatttatcgacccccgcattaccagtatgggccacaaagccatcggtgataatcgttgccaaatgattcaaacctaagcgtggctgctcaaccaacaataagccagtcgtcacaaaaacattcaacagcatcgttggtatcgcaggaatttttaagcccgcacaagcaaacacgagaataattggcaacaaggcccaaattgaaatcgaaaaattatgatttaaaatactaaccgtacgctgaatttgactcaagctagcgccattgctagtacggccaaggaagctaaaaataaccaacgtaataccaccggctggtacgatcgaccagtataaattacgcatatgagtgaataaatcaatatcaacgacggctgccgctaaattattggtctctgataatggcgataatttatcgcccataataccaccggaaataatcgcccctgccaccatggctgggttcaaattcatcgtcatccccataccgaaaaaggccaaaccaactgtcgacacaactgtaaatgcactcccaacagccgcaccgactaacgcacaaacaataaaaacggaaggtaagaaccaacgtacactgatcaatttaaagccaacaaccattaacgtaggaatggtcccggccgcgatccaggtactgatcatagccccaatcaagataaaaataaaaattggaatgattcctttttcgataccttcagcgataccaacattaaccgttgcccaatcagaatgacgcgattttgcccataccatcaccaaactcattgccagcatgacgggtacttgcggtgataagccaaaaccgatcacaccgatccccatgaccgccaacacaatgatcaaaacaattaacgcttcagtaaaacctaattttttcattttattctgcatattcatgcgctcctcgtattcactattatggtgccttaatgctaagatcaagctgctttacaactgatcaactttatcatcaaatagaccattaacagctgcgataacgtgctttacccccacaatgttgttgcatctcatttccccaattctaaaaaagtataaaaaaagtccctgctgcaaaattgcaacagggacgacaaacgccgtggtaccacccaaattgagtataaaactccactctacaagcgcgtatcgacgcttgatgccgtttgaacccagaacggtatttggtcaatttaccctgatcggttcgcagcaaccaccgacttcctgacacccagataaatcaactacttcttgtcctgctttgttcacttgatataaattaattgtaatcctatcacgcttcccaactatcgtcaatagtattctaccagtcccatcccaacaagatcaaaatgcagacatctttggaccattattagcggtgtgttcaacctgaatggtggcaccacttatttcctatgaaaattgggctatccactatattaggtcatctcactgtaggcatagttttcattgtgtaaaatttataatcattattatctagaagtggttttaatttagcccgatatgttttataatgaaagcgtagtcgaatttatttcactacataaaatttcgtaggaggctgatttattttatgaaagtaatcgtcgtcggttcatcacatggtggctatgaggcggtacgtgaagttctagcaaatgacccaacagccgagatccaatggtacgaaaaaggtgattttctatctttcctttcttgtggtatgcagctttatttggaaggcgttgttaaggacgttaattccgttcgctacgcgacacctgaaaagatgcgggcacaaggtgtagccgtttatacgcgtgaagagatcactgcgatcgatcctcaagcacacaccgttcatgttcaaaatcataacaatggtacagaacgtgatgagaaatacgataaattaattcttagcgctggtgcagtaccagcagaaattcccgttccaggtaaagatctagctaatatctatgctatgcgtgggcgcgattgggccatcaagctcaaagccaaaacggttgatccaactgtgaaaaacgttgttgtgatcggttctggctatattggcgtcgaagctgctgaagtttttgctaaagctggcaagcacgtcacgatcattgatttgttaccgcgtttactcagtttatacttagatgctgaatttacggacattttgacgaaagaaatggcgacccataatatttatccagcagcaggccaagcggtacagcgctttgctggtgaaaatggtcaggtgacacaagtcatcacggatcaagcaacttatccagctgatttagttattgaagctgctggtatcaaacctaacaccgcttggctcaaggatacccttgaacttgacgaaaaagggctgatcaagattgatcagtatttacttacgagccaacctgacatttttgctgttggtgatgcgaccttagttcgttttgcgccaactgatggatccgcacgcattgctctagcaactaatgcgcggcggcaaggtcgctacgctgccaaaaacttagtcgacgcaaaatatccggtacccgctgtttctggctcctctgcattatccgtctttgactataagtttgcgtcaacggggatcaaagaaggaactgcccacaattacggtctcgaaacaaaatccgtctttgtaaccgatacttatcggccaccatttgtgcccgaaactgctggtaacacagaagttttattcaaattaacttacgcaccagaaaatggtcgtgtcctgggtgcacaaatcatgtcgaaagcagatgttacagctaatatcaacgctatttctttagccattcaaggtaaaatgacgatcaatgaccttgcctacgctgatttcttcttccagcctggcttcgatcgtccatggaatatcatcaatgttgcggctcaaaaagcgcaacgccaaaagtaatcaagtctattcggtatttgtcttgtgcaaataagctgacgtattaaaagattgtggtagaggatttttctttaccgcaatctttttgttacctgcatagtattaaaaccaccctgtcgaacattaatccgctgcacctattttatttttacaacaaaagttactgcatttttgttaattattgctatagtataaatagaaatggagggattattttggttcaattaactaaattaaccgatacatttactttaaataatggtacaaaaattccaatcgttggctttggaacttggcaaacgcctgatggtgatgtcgccaaagaatccgttaaggcagcaattgcggcaggctatcgtcacatcgataccgcctttgcctacggtaacgaaaccagtgtgggtgccggcattcgcgaaagtggcgttaagcgcgatgaattatgggtcacatctaaattaactggtgaagatcatggctacaagaatacacagaaagcaattgatacttcattaagtaatcttggcttagactacttagacctgtatttgattcactggcctaatccaatcgccttccgtgatgagtggatcgaagctaatgctggttcgtggcgggcaatggaagaagctcaagccgctggcaaattacgagcgattggcgtttctaattttcggcctaaacatttagaggaattgcttaaaaccgcaacggtcaccccgcaagtcaatcagatcttcttaaatccaagcgatttacaatcggaagttgtagcctataacaacgatcacaatattttatccgaagcttatagtcccttaggtaccggtaagattttcagtgtacctgaactaaaaactattgcagaaaaatatcacaagaccgttgctcaagtcgttttacgttggtcattacaacatggctttttaccattaccaaagtcagttcatgccgaacgtattcaagaaaatacccagttatttgacttcgaattaaacgctgctgatatgactgcaatcgaccaactacatggggttgctggtgttgctactaatcccgatacaattacttggtaactttaaaatcgccttaaccggcgattttttattatcgtgccaacaatccaatttggtacttacaaaatagttatacaaatcacatgcaacgtgctacaataatgacgtacattcaggaaacgttatcagcaagcgtttctaattttacatactaaaggagctggatatgatgaacaaattaggtcgtaaaattgtaacgttagcggctgcagtcttaatgggcggctcagttgcaacgttttctactgtcggtgctgctaaagctgccaccgatgataatcaggtggtcttgaaacaattggatactgcacctcatggtaagcaagctttcgccgtaacaactgttgcgatgaaaggtgacaagatcgtcgctgcttatattgatgaatttcaatttgttaaaaagggtactaaaggcatgaccccagtacctaacagtactaaaggttttgctaaaggtgttaaaaacaagcaaatgctgatttctaaagcaactaatgatgaagcttatagtggtttgatgaagaaagaagctaaatcaacccaaggtcggttacaatcattagacgctattgaaaaatacaccgtcggtaaaactgcagcacaactgaacacggccttagctaaaaacaagaagatgcaaaagaaagttatttctggcgcaactctggctgatactaacggctacgttaagtcaatcgcacaaactgcaactaaaggttatgcaactaaagggatcgatgtcactgacgacaacatcactttgaaacaagttgaagcagcacctcatggaactgattcatttgctgtaactactgttgcaatgaacggtgataaagttgctgctgccagcattgatgaattccaattcgttgctaaaaaaggcttcaaaggtgtaccaaacagcaattctgacttcggcaaagcttatcctaaaggcaaagtgttaatttcaaaacaagttaatgataaagcctatagtgctttgatgaagaagattggtaaagctaaacaagatcggatgacttcagttaatgccatcacgaagtacgcttctggtaaaactgctgatcaattgaagaatgacttaaatgcacattctaagatgactgatgttgtttctggtgcaacacttgaagataccaacggttacgttcaatcaatcgttgatgccatcaacaaataaatttaaccacgaaaatctcgcgactcgttctgcgataatccctttatggttgtcagatgaaatacaataattcatctaacaactatggagggatttttgtatgcccagatctaaacatacggtactcgaaaaattagcaatcttaaaggaacttacc

SEQ ID NO: 533 - DNA, 17261 bp, Unknown
  Metagenome-assembled genome
caagcactcctttgtatcgtggtttagacgactcaagtatacttcaaggagctgcttgtgtttaatcttgggctaaaataacttagtgcaatcaggtttagctgggttttgaactttcacggtttagttatgaaatacttaaagctgattttaaccaataaaaaaccagcgtatgggcttacgctggaaaaaggagttgggttttccattacttggggggtaatgaaaaaattaagttttgggttagggatttaggtggggtccttcatctctatgtctattactataaccagaaaatgtgaagaatgcgtgacgaaattgctggaatagttggaaaaaaacattatagaagggttaaggatatgtttacagccgttatcagtcttgttgctagttgtgtttaaaaaatctgtaaagtgacgaccgaaaatttaaaaaaggcccgacaaaaagccttgcataacgctattattatgggtatctattgcacagtataagtcacctagtgcaaagtgcgtaggctgtttttctgaccactttaactacgtgggacaatatcataagttcattgatcatcggttctttaatcattttcctcatctatgtaattaactggagtcgtataaaacatagtgacgattaaaataaaccattagccgttattttacgtatattttaattagatactccgatgataattttatcttagtatccctaattaaaataaaaggagattagcataatattcattttatgaatattatgctataatgtagttatgcaggtagtgtatacaacgtctacatcggcagagttcctagagaattttcaacctaactctcagtttaaattcaattggcaacaaatccttaatgaaaaccaacattcaattgttattgttgcgtattataaagatcaattggtcggcatagccaattttgaacgaatttcaagcgatcgttacaattttgtttataatatcgaagtagttgctgccgcacaacatcatcatgttggcgcgagattattggcattagtgatgcaagattcattcgctcatggatttgatggcttcgtaaaactgctaacaaaaactagtggggttgagaaattttatcaacaacttggcggtgaattttttggccagcaggttatttttgacgagtatgccagcactcaagtaatagagaaatatttatctaagtatcggaggttataatatgcaaatcaccaatcagccaattgatttaactgatatcgccgcggtagaagcaaagcgacgtgaaattgcacatatcatcgaaacttatcccagagattcacacgagtttatgacggctactgcagctaataatgaactgcttgattcaaatgttccaattcgcattttttatttaatcggtcatcatctagaccatacaatcactgaacatgaaattgcccaattgatcgttgccggtgctaaaggggaagatcttagtgaagttcttccgctgacacctgaagttaaaacagctattaaatttcaaatagcacggcgacaagcaaaaatgactcaagcagaagtcgctgccaaagttgggcatatttcgcaagcacagattgctaaggccgaacgcgcacagacttcactttcgatcaatcgttgggcggaattatttaaggtagtaggaactagtgcagtaatcaagttgtactaaacaagtctcatctaggctatacttttcaccaaaaatcagatatttaaaaaaaacaaaccgtatagcaaaatagcgtggcccgctaaccaacattggttgacggagccacgctattatttaggatcataatgggctttagcactatattgattgactgtaattttaatgacaccaacatactcaacgtcatgttccttaatgttaggccaagcgtgccccgtctcatgcactaggatcgtctgtaaggcgtgttgcttagccgcaaggtcggtcactaattcagcattaccagtcccaataatgctacgataggcggaagaattttggctaggatcaccattggttgtcgtcattaaatgtccaccgtcatcgatttcaaaaccaactttagggtactgagcgatcaaatcatgtttacgtccaactggtgcaccgtgcaagtaaataaacaactgctgatcaacaaattcaaaaccgtaattagttggcaccacatacggataatctggtgtttggataccaagatggatcacatgcgcagcttgtaaaatcgccgcgatttcagttgcatcagtaacttctctgtcttttcgccgcattaacttcatcttcttcatcgtttttcgtttagtatacgctatttgtagaattttttaactataatctcataattgatggcataataattggtatgaatagtgagataaaacgacgatcatgaaataagttgcggcacaattagacaattctgtttttcttgatggcgattggtgctggaacatgcatcccttcaccgtcaacacagagaataaggcgatggtgctagacaatatcagctacctactgaactcatttctgaaaaatactaacttcgaatacgtcctatttgtttgggtcatacaccagccagagattgcacaagatattctacaacggttggaaactgctgattttaaactgatcagcatcacactaaccgccacaccagaaaaactacgcgcaaatattcagcaagacgttgctgccggcaaacgcgagctggctgcgattgagccaagtattgcgcggctgccactatacgatcagcaagcaacaatcaaattagacacgactgaattaactgtcccagcggcagttactaaaatgatccaaatcattaacaaagccagcgaccttgattaaggctgctggctttagtttaacgttttagcggatgtttcagtaaaaaaatttgaagtaaagtacagtcactttcattgcggcaacaacaaattcaacccgattggcactaatcccaagataaatagcactccagctaccgcacggcctaagtggactttatgcagtcgttgtgcaaaaaattgtgcacttaagtaagccaacattatcgcatttaaaccagtcaagacgatgctcagaatttgactaatattgcccgctgttacgatgatcgcaaccaactgtaacaaatcaacaataacactagagatgcaaacggctaaatataaactgcgtttagtggccgttttatcggcgcgcgcttcatgcaagacactgcatagtagtaaataaacgagatacccaccgtacgtaaaaataaatagtcgcagcaccacacctaaaaaactggcgataaacattataaatttgacccgcccaggcatttgcgcaagtagtaccgacagtggataaacgatcgtactgaaatacgccaagacgatgccgactataatatacaatgccacccaaattttcgtatcctttttaccgacctggccgaaccacgtttgcatcaaagcgcccccattaaccactattatagattaattatacctgtaacaaccgtttttagaaagcgcattcaaagttaatgatttgggtatttttctagtcgttataattgttccgcatcgacttccgccacgccagccttgaactgataacccattttctggtaaaaacctaacgcagtgatcgaggctggtatttcaaccctcgtcgcttgctgaaaatagtcgtctgcctctaaagtagctataatttggctaccgatgccgtgaccttgatattccgaatgaacaaaaatatcgaacaggctgtgttccgtttgactaccccagtacgagccaatcgcgccagtcccgataattcgcgcagcatcagtaaaaacataaaaatgcgtttgctgcgctttttgcttgaaaaaggcagcatccatttgctgaatatcatgttcaatgtaagcagctgaataatccttgcgattagttgttcgtaacgttgtcgcgactaattgcgctactgctgtggcatccccagccacaaactttcttgctttaatcatttcacatcaccatcacttagtcgtttttccatataggtgtagagattttctttgttcatgatcgcagtctgcagctgctgagcatcgccagtcacaatgccctttttcttcaacgaaagaatgaattgcggcagatattgtgtaaagttttgcttaagtggcaaataaatctgccgctgatcctttaagtacagtcgtaaaccaaaattatcgggataccaatcaaacggcatccgttgccgtttgttatagagtaactcactgttgtcgatcattgtatacggaattttactgattgttttatgtgctaggcccaacacctgcaaaaatttgtgcagcgaccgtcgatcatactgaacaaatctgatctgcgttttttcaacgatccagtaatcgtcaaaatctactggtattactaggataatgccacacagaaaaataccgccaaacagccaccacggttgataaccaaatcccgttaacagcaaacaagtcaccgtccatagtacaaaatcaacgatcaaccgtcgccaatgcactttgcgccccaccacaaacggtcggcgcaaaaattggctaccacggactaattcatccaaggaaacattatagagttcacttaagcgcaacaaattattgatatcgggaaaattttcaccccgctcccacttggaaaccgactgccgactaatgcccaattcatgcgccagatcagtttgactatagccgttttgttcacgcaagtgctttaattgctgggtcaataacatatcgatcacctcgcctaaactataggtgtatctgtctaaaaacgctagcactctttagttgtcaataaaataaggccaagtgtcagttacaacacctagccttaaagtttatttaaataacccgattatcgttgggatcagattgatcaccagcaaagtcagtgcaactgcccgacctaatttaattttatgcagtaacgctgtaaaaaatgcatcaatcagcgctgccgtcacaattgcactaactactgccaaaataatcgtaacagtttgattgatcacaccaccagtaatgatgatcatcactaaatgcaccaaactaactaatataccagaaagacaagtcgttaaataaaaacttcgcttagtggcgactgtgttggctggctcctcgtgcaaaatactacgccagatgaaatagatcaaataaccgatatacgttgataaaaacaagccaattaccaaaccgatcgcactactgccaaaggtgacccatttgaccattgccggtgcattgactaataacgcttttggcgggtaaacaaatgcaacaaagtaggctaataccaaatcaacgacgaaatataaggtgatccaaatttttgtgtcattggcactagcttgactgaaccattttttcattttaatttcctccaaataagttgtatgacgagctttttaacgaataatctcaattagatctttgcggctagcagcattagctggcatcacgccgaagactaaaccgacggccgtggagacgccaaacgctaacgcaaacccaccaaaactaaagctggccttaaacggcattactggcagcgcgctaacccctaacgccaacaacacacccagtccataaccgatcaaaccacctaaaattgtcaaagttgcactttctaataagaattgtagccgaatatcctgttgccgggcgcccatcgcgcgacgaatcccaatttcggtagtccgttcagcaactgaaatatacatcatattcatcacgccgataccggcgataaatagtgatatcccagcaacagccgaaacaaagtaggtgatcgcattgaggactttaccgaacgtatctgcttgcgctgttggatcattactttgatattcaccctggctgcgcatactaccttgcgttttcagtatatgcagtacccgtttgtttacacgactcgctttagcacctttagttagcgacaacgtcaataaatcaccagtacgctcgctacgcgtatagtactgatgcactttacgcgggatcgtgatatttgtcgggatttgtccactcatggcatcagtaaaattaacgctgctcgccactgaactgcggacaccaacaatttcatataactggtcgtcaacggtaatcccatgatgtaaagcgttagttgtgccaccgaatagacttttggccaaactagcatcgatcactgcaacttgattaccaatttcattgtccatcgcggtcaaacgtcggcctgcgatcactttactactcttacctttggtgtaatgtaccaacacacttttggtcttattctttaccggcaacgtaagctgcgcataatcggaatccgaactactctgcttcactttagcgatgcctttgacttgacgcactaaagtcagatcacgctcattaaagggttgtgcactggtattggcagtatcgtttggcatgtaaacaatctgggtttcgactttaccagatttattgctagtaatgcttttagtcacccaattggagaagccatcgccgattgctaaaatcgtaacaacggccgcaatcccgataatgatccctagcatggtcaaaatactgcggcgtttattttttaggatcgaacgcagtgcggtggtccaaatttcagcgaagcgcatgctgcgtcacctcctcatcggctgtgatcgcaccatcaagaatcttgatcagccgatcaccatataacgaaacctgaggatcatgggtcactaaaacaattgtggtcccctcattgcgattaaggtcacgaaagatttgcatgatctcagcagaagtcttggtatctagcgcaccagttggttcatcagcgatgataaatttaggctgatgcactaatgcccgcgcaattgcgactcgctgttgttgcccaccagaaagttcactgggaatcttttggctactgttaggtaatccgacacgaatcagggcttgctcaacgaccggcttagcggcacgcttagtcataccaccataaagtaacggcagctcaacattctctagaatcgtgttgttgctgatcaacttaaaattttggaagacaaagccgacactgcgattgcggatacgcgccaacgtattatcgctagctttttgataagaatcaccgttaaatagatactcaccttcatattgacgatcaataaaaccaattaaattgatcaacgaagttttacctgcaccagacggtcccatgatcgataaaaattcaccgcgatcgatggttaaattaatatcgcgtaagacatgaaagttttgtgccccattttgatagtatttattgacggattttaactcaatcagcattgaccgtcacctcttgcccattctttaagtgatgatcagggttggtaatgatcgtagttttcggttgtaatcctgacatcagatgccaatagccatcaacttttttaaccaccaccttttgccgataagctttatgctttttaaccacatagacgtagtgcgtaccagcttttttaactaagctagccgcaggtaaacgaatcgtattctgcggaacgcgaatttgcacattaaagccattagtcaatttatggtcgatttttacagtgaattgataggttgcggcttcactgccgccagtttgcgccgtacttgttgttggtgtagccgcttgcggcgtttgatcaatggtcacaattttaccttgataatgatcggtgttgctaacaggcataactgtgaccgccaattccagtttgagcttggcataatcgtactcagtcacttgaccgtcaatgatctgcccatcgctgatgatctgcatatctggaataccagtattactattatttgtggtatccaatgcaatcgtaccagcaattttggccgtcacttgtgggtctaattttgcttgtaaacgcgtcaaactatcattagtctgttgtaatgtcaattgatccgccaccaatgtattccgtgcttgttgcagctgatcagcagctgcacctgagtcagcaaccgagctatcagtatcactaccagtgacttctgttgtcggctgatttgactgttttttcagcgctgtaattgcctgctgatcattttgaatcgccagctcggttttcgctacagtttggttagcctcatcaatctgactttgtacctgatcatcatgaaacgtcatcaagacggtgccgggatcaacgtgttccccatttttaacgttgatcgccgttaatgttcctgtactgctaacaccagtttcaaccgcaaccgtatccttcgctgctactttgccctttagtaacagcgcgctatcacgcttaacttgatacgtttgatactgctgtttttgtgccgcttgctggttatttgccttaactaagccaactgcgccgatcacacctaaaacaagtaaaacccccaaaatgatccaaaaacgtccccgaaataatttcttcatccaactctgaccttgtttgctcaatatttaactttcagttaccagcaaacatcctttcctgtagacttatttatacacaatttaattatacaggtatttataatttacgaaagggtcaatcaagctagtcctaatttgtgtaaaatttatcaaattattgatagtagcaatgcgatatgtatatttcttttattagcttgcccacctcatttacactaaaactagatcaaaacaaggaggtcccactatgccctggaatatgcgcgactacccagtttctatgaaaaatctacctgaattagtacgcaagaaagcaatcgacatcggcaatgccctattagcagatggttatccagatgatcgtgcgatcccgattgcaattagtcaagctgagaaatggtacgagaccgctgataccaaggagaaagcagcttttcaaaaagaggccaatcccagcaaacgcgataaacatgaatcacgtggtaatcccgagttgatcactgccaacgaaatcgttcgccatcaggatgacggttgggcggttatggctgaaggcgctaaacaagccagcgaggttttttctagtaaggaagccgcagttaagcgcgctcgtgaaattgcccgtaacaaggaatcaacgatcaaggtttaccgcaaagacggtagtttacaggatgaaatcacgccacggaaatgagtgtataaaaaaatcccacaagtgggatttttattttttatcaacgccgcgcagccactgaattaaatgattcgcgacctgccgttgttgtgtctgattactgattgtcgcggtacgatcacccttttgcgggccataactaccgaagcctgcatgattgccaccgttgatctgaacgtattttgtatttctgggtaaattgtatttagccttcttataagccgcctgatctaatacaccatcacgactagctgtgatcgataagactggtaacaccgtggaacgcaaactacctttactgtcgggataactagctaagaagaaaacgccttttaaccgttcttgatgattttgtgcgtatcgactagccataacaccacctagcgaatgacctccgataacataatcacgctgcgaacttttcaagacgctatccgccttgttcggcgccaaaacagctagatccagcggaaaccgcacgatgtaaactggatagccggccgccgctacttgtttagcccaaacactataactcgccggttctaccaacgcaccaggatagaaaataatcattggtgtggtcgtcaatttacttttgaaaattaattctgagccactagtcgtcgccgactgtgccgccgattctgcggactgactaggttgataaatctgtgcgcgcaaataagcccaactacccaataatagcaccagcaaaaccactacgattcccaataaaactttagtacgctttttcatggaattccccttttaacgatatattccatcataccatatctcgcatatctgcctgatcttacttcagaattttgataataaatttaatatttagcgttgctaacaatggctgacaacaactgaggaaatttagcttctaattctgcagttcgcaaagttaaataactatgccggccttcacgtcgcgtgctaaaagatctcagcaatttatatgagctttcaattgatgatttactagcggaaacaaaacaagcaacccaacagaaagagggcactaaaagtatgaagcatattaatttcttagccctatttggcgtcattttctttaatattacgctgttctccggcgttgcaattattgcgatcgcattactgccgttagcacaaaaaatcacctttagcttatacgaatttttcgtccgctatatcaaatacaatcaaaaaacaatctataattaaaattcgatcacaaaaactagcatgatagcaaaagttactttagctatcatgctagttttttatttaaatagctttattctgtctatggcgaaataatagataagcgatcaacgcaccgttaacagccccaagcgtaaataaatacttccgctgcaaaatacacaatatcaagccaacagtaattatacccatgctcacgataaagcgtaacgtcctattagtgatcaaaaatggatcagtccgcttcaatctacgataactgccacctgccataattaacaaataaccattaactaacataaccatcgctattacaaatgcaacggcaccggtcaactttaccccaaaccaagaaaaccgatcagccaacaacagtaatagtagcaacaaattaaccacataagacatcaaccaaattcgttgagcttcttttaatgcacgttctttccttgccagatcatccgccattccgttatcctcctttaataattcgtctaaagaaagctggtagtaatcactaagtgcgatcaagctagcgatgtcgggataactgcgttcgttttcccaactagaaattgtttgtcgggaaacgtgtagttcaaccgcaacgatttcctgggttacacctaatttttggcgtgcgctttttagttgtgcacctaattgcataccaactcgcctcctatattttgagagtaacggctccctatttaagataccagaaaagaaagtcagcttggtgattattcatagctaagtttctaagcaagctattctatggggataagcgcgatatcaagcgcgcttaatttaataaaaacaaaataaaactaaagccaataaacaaactaaacatcactgcaaacccagccgtcagctgaattttcagatggtgccgttttggcgcatcatctagttcaataatcactgcacgttggcggcgtaaaatgagatacgtgaacaaacccgacccattttgtccgctagtcgccagtagactagctaaatgcggatgggcaatattccgtgaggtagcgtctaaacgaaccaatcgccacaacagaacctgacatagaatagcgctagccacaaagcaaattcccactataaatagtaaaataattttcatcatcaacacctcagataacccaaatcatgagcacaaacaaccaacaaacatttaatagtagtagcgccactagtactagcgcccaccaatactgtactgtaaaaactaacccaaccactaaaactaaattcagaaaaagacctaacgcaagcaaccgcccagttttgactaaattcgtcgtattgatcaagtttttaaccattttttgatcccctctcaacaattcatctaaggataattcatacaaatcagccaaacgaatgcaacgttcaatatctggataactacgtgaattttcccagttggaaatcgtctagcgggaaacttttaatttggctgccaccatttcttgcgataactgctgttgctgccagcattgtttaagccgttcaccaatgatcattagccagcccccttcctttagcttcagtgtacgtaatccgtcaatatttgcctagcaaatatttttgacaaccgaaaattagcgttaaaatgctaaaatagagctacgaatcacgcggaggttacctatgaaaatcatcatcgcaccagctaaaaaaatgcggctcgataccgattcatttgccatcgctgccttgccacaatatttggctgaaacacaacagatcttagcgacaatgcgccagttatcctatacagagttaaagaatctatgggcgtgtagtgaaaagttagcgcaggccaactatcgctcgctacaacaaattaaacttaaagaacaactaacgccagcactaattgcattttctggtattcagtatcaatatatggcaccagatgttttcacggcaccagcactggaatacgttcaagccaacttacgaattctatctggcttttacggaattttacgaccatttgacggtgttgttccttatcgtttagagatgcaagcgcgcttgaacgttgcgcaaagtcctaatttatacgacttttggggtgctaaaccttatcaagcgctacggacaaaggcagagccgatcatcaatttagcttcccaagagtatgctaaaatcatccaacgccatttacaaccagacacgccgttgatcgatattgtgtttggccattgggtcgacggtaaaattaaaacccgtgccaccctagctaaaatggcgcgtggtgaaatggtccgttttatggcggaaaataatgtacaacaacttaatgagttacaacaattccagcgactgaattaccgttttatacccgaattatcgacggcaactaagttggtgtttgtggattaaattatagtaggcattggctagtaaaagctggttaatgccttttttatatagccatcactatcacaaaatttcatattgatcaaccctcctaatgatttcaagcgcgcttaaattcacgcttgattataaaatattatctaactctataatggatatccaaagtcattgacaaacgcaaaaaaatgagtaagatagttgcatacaatccttatagaaaatgaggtttcatagggtatttcataaaatagtaatgcggaactatttttagtaaattagatgaggaagagatggaagtagaatgaaacgttttttggaacgacacgtgggcgcgttagtggcttgggttgtcgtgatcattattgcgttgatcacaatgcccgacacaacgcggctgattcgtgagtatggtcaaaccaaaattcctgctgccgcgcagagtcaagtcgccgatgtcatgcaaaatcattgggggcgtggccaaggtaacacccgacaggtcgtcgttgtttttaataacggcgcagataaactgaccacaacgcaaaaagaaaatatcgcgcgtactgtacggcattttcgtgaaaataagcaacattaccatattaaatcggttactgccgcgacggataatgctgcgacgcgtaagcaattgatttccaaagataaatcaactcagttagttcaattgctggtcagcaaaaaagacacggttcggcaaatgaatgccgacattaccaaagccgctaaaacagcgggcgttaagacttatgtcactggtagtgatattttaaatgatgatttcagtcaagcgactgaggaaggaatcaaaaaaactgaagttatcgccgcgatttttatttttattgtactgatcattgttttccgttcgccgatcgtaccaattatttcgctgttgaccgttggggtttctgtgatcacttccttaagtatcgtcatgaacttagtcgatcgtgtcggcttcccactatcatcattcactcaagtctttatggtggtagtgctgttcgggatcggtactgactacaacatcttgctatatgatcaattcaaagctgagttgagtcagggactagacgcagtggcagccactaagaaagcccggcggatcgccggacgcacgattttgtacagtggctcgacaattctgatcggtttcaccgcgttgtcgctagccaagttctcgatctaccgttctgcggtcggggttgccgttggggttgccgtcttactattggttctcctaacgttgaacccatttttcatggctaccttgggtgcgcgtatgttctggccgatcaaaaactttgaaggcagcagcaatagtaaattgtggcacggtttgtcaaaacgctcggtgctgcatccatttattgccctcggcttagttttattagtgacattgccatttttattcacttatagcaatcaactaaattatgataccttggatgaattaagcgatagtttaccggctaagcaaggcttcaaagtcgtcaaagatcacttttctaaggggaccgctgagccgtcaactttatacattcaagcgaataaaaagctgaatcaagaacaatacttgaaagtgatcgatcaaatcacgcgtaagttacaaaaagaacatggcgtcaaaaccgtcgcttctgtaactcagcctggtggtagtaaaatcaaggaattgtacgctaatcaacaattaggcactgtaactagcggcatgaaaactgccggtaaaggcttaaaaacagtcaacaaaggtctgaatcaagctagtgataagttaggccaaagcgacatgtctagtggcctaagtggtgtccaacaattgatcagcggtaccgatgcattgactactggtagccaacaattaaccagtggtactggccaacttgcgaatggcgcaaccactttaagcaacggtttaggcacacttaacagttcgactgggactttagctagcggtgttaatcagctaactagcggtgcctacgtcttgcaaagcggtatcggtcaatacacaactggtgtcagccagttaaatagtggtttatccacattagccggcagctccgatcaagtcactaacggtgtgcaaagcttagttagtcaaagtagtcagctaccgttagcggtcgctgggctaacggcttacaacagcggtattgccagtggcgttaatcaaatcaatagcgcattggccgctaaccaatcaaaattagctgctttaagtagcgcccaaagtcaattgcagagtttgagtagtcaaagtgctactttgaaacaagaagtggcgcaagcacagaaaattgaaccacaattagacaacatgcttactttattaggtagcctacaaacagctaaaacacagatcagtcagttacaaactaaagcaagtgcacttgaatcaacgcaagcaacgctaaaaagtgctttgacccaaatcggcgaccgcgatactgcggccgcaacggccgacaaagcagtaatcgctacagcgcaaaaaatcgttgctgatcctaatgcaaccgcagattctaaagcacaagcacagacgatcattaaaacagctactgctagtttgacgaataatttagccgctaatggtacgacattaacgcaattgcagcaacaagctagccagacacaaatgccggatctatctagcttgacaacactggccaatcaactgcctagtgatagtgagatcagtagcttaaagacacagttaacaggtatgaaaaccatgctcgctaatgccaacaaattactcagcgaaactgataatttagctagtgcaactagcggtttaagcgatttacagaaccaaatgtccactttgacccaatcattagcccaattacaaacagcggctaaccaagcttcaagtgtggctaatcaattaaacgcaggtgttaatggttccggcgttgatacaactaaccaaagtacgatcaacgcaacgatcagccagtcgcaaatgttgagtcagatcaatcaattagccgctggtttacaacaatatactggcggtgttgaccaagcagctagtggtgctagtcaattgaacgctaactctgcatctctgactagtggcactaagcaattagctggtggcttaggtactttaaacaaccaagtaccgactttgaccagtggggttagtcagctaagcaatggcgccaatcaattagccagtggtgctaaccaattgaacgccaaagcaccacaactgaccgccggcttgattcaagttaacaatggtcaacggacgatgtacacgaccctacaaggtctagttagccaaatgcaggtattgtacaacggcttagtggatgccagtggtggtttaactaagatcggtaaaggcgttactagcgctgacgattatttaaccggcttaaagaattccgctgccgcaaataatttctacattccagccagcgttttgcatggtaaaacttttgccactgcaattaagacttatatgtcagctaataaacatgcgactaagctaacgattgttttagattcaaatcctagctcagccagatcaatggcgcggatcgattcgctacaaagtgaagttcaaaacgaattgaaaggcaccccactatctggtgctaaagttgcgatcggcggccaaaccgcttcgatctccgatacgcatcacattgccagcagcgactttacccgtactgctgcaatcatgttgatcggtatcttgttggccttgatggtcatcacccgttcaattctgcaaccattctatatcttaggtactttgttactggcctatgtcacctcattgagcctgacacgttggttaagtactgctgtactgggacaaagcatgttgacctggaatacaccgttcttctccttcgtcatgttagtggccttaggggtcgattacagtatcttcttaatgatgaagtatcgtgaatttgggttgactgacggtacacctagcaagcgaatcattgccgcttctggtgtgatcggtgctgtcgtgatctcagctgcggttatcctcagtgggacctttgccgccttgattccatccggcgttctgactttgattcaagtcgcgcttgccgtgatcatcgggttgatcatcttagtgatcattttgccggtagttatttcagccgcaattcggctaacctacccacttgatgacaaattgaatgacaatattaagaaacgtaaacattaaatgaaaacagctagttaccaattatggtaactagctgtttttttgatcaattattctgcattgctggaaattcgtaagcggtaaataatcacccgttttaaaaagacaaccaaacttctcgattttgagaaatctggttgtcttttgttaggcggcatttttagcttgatgcttgtccgttgtttttttattttgatgcc

SEQ ID NO: 534 - DNA, 7223 bp, Unknown
  Metagenome-assembled genome
tttttcacattctaaaagcagaagtttatgatcaaaaacagttcgataccttggcggaattaacccaagccgtagcgaactggattcaatattataatttcacgagaatcaaaacaaaactgggtggcaagagcccggttaaataccgtgttcttaccacccagaaagttgcttaaagtttcgtccaatatttggggttcacttcatatttattatagcctctttttttatgcgaatttcattgaaagccttgattaatgattaatactacaaattaccaccaatgatgaaaatgacagtattaattttagttaacgcttacattatgctgtaactgtaatcaaattaaacagctgaaaggtgtaatgcagtgatggaaaaaaattggcttgacttagaagacaaagtaattattgtgaccggaggatcgtcaggtattggtgcagcaattgtaaaagaattattgaatcaaggtgcttatgtctatgacgctgatttaaaaccaggtacggaacgaaatggaaaattggcgtttgtccccactgatgttactgctgcagataaagtgaatgaattagttcagcaagtaattgctaagcaccaccgcattgatggcttagttaataacgctgggattaatttgccaagattattagttgatgcgaaagaacctgagagccaatatgaattctctgaaaacgaatttgataaaatgtttggtgttaatgttaaaagtgttttcctgatgtcacaagctgttgcacgtgaaatggcgaaacaaaaacatggtgtgatcgtcaatatgtcatctgaagctggtttagaaggctctcaaggtcagagtatttactcagccactaaaggtgctatcaatggtttgacccgttcttgggctaaagagttaggtgaatttaatattcgtgtggttggtgttgcaccaggaattatggaagcaactgggttgcgaacaccagcttacgaagaagcattggcgtatacacgacataagacagtagcagatattcgagcgggctataagagcaagagtacgactccattaggacggagtggtcatttatctgaagttgctgatctagttgtttatttcttatctcaacgtgcaagctatatcacgggtgtaacaacaaatgtagctggaggaaaatcacgcggttaagggaatgatggtatggatggacaagaatatcgtttgctcaaatattttattgcgaacgattcattaacaataaccgagttgacagcacagtttcaaatttcaaaaagaactatgcaaaaatatattaaggaattgaatgctgatttaaaaggaattgcagtggtacgcgacaatcagcaacgtttttatttgaaaatatatgactataatcggctaacttccctccaaactggatttcttaaacaatcacttgattttaacgatccacaaaaacggcaagcgtttatcatattaaaattaattcaggctgatgattttatcatcttagacgatttagctgaacagttagttattagtaagggtactttaaatcgggatattcatgatttgaaacagagtttgcaagagtatcaaacagagatcatatcagttactaataaaggtgtacgtctggttgtgacacatgattatgattatggtttgttattacttaactttgtctatgactattatccactgtcagcagttttagctgatgaacacgataagtttgtgttggaaggattgattcggcagttggatgcaactgaacatactgttactttagttgaaaaaaatttgattgtgttagccgtactttttcaatataaacgacgtttaaaaatgtcgattccattttatcaagaattggttagtgaggaaaagttagcacctttgatccaacaagcagaaaagttgttacacacgcaattaacgactacagaaaaagcatttctctgctatcccttaaacatcaaattaactaacgtgactgataaagtaaaattggagcaacgattaaagtgggtacaccacttatttgataatgtgcaacaaacgataagaagaacgctgaatagtcatttggatcttgaccatgtttttatccagatcaggtatcatcttttgtttatggttaatcggattatttttaaggcgcaaacggaaaatttattaagcaacgaagtaatcgaaaagtatccagtagcgcttgaattagccttgttgaccgcgcgaagcttagaacaacagctgcatttaaaaattcctgaagttgaaagtaattatttgacgatctattaccagatggaaattgaggagcagcaccatcgccaagttaataaaaaggcagcaatcgttggaccagtcagtcgaagtattaaaaaattcatcatgcatcaattgaatgatctgtttcaggatacgattgagatcgtcacctttatgagtgtgctggagttacaacaaacacaggaacattatttaattgttttttcgaatcaaccgattcagcttgatgatccttctattccgatcgtgcgtttgaatagtgcgtttcgcaccgatgaattattgagtaaagtacaaaccgcacaagtagaagaagctatcaatcaaggctggtgccacttcagaattacgcgtttgaatgcacaattaggctatttgaaaggcaccgaaaccttgatcaaacaagaaatagcacgcgggcaattaaatgaaacgtttttaaccgattggtatcaacgtgaaaaacaaactaataatatttttgaaaataaaattgcgattccacatatgatcgatcattctggtgccaaacgaattttattaacggtgggtatttttgataagattgttgcctatcaacaacgccaggtgcagttgatttttctaattggtattccaagtcaattggatccccagatcaatcgggcgttatcgcaagtttatgatttgattttcaccatctcacgacatcaaaatatttacagcaatttattgaactacaacgatcaacaatcgcttacgcagataacggaggggatttaatatgctaataatcggtcttttcctagtgagcgcgtttttattacaaggtgcattaggatttatccaaattaagaatttcaccaaaaattttagtgaacttagaaaacaagggcgtgttctcatcggcaaaaatcctaaaagatttaattcggggagtttgatgctaatttcaattgatgatcagggtctgatcaaggaagcacgcatcatgaagggggtcacgatttttgctaaatttaaatcattacctcagttagcaggtagctatttgccagtagtggctgctgattatgatgaattacatcattttgatcgtttgacacggcaatgtttattgaatgcatatcgcaattatattgattttaaagcaggcaaactttcttcagatgcttatgataccagtgttaatgtcttttcaatgccactttttgtaaagattcaacaagttgggcttaatgtgacaacaacggttaaacaacgttataaaacttttagaaatggggattgaaattaatgaagtatattactgattttgcctcaggattcatggggctcttccaaactggtggtaaaacctttattggttggatgtcatcaatcgtaccagttgtgctgttattattggttttaatgaatacgatcattgcctttttaggtgaagaacgtatgaataagttggcgcgggcctcgtcacgtaatgtggtgaccagatacctgattttaccatttctgtcggcttttatgcttggtaatccgatggcctttaccatggcgcgctttttacctgaattttataagccgagttattatgcggcgcaagcacaattctgtcataccagtaatggggttttcccgcatatcaatcctggtgaattatttatttggttaggaattgcgcaaggagttcagaaattaggcttaaatagtatggatctggcgattcgctacatgttagtcggtattgttatgaactttattggtggttgggtaactgactatacaacggcttatgtttgcaagactagcggtgttgaattatctaaagaaattaaattaacgactaacgctgacgaagcggcagcgtaatggagggataataatgacgacttggaatagtattcggattgaaaaaggttctggcggttggggcggcccattgatcattacgccaacagaacaaaagcataaatttatttacgtgacgggtggcaatcgtccagcagtagttgacaaaattgaaaaattaactgggatgaaggcggtcgatggttttaaaacttctattccagataatgaaaccgctttagcaatcattgattgtgggggcaccctacgttgtgggatttatcctaaaaaaggtattttaaccgctaatgttttgccaactggtaaaagtggtcctttagctaagtacattacacctgaattatatgtttcggcagttggtgagaatcaagttagcgctattggcgcaactgaagccgcacagggacttgaagagaatacggccaaggcggccgaagaggttgaggctgctcaagcgactgaagcaaaatatgatagtagcaaaacgatcacacaacaactaaatcacacaagcttcatcgctaagatcggtattggtgccggcaaggtcgtggctaccttcaaccaggcagctaaagattctgtacaaacagttattaacacaattattccgtttatggcctttgttgctttactaattggtattattcaaggttctggtattggtaaggtttttgccaaagtaatgtcaccattggccggtaatgtttggggtttaatggtcattggttttatctgttcgttgccattcctatcaccattactaggacctggagcggttatcggtcaaattattgggactttaattggggttgaaattggcaaaggcaatatttcaccacaatatgccttaccagcattatttgcgattaatacgcaaaatgcttgtgactttattccagttggcttaggacttgaagaagctgagtctaaaacggttgaggttggggtgccatcggtgctgtattctaggttcattaacggggttccacgggtttttgttgcttggttagcaagttttggtctctatgcaggtaaataagagttataagagaaattgattatatggggtgaatttttatggtacaagatatcaatcaaaaagttatttttgaaacaacggttagagaaattggtcaagaagcaaaagactttggtgaaatcaaaatggcaattctattcggtgatgaagcaccagatgccttacgttcttcatgctatattattaatgttaagccggttcaggaacaagtgacgacagcgatggttttgcagatcaatgatgaaatttataaaatcactgcagttggcagtgaagttcaaacaaatttgaccaatttaggtcatattgctattagttttactggtgcaactagtgctgaactacctgggacactttacgtagaagataaaccttatcctgatattgaagttggcagtgatatcaaaattaaacaagtaaattaatggagtgtccgttatgagtatacaagcagtcatttttgacatggatggtgttattttagattcagagccgcaaatcattgaagctaagcaacaggtgctgcgtcaatatggtattgagcagccagaatcctatcattataagtttatgggaatgtcctttcaagcaatctggcagcaaattcaagtagaattggacttgccggtgagctggcaggaattgttaaacgattattttgttaagtataagttattgatcaaacaatcagcgcagcacccaattgttggtagtattgaactagtgagccgactgcagcaggctggttataaattagcattagcatcctcttcaccaatagatgatattcaacgtactttgaatgattttaagattacagattgctttgatgcgattatttctggctataccttggcacatccaaagccggcaccagatattttccaaattgctatccgtcaactacaggttacacctgcgaatagtgttgtagtggaggactcaatgaatggaatcaaagcaggattagcagctggtgcgcgagtgattggatacaatgatccgcgatattattcacagcgtaaagtagatgatattcaggtagttacagaaatgaaacaaatacaagaatttctattaccaaaggagtaatggttagatggaacttttattagataccattaatttgacagcaattgaacgttatcaaaaagtgattaaccttgcaggcgtgacgtctaatccaacaattgtgaaaaaagaaggcaaagttgacttctttaagcacatgaaacaaatcagaagtattattggggattcagctactttacatgcacaagtagttggacaaacagaagcagcaatgctagatgacgcgcatacgatcattgataaaattgattctaatgtttttattaaagttcccactaatgaaattggattagcggttatgaaggcattgaaaaaagaaggtatcaatgtgactgctacagcagtttatactgaatttcagggttatctagcactggcagctggtgcagactatttagcaccatactacaatcgaatgttgaatatgaatattaacgccaatcaggttattcaagcactagcagctgagatcaagcgaactaatgcgcattccaaaattttagccgctagctttcataatattgcacaagtgaatgaagcaattgaaaatgggtcgcaggcagtgactatgggtccggatattttagcatctggattaggtatgccggctattagtcaagcagttactgatttttcagctgactgggctagcatttacggagaaggacagactgttagttcaattggaaaacaaaatatgtaattaaatggccacgataactgtttcgtggccatttaattacataactaaaggttgaaagttaatattcccaattgagtcccaatctgttggggcttttttgttataaaaatagacacgaaacactgtaagcggtaaataatcacccgttttaaaaagacaaccaaacttctcgattttgagaaatctggttgtcttttgttaggcggcatttttagcttgatgcttgtccgttgtttttttattttgatgcc

SEQ ID NO: 535 - DNA, 2184 bp, Unknown
  Metagenome-assembled genome
agatggaccaattttgaaaaatgagcaaaagaatgatgaatatcagtgtcattgtattgtatagtagacataggcatgaaactcctctgtatggtttttgtttagacgctttaagtatacagatgtgaatggtttcatgtctatttttgtagcaaaaaagtcctaacagatcagggcttaagtggaaatattaactttcaacctttagttatttatagatctcttaactttgtggtaatcatagcaaggttaagagattttaattttttcatacgttatattttatgaaatgttccccaatctaatttagtgcatcccaataaaatttcagtaataatattggtaaagccttaaataggtggtgttcaatatgaaaattgatcaagcggaacttcaaaatgacatctacaatttgatcctcaacccggcaactcgtgactgggagcgagagcaattagtcaagctgaaaaaagccgtcgctgcaggggctacttttaatgcggagttggcacggttggaagctagcctacgacctttggcggtacgcgataatctgacccccgacatgactgatttttatcacaaaattaccggtgagcctgaattggccgccacatttgatctttcgcgccactacgcgaccgatcagccgtatgaagcgcgggcgattttcgccggtggttgtttttggtgtatggttgagccgtttgatacgcggccagggatcatcgcggtgatttcgggctatactggcggtcacaccgaaaatcccagctacgatcaggtgattggtcaatataccggccatgttgaggcggtggaaattatttttgatcagcgcatcgtaaagtacgccgatctagtcaatttattttggcagatcactgatcccaccgatgatcagggacaaatgaatgatcgcggtaaccattatcggccggtgattttcgtgcgtgatcaacagcagcgagcaattgccacgacctcgaagcaagcgttagcggcgtcaggcaaatacaaaaagccgatcgttacggccatcgagccagcacaaaaattttggccggcggaaaactttcatcaggaattctataaaaagaatcggcagcgctataaacggttggaacgtacgcggcaacagtatttagcggtacaacatttacacagtaaactgcggttgggctggcaacgatttaaacgcaaataaaacttttcattcgcttcagttgctaaatgtaattattagtattacagttaaaatgtagtttgagcaaacgaatggaaggaaggatatcatgagtaatgtattgattcttggggccgctggtaaaatcgcccgtttagcggaacaacagcttttagcagaaacggatgcgcaattaacactgtatttgcggcgtcctgaacggctcggcaatgttgatggcaaccgcgaaaaggtgatcgatggtgacacgacgaagccggaacaattagtggccgccatgcacggacaagatattgtctacgccaatttagccggtgccaatattgaagagcaggcaactaaagttgtggcggcgatgcaacagactggcgttaagcgactgatctggatctctacattgggtatttatgatgaagttcccggtgaatttggcaaatggaatcatcagatgttagacggtggttatttgcaaacgtatagtgcagcggctaaagtgatcgaagcttctgatctagattacacaattattcggccagcttggttgtccaacaaggatgagatcgactatgaaacaacccaaaaaggtgagtcctttaaaggcaccgaagtcgcacgtaaaagtgtcgcggcgtttgtcactaaattagtacaagatcctagtcaagaaattcggcattcggttggtttaaataaaccaaacaccgatggtgacaagcctgaatggtattaagggttaagaatttgcagtcaacgctgcaaattctttttttatacaataaatacgcgtggtgctagttcgtcataaaatcaaaaaagcctaaattgtataccaatatcgtcaattcaatctttaattgaaaaccaaatagactacgggtgagattggtttcaatcccaaattgctggtctaaaattgaaaagcgtgactctattgtccaccgtaacgccttgagttgacgcttattatgctgtttagc

SEQ ID NO: 536 - DNA, 11119 bp, Unknown
  Metagenome-assembled genome
tgtggttcagattgatccattttgatttgtacaatatcgggttttgccaataaaaatcacctcaccaattatttgatgaggtaatcataacttggatttagttagtttgatagtcggtcagttatttggtgcttacactaaatcagcaataaaaataatttagcgacaattgacaaaacacttcaatcgcctatttatctggtaacaaacagccgccaacaaacccatactacataagtttgctgacgactgtcgattcgttttattcgtttgaagactaattagtcatcaagcagatcatagatttccatcgcaattagatcaatatcatcgaactcaaatttttgatgattagttaattcttctaactcgtaagtttctgtttgtgggtcaaaactgactaaaccacgttcggcaccatttttttcaaagcggcgagtccggacttcatcgtccgcagaaccttgctgcatggcttccaaacgactgatgatcgcaactagctgtgagcttttcatgacgtgactcccttcattcgatctttacccaataatgataccagaaaatcggaccaagtgagcatttcagcgccagttatttcaaaaatattagtttttttcggtcaatagcctactaaaccaacttctagcggtacctttttcatgaaattctaatactatcgaagccactaatcaatttctttcaccttatccggcttgacgactaaagcaaagatgccaataaacatccctaaataataagtcataaaccgccacaggatcatcgccaatactaatttactatttaccacaacaaaggtcgcaaatagcacacgaaagctgatctccgcgcctccagaaccgcctgggatcggaaatagtgaaatgatcatgacaatcataatatgcatcactaaaacttccataaagcttggctgcagccctagggctaataacacaaaatacggcacgctataataaaagatcaattgaataaaagtcagtatgctagctttgatcaacataccggtttgatttttgatacgtaaactttcgcgataaaaattatcgatcttaaggtttaaagttgtctctagcttattggcccgtgactcagccattacccaatgtagtggccgtaacaataaacgtactaaacctttggtgaaattgtaccaatacatgatcagtagtagccccgtaatgaccgccaagtgaatcagaaaaccaaaaacaacaagccaagcgagataagtgaacttagccgcaactaacttaaagccaaaaaccagggttaaaatgaagttgatcaacaccattgcttgaaaaacaataaacttcatcaacaataatgaactagcccggccaccatcaactcccgattgcatcaaagccatcaactgggccggttgcccaccagaagaaaatggcgtcaatgaattaaatagctgctcaactagcggtatccgcaacgcgtttttaaacgaaaaatgatcgacgcgcccttttagtaataatttaacgacaaaggcttccatcagccaatagaggcccatgcacccagctgctaccaataaccaccaccaattaagttgtgcaatttcacgcaacaattggctcaaacgcaccgtacgcaactcgtaggcaaaaatgccaccgcctaatagcaacatcccaattaggaccgcaatattttttcgactcatggctagccctctttagcatgttcaacgtaaaaacgatgccagatttttgccaaacgctcttctgaataataatcagccgccgcctgagcttgttgttgcatataagccagtgaagcgggtttttcccgcagatcagcgattttttggtgcatatcatcaacatcggtagcagcaacatagtaaccggcaatgatcgcacgatacaaagatagatcacgcaacaagactggtgtcccacaagcaaagctttccaataccgacatcgggaacaactcgttgtaggaaggcagcaagaataagtcacttagattataaaagttcatcagttccgaccgctcgatgatcccagtaaatcgtaaatttgctgggggcgtatcaacgatttttttgtaacgctcataaccgtcagtcattttgccaaaagaaaaaccaccggcccaaataaactgaatatcgggattacgtcgagctaattcgacaaaatcgtcaacccctttgcgctcttgaatctgtcccgcaccgaggatcacaaactgatcagctggaatctgataatgctgccgtaacgccgtgatctgttctggtgattgcggataaaactccttacgcgacacaaaattaggaatatatgtaattttgttagctggaatttggtaggcgatcagcttagaaataaaactaggattaaccaccactaagtgatccatccgccgataaaaggcgatcacataatgataaaaaatccctttaaacggctgcggaatcgttaaactaccttctagcgtttccggcaaaaaatgaacataaccaattttacggcctcggcgccggaaaaaagttgagagaaaaaaccgaaaattgatcgtgtggtaatgactaatatctgaacgaccatattgattaatgctgaccttaaattcattttgaaaatggcgttgcagtagctggactaactccatataagcactaccaacgccttgtcccttgaccttagtggccgtagaaaacatgtgtatgtctaacatgctagttatatctccaattataaaagattgctgttaatcgctaacatccgcggaatcgcggtggcgttcagcgtagtaaacctgtgtatcttgataaaaacgaactacttgctcggcaaaatgctccgccgaaatcgagtaaagcttttgttgtcgtggtgctggatctgagtaactttgtggatgagctaaataattcaaaatctgatggaccatttccgcttggctttcaaaggtcgtgccgatcgctggatcatccaacaattcattagtgtacggactggccgctgccaccgcctttaacccactggccatcgcttcaacgtaagttagcccttgcgattcagagtgcgaagccgaaacgaatagatcagccatatgatagtacgctgatacatgatcattaggtacttcacccgtaaaaataacatgatcagcaatccctaattgttccgcttgttgagctaaatcagcccgcgccggcccatcaccaacgatcactaattgtacggtgggttgtttaactaaaatttgtggtaacgccgcgataatctcatgaatatttttctcatatgctactcgactaagcgagagtaataccagtgtctccgggctgatacctaacttcttacggcactcaaccggaactggattttcatattgcgaaatatcgatccccgtgggaatgatgcgcatcggtgatttaacaccataactttgtaatgtcgctacgacacgctcactaggtgcaatcacaccatacatatgatgtaaataagcgcgcattgcctgcttaacgtggtatggccgcaataacttcccatttaaaatataatgaagatagtcttggtacatcgtgtggtacgtatgcacgcacggaatttttaaatttttagccacaaatttaccgatatagcccatcgaaaattcagtctgggtatggacgatatcaagatctagatcacgtgcgacctgataagcatgaaataagccgcgtaccgcaattcgccgatcggtaaaagaaacaaaaggaacgctcgcaaatcggaaaatattcggttcaaattcgtccttatccacatgcggatcggttgttgtaaaaatgtaaacggagtgcccttcacgctcaagctcatcacgaagtgtcttgatcgaagtcgcaaccccacttacctgtggaaagtatgtatctgtaaatataccaatgttcacgcgcaatttgccttctttccaaaccagtctattggattaattatagtgggaatgcaaccaaagcgcaaataacagctaccttaatcccccactccaatcaacgttacctaattataaccaaacaaagctaaaaaataatcacacaaaagtctgagtttttcctcagtaatccgtctaacaataagaaaaaagcgtcagccccttcagtcaccggtccgcaacagctttcaatccacaaaaaaagcgccgattactcgacgcttctgtacgttaattaagcttgtgtaactgacttaactaatgcaatgacatcttcgttggtttccgcatcagttaatgctttatccgccaaagctttcatatcattagtgtccaattgccgcattaagctacgaatcttcaagattgaagttgcactcattgaatattcgtctaagcccatgcctaacaataatggtaccatgattgggtcgccagcagcttcaccacacatacctgcccatttaccttcagcatgcgctgcatcaatgatccgcttaaccaaacgtaaaattgatgggttataaggttggtataggtaggaaacatgttcgttaccccgatcagcagccattgaatattggatcaagtcgttagtaccaatactgaagaaatcagcatacttagctaacttatccgcaataacagcagctgctggaatttccatcatcataccgacttcgatcttgtcggcaactggtgtaccagctttaactagcttagcccgttcttcatcatagattgcacgcgcttgcttaaattcactaacggttgcgatcatagggaacataattgctaagttaccgtagttagatgcacgcaacaaagcacgcaactgtgtccggaaaatatcctgacgatcaagactgatccgaattgcacggtaacccaagaatgggttcatttcttctggtaatggtaaataaggtaaatgtttgtccccgccgatatccattgtccggacaacgacttggttaccattcatcccttcgagcgcttttttataagcttcgaattgttcatcttcagttggtaattctgctgaatccatatataagaattcagaacggaataaaccgaccgcttcagcaccattatcagttgcaccaacaacatcatcaggggtaccaatattagctgccgtaatgaaattcttaccgtctttagtgacagtccgttcattctttagcttttcccattcagctttttgggccgcaaagtccttagctgcttggtcatacttagcaatatcagcatctgatggatcaagtaaagcgtcaccggtattaccatcaacaataaccatctgatcttcattcacaacttcagtcgctttttccgtccctacgattgcaggaatttctaatgagcgtgccataattgctgaatgactggtccgaccgcctaagtcagtgataaaacctttaacgtatttacgatttaattgcgcagtatcacttggtgtcaaatcatgcgcaataataacaacttcttcatcgattaaagcaggattaggtaaagttacgcctaataaatgactcataacccgcttagttacatcgcggatatcagctgcccgttcttgcatatacgggttatcagtcattgcctcaaacatttcaacaaattgtgttgaaacgtcatgcaatacttgttcagcattggttttatcatttttaatgccggtttcaactgcaccaacaaattctggatcagccaaaatcatcatgtgtgcatcaaatacttgagcttcttcttcacctaagcttttgacggcaatatcacgaatcttttgtagttcttctgttgaagctgtcactgccgcctgtaaacgagcaacttcaccatcaaccgagtcgatcgactttttagaaaatgataaatcaggttgaacaagcaagtaggcttttgcgcgagcaatgccgtcactagcagcaatcccttttaacatttccgtcattagtctgataaaccttccttagtcattgtatctgcaattgcagcaatggcgtctgcttcgtcagcaccttcagctgaaattgtaacgtcagcatctttaccaacaccaagtgacataacacccatgatggacttcaagttaactgacttgcctttatattccaagttgatatctgagttaaatttgcttgctgattgtactaacaatgtagctggacgagcatgaatacctgtttcagcaataatatgaaaatcgcgtttttccatgattgatcattctcctttagcgtttaaaagttatgttagggttttccttttaatcgacaacaaaacaaggtcgccctttcaacatttaagactaccatttttcaaccggttcgacaaccttttttgcccattttccggcttgttaccgacgtttttgcttgcaaactggtatgaaaattgatatgtgactactgttcagtccctttttcaaaatgatagatgacatcgccaccacgctgtgcttcaccgacaatacttttccgttgtggaaattccaaccaagcacgccgaaatgcgtaaaaatcagcttgtctcacctcgatctgcttacgttcaccggttgctaattctttgatctgggttaaataatcggtcataatttttgcctcatttccttacctatactaaactgacattgtaagcgaaattttttagttgcgcaaattagcactcaaaaatttttctgctaaaaaagcgagccaaacacttgtatttcagaagtcggggggtataatactgtttgaaggtcaaagttggtcaaacgaattttgatcttttagaatgagctacgatacagaactcgtacgaaaggttgtgaagcgatctatgctgtgtcaaaattgtcgcaaaaacgaggcaacgattcacttgtacacaaatgtgaatggcgcccgtaagcaaatcgatctctgccagaattgttatcagcaattaaagcagcagcaaggcggccaagtgcgtaatgcaggccctagtgatccttttggctttagtaatttagatgacattttccgtgctatgggtcaaggtggcatggatgccaaccagcaaatgggtttcgaacaaggtccgcaaactcaagctggacgtaatggtggtagccgtggcaacaataaaaacggcggtggcttgttggctcaatttgggatcaatttgactaaccttgcccgccaaggtaaagtcgatcccgttatcggccgggacaaagaaatttctcgtgtgatcgagatccttaatcggcggacgaaaaataaccctgttctaattggcgaagctggggttggtaaaacagccgttgttgaaggcctagcccaaaaaatcgttgccggtcaggtaccacaaaaactacaaagtaaagaagtcattcgtttagatgttgtttctttggttcaaggcactggtatccgtggtcaatttgaacaacggatgcaacaattaatggatgaagtccgtaaaaatacgaatgtgatcctctttattgatgaaattcatgaaatcatgggtgccggtaacgctgaaggcggtatggatgctggtaatgttttgaaaccagctcttgcccgtggagatttccaattaatgggtgccacgacgctaaatgaatatcgtaaaattgaaaaagattccgcacttgaacggcggttccaaccagttcgggtcgatgaaccaaccgttgaagaaacgattcaaatcctgaaaggtttacagaagaaatatgaagactatcatcacgttaaatatagtgatgaagccatcgaagctgctgctaatctttctaatcgctacatccaggatcgttacttgccagataaggccattgacttactcgatgaagctggttcacgtaagaacttaacgatcgataccgttgatcctaaagtgatcaaggaaaaaatggatcaagcagaagaacaaaagcaacaagcattgaaacaagaagactatgaaaaagcggcttattaccgtgaccaagtcaacaagttagaaaaaatgcaaaaagacgacacgtccactgaagaaacacctgcagttagtgttaaagacatggaacagatcgttgaagaaaagacaaacatccctgttggtgaattacgcagtaaggaacaaaagcaactcaaaactctagcttctgatttggacagtcatgtaattggccagactgaagcggttgataaagttgctcgggcaattcggcgtaaccggatcggcttcaataaatctggccggccaattggctccttcctcttcgttggtccaactggtgtcgggaaaacagaattggctaagcaattagcagttgaactatttggttctgaggattcaatgattcgctttgatatgagtgaatatatggagaaattctcagtgtctaaattaatcggttcacctcctggctatgttggttacgaagaagctggtcaattaactgaacaggttcggcgtaacccatatagtttggtcctattagatgaaatcgaaaaagcccatcctgatgttatgcatatgttcctgcagattttggatgatggtcgcttgaccgatgcgcaaggacggactgttagcttcaaggatacgatcattattatgacgtctaatgccggtcagggcgacgctgaagcaaatgttggtttcagtgcctctgcttctggcaacacgcattcaattttggatcaattatctaattacttcaaacctgaattcttaaatcgattcgacgatattattgaattcaatgcgttgaagaaacaagatttgattcagatcgttgatttaatgttgaacgatgttaatcagatgaccgctgatcaaggtttgacgattcacgtcactcaaccagctaaagaaaaattagttgacttaggttataaccctgcaatgggggcacggccattacggcgtgtgatccaagaacaaatcgaagatcgaatcgctgattattatttggatcatgcagagaccaagtcgttatcggctaacgttaaggatgatcaaatcgtaattggtccctaccaaccaacagaaccaacaccaaaaacagaagataaaaaaactgacgactagcgccagttgattaagagagttgcgacataagtaatttatgtcgcaactctttttttatacttccaaacaatatagccaaaacgtgtgacataaggcaactttttccgcttgccatgtttcttgcggcaagttttttaccacaagaatggtcaacgtccgaaacatcaaggattttcagtatgaaaatcaactgctactgtgaagtagtagctgggcaccttatatcacactccttttttgtaaataaaactgatcgattatgcttttatcgtgaattttattttgttttgggtgaaattccactataatgtaagtgtcatcattatttaggttcatcagcgctaaatattaataaaggaagtgcgcgttaatgcaactacaagaggttactaccgattacgaaaacttagttactagtcaattaaataataccgatgccactagtgtacaaattttttctttgaccgatacattagttatcttttcaaaagcccctacccacgacgagattctattaacgaatcgacagcgtaacattactcctgcagagattgattttgttcttgaacaactcgcacaaaggacacgagcggggcttaacgtgatcacttccgaaaaattagccgaaatttcattaaatcactagtattttgaaatctattgctaagttagtttataccactaactcagcctgaacgtattaaaaaagccaagcaaaaagaaagataggagggttaaatcaagtgaactttttaaaacgactcaaagctttctttaaccctcagcagcaagttgcaactgcacagctaccgatgggaccagattatcaaccaattgcgcggcggcggccaattctactaccctcaccaactcgccaagcctatctgccaatttcaagtcatcatcaacctagtattcatgttcagcccgattcttttgtgatcgttttttactttacagaaaccggtgaacgcttagctaaaccacagattattagtggcgtgcgcggccaagctttcaaattcacggtccatcaatttgatgactattatattagccgaatcgaaaattatcatggttattttgtttatccacgggccattatccagttaatttacgctcaacaaccagcggcgccagttatcgtttttcactttgacgaaaatcatcacttactgacaccaccagaatatttagttgggcagctggggcaacattatgaaacccattttctcgattcgcaactttatcgcgttcaacatgtgactaccaatcaggtaggccatttcagcgaacaaacacaaatcgtgacttattcttatcgaccacgagtcattcggtgggctaatcgttacttaactggctttgtgcgtctaacgatgccagttaccagttatcgtgaacctggtaagacagcattagcacaacagctaccaactaataccatttggcgcgtttaccaaaaagttcaaaccaccgatcggcaaacttggtatgacttaggcggacaatggatcgcaactgaccatacggaacgtgttgaatactatcagcagccaaagcagcaagtaattgcggccccactatttcaacaagcagcggttattccgggttcacggcgcgcggtcgtcgatttcattccacagcgctccttacgtacttggacacagccttatggcgatgcggcgaattacttgcaacatgggcaaatcgtcaacatcattcatggtttgatcctatcgaacaacagtgtgtggtatgaactggaggatcatacttggcttgaagaacattatctacgtttactatcagccggtcatgacttcacatcgccaattaaacgactgcaataaaaaatcgtaacctttataggtgcactaggccctgtcaagttgacagatgaaataataaaaaattgaatctgtttctaagcggcttcattctagtattcatctggagtgaggccgtttctttgtgccgaacggttgtggtgattaaagtattcaataccttcttcaaccagcttctcgagttcttgaagggtcttaggcatcggatgacgctccatcca

SEQ ID NO: 537 - DNA, 50687 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttatgggtttttctgtccactaatatattcaacttaaattttacaatctaccttactcaaaaatattacttaatttttattacactttgagtatagcacttagcctaaaaaaatatagtgtgactaaaaaatattttattgacaaatctttttagatttctaagattattgctataatagaatttataagtacgaaatcaccaataaattttattggtgactctacattcataaaaaaagaaggtattcacaatgttaacagacgaaaagcttaattttctaagtcaagttggtaaagctctagccggacaatttggcgaaaattgtgaaatcgtgatccatcgtattgatcctaatgatatgaatcatacgatcgtttcgattgaaaatggccaagtctcttcgcgtcaattaggcgatggtccttcacaaattgttttagaaacattaaaaaaagatccagcagaattgcatgatcatatcaactatattactcacacccatgacggtcgtgtacttaagtccagtacactctatttaaaaaacgaaaagggtgaactggaagccatctttgccatcaattatgatgtttctaatctgatcatggcagaaaacgtgttacattcattcacagctgttgaaacaaaagaagaccctaacgaaccaaacttcattccccaaaacgtcaatgaattattggacgatttgatccaagagtcagtaaaattagtgggtaagccagtttcattgatgactaaggaagacaaagtcaaaagtatccaattcctgaacagtaaaggcgcttttctcgttactaagtcaggtgacaaggtttcacaatacttcaacatctcaaaatataccttgtatagctatattgatgcgaaaaaatagcaatcaatcccctgattctgagcctaacccaaaataataaatagtgaatttattattttgggctacgcttaacagtcagtctttttgattgcaaaaaaataaaccaatttgtaaaccttcaggaagctctctatcctgaaggtttttcattactactaggttgacttactttaagtatccgtctattctaaaattaaaattattttgaacaaaaattttttagcataagaaagcaggcctccagtatggatccagttacacttctaaccagtcaattagtcaaaataaatagttctgatcctggcgcttatgaaggtaccattggtgactttgtcactaaatggttgcgcgttaatgcgccaacagcaacgattgaacaagacgccgttttaccccaacgctataatattcgagcagttctaccaggaaaaatcgcgcacccggcactagtctacatttgtcacctggatacagttgtactgggcagtgattggcaaaaaagtacaccactggcaggtaaaataaacgctgaacgcttatacggtcgtggtgcgtgtgatatgaaaagcggtctagcctgtgcgctgagtgcttttgctgcaatcgccaaacaagtggctgctggtaaacaattaatgcgtaatttagttttgattgctacagttgatgaagaagactatatgcgcggcgtcgaacaggcaattgccactaattgggtcactgccacagactgggttttagacggtgaaccgactaacggccaaattcgcatggctcacaaaggtcgtacttggcttaaattggccacgcagggaatcaccgcacacgctagtacccccgagaaaggaattgatgccgtggcagcactggcggcaaccatcactaaggcccgtgacgcgattgcggcgttaccaacgcacactaagcttggtcggtcgacgatcacatttggactgatcaaaggtggctatcgaccttatgttgttccagatcatgcacaagtctggatcgacctacgtttagtcccaccgctaaatacgcaacaagtactgactatttttgaacaaatcgttgcaaccactaaacaacaatatccaggtttaaacgttgagttaacaattgatggtgatcgaccaccaattgaagaaaatctagccagtccgcttttgttgaatctgaaaaaagcgatcactgctgtcacaaatacaacagctcaagttggtgtgttcaccggttataccgatacggccgtgatcgccgggcaattaaataaccacaattgtctgtcatacggtcccggtaatttagagttggcccacaaacccgatgaatacgttgaccttgccgatattgctcgttgttatcaggttttattaaaactggctgaacaaaatttaaccgcttaaaaaggcaccaccaactgaacaatttaagttggtggtgccctagtttaatttgaagcggctaaccgtttttcaaagacggctaacgcgcgtgaaataccgaatgttaatacaaagtaaatcaatgaagcaataatcaatggataaaatggcttaaaactagccccctgaacaactccagtttcaaacatcaattcactgaccccgattactgaaaccactgaggaatcctttaagatcgtgataaactcattacctaaggctggtaaaatatttttaattgcctgcggtaacaccacataacgcatactagcagtttgcgtcagtcctaatgaacgtgctgcttccatctgtcccggtttaactgagttgatccctgaacggataatttcagcgacataggccgctgaattcaatgaaactgcgatcatactggaaatcaatgccgacaaccccaatcctaacatttgcgccccgaagaaagcaatgaagacttggatcagtaaaggtgtcccacggataaattcaatatagacgatcgcaattgccttaaggagccagttacgcgaccgtttcatgaaagctaataaagtccccaatacaaccccaaagaaaacgccaataacggctaactcgatcgtatacaatgtgcctttgacaaagtaactaccgtactgactgaaaaagctatttttctggaacattaatttattggctttagcttgataacctttcagcagaccttgcttattgatctgagtgatcgaccgattaactgctgcagttagtgctggtgcatctttaggtaatgcaacggctgtttctttagttgcttgcgcaaacgttgttttggttaaaacaaagtctttattttgagcaatataagcatcagccactggcttttcgattacgattgccttgattttattattctgtaaattcaacaccaaatcagtcattttctgtaatgaagtaactttagcgccaaataattctttctgagctagttcttcttgaaatgattgtttttgtaccccaactttgacaccttcataatcactggatgatttaagcttagcggcgtcttcctttttcgccataacgacttgcttaacatcaaggtatgatttagaaaatgtaacttctttttcccgctctggtgtttttgacatcccagaaatgatcatatcgattttaccagtttttaaagcgccaagtaacgcatcgaagcccatctcattaattttcaatttaacaccgagatccttcgcaattttctcagcaatactaatatcgaaaccaacgattttatcttgacctttgatcgtttgatgaaattcatacggtggataatccgctgaaagaccaaccgtaatgtacccttttttcttgattgcatttaaatgtttatcagttaatgtggtattttgtgttgtggctgcattagctgtacttgctattggcaatacaaccgacaggacaacaaacaataccatcaacagccgccccagtttacttttcatgcgtaaagtcctccgtaatttcttcatctttttttaatgattagccatattatacgcatttaaaaatatttatgcaagtattttcataatataagctttattaattctttttattcattaaaaatgtatatttggcattttctgaagacactggtaaaataagtgcagcgataactgggacaaaatcatttttagatgtgcgtgattacgttcattaaaaaataactgctcagtggccgtagaggggagtgatcatggtggtcaaaaaaattaatattgttagtctggttatttcacttgctttcgccttaatgctcgccttcttatccaacaaaggaacaccactattgaatctttccaataatttatttttgattggtttgttcattttgattattgccatcattctttatttatatgatgctcatttatttcgtcatctgttctttcgccatcaccaaacggacgatgataatgaatctgtcgcaactgatcagccagtgttctatactgaattacggcgtagttttctatggatcggcttaggcgagatcgttgctagtattgtgatctcatttttataaatgtacacaaaaaagagttgtgacataagacatttatgtcacaactctttctttgtacttccgaacaacatagctaaaacgcgtaaccataaggtagcttttgcaaatagctcaaccttattagcggcgtagtagctgagcaccttatgttacactctttatttattctcgattaatttttaaattacgtctgtgccgagcatgcgaataaaatcctaaggtattcatcaataacaatatcgatcccgccattacgattgcactaagtacaaagatcatcggagactgaaacgctaagatcccgtaaaggctagctaaaagtataaacagctgtaaaatcgatattgtgatgcgtatgtggggcggtctgggttggtcagatttcatcgtccttcattccttttcgtttaggatttatttattatacctgcattgtagcacatttttagtttgctgcaaattctggtgccgctagtatggccaaagcggcatttaataattgcggttgcggcgcaggtacttgaacggtcaacccgttttgacgtactactttagcggttgtttcacctagtgcaacaaatttaggaatcgtcgtttgctgataaatttgccaaaaacggttaaagttggatggactagtaactagcgctcgactgatcggtagttgcgctaatttagcttgtgcacaagcaacatcagctgcagtccattgatttcgatacaacggtattaatgtccagccttcttgcacggtcaatttagttaaatttcccactaaagcaacaacctgctcttgtggttgacgtagcaactttaaatagtcaattaaagcttgctgatgcggttctggtgcaactaaaattctttgcccacaaccagccactaactgcgctattttatcactaagcacaactagcgtggtggtttgcactaattctgcataatgcgccaccaaactttttgccgcaaaggcacttgtcaacacaacgtaatcggctcgctgtaattcgtgttgctgtgctggacttaatgggcaaaaagtcagtttacgcaacggataataaatcaccggtgcaatcgttgctaagcgctgctgccacttctccgctattttagcctgtggataagtgatcaaaatcgccatcataattacctcatttctacaaattccgcgctaatagtttgacctgtcccgcttgccaatcaagcacggtatattttccggcattaaaacgaatatcccaaaaaactcggtcactggcaaataaatactgatctaatacgcgtaaggtgcctaaatgtgcgatcaaaaccaaattagttgttgttgtattggtaattatttgctgccaaccggtaagtacgcgctgacgaaaagctgcaaatgactcagctgccggcggtgtataactcaatggggctgctaaccacgcctgccaggcctggggataagcagcctgaatctcatcagcatctaatccctcccacgccccaaatcctttctcattaaatgctgcttgctgatgcagtggctgctgatatctagcagccagtggttctaacgtctgccgagcgcgacgttgaccgctgcaccaaaacgttgtggtgccagttaacacgatgtggtccgctaattgctgtgcctgagcaatccccttagccgttaaagcaacgtctaacgaaccataaaacttccgttgctgattcaatggcgtttcaccgtgacgtgctaaataaatcttcatcctaaccaccgactaaagatcaaataagctagtaaaaaagtaacttgagctaattcagcaaaagcgccaatcgtgtcgccggaaaagccaccgagaatatggatgatccgccgccgataaccataggctactactaaaatcgctaaatagcttaaaataccactaagccctagtgctagtgccataacgatcaatgagaataattgagcgacaacgatttgccacgtttttactttgacccagatactggctaagccatggggtgcacctgcataaaccattttatagaacaataatgataagccggttttagccaacatcgttgtaatggcagcaataaatgctaattgcaatggtgttacctgctgactaagggccacgccgccaccgatcattattccataataatagagcaacgctagagtgcccatggtaccgatccggctatccttcatgatctcatgcattttatcgggtgttcgtgaagaaaacaaaccatcggcactgtccgctaaggcatccaaatgaaatccgccagtcagcagaccatcactgactaaaaataatccccacgccaaccaaactggcaatattaattgcaataaccaaaaaatcaccgcttctaaaatacccaacaataaaccaaaaacagttaagtattgaatattacgccggaacttttcttctacgtcatcgatcatcactggaacattgatccgggtaaaaaactgaataaataaaattaacgcttgtcccaaactgctacccccgatcatttaatttgttgtggcaaaccactgatcacgaaataaacctgatcagccgcttgagctaaatattgattgacatcgccataaatatcacgcaataatcgtgcttgccgcgtggcgggtacgacgcctaaaccaacttcattcgtcaccgccaataaacgctgtttcgtggtacgaacggcgttcacaatgtcatgccactgggttaaaatctgctgttcgatttctttgatctgcgggttagtcatttgctcaatataatcatcataagctgccggttgaacttgaccttgttgggcaaccaaatgataaaacagattagtcgtcagcatggtcacgtcatccagcaaataaccagcaaaatgatgttgctgaataaagggcgccacgttcaaataacgttcttccgtttgccaattagctgagcggcgggcttggtggcgttcgatccgcaaagccatttcttgatcaggtgccaacatcaccccggtggcaatatagcagattgcttcggccgctgtaaactgctgctccgcaaacgctgacttgccgctacgggcaccgccagtgatcaattcaagttgtgccatcatttcgcctccaattctgcgatcaagcgcacggtaggaaatgcgcattgtagttctgcttgtgctgccgggacgattgcaatcaataagactgtcgccggtccagctgactgactaaattctgcatcatcagtcaccacccatttaggcgttaatttttgcgtggtcgctagttgacccatttcatcacgaattccttttgaacccaccggtaataaatcgacaacgccaacaatttgctgcaaccgtcgcacttcttggtaagcaaaaatcgtatctaggtgcgccacgacctgttcaccaacatatggtgtacccagctgataaactagcagcgacgagtactgtttacgttgttttagcgcacttttaccgatcacggttacaccgactgaggttgtgatcgtcgtcatgttatcctcggtactgccatttaatggcaacgtcgctaaatcagctttagctaattcttgccgcaacccggtgatcaccttttcaccagtaggctgcatttcatttccaacggtatcgatcaccattaatggctgtgcaccaaagcacaacagctctaataatgggacgcgtaaacaataagcagacataacttcggtgggaaccgaaaccatgtctgcttgtttagcgccaattcctgcactactgtcacaggcaattaccaattgttcagttgtcgataatggcagtaatgttaaatcacgaaattgactcatcgccactcacccctgactaacggcagcaaaggcacgttcaaatgctgcaatcgtttgatcgatttcagcatcagtgtgtttagtggaaatgaaattcgtttcaaattgtgatggcgcagtataaataccttcttgcaataatgccttatagaacttggcaaagtatgcctgatcacttttttgaacgtccgcaaaattttcaacttcatgttcattaaagaagtaactccacatcgtgccaacatgatgcgtgactattggcacttgatattgctttgcggcagccgcaattccagccatcaagcgcgtcactttttgatccatcgccgtatataaggcttcatttaattgcttgattgtgctaataccacccgtcatcgctaatggattaccagataaagtcccagcatgatagattggaccatcaggcgtgatctcatgcatgatctcccgccgaccaccaaagacgccaaccggtaagccaccgccaaccactttacctaaagtcgtcagatctggtgtgatcccatataaagcttgggcgccatggaaggctgcacggaaaccagtcataacttcatcaaagatcaataaagcgccatgatcactagtgacttggcgtagcgtctgcaaaaatgacttcttagctggaataacacccatattaccggcaacgggttcaacgatcacacaggcaatttcatcaccatgcgccgcaaagacttttttgatcgccgcttcatcattataagccacagttaaagtatcatacgctaaagcttcaggtacaccaggagacttggtaatattaaacgttgccaaaccagaaccagcatcgaccaataatgaatcactatgaccatgatagttcccaatgaatttaacgatcttatcacgtttcgtgtagccacgagccaaacgaatcgcactcatcgtggcttccgtccctgaagaaaccatccgcatcatttcaatcgacggcaccactttttggatcattttcgccaattggctttccaacaaagttggtgcaccataactggttcctttagtcacagctgcctgtagatcagccaccacttgatcatcagcgtgcccaagaatcaatggcccccatgacatgacgtaatcgatataatcattaccatcaatatcatagatatgtgatcctttaccatgatcgataaataatggatcaccaccgacatttttaaaagcacgaactgggctattgaccccgccaggcattaattgactagattcagcaaaagcctgttttgattttgtaaaatcacgcatactatcctaattccccctacttcacaatcgtggttaatttaatattaaagttttccgttatttgaccagccgggccgcaacatccttggcaaaataagtgatgatcaagtcggcaccagcacgcttcatcccagttaaaatttcatccacgattttggcttcatcgatccacccattagcggcggcagctttaaccattgaatattcaccagaaacattgtaggccactaatggcaacaatgtttgttcacgaacgtcacgcataatgtccccaaaagccattgacggtttgaccatcaccatatcggcgccttctttttcatcactagcaacttcgcgcaatgcatctaagcggttagctgggtccatttggtaagttttacggtcaccaaaagctggtgcactattggccgcatcgcggaatgggccatagaagctagaagcgtatttaacggcgtaggacatgatcggtgtattaacgtaacccgcttcatccaagccctgacggattgccgcaacaaagccgtccattgcattagatggcgcaataatatcagcccccgccttagtctggctgaccgcagttttagccaacaacttcaatgattcatcatttaagacgtagccattttcatccacgacaccacaatgaccagtagacgtatactcacacaaacaagtatccgcaataacgatcaaatcaggataagcggctttgatcttgcgtgttgcttgttgcacgataccatcgtctgaccaagcaccagtaccaacatcatccttatggctaggtaggccaaataagataattgctttaatacctaaatcagtgatagccttgatctcagtcaaaatcgtatctaagccaaattgataaacccctggcatcgagctgatttcttttttgccattaaaatcctcaacgacaaaaaccggcatgatcaaatcatcgcgagtcacccgattttcccgaacgaggtcccgtaatgctggagttgtgcgtaaacgacgatgacgatcaaattgaatcataaatatctaacttctttccttaaattaattttgtaacctgcgttgaaaaaacgcctgaattatgacgtatacctagttaagcaagcacaatattttccgctaaattaacaataaacaacacttactaatccactgctaatgctgccaatgcaccttgagcgatcaatgtatcagccgccgttttacctaatttagcggttaagggaccgcgattctcaattggataccatgcggtcccatcttgcgctgcgactaaacctttaaactcatacccaagtgcattttgcgtggcgtaagctccaattggaaaattacaacttccgcctagtgcctttaaaaaggcgcgctcaatttggacacagctagcagtttgggcatcatgaattgctgctaatagtcccaaagtatcggtatccgcttgccggcattcgattgccaatgcaccttgaccagtggctggcaaaattacgtcttgtaaggagtaacgataataaggcgcaatatcaacggccaaacgatctaaaccagcctcagccaaaacaatgccggccaagttttcactagcaattttagctaagcgagtatcgacattaccgcgaattggtacgatcactaaatccggccgtgcgtgcaataactgcccttcacgacgtaaactattggtgccgatacgcgcattttggggtaaatcagctaacgatttgatgggtgccaccgtgatcaggcaatcaaatgctgaagctcgttttggcactgcgccaatcgttaaaccctgcggtaaaaccggtggtacatctttcaaactatgcactgcaaaatcaatttttgcggataatagttcgtgttcaatttctttaacaaaaacacctttaccaccgattttttgtagactgtcatgtaagttacggtcgccttcagttacaatcggctggagcttaaattccagttgcggaaatcgtgtttgtaattgtttttgcactaattgggattggcataaagctagtttacttttacgtgtgccaataataaacgttgttttcatttagcaacctccttcttagcagtcgcttcatcttcatctaaaccgaaaatctgtttaaagaaatcaatgtcgacctctgcatcggttgtgaccgataactctttgattgttttgataggttgcttgatcaactgattcacaatgctcttcatatgcttacggatcacttttagctcatgttcgtctaactcaggtaacttacgctgcagactagtcaaggcggtaccctgcaccgctaaagctgattcacgtaattccttgatcaccggaactatatgtaattggcgttgccaggtatagtaatcctgtaccgcaacgggaatttccgcggcaatctttttgactaactgctggcgtaattcattattggattgaacgatctctgtcagttgatcaatattgtaataatgcaattgatccgctaattgtggggttaaacgaatattgcgcggaactcccagatcaatcaataccaaatttggccgccgttttgtcaacgtttgttcagtaatcaccggttcacgtgccgccaccgcagtgatcaccgcatcagaatcggctaaaacctcagttaagttagtcaacggcgcagcgctgacttgctgaccaaaattagccgctaaatgttgcgctttacttaaagttcggttgactaaaacaatatgactaaagcccatattgtaggcatcatccaacgcttggcgaccaatttcacctaagccaacaattgccaattgtttaccctgtaaagcttgtagatgggatttaatctgatgtaagccggcctgactcgatgaaattgaatgttcactgatcttatattctgtatgcatccgtttggcaaaagtaatcacttcttggaataaatgattgaaaattgcgccagtcgttgcattggcttgagccgcaaagaaagcccgtttaacttgacctaagatttgtggttcaccaacgatcaatgattccaaaccactagcaacccggaataaatgggtcactgcagcgtcctgttcttcaatcataacataggtattgatcgtcgctaagtcgacattaaaccagttggccaagaaacgcttcaaataataacggcccgtgtggatctgatcaacgaccgcataaatttcggtacgattacaggttgataaaatgacattttccaggatacttttttcctgatttaatttttgatcggcttgcgccagttgctctgccgcaaatgaaaattgctcacgaagtgccagcggcaaacgatgatagtccagattgacataaataataaacattatttggtttcattccttcctttttgccacggcttggcctgcagccaaatcgttaaaagttgccggatttttttagctagcttaggggaactgccatgagtcgagaccgctagcgcaacatcatcttgtgacaccatcgccatattataaaaatcagaagcatatttattgctggtattattgaccaattgacctggcccggcgtcttgacgcacttgcgcattcacggccaaatcatcggtacaggcaatgattaaatcagcttgcgctaaatcacctgtttgatacgcgcgtgccacccaattaagttgttgacggtcgattgttggcgccaacgtcggactgatcactgtgatcaccgcgccagttgcttgcagcattttgattttacgtgcagccacacgaccgccacccacaacgattacctgtttatcctgtaagttcaacataactggatacatgaaattccccacttcttaaaaagttcgccaccaaagattacagcagcgcttcacgacaacataactgaaaatattttaatgtgcgctatcagctaaaatctgataaattgcggccatatcaagatgttggcgcagagttgctgctaacttgtcatactgttgttccttataagtattcagtgaaactcctggcgtataaatcggctccaaacctttatgctcacgcaattgattcaataaatgacgcgtccacaattgattatcgaaaataccatgtaggtacgtcccaaaaacagtgccatcatcattgatagcaccatcatcccgagctgttttaaccccattgttagcaacaatcttggtgtatggccgtgctgttgggcctaatttagtcgtgcccatatgaatttcataaccagttagtttaaagtcatcatgccaggcttccgcttgggtggtcgtcttagttggattaaaataagtttcggtatcgatcagacctaatccagcctgatgtttgatcgctgattcaacttgttgttcatcatgcaactgccgaccaatgatttgataacccccacaaataccacagaccatgctgccacgttgatgtgcgcgcttaattgctgccgccaacccagtttgatttaaataagccatatcctcattcgtatttttactccctggaatgatcaataaatcaggttgaccaagttcctctggcttgagtacatagcgtactgaaacatcaggctgcaattctaaactatgaaaatcggtaaagttagagattttagttaagctgatcactgccacatctaaagctttgctggtatccatttttcgcgatttgccagttaaagctacactatcttcttcgtcaagatcaacatcgctcattgggatcacgcccaacaccggtacccccgtcagatcctcaatcattttattacctggcgttaacaaagtttcatcgccgcgaaatttgttgatcacgattcctttgacccgtttttgatcagctggtggcattaacttaattgtaccgtaaattgcggcaaatacaccgcctttatcaatatcagccactaaaataacgggagcatcggccatacgtgccatgcccatgttgactaaatcgttttcattgagattaatttccgctgggctaccggcaccttccagaacaaccacatcattttccgccgccaactcttgataaacttgtttaactttatcctttaattgcggtttgaatgcttgataatcagccgcatccatatcggtgaggactttacccaagaataccacttgtgaggccttatcggtggagggcttcaataaaattgggttcatccgcacatcaggagcgacccccgcagcttcggcttgaaatacttgcgcgcgacccatttcattgccttccttagtaataaaagagttcagcgccatattttgcgacttaaacggcgcgacccgtaagccatcatcacgtaaaattcggcagagaccggcagctaaccaacttttacctgagtcagaagccgttccctgaaacataattgcttgcgtcattttattttcctccctcatggctagcatatttagactaaattacatgtaagcgttacgctccccactagtccagcaaatgcaattgctttagtttttcctgcaaattctgatcagcaaataagtctgccggtgtgtcgtataacggcaaatgtagatcttcatgcaggcgaaccaaccaaggttgctctaacttagcctgttcaataattgcacgttccttgaacactgtttgcttatcaccacttttgacgatgcgaccatcctgtaaaatataaaagtattggccgacttcgtacataaagtccatatcatgactggacaaaattattttttgtccgttagcgatcaactgctgaatcaatctaaccatccggcgccgaccatcaggatcgagccccgccgttggttcgtccagcaatagccactctgaatctaaaactaagataccggcaatggcgacccgctttttctgaccgccacttaaatattggatcggccgttggcgtaagtcactaatatccagcttagctaaggcgcgatccacccgtgcatcgatctcagcctgtggtagcccaagattatgtaaggcaaaggccacatcgtcctctaccaatgaataaaaaatttgttgctccgaattttgaaaaacaatgccgatccgtttgcgcaaagccaataaagactttttatcatagcgtaatggttgtccgtctagcaaaatttgcccgctatctggtcgctgaatgccaaccaagtttaaaaacaaagtcgactttcctgacccatttggtccaatgatgccgataacctgcgcctgatctaattttaagttgatgtcatgcagcacttctttgccaggttcataactaaaattcacatgttgtagttcaagcattattgccgctccgttcttttgtcataattggaaattcgccatgataaagtttgactgccagcgcattatccatttcccgataattatagatgatctgttcgaatagcaacttgatcaacaaactaagcgaatgaatgctggtatgaaaattacggtagccaaaccgcaattgctgtgcatgatagatctgttcccacgccgcaataaaaataaatataaagcggtacatcaacatggtttcttcgatcaataagcgcggtagatgtagcttaactaacaaataaacaatttgttgaaacggcgttgttaaggccaaaaaatacgtacacgtgatcgcacttagtgcccgcaaaccgatcgttaatccttgtggcagcatcgtctttgagatgccaaaatattggccaaaaactggaatcgaccaatacaaggtccgttgtgtcggcccaacagtcaaaataattcccaaaatacttaacagcaggaacggcaatatgccataataccaacgcaaatattgatgtaaaccgactccggtcacgtataatgtggcaccaatgacgccgaccaataataaaacctttaaccaaatgatcggctggaacgctaaaaccattcctagtaaccacaaccagccttttaaaaccggtgaccagtgaacgattttattttggtaagcatatttatcgatcactaacataatgcgttcctcctatctcactgaaaaacgatcgttcagtattttgctgaattttatcgccgacacgctattcttggtgtttttgcgcctgcatttcctgccgtgccttacgcttgccatgagcattgccgatgatgtacgcgatgatccctgtaccgatactgccttgtacggtaaacaagaagctttccacttcagcagaaggcggcgtccataacggatggatccatactttatagctgggatcatttttacgaatctgcgcggtaccttggtcatcactaccagtaaagctaccacctttggcaacgaaaaacggaatcacgcacaagacaatgactaaagcgactaaaattaagttctgcactgtttttcgtttcatcgtaaggctgactcctcccataaatgattactgatcactaagttataaaccagcactgtcagtattccttcggcaatcgccaacggaatttgcgtgaccgcataaatactcaaaaacttgatcgcagcgccgagcaccccattattcgggtccggatacaccactgctaactgaatagaagtcgtgacgtaagtgatccaatcagcgaaaaccgcacagagaaaaattgaaattgcccgattcatccgcaatgcgcgacaaagccgccaaaccgcataaccgacaaacggaccgacgatcaccatcgaaaccatgttggcccctaacgttgttaaaccgccatgagctaaaagcaaggcctgaaataacaacacgatcgcgcctagcacactgagcactccgggaccaaacaacacggttcctaaacctaccccagttggatgcgatgacgacccagtaactgaaggaatctttaatgatgataaaacgaaaacgaatgcaccgcatagcgccaacataattttcgcattttgattagaatcacgtacgatctgccgcatccggtatagaccataaatgaagaacggcgtggcgatggcaaaccagaaaatacaccagcctggcggcagcatgccttccataatatgcatggcgtgaacggtgatcggataattcagactgaccagcaacaccgccaccccgactatgatcaataaacgtttaaacttttttgctgataacatactgtacctcccactcataaaatatttttagccaactcattcaaccaaacgttgatgttttttaaccaacatcgtggcaaaataaggcaacttactgtcggccgttaactgttgaactggcgtgatctcctggccggccattgacgcattggcaaccacgatcgcttgatctaataacccagcagccgctaaaagttgatacaccatttgccaatgtgtggcgactttcataatcactaaattatcgtttaaagctaaggcactttttaacgttgcttcatcggttgttgccggtaccaccgttaataattcatcatctaatactaacgggatcgataaactagcggcaatttgtgagaaggacgagatcccggcgatcgtttccaccgcgatttgatcctggacccgcgctaaaatataactataagtactataaacggacggatcacctaaggtcagaaaaccaacgtcgcgcccagcttggacgtcactaacgatctcactagcgatcgcggtccagcttttttccttggtcgccaaatctttaaccattggaaaatgacgctgcttgatttctagatcagctggcaaatacggctgggcaattttttcggccacactgaccccaccgtgatgcgccttaggtgtatataaaacgtctaactgttgaatcagcttagttgccttgacggtcaatagatcaggatcgccaggaccaacgccaataccataaaatttcgccatttgtttacttcccttcattactcttgtcgagcgcctgttgtaaatgttgcgtgaaccgctgttggaccgccggaagctcacctaaaccaactaagtgactttcagtcttaaagccgtgcgcctctagttgtgaccgccacgaagccggctcagtcgatgacatatcattagtcgcatggttgcccgcaactaacattaacggccatagatgaacttttttaatgccatcttgctgcattcgcttaagctccagggttaaatcaggataactttccactgcccccacataatggcgcgtgcccattaacatgtgatccaagcacgcataagccgtgaattggttatccgcggtaccgtggcccataaataagaccccttcatcggccgccaaattaggcgtcaacttaggcagctgggccactaaccattgataatcgctgtagtcgcttaacaacggctggcccacgatcaattccgcaaactgatcacgataacccgctagttgacttaataaccgctgatattcgatgccgggaataatatgcaatgattgaacgagcacgcgggtgaagccggcctgctgaatcttgtgcaaagcctggctaggcgtatcgattttaatttgttctttttcgcggatgcgtttgatcacaacgttagaagtaaacgcccggaaaacggtggcatcaggataagcctgctgaatcgccgcttcggtcgccgcaattgttttctgccgcgttcccggaaaagtcgttccaaaactgaccactaaaatcgctgttttggtcatacttgacaccatctttcaattttctctaaaactttagcgtagctaggttggctgccatagacccgttgtacgccttgggcaatcaacgctgccgccacttggtcacccatcgcaaaactaggcaattgctgtaactgctgccgctgactaggcgccacactgttaaataagtcagccactgcctgcgtgctaggaaaaatcgctgcttgatactgccgtggccgcaattgatcttgggtaggcaagcgatgttgataagttgccaaccacgttgccccctgagttgattgggctggtgcagcaccgatgatcaataaagcgggcgcggataaatcaagctgcgctaatggtgtacaagcatcagctagcaacccgtatttttgtaaccctttagcaacgcgctgactagttgccaccaagtacaaatgtgccaatacccgcagatcttgttgtgcggctagcaattgctgctgcaactgtgcaaacgcaactgtatccgttaccactagcgtttgataagccgtaaagtcaggtaattttagtggcaatgattgtggagtgctccgttcaaagcgaccaacaaaagcgccgcgatcagttaataattccgctaagcgtgatggttgtgcggcaggaatcaaaatatgtttgccggtcaacggtgtcgccggcgcctgtaaaacgcggcgtaatttaaccacatcgccaacgacgatcaaactgggcgcgccaattttttgctggcgcacggtgctgacgattttagctaacggtgccgtgaccacgcgttgattccagtgcgtcgcccattgaataatcgctactggtgtcgttgctgctttgccgtgttggcgtaattcagccacaatttgtggtaactgactcatccccatcagaaaaactaaagtgccttcttgttgcgcaatgttcgcccaatttaaaccaccatttactttctggcgatggccggtaataatgtgaaagctggaggcatagtcacggtgggtaatcggaataccagcagcagctaaaccagcgattgcgctggtgattcccggtacgacctcaaaatcaataccagccgccgccaaccgttcgccttcttcgccaccacgaccaaagacatacggatcacctgcttttaagcggactacccgtttgttttgccgcgcatgatcgatcaataattgctcgattcgaccctgtttgaccttatgaaaacgcggcaacttacccacatcgatcaattcagcttgcggtgctaaatgcagtaattcgggatcgactaagcgatcataaaaaaccacatcggcttcgctcaatcgccgtgcgcctaagcgcgttaaatattctggtgcgccggaaccagcaccaactaatgaaactaaaccactcatgctgccactcccttttaaagttgtgctaacgttgttgctagttcaggaatcgttttgaccactgctggatagtcaacagcaggtcgtttgataatgatgcagggaatatttagtgctgcacaggcggcgactttttcttgaataccgccttggcgaccactttccttagtcactaccgcgcacgcgttgacacgcttaaataattcaacgttcaacaccgtagtgaacggtccgcgaataccatcgacctgttctgctcgtaagcctaacgcggtcaacttttcaaacacccgggtaaccggcaagacgcgaacgtgaatacgttcgagccctaaggcagcaatgtaatcaccaacggttttgctaccagtcgaaagataaacggttccgtcaagctgctttaaaatcgcacaggcttgttcaagatcatccacaaagcgtagatcttgccccgcctcagcaacttgttcgcgttcaaaacgcacatacggaataccaaccattttagttgccgcaatcgtattttcagaagcaaccttggcaaagggatgcgtggcatcgatcaccaacgtaatttttttctgtcgcaaaaattgcggtaactgttccgcatctaaagcctgttcggaaaccaccgccgcatgctcatgcgccaactcagcgccgtactgactgaccactgacaaaataaatggtcgttgttgctgggtgagaaaatcggcaatggtcagactttccgtcgtaccacccatcaataaaatcatagtgtataccctcttggtgtgatcatatggccatcagcgacgtaggtattcttgttaccaataataacgatcgtcgtcatatcaacgtcttcttcgtccaagtctttgatcgtggttattttttcaatttcttttggccgcgccacatctttgccaatgccaaccacggtttctggtgatttatatttcaaaataatgtctaaggcttcacgtaagttattaggccgccctttactacgaggattgtacaagcaaatgacaaaatcagcgctggccgcagcgtcaactcgtttcgtgatcacttcccacggtgtcatcaagtcgcttaggctgatgtggcagaaatcgttcattaacggtgcgcctaaagcagcagcggccccaatactagccgttacccctgggacaactttgatatcgatcttcgctttagccttggccgctaattctaaggccaagccggccatgccgtaaatcccagcatcgccactagaaacgatggcaacatctttaccggtttgagcgatctcaatggccttttgacagcgcgccacttcaccacgcatcccggtcgacacgatctccttatccttgatcaaatcacgaatgatgcggatataggtagaatagccgacaataatatccgtttttgcgatcacatctagggcttcctgggtcatcaggtcacgtgaacctggtccaattccgacaatatataacatgtaatttcctcatttctgtaattgttttaaacgcgctaacgtaaaggtcatttcctggctagcaaagcgtggcgtaagcgctagttgaccactagccacttcagcactagccgcagccacattgccaacaccgaccgtttttttaacaaacgccgattgcgggtaatgctcggcggcggtagccaattcagcggcagaataaaaagtgagctcacagttaaaggtcgccgccaaataatgcagcgccggttcatgcgcttttttatcaatactggcaatttgggctaccgactgccacgccaactgttcttgttggcaaaattctaaccaggcctgctgcgcttgcgcaatggtcacatttttgcggcaaccaatgcccagcacgttgcagcggggaatcaattgcaccgtctgcgctcgcttggggaaaaccgtccgatcggaaatgatcaccgccggtccagccgttggtagcgcatgccagtcggcaacttccgtaaagccccgcaaatgatcgacatacccgcgtaaatacggctcgatgtacaagtaaacgggtgccttggccgccaataaaccgttgatccatttagtgttgcgtttaaactccggataccaaccatttaattgcttcatgagtagatccagcgcttgcacttgctcagtgtcagttgccgtagtcaccactggatcagcaactagcaatgttgctagttcgttggtccactggttggcaccaccaatatggccggacaataaactgatcacgtgttggccttgttcatccaaaactaacaccgccggatcagtggttttatcttcgatcaccggcgccaacgttcgcacaacaatgccactagccataatacagatcaaacaatcgacttgtttaaatagccgttgcaacaccgtgctaaattcgccacgggcaattgattgcgtcggtgctagcgcaattttggccggcgcataaattgtaactggttgtggccaaaccgctgcgatctgctgggccaatttttgaccagttgcggtcacggtcacgattgcaaagcgttgcttcatttttcgctggccttgcggtattcatgggtgaaatgggcatcgtacaaatgcgaataatggtactgctcgcctaagaattcgccgaccatgatcaaggccgtcttccggataccagcgtccttaactttgccagcaatatcggccaaagtcccagaaacactttgttcatccggccaagtggctttgtaaataaccgttgctggtgtggtttcaggatagccaccagcaatcaattctttgaccaccttacgcatgccctgcacggataagaagatcaccatcgaggtttggtgcgcagcaaatgattgcaacgattcacgatcaggaactggcgtccggccagccatccgggtaatgatcacactttgggagacttcgggcacggtatattccacgcctaagctggaagccgcacctaagaatgagctaacaccaggaatgcagtcatactgaatgtcgcgctttttcagttcttcgatttgttcacgaatcgacccgtagatcgaaaaatcgccggtttgtagccggaccacatttttatcagccttaactgcttttgccatttgctcaacgatctcgcctaaagtcatgccagcgctattgaacttttcagcgtccggcttgcagtaatccaataaatctaaattgatcagcgaaccagcgtagatcacaacgtcggccgccgccaacaaacggtaccctttcaacgtgatcaattctttatcgccaggaccggcgccaacaaaacttacaattgccatatttgctcgtctcttttctttgatttgatgttacttagtcgcggtgaggatcatcgtcggattctgaggcttaaaataatgacctgggcccaaggcgtgccatttagagatctccgcgcgaatcatttcgacctgcttaaacccggcctgctcaactaattgataagccgccaaggcattttcgaataaaatgaaattcagcaccagttgcccaccagtagtcagctgggccgcagcaaaatcaacgatccccgccaactgctgcccactgccaccaacaaaaatagcgtcgtaagtctgttgcggaatggccgtcggtgcggcaccgttgatcaactcaacgttagtcaactgaaatttttcaatattttgttgcatgatcgcaatggcggctggcttttgttcgatcgccgtcacttgcaactgtgggaaatcatgggccgcttgcacgctgatactaccagtaccagcgccaacgtcgagcaacgtgtgtttgtcacttagttgtaacgccgtaatactgatcgcgcgtacttcggctttggtcatcggtactttactccgtaaaaattcttcatcacgcattcgtgatcaccaccacattcaaggcatattcgcgcttaacgacttgatccgccggtaagcaagttattttttcttcgggatagctgagcatttcgccaatatacattagccgctgctgaccacgttgtaaaacttcttgggcaatttggtacggcccgatttgcgtatcggtaaccatggccaccgtttgatgttgtaatagaaaatcaaaatccggcacccggccatgactgctggtcaaatagctatcattcattggcaaaccgatctgatggaaacaatattggattgcgctgattccgggtacgatatggatctgttcacggggaaattgatgcagcgcccaattgccgatgccataaagtaatggatcaccagaagctaacaccgcgatctcccgttgctgattattttgcaaaaatacttttaattcacttaatttaggtaagacatagcgttttgcggctggtagatcaaacaaggctaattggcgctggctaccaacgaccacctcagcccgtgcgaccaccgttgccacttccgccaccattaatttagccgcaccggggccgatccccacgatattgatcattgccattgcccctcaatttcagccaacggcttagtcgccgccaaaaagccggttttattggaaaagatcaccacgtcaatatcaacgtgtggcttacggtgagctaataatttgtctgcccgcaatttgatcttatcaacgatcatttggtacacgccttgataaccggccgcgttgatcacttcgatcatcgagatcgtggtcaggcacttataaaccttttgcaataattcagttggtgcgcccattaaagccaaattagccaccatgatctcagcccgcgcatcggcgtccttactatgggtcgaaaaaataccagccgaaactttgatcagcttaccgagatcaccgacgatcaataacttttcaaattccaaccgctgcacttcatgtaggacatagccgacaaagttactcatttggacctgcttcgtaactggaatgtgcatttgatctttcagaaaatcttcaccataattacccggcgttaaaatcaaatccttgtcgccgcgtttgcggtgaatattcatttcgatggtgatcgaatgtttccagctttcttctgacattggcgtgacgataccgctggtgccgaggatcgaaatgccgccgacaatgcctaatttaggattgtaagtcagcttcgcgaccttttcaccttctggcgcggaaatgatcacattagcgccgcggtcaggccctaacgttgcgcgaacgctttgcttgatcattttccgtggcgttgggttgatcgccgccatgcccactggattggctaaaccttcttgggtcacacgaccgacacctttaccgccatcaagcacgatctgatcatcatcacgtaaggtgactgtggcgtagatcagcatcccgtcagtggcatcttggtcatcaccgccatctttttggatcgcgatgctagcttcgtgttcatcaaagtgacattctttaatttcaaaatcaacttgttgtccgttagcggcggtcacccgcacggtatcctgtgcggtttgatcaagtaatgctttggttgccgccacagctgctgcggtcgcggtcgttccggtggtaaaacctttgcgcagcgcccggccattgtaataaacgtaatcttcttctttagccaatttaatcaccagcgatctgatctaaattatataaaaccgcattcgtcaacgcggccgctaagttactgccacccttacgcccatgggctacgattgccggaatatcactttcaaacaaagcctctttactctctttggcttcaacaaagcccaccggtacaccaatcaccgcgtcagcgtgtagttgacccgctgcctgcatttccagaattttatacaaggcagtcggtgcgttaccaaccacgaataactttttagtatcgccttgcgcggccacttcaatactagccattgaccgggtaatatcgtgagccttagcgtaagtgaaaatctctggatcactgacgtagcaatgataatgacaacctaattcgtctaacttacgcttattgatcccagacaacgccatatgcgtatcggtgtaaattgtaccgccttgggtcatcacggctttgatttggcggatcacatcatgagtaaaagttaaactgtcaagatactcaaagtccgcggtggtatgtattgcccgggtaatgatcgctttttctacaggatcattgaatttataatcagggcgggtcgccgcaatttcttcgtggatcatccgaaaacttttttcggtaattaaattaggtgttgtaatatattctgccaaaggaaattcctccttatatttcacgattaagggactgtttaaatgagcaaccagcggcaaccggcaaaaaacaataggcctaaaatcgcacttacgtacaacatgcggttggttgtgccgatatccgcgctgctggctggtcgggcatcggtgcggccaataaaaggcttatcgacacgctcaccaaagtattggtgcgggccaccgaggcgcagatcaagcgcgccagcaaccaccgattccgatagcgcactgttagggcttaaatgctgccgccgatcgcgccgaccaatttgccaggcgccgcggctattgagtcgcaataaccagctagctgcaagtaaaaataaccacgttagccgcgctggaagccaattgaaaatatcatctaattgggcggaaaagcgaccaatattgcggtacttctgattgcggtaaccaaccattgaatccaatgtattgacggccttataaactaagcccagcaccggaccaccgataaataagtaaaataatggtgcgatcaccccgtcactggtattttccgcgatcgtctcaatggtcgccttgcacacggcttccgcggataactgctgggtatcgcgaccaacgatcatccctacctgttgtcgcgcctgggttaaccgctgcgcctgcaaacttttttggatcttgcggccttcatgcgccaggccgcgaatggataaggtggtgtaacacaagtagacccctaccacgtaatgtaaccagaaccaccgttgtgttagacccataatggcgccagcaataattgccgttccaccgacgatcacaaaccataacagtacgcccaaccaaaataattgccgcgccgagcgcgtggtttggtcaaattttttcacataagcggcgatcgcctggcccataaccttgaccggatgcggccaactatacggatcgcctagcaataagtccaacacaaaagccaagccgatcatactaatcagcgccacgggtcaccgcccccatttcctgcaacaaatgctgcagtagctgtggattttggtaaaaatgaacgtgcacgtaaccggcaaaagtccggcgaacttgatagccgccagtccactgatcaacgatctgaccgtcgcgctccttagtcaacttaagcaacggttgcgccccggtggctttaaaaattgaatgatgaaattcatggccagcaattcgttggccttgcgccaccaacaaggtatcttgttgcgccgtggcataacaataaccaaatcttttcaagcgcggtgtcatttcacttgtaccagctagcacgccgaccatcggaaattcgccagcggccgtttttaacgtttcacctaggtacattaggccaccacattcagcatagatcggccgattttgcttagaaaagctagcaatatcttgccgcatcgactgattggccgctaattctgcggcaaactcttcagggtagccacccccaagatacaaggcatcaacagctggtaattgggcgtcatgcagcggactaaagggcaccaatgtcaccccacagcgtttaagtaactccaaattatcctgataataaaagttaaacgcatcatcttgcgcaatacccaagcgcaactgatattgcggtaatttaaacggcaacttagccggtgtctggtccggcacagctaagcttaatagctggggcaaatctaaatgtgcacctaataattcggcgatgcgttcaatcttttggtcgatctgtggtaactctgaatcgggcactaagcctagctgccgtgacggtaaactaattgccggatcacgcggcaagtaacccagtactggtacagtggtataacgttcgatcgcgcctttgatcaattgaaaatgattcgcactaagcacattattgatgatcaccccaacaatattgactgccggatcaaaattgacatagcccatgacaattgcggccgtagaggtggaagtcgctttgccatccagcaccaaaactactgggagatcaagtagcttagcgatcgctgaactcgaagcacaatccttgtcggtacctaaaccgtcatatagccccatgacgccctcaacaacggcataatcgatcagtgccgtattttgcttgaataaataagcgagtgtcgcccgttgcggcgttaaaaaactatctaagttacgcgacggccggccagtgatccgtgtatgaaatttagtatcaacgtaatctggtccaactttgtagggttgaacatttaagccttgttggactaataatttcaataacccaagtgtgacactggttttaccagcaccactggttacgccagcaatcattaatttacgcaaattagccaccacccatcaaaaatttctaaaattaaaagcgcttatctgttgagagataagcgctttagctagcatgacagtttttgactgtacgccagaaatagcaaaactaataccctcagaagttttcccgaacatgtagttgatcagccggtcttctgacttagtttcatcctactagcagcccttcccgataagaattatcagtgggtcttattgcgttcgtccacatcacagtagctagggtctgtaaaggctttgcacctttttcccggttctgatcaacatttatttaaattctgttgcttgaatataagcacgatagtaagcactaaatggctgttggcgtatctgttgcaataaatcatttgccgccaatcgttgcgggtcaaacattagcccgatcaccgtgcctgaatgggccacatttaagcctaaaaacggttgtgtctgcataaattgctggatcgccgtaaaatacggcttcggtaataattgctgccgtaaacaggcactttgcgtcgcagctgcgcctaataatgttaatgactgcgtctgcaccgcggtcataaaagcctgatagacttgtgcaaattcggtcgcttgctgttttaattgtaacacggtcaactgccgatgaaccaatgcagttgataattgtgtggctggttccaaaaccaaactggcaaattgtggccgccacttggtctgccaataaacctgcccagtccgtgcatcgatcacagtcaatccttgcgccagatacgccgaggcatcactggcctcaacttgaacacaaaaccgagtgatctccgcagccgacaatgaacgaccaaacaaccgtgcaaccgcacgacaagttgccactagatctgccgtactactagccatgcctttgcctaacggaatctcactttgccgacttaatttaattttaacttgtggctgaccaaagtgcgttagcaacaaacgacacaactgatacattttgacttgcgtcgccggtatggctggccagctgggtaccaaaactgccgtcacgcgactggataaatcaataccataagcaactaatttttccgagccggctaaccagccttgcaataattcaccacaagttgctggacaactagccaccgccgattgcaaactcactgactaagcacctgctttaaagccaccaataaacgttgatcagccgcacgatccttaaccgccacccgataataatgggcgtctaattgccgataatccgcacaagtccgaatcacgataccgaattgcagcagccgctcagccaaatcagttggcgctgcccgcaaaagaatgtaattgacctgactaggaaaaacggttagttgtggtatttgcgctaattgttgctgcaaccacggctgttcctgagcaaaccattgttccgtcgcctgaatataatcagttaattgataaatatgctgccccgcgatcgccgctaaactattcaacgcccacggctcactaaaagccagcagccgttggcctaattgcacatgaggcacgatcgcataacctaaacgcaaccccgggatcgcaaaaaacttagtggctgagcgcacgatcaccacctgatcatccgtctgcaaactaggcactaaactgatcgccgcttcatttggcaaaaagtccataaatgcttcatccaacaacaaccaaatatgttgttgctggcaatatgattgtaactgctgcatttgttcgcgtgctaatacttgcccagttggattattcggattacctaagcaaaccgcttcgatttccgggtgttgctgcaaggttgcgatcagcgcaggcacatcgatctgaaattgttgggctggcgctaaatcaaaataagtaattttggcattgatccgcgtaaacgcgcgctcatactccgcaaacgccggcgctaatagtaaaacgtttttgacggccaaggtcgcagcaacgtcaaacaatagttgtactgcaccgttgccaacaaatacccaatccaccggcacttgaaaatgctgacttaattgctgccgcagtgctaaataagtggtatctgggtagcgggtcaattcatctaaccctgcagttaaaagttggcgtagctcaggcgctaaacctaaagggttgatgttcgcactaaaatcaagtaattgttgcggtgccactgtctgcgtacgtctgatcgcagctaaattaccgccatgatgtgcaactctcatcttgtcaccccaagaaagcttaacgatttgatccgttgtggtaaggccacgtagacaacttcagttaaaactaggttagccacagtcgccaccgtcaacggtacaaatagtgcaataacggcttgatgcataattggatataagatcaacagatccagtggcacattgatcaagtaaccacagacatccgctaacaaaacactataccaacgtgacttgcctaggcgctgacgaataaaaccaaatacacccatgcaaagtgccatcaacgccgcaatgatcaaatgaattggcaacgttaacggaaaaccagataacatcgatgagatcagatgaccaaatgcccctaaaaaggcacctacccaaggaccaaataataacgcgcctaaaaaggcgggaaaggaatctaaggcaattgagcccattagcttaacgttagccccaacaacacataaggctagcaaaacagccacggtagtcagtttacgaatcttcatttgcttatttctcctttccgatcattaaaactatgacgctttcattatactgcatcccactagccttgtgcttactagtgagtgattgaacaatattcaatatattaccgctgaccacaaaataagataaatcaacggaaaacaggccgactattacgatacaagacgtcttcagtaccttctaaaacgttggcgtaacgagcaacggcgaagaaataatcggataatcgattaatgaagaccaaaacgtccttattgatctcagcagtgccttgcaatgtaacgacttcacgttcagcccgccgtgtgatcgtccgggcaacatgtaaggcactggcaacttgtgagcctccaggtaaaataaatttttggactggtggtgccacttccgtataatgatcaattttaccttccagccatttagttgatttagcatcaaaaataaaatcatgcttcggatcgtcagctggtgtggctaaatcggtccctgcgtcaaataataattgctgaatttcttgtaattcagcgtgcagttccaccgttttctcagtcaattgactgtctgcataaccgacccaggaatttagctcatcaactgagccataagcattgacccgaacattatccttatcaacaacttgcttgccaatgatccgcgtctgccctttgtcacctgtttttgtataaattcgtaccataaagggtacctcctactccacaatagtggataatttttgcatcaaaaatttctgatgtttcggtcgatgaccattcttgtggccaagaccgtaccgcaagaaacatggccctactccacaatagtggataatttttgcatcaaaagcttccgatgctacgaacaataaccatgcttgtggcaaaaatcataccacaagaaatatggtttatataatgcattatgccgtttgtgattgacttatacctagataatcgacgatagcttgaataccctcgtcatcttctgcagaaatcgaaaaaatcttcttggcaccagctaattcaagttgcgttgctgcccaatcaatatccttctgatccttggctaagtcgatcttggtcacaatgccgatctttggtttaggaaacatgctgccaaagccaggcgaaaaggtttgccggcggtcactaacactttgcaataagacgatcacatcagcttctgcagccgtgaccgtcaacgcattatagagctggtggtgttcaacaaattcaccgggcgtatcgatcatgtcctgatagaattctaccgcttgtgtcttccgataatcaagggccgctccttgcagacgttggcaaagtgttgttttaccgcagccaattgccccaacaaaaattggttttttcatcgtttggcgatcattgattcgatcgcccacctcactttcataattagcggacacatttatcatacactatctcgcttagaaaaaacacgccattttatagcgcttccatctagtatctaaaagcacaaaatagtgttaatcacaaaataatacaaaaagatcctgcactatttcaccgtgcaggatcttttaaatcaaattaaagttgtgccacccgtacaacatcgcgagcgatcattaattcttcatccgttggaatgactaaaactttggtcgtgctgtcggcggtttcgatcgacaaagcattagccgcattcttggccgtatcgattttaacacctaaatagcctaagttttggcaagccagttgccggactaatgctgaatgctcgccgaccccagctgtaaagacaatgctgtccacgccgtttagctcagcagcgtaagccccaatgtaaaactgaatttgatgagcaaagacttttaacgctaggtccgcccgctcatgccgttcatcagattggtcgccggcaattttggctaagtcacggacatcattagaaatgcctgacaagccaagtaagccggattttttgttcaacatatctttgacatcttgtgccgacatgccttcttgttgttctaagtaaggaatgatctgcggatcaacatccccactgcgggtacccatcactaacccagccaagggagtaaagcccatggaattgaccactgacttaccatccttgatcgccgtgatactagcgccattaccaatgtgacacgaaatgattcgttgactgttgttcggaaataactccgcggttttcaaggcaatatattggtggctaggtccatgaaaaccgtaccgccgaatgccatctttttcataatacttatacggaatgccatagatcttatcaacgactggcatggtgtgatggtaggcggtatcaaatactgccacttcttttgcatctggcaacgccgctgatactgcctggatcccagttaaattaaccggattatgcaatggtgataatacgcttaattgatcgatccttttttcaacatcggcattgatcaacgtcgcatcactataataacgaccaccattagaaactcgatggccgacaccagcgatctcactataatcagcaatgatctgctctgccaataatgtatctaacactaagtgcactgccacatcatgatcagcaactggctgtacggtttggtgcttttttccctgataatcataactaaaaatagcatcatccttaccgacacgttcaaccgcgccttcgatcattacggtctctgcaggcatttcatataatttaaactttaatgatgagctaccacaattgattgccataactttttttgacatcgaatcacctcaaattttaatcacgtgacacatgactgcgccaaacaaaaaagtggggcccaggctgcccattaagcgaggattggttgctaccaatctagactagatttgagctgtgattccctggtaccccacattttaattactgtagattgaataataatgctgcaatagctgcaccaacgattggaccacacattggtacccatgcatattcccaatgggccgctgttttgtgtggaattggcaataccgtgtaagcaaaccgcggaccccaatcacgcgctgggtttagtgcatacccagttgtcgatcctaaactggcaccgatcgcaaagataacgaaaccaacgataaatggttttagaccctcagtaaagttacctaaattaaacgtaatgtaagtaaatgtgaatgtcgcaatgacttcacttagaaagttaaatactggactgttgatcgccggttttgttgcgaagattccaactgtattgccttctgcttcgcttttacttgctttgaaatgaggatagaagtgaatgacaacgatcgctgcacccacaaaagcccccaacatttgcgcaataataaaaccaacaacttgcgaccattttatcatacctgaaattgctgcagcaatggtaaaggctgggttcaaatgcccaggcgcaccaaacgatgcagccacatagacaccaaatgccaccgccataccccaggcaaaggccacatacaaccaaccttgccctttagcataagctttattcaagttgatacttgcaccagcaccggcacctaaaatgatcaagatcatcgtgccgacaaactcacctaggtaagcatccataacattaccctcctcttgctagccgatcaccgcttgataaacggccgctaactgttcatcagttggcacgattggattacctgggaaggtgccatccgcacgtgcagccttaacaacgacatctgtctttgctttggcttctgctggatcaacaccgaaggcacgtaaattatgcgggcacttcatttgatccatcattttgtagatcgtgttttgtagccgttttacttctaagcgtggacttaagttagcattaccaataccagctttaacggcagctttacagtacttcgcccgcaccttaggatcttgtgcattaaattcgatcactaatggcaacatcatggcacaagctaagccatgcggcatatggaattgcgcacctaattgatgggcgatcgaatgggcaatccctaaaccggctgtgttaaaggcgatcccagctgcattagaagcttcatgaacgattttacgagctgcataatcatctggatgttgataacactgaaccaagttatgcacaatgatatccactgcttcttcagaaagcgcagttgaaataacattagcacctggatcaaccgcaactaaggactctagtgcgtgggtcaaaacgtccaagccagaaaaagcagtgacgctagccggtgcactcatgaccaatcgtggatcaagtaacgcgatatctggtgtcaggtgatccttgatgatcggcatcttagtcgcattcttttcatcagaaaccacggctgtattcgtcacttcagaaccagtcccactagtcgttggaatggcaataaagcacttaacttcacatttatttagcttttcaccaaagaaacgaatcgctttagcagtatcgatcgcagaaccgccgccaacaccgatcataacttgtggtttgacttgattgaagacttcaacgccagccataatattcgttaatggcggatttggtttaacgtcagaaaagatcgtgacttggttgctgctgtccaatttgctttcaatcgatttcaaaccaggtgtccctagtagaaatggatcacaaaccaacaaaactgcagtttgcttgattgtttctaaaacgtttaggctatcgtcaccagagtagatcgttgttggaattgaaattttttccatactaatccctccagcttctcaatgaaaatccttccggtgaattcaaacgacgacgacgagtgaatgacttagctgtagtcgtaccttcaccagttggtgttgcaattgttaaggccgaggcaccagtatgaccaacaccagtaccagagtacgtaggaccatttacaacgaagatcgatgtattcatccgatgtgctgcttggttgatgtgtggtaagttttctgaatggatcgaagccgtatgatgattgccgccttcaacaatgacggctgtcttcaagacactatcaaaatcagggcaagtcacaactggtagaattggcatcaacatttcagttgtaaccaatggatgatcagctttagcttcaagcaaaatttcttttggcttgccggtatagctgatgccagcagcgtccatgatataagtggcatctttaccaacgtatttacgatcaggtgtacctttatcagtgatcgtcatatcgactaacttctgaattgctgctgggtcagtaactaaatagccaccttcagcctgcattttacgaactaattcatccttaaccgaagcttcaacgacaacttctttttcagcagtacataaaatatcattatcaaatgaagctgaatcaatgatgttatgtgcagccaaatcaatattagccgttgcatcaaccattgcaggtgggttaccagcaccggcaccgatcgtcttcttgccactgatcatggcttgatggaccacgccagggccgccagtaacggctaacatggcaatgtcaggatgtttcatcatttgttgtacggattcgatcgatggttcgtctaatgtcacaactaagttagttaaaccagtggcattttcaacaaactcattcaatttttgaatcgtccatttagtgatgtttttagcaccaggatgcgcaccgaagaacaaggtattgccgccagctaacatcatgatcgcattggcaataacggtttcagcagggttcgttgatggaccaacagcgccaataacaccaaatggtgcatattcgtacattactagaccaccatcaccagtttcagcttctggttggagaatttctggaccaggtgtgttatacaaagcgttgtttaatttagccactttggcttcgacagtacccataccagtttcagctaaaatatcttcagcaattttttggatatgtggccggaagccttccttgatcgcatcaatcactttttcacgagtgtcgatcgagcaatcaacaaatttttcttgtgctgctttggcggcagcaactgcttcatcaacggtcttaaatacaccgtgatcaccattagttgcagcaagagttgttgtacttgctgccccactttgtaattcttctgctaaaatttttctaatttgttcttctaaactagccattatctttgtctcctttgaaaaatgcgttgactgcggtttcgcagatcagttgatcttcttcgaccagaccgccgctcacaccgacagcccccacgattttatcatgccaaaccaacgggataccgcccgaaaatgaaaccaagcggccatcaagattcccactcatttcataaagtggtcctcctggttgaatatcaggtccgatctgcatcgttggttctttcattgcgatcgccgaccaagcctttttaggtgctaaagtccgtgataccatattggcgttgggcatgtgataaagcatccgcacattgcctgcttcatcagcaacacacattgtaacgccaactttaagctcattagccttagcttcagcaacatcaaatacacgttgcatattttgccgagtaaagaaacgttctgcattcgtttccgctaaaacagccttaacgactcgacgaatttcttctgtattcactctgactcacttcgtttctattttgattcaattgctttacagtagcgtttaacaacttcatcaactaatttctgctgttgcgcataatgatcttctgcccgggccaagatatacatgaagtccgataaccgattggcgtattgctcaacttctggacgaaacttgatcgtctcactcagctggactaatcgacgctctgcacgccgacataacgttcgacaaacatgcagttgcgcgccggccaaactcattcccggtaaaataaaactatctactgctggcaattcatccgtgtacttatcgatcgtacgctctaataaatgaatatcttcagcttcgatccgctgacttttaccgtaaaatttgtcggtatcttgcgtagcgatctcaccttgcaagaagaacattttatattcaatttgtttcagcaattctttattttctgaaatttggcaatacttttcagcaacactgatttgggcgttgcactcgtcaaaagtgccgtaagtttcgacccgcagatcatactttttaacgcggccgccatcaaataaacttgtattacctttatcaccagtcttagtataaattgccattattcacatccctattccacgatcaaggttgatttattagccaaatgcactaataattctttgatgttcctgacggtgcgacttggacttgccgtacttcgacactagtccaatcgacaacgggaagcaggttctgcttagccaaaaagttcaactaatcaatacttgcttactagtgttgtcgaaaaccagcgacagtgtccattcaacttaggcaaaatacgcctagttgaagcatggccctatttatcgaaacgatcgataatgccgacaattgctgcatccatgacatctcgacgcgaactgtcgccatcaagactatgacgtgcaccagcaccacgaaccattaagacatattcaccaatgccagcacctaccgtatctgcagcaacttcctcacgattcatagggtcgccattactatcaacttggcgtacgatcattaatttacgtccaatcaatgacgtatccttttgtgaagaaaccacgctgccgactacttttcccatatacatgtgcgattcgacctttcttggaggacgagctggcgcttgaccaattcttcttgccccaacattgttattttttgtgcgtgtgtttttagcaccacactttttggcggcaatttaactaaatcgcgccgtgtgatctgggtctgttcgaaagcagcaattggttgttgctgataagtcttgaactttaatgcccatgcagttaacatcggcaacggaataaagtcaagttgcttaaagctgaccgctaatgttaaatggactcggtagccgataccagtcattaaccattgcacccatggatcagacacatccattcgatagagatcacggatcaagggaatcgaaacattttgaacggtgacgctagcataatcataatagatcgttgcgctgggtgctggctgatcagattggtagaaaaaatcgatcttttgttgctgtcttttctgcaagcgtgccaacacttgttggatgagttcttcattcatcgcaaccacctctacttacttcacaattaagaacggcttattaaaccgatcaacaagctgttctattttatttatcgtacatggcaatgcctaatggtgttacaaattgcggaaattcaggtttttgtgcggcacgacctagggtatgactgaaagttgcaacaaaatctttaaaattagtcgccccgccaaccacgatcactggctcagctaattgtgtggccatcacatttttggtgatcgtcgccatcttttctacaactggccgaatgatcgggaaattagcgctatctttcttggggtcacgtttcattaattctgcatcgtcagccggaatatggtgatagccagctaaaacaagtgtcatatgcgaaccaccagttggctcatcaattactttgaccagccgtttctgcttaaaaacactaattcccgttgtcccaccgccaatatcaactaccgtccccgtcgctaaatgaagaaacttagcggctgcggtcggttcgtcaacaatttccttagcttccatttcagcagcctcaatgacgtttgccaccaccttagcgctattttccccagtacccggggggatggccccacaagcactggtcaacgtctggcctaacacagtttcggcctgcgcttttaatcgtttcaaaatctgaattgacccaatgtaatccacgacaatgccatcacgaacaactttggcgtattcaaacgccccatataagggttgatcattttgatctaaaacagttaaaacaattgatgacgtaccgagatccacaccaaccttcaacgtctcatccttatgcaatttacgggcggctttatcaccgttgaccaactttgcgaacttcctcaacgtttgattagcggtatctaacgtccattgcttttttgctgtctgcatttgaatacacctctagtggttaattttgtagcacaagttgctgataattagattcgtttgtctttaggaataatgtgaccaaccgtatcaggaccaacgcaagctgcgttagcttcgtcaacgtcaatatgcatttccaaaacaaaatctggattaggccgcgcaatgacatcatcatagatcgtccgccgaccattagtttcaatggccacttcaacggtttcaccatacttaacgccgaaacgttccgcatctttatcgctcatatgaatgtggcgctttgcagcaatcacaccttgaattgtgacttcaccatcggcagtttttactttaatcgatggtgtaccatctaattcaccagacaaacgaactggaactgtaatgccgagactgcgtgcatccgaacgagctaattcaacctgcgaatgcttgcggcaaggccccatgacccggacatgctgaatctcgctaccattaggtccaacaatcgtaaccacttggttagctgcatattccttaggttgggtcagccatttccgcggtgaaatctcttcatggggaaagaggactttgtaatccgcttcagttaagtggacatggcggttagaaaccgccaccggaatccctggttctgactcttctttaataattctgcgaataactttacgtaattcttcttcattcataattcaatacaccgctttatctaaaattatttttctgtgccgtttggtaaaatcttttcaacatcgctgtgtggacgaggaatgacgtatgaagcgtaaacatcgccaacttgttcagcggaagaagtaccggcatcaacagcagctttaacggcaccaacatcaccacgaaccataactgtaactaaacctgaaccgatacgttcgtaaccagttaagctaacattagctgctttgaccatagcatctgctgcttcgattgctgcgactaaaccttttgtttctaccatacctaatgcgttgttcataaataacaacctcctgattattgtttaaatacctgttatcaagcctttaacggcagctttataaacagattattttttgtgtgatgatttattttgctcagcttcaacttcattaaaatgaatacaagaagcgcgcggctcgccttttttacgtggacaagcaggatctttacataaattacaagtgtaatgagtcgccggtgttggctcggtcgtcggcttagacgcatgactaaccgctgcagcttcgcttatcgcagaagctgagaccgaagtcgctgctgagtcagctgcactagccgcagcactcactggcgccaccttgcttgtagtctttggttccggcgttactggcggttggggctttggtttaggttgcggtaaaaaggttgggcctaaaccagtgcctaagcgtggaatcacctgcgaagttacatagaggtgatctcgttgtgcttgtgccttaccagcattaacactggcttcgaccgctgcaactgaaccagtaactttgatggtgagccagccggaacctttagcacgctgcaaaccttgaatatcaacggcagcagttttgaccatcgtatcggccacgctaacggcacaggcatatccaataacctcgaccatgccaagtgcatcattcatttccggttcccccttcacaaaatagtgcgggttgaaaaagcgcccagattacgtatattccgtaacttgctgtttcaaccacgttttcgctaaactaactaacactaaaatacgtttgtccgcatttaatgttacggatgctgtaccactttagttgaaaatcataactcaattttcttaaatggcacacctttgaccagacgtgcagcgtcagcaccgagcgcacgtagcttatgatcgttgccccaagtttctgtaaacaacggttcagcctctggtaaattcttgtagtgaacaacgatctgttgccgatcataggcaatgcctaccgacaatggtgaggcgatcgctgcttcatgggcgatatgggctaacgacccactaacatccataggtcgcaatacatacggaatttgttcttcctcgatcccataaagtagcggctgcaagcgttgatcatcagtaccactcgcgattacgatcacaggtttaactgccatccgcttacctccttacctcattggcataacgtaagatcaatccagtggcaacggcattccgtggcccttcaaccgaacgtacattaccgcgaccagcaactaaattataatgagacaattcatctgtgactaattgtggaatctcgaagtcaagtgccgagccaccaacaataaccacaaatggaatatcacgaatgttgccagtaggactaacatgctgtaaggcacggatcgcattggcaacaaaaacccgtttcttcgcagtacgccgaacgatacgaatcttttcgatcgaaagctcacctggaattggttcataaccggttggcttaaccaccaccgttttagcaaaaatatcagccggtaatgccttttcaaagaactgtaccgaaccatcctcatgccgcagctggaataaattttcaaccttggctaacggatagcgtttgatatcttcagccaaataaggatcatctaaaccgagttcagaattaatgatcatgctaaccatgtcgccagcaccggctaaatggatcgcaacgattttattctccttattgatgatcgaggcatcggtcgagccggcccctagatctaaaatagcaatcggttttgttgtccctggtgtggtcagcgcaccgagaattgcggcctcggcttcggcaccaccaatatcaaccttgacgttgagttccttctcgatttccttagcgatccgcgacatttgcagccggtcagacttgaccatagaagcgatccccacggcctgttccatcgagaactcacctgctagaccgcctttgacattgatcggtactgaggtattgacccctaacagatcttgaatggcgatctcattaagctgcttgccagtaagttcggccatcgtttggcgaacacgttccagcataccgccaatattggttccaggttcaccggtcacatcatcgatcgtcttaaagctggagatgaccttcatgatcttatcggcaccatcagagatgccaaccttttccgtccggccattatcaccatggatcgttaatgtgcctgccggaatgactcgtgccttgacgtcacctttaggcgtcttgatcacaaccgctgaacggttgccgatcaaggcccgggcaacaggtacgatattcttcgtttcctcagaattcaatccaaaaacagtggcaatcccgtaaggattcgataactcagaaatcacccgtccttgctcagcaacttcgacagctgccaacatatcgactggtaccttatccagaaaagcaacttcatcaacaattggaatcttagtatccaaacgattatcgactaaaacgccatcatcgccttgcatgaccgctgcggtaactttataaccgcaaccgatatacatattgatcaatttagcagcgtcagcaaaatcaacactacgtgggatcaagacaatgtaactgcgttctttatccgtttgtttgatcaaatcaacgatgttgaccgtatacccaatacctagacctagaccaccaggtgtccgcggattatgtccaatcatggttgattcagtaataattgtttctgtgatggtttccatcgccacatcaccaattaccggcgtcgcctcattgacccgaattagatccacatcggcaatatctagatcagctttatgcaaaacgccatttaacgccttgcgaataccgatcagattacgcaatgtgcctttgatcccagtcgtttcagcaatatcggaagcaatgaagtcaactgaaccatctgtatcaacgttggctaaagcaacttcagttgatgagttcccgatatcgacaccaattactttttccatgagaactcctccctaccaatagttattcagaatttgaattcaatttctatactgatctgcttggttttataaccaagatccttcactaaattagcggtgaacgctcctagcgcaaaaacaaaacaccatacagaaatcttattctggcaacaactagttgtcgccttttaacttcttacgaccttcataattagtggctgcttcacggaaccaagctgcgcaaattggtgcgttatacttagtttccaattctttagcaatatcttccagatcttgtttagaagaacgatatggccgtaatgcaccatacattgctaaaatcttttcatcgggaatagccgttaattctgcagcccgagcaaagtttttctgaatggctgggcgaccagcgtttttagcaatttcaccttgatactgcaaggtttcttttgtgattcgcagatcatcagccttaacgttgtccttcatgacgttatccaaagtgatttcatctaatcctttaccacttggtgatttgatcaaatcgggatgtttggaaaataatggataatctgatgcatctaattcttttgtaggtgcggttggggcacttgcagtagtcgttgattgcgcagttggcgcatcattttgctgctgcatttgagccatgatttttttgactaattcatccatttctgccacttttaacgcctcctaatcaaacgttacttgaatttcatcagctggtttaccaattacaacatacttggtttcccgaatatgcattaatgcggaaagtgcttggtattgcacccgtgccatttggtcgttgaccgttggtactggtactggtgattcacccttagcatacttagcagcattcttaccgatggcccggtaagttggtagatcaataactggtgcctgagggaacaattccaagttagataatggttcttgatcaacttggtgaatgattgttgtccctttagactgaatcgagatcccaattccagagccagataaatgatcggcttcaaccccaccgaatgaaacatcggctgtccgataaactttaacgacccgtgcatgcaatccttcttcttcgatcccagcaatgacttggcggagcacttctttgtgatccaaaccagtcaatgtatgggtcaaatgttcggcaaaaccaggttcgaccccaatgacaacttcgtccttagaagtccctggtttagcaacgccaacatgtttaaaccaagaaagttgtttaggtgcatcagttgcttcaggctttgcggcaacagctgtcgctgcgccactagcatttttatcgctgaaatcaattttagtttcgtttgtatttacttcctgcaaaacttctttgacgatggcacgcagtaatgactcatcaatttctgccatgttatttcctcctttaaaaagtaggttagatttaagaccaatagcggtctgttttcgttaacaatacttaattacgcaacacgcaataagtgattacaatttagcatttttgccatcgatagcgaatggtagatccttgatccgatcccattctttcttatcttcccagagacggtagccagtgccaggacctttgtaatcattagcattgttgatggcggaaataacgttccagttctcatcaaaaatagcagaagtctgcaagaaatcaccagctaaacgttgacgcagtaagttcaaataggcattagcaacgtcagtaaagccatgattgtttaatgctttaacaatatcaacaccggtaacgccacgatcaagaatatcttgtgcgcctttcatatcggcgaccatatcacgatcaggcatgtctttggaagtatcggcataagttgctgcttcaacttcttcatccttgatcgctggtaagccaagatcttcaaagactgcttgaacagacttagcagcataattacgtgccttgatgatgtcatcttcttgaaccggatgtaagccaccattgacagctagatcacgttcccaaacataataatcatcataatcatgcgcatcagcgttagaaccggcaaaaacgttatcgtagttaggtgtcgatgaataaccggaagaaatataatctgtcccagcgataaactgaccgatcatccgttcagtccgccgcatatcggaatgactgaaggcctgatcgttagccgaagcacattctagatcgaccatcatacagatcaagttttcaccaagtactgaacgaatacctgatggtacggcaccagggataccgatacagctaacaccaccattttgtaaaccttggacaccagatgctttggtgatcaagatacaacggcattcaaggtacaacattgatttaccttcggcgtagcccatcataacttcagaaccagagccagaagtaaagcgcatcttcaatccacgtgacgcgtagcaagaagctaaaaatcctttagaccaaggtgtatcgtcaccatcggtaaagactggttcagtcccataaacagagatcgtttcggcataggcagtaaaaccacgcatacctagacttaattcggctgcttcttcaactgagcattgcgtcaaaacacctggccgtgctgattgggcaccagttgtgatcgcgatcgcatttaatggtgcataacgtgcgatcgcagtggttgtttcttcttcagggaacccacgcaatgcggcatcagcagcatcggcagcgatctgggctgggttatcacgaatattggtaacatggccttgcgttgctggtgtccgccgtggacgcatcttctgagctgccatgatcatttcagcaaagttcaatttactgatgatctcttccaatttagatggtgtgcaggcagttgtaatatcaatgacttcttgacggctaacattcggatcacaaagcatgttggcgatcttaacggaatccatttgaataacttcttcggcacgatccaaattgatcccatattccgcaatatatgaatcgatcaaatcaaaatcagcgcgtttcttgccatctaattcagtgacaacaccgttttcaattttgatcgatggcttaggatcattaggccccatcatcgcgatgaaaccttcttcaggccattcctttacaaatccgtcaagatgaattggccgcttctctaattcctcaaatcttttttgacgtttcaagtatgcttcctccttctaataactaggatagattttgcttgggcaaaatcgtatttacaagctagttaattcccttgcgacaccccatgcaacaagaaactcaacccggcttgttgtccaacgcttaaatatatgatggaaattcatttttaggttcagtaccacttaaattacctaataatactttaccgacttcacgggctgagataacagcctgacgaacggcaccagaatcaccggtaatgtggaccattgcttcgttagaaacactagtgccatgcgctggtgaagcaacagacaaaacttcaactgctgctgttttgactgcaacatcagccatcacaacaccgatcgcagctggcgtgccacaaactaagccataggccttgcctaatggtgcaccaaaagctttatgcaccgcttggcttgcccgcgccgtgtattggaattccaaatgaccagcatcggtgctataaacatcgccgaaagtccgtttaacgtcttctaaagcgatactaaccgcctgacggacatctgaaacatcgtcaccaccgaagatgatcaaggaaccatgaccaccgccacctttagtatcacgaggtaattcaatatcgacaacttcagtattagtcgctttgaccgcagtatcagccgccataatatggggaccagcaccagtccgtgcgcctaaaatacctaatgaatgatatttcttatctaaatgcaaattatccagaatctgttgatctacgttggcaatgactaagccgattgtgtcaccgatcggtgctttaccaacatactcagttaacttgttatccgctaattgatcaagattattcaaattgccacctcctacttcacgattagggtagttgatcaaccaaaaatgttaatcaactttgatgttacggacggtatctattcttgtggtaaagtttgtaccgcaagaaatatggtcctaaaataatgcccttttaaacgcctaattcagttaaatatatgagggatgctgatttttaggttcagcacccattgtgctcaacaatttgatgccaatttcacgtgccgcgaccactgcttgacgaacagcaccagaatcaccactaatgtggatcatcgcttcattggaaaggctagttcctttgcttggtgaggcataagaaataatatcaacattggccgcttttaccgcggtgtcggccataataacgccaatacctgcaggtgcgccgcagaccaagccgtaagcacggccgatcggtgcaccgaaagctttgttacaagcgtaacttgcccgtgcagtatattgcatttcaatgtcaccagcatcgttagcgtaaatatcgccaaacatttttggtgttgctgctaaagcgacttcaacggcccgccgtacatccgagacgtcttcgccgccgatcgtgatcaaggaaccatgaccagcacctgtcttcgtatcacgtggcatttccacggaaacaacttccgtgttcgttgccttaacagcttcatcaactgccatcacttggggactagcaccggtccgcgcagaaacaacgccaattgaacgatacttttgatctaagcccatttttgcagctagatcagcatcaacatttgcaatcaccaaaccgatcgtatcgccgatcggtgcagtaccaacaaactcagttagtgccttaccttctgttgccaaactgttgacctcactttccgcttcagcggttggcttgttagccaagattcgcgccatcacgcggtcaataatttccgattcatctttcataatagctcactaatcgttttcaacgttgacatcgccatcaccaactgcacctggtgttggtaagatcttttcaacatctgtgtgtggacgtggaatgacataattagaaacaacttcgccaacgttttctgcggcagcaacaccggcatcaacggcagcctttacggcaccaacgtcaccacggaccataaccgtaatgagtccttgcccaatcttttcttggccagtcaattcgacattggccgccttgaccattgcatcagccgcttcaattgatgcgactaagccacgtgtttcgatcaaacctaaagcttcttgttgcataatgattcctcctcaaattggatggtactgtcaaacgtacctcgtttttgttattaatttccgaatattaaaaaacacccgaacgtctttttctggtattcttggtgtgcgaacaacaagaaaatccagaaagaaggattcgagtgcatacaccattaatagcctatttag

SEQ ID NO: 538 - DNA, 1586 bp, Unknown
  Metagenome-assembled genome
taatgtctactgaatcgttcttgtaatccttttgtagcagtaatctcaacgccagtttagtataattactgcaagggttttatccacttacgacaaaaggtcgtgcacttttactagaaaatgagggggtttcatgtataaaccacagctcaacacgcaattagctttcgaagattttgatcagccaatgggcttgtccatgaatccagaaaatcgctggatcaaaaaagcggccatcattccttggtcagaacttgaaaaagactacacgaagaacttccgtaatcgaaaaggtaacgtagctaagccgttacgcatggcacttggcgccctgttgatccaaactgagtatggctattctgacgaggaaacagtcttacaaattcaagaaaatccctatcttcaattcttcatcggcttaccaggctatcagaatcaggcaccttttgatgcgtcaacgatggtttattttcgcaaacgcttagatgcagtgaccttggcgacgatcaacgaaaaaatcattgccgctaattctaagccaactaaaaccgtaactgataagcaagacgaccattctgatgatgaccataattctggcaccttgattcttgacgcaacttgcgcgccgcaaaacatcaaatatccgactgatactgagttattgaacgatgcgcgaactcatcttgaaaagatcattgatgtcgcttgtgctgataacggctggaccaaaccacgaatctatcggcgtaaagcgcggcaggtttatttagccattgttcggcgaaaaagaaaaggtcagaagtggttacgcaaacagatccgtaggctgctaaactatgtgaaacgcgatttagataaagttgaaatttatttaaccgctggctatcaactgacattggaacaagaaaattggttgacgactagcaaggcgatctatgcgcaacagaaatatatgtacacagagcgaacacattcagtcaaagatcgcattgttagttttagtcagccttggatccgaccgattttacgtggtaaagctagaactaatactgagtttggcgttaagcttgatgtcagtcttgatcgaggattcgcccgtatcgaaaagaccagttttgatgcttacaatgaatcgacagatctagtcaacgctgttcggcgctactacgatcggaatggtcactatccggcacgtgtcttggctgataaaatctatcgtaatcgtggtaacttggcatactgtaaagagcgtgacatcagactttctgggccggcactgggccgaccgaagaagaatgaaacgcgtgataaacggatcagttatcaagacaacgctgaccgtatcgcagttgaacgtgattttagtctgatgaagcgtcgattcagcttaaatctgatcatgaccaagttaccgacaacgaccttgactagtgttggtattagcgtgattgccttgaacttatccaagttgatggctaatttttcgcggcctatttttggctggttggtatttatcaatcagattttctgtaaaaaccgacaaaagttagtaaatatttaaaatacgatttgttcagtacgcatta

SEQ ID NO: 539 - DNA, 4668 bp, Unknown
  Metagenome-assembled genome
tgttggttatgttgggaaaaaactcaagaccagttttagggccctaggctataacttatggacgccttatcgttctaatatgaaaggtgctaaacagcataataagcgtcaactcaaggcgttacggcggacaatagagtcacgcttttcaattttagcccagcaatttgggattgaaaccaatctcacccgtcgtctatttggttttcaattaaagattgaattgacgatattggtatacaatttaggcttttttgattttatgacgaactagcaccacgcgtatctatatatataaatatcccatttagctggaccctcataacaaatcgcaaaagtcattcccgaaaatacgagaaatacgacaaaacacgcccgtcaagcttataattgaagggatcacccccgctcatgcggggaatacgaaatatcgctatatatgttactcccaacaagcagaatcacccccgctcgtgcggggaataccttaaaatactgacacttacttgtttgcggacgggatcacccccgctcgtgcggggaatacagtcccgattcattaatgagcgttgacttcataggatcacccccgctcgtgcggggaatacctgatgtgatgcagcatatgtcaaaggacggtgggatcacccccgctcgtgcggggaatacttatagttagctgctttttcaggatgctcttcaggatcacccccgctcgtgcggggaatacacggcgactaccgtcaggatttacataacccaaggatcacccccgctcgtgcggggaatacacggtgtatgcggatcatatacacggacagatgggatcacccccgctcgtgcggggaataccattactaatctgactagttaggctactagccgggatcacccccgctcgtgcggggaatactaaagccgcacaggacacaacaactaaagctcagggatcacccccgctcgtgcggggaatactgcttttatcgttgtgccagttgctgtttcaaaggatcacccccgctcgtgcggggaatactcaactaacgtcatttcctcaatttcctgcataggatcacccccgctcgtgcggggaatactaaactcgacgtcgtttgtcttagccttcgtaaggatcacccccgctcgtgcggggaatacgagtattaatcgcgactgaatttgctggttacgggatcacccccgctcgtgcggggaatacgcattggctccatctaattcgccgtcatagtcaggatcacccccgctcgtgcggggaataccaatgggcgcgcagtaaacagcccaccatcgtaggatcacccccgctcgtgcggggaatacctgagctttacggagtaagcatgtcagcagtaaggatcacccccgctcgtgcggggaatacaaaatagccccttttcgtggcgcataataatggggatcacccccgctcgtgcggggaatacttgccggtacgataattggtgatgccttttacaggatcacccccgctcgtgcggggaatacacttgacctaagccgccgcctagccctaactcaggatcacccccgctcgtgcggggaatacttgtcggcaaattcttctagcgaccaggtctcaggatcacccccgctcgtgcggggaatacttacgacaaaaatctcactcaaaaaattgaataggatcacccccgctcgtgcggggaatacgcgagaatgcattaaaacaattcaagcagattaggatcacccccgctcgtgcggggaataccgatgctgcctggcattgtggcgggacaggtggggatcacccccgctcgtgcggggaataccgggcgttattttcatcgatgtaggcccagttaggatcacccccgctcgtgcggggaatacaatttgatgcggttagtaaagttgttgatggagggatcacccccgctcgtgcggggaatactgaaccacgttttggaaaatattattgtcggcgggatcacccccgctcgtgcggggaatacataacttagagtactctgagcgtaaggcattagggatcacccccgctcgtgcggggaatacctcatccaatacgcaaatccctgcataaaggcgaggatcacccccgctcgtgcggggaatacatatataaagtagtcataattcgcgagaaataaggatcacccccgctcgtgcggggaatacttcttcttttgctcggaaacggaagcattttgaggatcacccccgctcgtgcggggaatacttttcttgcgcaagtttccaatcgcttactttgggatcacccccgctcgtgcggggaatactccgtccattggactggtggcgctcaaaatggaggatcacccccgctcgtgcggggaatacacaatgataaataaaagtaccataataaactcgggatcacccccgctcgtgcggggaatactgaaacgagcatctaattgatgtttgttttttaggatcacccccgctcgtgcggggaatactaagccgcgaaatcgcggacagtgaaaatataaggatcacccccgctcgtgcggggaataccaactgattattcggttgatccgtcaaataataggatcacccccgctcgtgcggggaatacccattgcctgctggaaacaggtaagcatgatcgggatcacccccgctcgtgcggggaatacactaaacgatccctatagaattaacatttctaaatctccaattgcccattttcaatgagtttttccgctaacaacatagtcgcttgtgcgtcagataacgcatcatgtgcctgttcattattaatactatatttttttagaacagttgccaaacgataattaggcaagaatttttgaatttgcttaattagtgataataaatcaacactctgattgaccaaattattttcgcctagttgacgtaacgcttgtctgataaaattaaggtcgaaactaatattataaccgacgattttcaatgttccgacaaaatctcgaaaattttccatagcattatctaactccacaccttcagttgctaacttactatctgtaataccggttaattttgtgatttctttgggcaacggatgcccaagtttaataaattgttgtatgtgctctattttacctgtctgatcgtgtttaactgccccaatggctataattgaatcttgatcgatgttagtaccagttgtttcaatatctaataccacaaaagccggtatttttccactagttttgggggtcttcattcgttgctgctcatgaatacggtgatattttgcagcattactgaaacctggatgaatcggcgccttggtctctaccaaatgcattaatagaggaataccgtcataatcgataacttgacgactaacactagttgttaaaaattgatagcccaactcattgttagtgctaaaaaccatcgtagcttgtcctgagccgatgtttgtacaaatgcgcttccaaagttttaatcgaatccgcttattcacgttcccaacaaaaataccggtttgaatttcctgacaccactttgtcaaatcaccgcgtaatgacgctgggacttttgtcattgtaattactatcattcttgatcattatccttaaattcccgataagagacaccatttttttgtaatccgagtttgtcatcccataaatttagtaggtccgtttcttcagttacttcgtcagcgtttaacaaaaacttcagatcttttaccattcgcttaataattttgccgtcaacaaaagcatcacgtactgctaaccgagtttttcgaccaatatcatcatcctcatttgattcagcagcaatagtaaatgcaattggaatagtaacttctgctttatacaaatcagcaaaatcatacacaaacgccagatcatgcccagtatgaacgaagcctagacccggcgaagcgcctaatgcacaaatcacgctgtaactgaggccatataaagcctgatgagcagcagttaaagcctgattaacaggtgtacccgcattaaaatcctctggatcatattcgcgcccagaccattcaacacctgaacgagttgaccaatcgcgataaatacggcgtactctagatccttctttgccacgtaatgcttgcattgttaaatcactaacatcctcatttggaaaacgcatttgatacattttacgggccaccgcaactcgacttcgaacatttgaaacaagtttagcttgcgtttctaatagccgtgacgaatgcgttaaggcccgtccatgagcatattgtcgtacgccacgttcaccaacccataaaacacttgtaccagtatcacccaacaattccattgcacgatgcgttatatcaacaccaggtccaagcattaaaacgttaatcattgcggctggtacaaatacttctcctcgatcatcaattacggtaatggcactgtctctgcgattcaattttgcatgctctagatataaaaaactaattcgatcagacacacgaccaagctctgtcaattcgggcttctttgcaccaggtattttctaccattagtcaagggaaagttgatataatcagctttcttttttctttacccagatcaaagcggcaatattggtagtagccaatctaaaaatagtattttagggtatattaaattgatccca

SEQ ID NO: 540 - DNA, 137093 bp, Unknown
  Metagenome-assembled genome
agatggaccaattttgaaaaatgagcaaaagaatgatgaatatcagtgtcattgtattgtatagtagacataggcatgaaactcctctgtatggtttttgtttagacgctttaagtatacagatgtggatggtttcatgtctatttttgtagcaaaaaagccctaacagatcagggcttaagtggaaatattaactttcaacctttagctatcagctaataaaattgttacactacatacgatagtcataaaagtacgtttaccagtcgtaatccgtttggtcttgtaaaccgcgtccagtagctttatcaagcatgatccgttgttcaaagtgggctacattgcgttttgtttctttaaccatatctggattaacagaaacgtaatcaataccactttgaatcaggaaattcgtaaagtcgggatattccgaaggtgcttgtccacaaatagatacggtctttccatctttatgtgcagtcgcaatcaaatgatgaatcgctcgtttaacggccaggttacgttcatcaaataggctggcaactgtatcgttgttccgatcacagcccaaaatcagcatggttaaatcatttgatccaatcgaataaccgtcaataaactgattaaattgatcggcaagaataatgttggccgggatttctgccatcatataaactttgaaatcagcattacgcactaagccttcattatgcataatagtcgttactttttgtgcttcagcaactgtccggacgaatggaatcatcacgttcagattttttaggccaaattcattccgtacctttttaactgcagccaattcaagcttgaaagctgcaatatatttaggatcataataacgggaagcaccccgccaaccgagtaaatctgcagattcatgtggttcgtatttttcgccaccttttaacttccggtattcgcttgacttgaaatccgatagccgcagcacaacaggccggggtgccattgctcgtgtcactttagcgatcccctccgccaacatattaaccgctttttcggattcacctttttcaattaaatagagtggatgttcatgaatatacgatgtccagagaaattcctcccgcatcaaaccaataccatcagctggtaaggaagcgtaccgatcggctaaatcggggtcacctaagttcatcatgacacccgtagcagttggtgcgaaggtttcagctgccacaacttgaccatttgctgtattgactggtgctgactgtttaaacatactttcaactttgccacgatagacaacgccatttttagcatcaacggttactacgtcgccggttttgagcacatcggttgcggccacatttttacttctggttccaacaatgcaaggaatctgcatttcacgggaaatgatcgctgcgtggcaagtcatgcccccattattagtgataattgccgctgcttttttcatagctgggacccaatcaggtgaagtcattaacgtaaccagaatttcgccttgcttgaattgatcaatatctttcggattatcaatcacatgaaccacaccactggcgacaccaggactagccggtaacccacgaacagcaacttccgcattatctgcggtaacgtcactatcatcgctaggtgcattatttgtcttcttttctttgttgcgccgtgaccaaacagtttctggccgtgcctgcacgatccacaagcgatttgtattggtatccaaggcatattccatatccatataacagccataatgacgttcaatttccttggcataacctgctaattcaattacctgattatcagtaagtactggttgctcttgtaactcagtaggaacagcctgctccttcgtaccaccatttgggatccgcatcaattctatcggctgtttaatgatatttttttcgacgatcttcatcgattgtttatcaatcacaaaatgatctggtgttaccttacctaagacaatatactcacctaaaccataaattgcatcaatcacaattttagaggcgtcaccattagcaacattaacggaaaacatgatgcctgatgccttagaaaagaccatcatctgtactgctgctgataatgcaactttttcgtgggggaaatgctgcttatggcgataataagttgcccgatcagtaaatagtgacgaataacattgttgaacacgattaaccacatctgcggcgcctttaatgttcaagtaggattcttgttgtcccgcgaacgaagcgttaggcaagtcttcagctgttgcggaagaacggatcgcaacaaagggatcatcctgacccatttttttagctaattcagcatatgcttgcttaatatcatttactagatcttccggcattgttgcgctaataattaaatcacgaatctgttggcaggttgtatgcagttcatctgaattttcgtagtccttaatactttcaagtaaagcgttaactttatcgtttaattttgtctgatgcataaagtaccgatatgcgcgtgcggttgtggcaaaaccatatggcactggcacatccattgaagaagtcatttcccctagcgaggacgacttgccacctactaggttaacatcttcacggtgcaactcattgaaccataaaacattcgcagtatcgcgactactcatgatattacctccttgtaattaatcatgatcacttaaaccttattgattaccaaacaaaaagactagatggaagcgtttgcattaaccaactctattgtagttcaactttgtacaaagttaaagtaaattttaccatttattatgtttagactcacttacagtcggagtatatagtaatagatgaagtttcattttactcatatttagataactgagtgatggataaaggtggtgatcaataagtatccatataaaattattgtgttaggcaatagattttaagtaagtacgtctccctatcaattttgcagacaaaaaacgaagcattaacaattatttgctaacgcttcgttttaatttacttcgttaattgttcaactgctttgttataagcaacgtcattatcgctgattttcttggtgatctcagtttgtaatttatcaatcgtagcagtatcgagtttaccagtttgatccaaattattggctgcttggaaagcaacgaccgctttctgtgtagttgtactaaagtaaccattgattgttcctggatcttgaccaactgcctttaattctgtctgcaaggttttgatcttacttgagacatcctctaattggtaggtcttttgatcactgaccattggtagataagcataacttggatacttagcttcaatatttggcgttaatccgcgcttgttgatccaactgccatttggagttaaccatttagcaacggtgattttaaattcgctctttttatccaactggctgacctgttgcacggtgcctttaccgaatgacttggtaccgatcaattccacattagcggattgatttaacgcagccgcaaagatctctgatgcactagcgctaccgtcatcgatcaagactttgacgggctccttaaccttaaagccgccatcttgtgacttacctgccttgtaaacagttggttgcccagtgcgcgccttaacttgcattaaagtcttgccgttagcaacaaacatactggagattttcagagcctgttgcatgataccaccaggattactgcgtacatcaagaataaacgatttggcgccttcttggcgtaatttcttgatggctgtcttaacctctttgaaagttggttcggaaaagctggtgatctggatataaccaactgttgggtgttgcttatcaatgcgggcattaaccgtcttgactgggatcacgtcgcgcttaagcgtaattttgaagctttgttgatcccgtttgatcgttaacgtgactttggtgccttttttaccacgaatcttattggtggttttagtagcgctccaaccagccgttgagtggccgttgattgcggtaatgacgtcattggcttttaaaccagcctttttagccggactaccagcgattggcgaaacaatttcaacgtaattaccttttttctggatctccgcgccgataccttcgaagctaccagagatcgtgttgtccaaattgctggcgtcactgccggtcaaatattcagaatacggatcatctaaactattgaccatacctttaattgcaccattgatcaattttttctggtccgttttacgataatattgctgactaatggtctggtatacttggctaattttactaaaaccagcgctagaagtatccaactgttggctagtgcggctattcaaaccgacgatcaagattgtcatgaaaataccaacgaagaaagctaacaaggttgaactgatgtaaaccaataaactaacacgacgtttacgtttcttaggaacttttgactctgactttggagcttttttcaataaaatcacctattctaattcacatttaaaatcgttattaccagttaacttaacgctatagctcacttgcttgttcttgatagcgttgaaaagcctcgtcaaaaatagtcatactaggtagatagccagcattttcttctaaatactttgataaagaatcataattttggtctaacttaggaaagccttgatcaaaaaacgcatttgccgcaaattgtgcaacctcatcatgactttctgggttgcgctgggtcatcaagaattgatagaaacttttacgcatagaacttcaccgcctattcattaaattgtgggatatagacattcagatcgatcttatcattaggtaaatcgatccgagttgctttgatctgcatgccatttttcattttgaactgatttaatttcaataaaatcgttttttgcttgctatcaagtacgacccacttaggaaatttataactattgccaatatagttcataacggttttaattggaactgataaacttccgattgccatgcgccgagcttttaattggacgtcaccattttcttttacatagggatcaaagtagattgaaaatggtactggataacctaatagtttaaacttacccttaagaatcgcctgatcatcaagatcaaattcatacttaattttactgtccttcaaataatgattaaggtaatagctgatcactgcgttgacctgcgatttttttaaattaatcgcaaatgttggatcacgcttgatcaattgttcgctacttgtatcagctggtggcggtgttgtcagtttaacacccaaataagccccactgcctagtaaaattgccactaaggcgatgaaaagccatttccaccaattaagtggctttttaactgtccttttttttgtttccatactcatttcctatctattagccatttattcttttgttgcatcatgacttgatataaatcgtcggccatgacttggtatcccgaatgattgggatgaaaattatcttctgtgaaaattaactgatttttttcattactagaatcactagccgctttagactttttctgtgtcgtcaatttttcgcctttagatagttgatcgcaaatatcgatcaaataactattcttttgttgcttgatcactttagctgaagcagtgttccaattttcaacggcagcttgcattttcgtcattttaggaaaatacagataaaacggattatagataccaaaaacaaaaattggcgcctgatcgttatattgacggacgtcttgcaataacgtagctaaatgtgtggtatacgccgtttgtgctcgtttgatgtcggcttcatttaagttcaacatttgttgacgtaaaacggccattaaatcgttgccaccaactgacattgtgatcacatcagcatctttcaaggcctgctgcaagtctttgttagtccgcacgcgttgatcgatttgagtacttgtttcacccgcgatgccataattttgtgtacttgctttcacggcttgtttagtggtgagttcactcttaatgatccccacgtagccgccttgattcaggccatcaccgactccttgagtcaaagaatcgccgaccgcgacaagcttgatactttttttctttttaaccgttggtgtcgccttgggtttcacagtttgctcactgacggttcccggcccaaaatagttcagcccggcataaataccaccggcgaccaccccaataatgactagcaccaacacgatttctttaatgatctttaaaccgcgcactattaaaactcctctatctcactaaaataagttaagtttcttagcccaaatcactaataaactttctgatgttcgtggcgatgtccattcaactaaggcaaaaatcgctaagttgaaacatggttctatcttactaataacgataattatatgtctgactatagtaaaagggctttgacaaacgcgtcacagcccccattttactacaaattatcaactaatcttcagtgtaatacataatcgcaaaagcacccatacccgcatatgttgcaataattgggctagtatcacgaatcaataaaggtacattcggcaatgctgcatggatatctgctctgaatttttccataacatcattcgctgctacatgtgaaataccgatactcttaatatttggtttgcttgctaggtcagcaatcaaatcacgcataaagttattaacggttttcgtaccgcgacccttagtcctgacgtttagctcaccatcgatcatttcaaaaataaccttcatgttcaaaatattggagatcaagccagtaacccggctgactcgaccacctttaacgatgttatctaaggtcatgacggccatgtataactttgtactgttgcgcacacgatccaatgagctcaaaatagtttccttatcggcaccagattgtgctaattgtgctgcacgtaagacttgaaaggccatgccacgatcagtttcccgtgtgtcgataaccgtaacatcacttttacttaagttagctgcttgacgcgcagtattaacggtaccactgatggcatccgtcatatgcaaagcaatcacctgactaccgtcagcacccagttgatcaaataattcaatgaattcaccgatcggcggttgactagttttaggtaacgcggtcgattgattcattaattcaacaaaacgtggacgtgtgatcgttttgccatcgatataaacggtaccgtcaatcataactgaaagtggaatgaccgtgatattgtatttttcaacttcttcaggggttagttgaaccgacgaatcggttacgatttttatagttgccacgaacttcagccacactttcttacaaattgttttcaacttgctattgtcggaaaacgttaactcaaaagtaaccttctaaattaacgttggaccagcaaataaacactaatttagtatagcagattaaccttgctttttcacttgtcactctaaaaattattcgtcacggcgttggtaggtcgcaaatgaataaggatatttatttttggcgtcgatttcaccggcttgaaaagcaacccgtttaaatgctgaccaatctagcgctggcatatacgtatcaccgctaaaagtagcatcgatctcagtaacatacaagcgggtaacatattctttaaataaagcaaaaatttgtgcaccgccaataatgatcgtctcctgctgtgggtgcgcggatgcataatccaaaacagcaacgacgttatttaataaaatgacgctgggtgccactggataatccacttgttgacttagtacgatattggtacgccctggtagtggcttgcccataccagcataagttttccgacccatcactataatttgattcaatgtagtttgcttaaaatgttggagatcggcaggcaaatgccatggcaagtgtccgttggccccaatcaaatggtcgcgggcctccgcccacatgaacgcaatcgtcattttaaaatcctcctatttcacaattaaagtgagctccgacttaatattatactaaaccgcaaccggtgccttaattgctggatacggatcataattagctaacttaatatccgtaacatcataatcaaatatactatgtttggccggatttagttcaagcataggtgctggccgtggtgtccgcgtcaattgttcctcaatttgtttgacgtgattgctataaatatgcgcgtcacctaaagtgtgtacgaattccccgacttctagaccaacttccttggcaatcaaagctgttaacaatgcatagctggcaatgttgaatggaacaccaagaaaaacatcgccactgcgctgataaagttggcaacttagtttaccgtcagcaacatagaattgaaacaaagtatgacaaggtggtaatgctgcggtgggcacatcttcaggattccaagcagttacgatcaagcgtcgtgaatcaggggtagttttgattgctgcgatcacatctttgatttgatcgattgtttcgccactacgtgttttccatgcccgccattgtttaccgtatacattgcctaattcgccgtatttagccgcaaaagcatcgtcgtttagtatttgctcgcaaaaaagctttttttgttcctgataggctgccgcaaaggtcgtatcagtcagttgccgatgaccgaagtcagtcatgtctgggccatggtaatcagtactttcaacgtaatgtttaaacgcccattcgtcccaaatatgattattatgttgcaacaaatagcgaatattgctatcaccttttaaaaaccataatagttcacttttgattaagccgaaaggaacttttttagtggttaataacgggaagccttgactaagatcgaagcgcatttgataaccaaaaatactataagtcccagtctgagtacgatcatttttttgatgaccttcggctaagatctgacgtgctaaatcgaggtatgcttcttccatgatcactatttcctccttcaaaaaactattccacgtactgacttaaatagtcccagcgttgcattttagtttcgatttgttgattaagttggtcaacgtccttttgttgttgggctaacttgccgtaatcatcaccgttactttgcatggctgcttgggtggcagctagttgctgttccagctgatcgatgtcatcttccaatgtatcccattctttttgctcgttataggtgagcttagtcttttctttaaccactggcttagtcggtgtttctgtcgtcacttttggtgtagctacttttgtggtatcactagtttgctgttgcgctaaataatcacttagagccccagtaaagcgtgtaacttgcgcgttaccattgaaaactaagagctcgtccgccacttgatccaggaaataccgatcatgggacacggtgatcactgcaccattaaagttagccaaataatgctccagcaccgtcaatgtactaatatctaaatcgttagttggttcatcaagcaataaaacattcggctgctgcatcaagatttttaacaagtacagccgtcgttgttcaccgccagataatttacggatcagcgttccgtgcataaaacgtggaaagagaaattgttccaacaactgagtcacactgaccacatcaccgttacgttcagtgacggcctcgccaacttcttgcaaataactgattactcgcttatctgggtccaatggttcagtcatttgcgtatagtagcctaaacgaaccgtttcgcctaatgtgatcgttccagaatctaatggtaggcgcccagccagaacatttaagaaagttgacttgccagcaccattttcaccggttatacctaaacgagcgttgctttggaccattaaatcaaggtctttgataatgggatgctgatggaaacttagactggcctgttttagttccaaaacttttttgcctaagcgttgctggcctaagttaatatctacggtggcagcttgctcaacccctttattaacttgtgccttgagatcattaaatcgattgatccgtgcctgttgtttagtcgaccgtgccttagcaccagcacgcatccagtcaagttctttcttataaagcttttcctgtttagcggcttgttcactggcttgttcggctgcctcagcactttgccgcagatagtcttcaaaattaccactataagcggtcaattgaccaaaggctaactcgtagatctgattagtaactcgatccaagaaataccgatcatgggtcaccactaacaatgcacctttataactagctaagtattcttctaaccacgcaattgatgcaaaatctaaatggttggtcggttcgtctaaaataagcaagtctggagattcgatcagaacttgcgctaaaccgacccgcttttgctgaccaccagataattcactgatgcgctgatttaagtcagttagctttaattgggacaaaatcgatttgatctgcgtatcaacgttccaagcatcaccttggttcatagccgcttcagccttggtataggctgcctgtgcctttgtactattgccgtcaaggcttagcgcagtcaaggctttttcatatgccgcaattactttgaataatggattatcgccggtaaaaatagcttccatgatcgttaagtcttgcggtaattgtggtacttgctgtaaatacccaatacgatactgtttaggcgtggtgatatcaccttgatcaaaagtatcactaccggttaacgcatttagcaatgtggttttacccgcaccattcgtaccgatcaaaccaatgcgatcaccttccttaatgaaaaaggaaatatgatcaaatagtgttttttcaccgtaagttttagttaaattctctgcagttaaagtttgcatgacttatctacctcagtttctattgcgcccatcgtaaaagattacttccgaaaaagcaatcaactttatccgcaaaataaaagtgagagtcactgatcaattatcagcgcactcacttattaaagctttgtcgcggctgcgatcaaagctgctttttgattgggaatctgtgctgccacaactgcacgttccaaatgtgccagcaactgacctaattttggccccggctttagcgctaatgcttgtaacaagtcgccaccgttgacagcaagctcgctacgctgtttgatcggtaattgctggtacttagattgtaaagcagtttccgccacgtcagcaccataaaaataggcaatctgattagccgttagcacattagttaaacctgcttgataaaaatcccagttacttaatggttgctgggctaaaaatttttgtaaaacaggtaagctggtactcactgcatggatcaaatcattagccgatttccaatgacgtaaaaatggtttgacctgctcactgtccaattgtaactgctgtgcaatcaacaaccagaccgcagcttcactacgtaacggtgttgtgggcaatttcagtagcgctttgaacgccggcccggcattcgtaaaatctggacattgctgatataactcggtctgtacaaaactgaccagcccgttatagcgcgcctgtcccagcataagtttgacaaattcatcatgaattcgttcaaccgcaatcttactcaacaattgatgctgggcgcggatcgccacttcagtatttgcttcgatcgtaaaacctaattgactttcaaaacgtaccgcacgcatcatccgtaaagcatcttcatggaagcgctcattaggatcgcccactgcgcggatcactttattttctaaatccgttaacccagcaaatagatcgatgattgtgccgtcatgttgcaatgctagtgcattgatcgtaaaatcacgccgcttaaggtcttcacgcagtgagcgcacaaaagtgacatgatctggccgccgaaaatcttgataacctgattcagtacgaaacgtggtaacttcataagctgtctcttgttgcatcacggtcactgtcccatgctggataccagtatcgatcgtgcgccgaaaaatttgcttgatttctgctggataagcactggttgcaatatcgacatcatggatctttttacctaaaagcgcatcacggacactcccaccgacaaaataagcttcaaaaccggcctgggtgattgtctgcaataccggtagcgcttggacaaattcgtctggtaattgggttaatttcatagtaaatattcaagcccatcataaagttgcttttcttggcgcactttacggcaagctaacgcgaccccagtcataaatgattcgcgatcgtacgtatcctggcggatggtcaagccttccccgacaccaccaaattgaacttgctgatgggcgattaaaccgggtaaacgaacactatggatccgcatacccgcgtagttagcaccgcgagcaccaggaatactttctttctcattagggttaccttgtggtttatcgccacgaacctcggccaacatctcggctgttttgacggcagtaccacttggtgcgtctaatttattatcatgatgcatttcaatgatctcaacatcaggaaaatacttagctgcttgtttagaaaattgcatcattaagacagcacttagactgaagttaggtgcgatcaagccaccaacttggttcttagctgctaattcttgtaacgccttaatatcggttggcgtaaaaccagttgttcccacaactggtgagatttgatgttccaacgcaaattgtgtattagcaacggccgctttaggaatcgtaaaatcgatccaaacttccggttctgctgcaagggttgcttctaagtcagtaaatactggtgcatgttgaccgccaaattctgctacctcagctaaatctttttcagttgcaattggatcataaacaccaactaattcaaaatcagtgttcttcaataccatatgggttgcggtagcgcccattctacctttaaaacccgccacaagaatttttgtcaaaacgatcacctttttcatttaatttaatccgttacctatcatactaacaaattatgccggtaattaaaatatcggttactcgctaaaaaaaatcctaaaattagaatctgcccattccagccaagttggctaatgaattcggtataatgcagttaaaacgttttttaaaataataaggtggtggcattccatgacgaagcaagaaatacgaatacgtgatttattcttgattacattgggctgtgctttatacgcattaggtttagtaagtattaatatcaataatcatttagccgaaggcggtatcaccgggatcactttgatcttacgtttttggtttcagattgatcccgcctattcaagtttattgctcaacattccgctgattatcgtgggctataagtttctgggccgtaatgcattgctgctgaccatttatggcacagtaatgttatccgtttttctgtggttatggcaacggctgccagtacagttaaatttacatcacgatctatttatcgccggtgtaatggccggattatgtggtgggtttggtagcggcttgatctatcgcgctggtggcacgactggcggcagtgacgttgttgcccgggtgatcgaacgacaacgtggtatttctatgggccgcacgttacttggatttgatgtgatcgtactcaccttatccttaagttatctagatgttcgtcacatgatgtacacgctactcgcgtcattcattttttctcaagtggttgattttactcaggaaggtgcgtacgcggcacgtggtattttgatcattagtgatgattatcaagcgattgccgacgatattatgacacacttagatcgtggaactagcttgttccatgctgaaggtggctaccagcacgctgataaacgggtgatctattgtgtggtcgcgcctaatgaaattgcactgatcaaacgcattatcgctcaacatgatgaaaaagcctttatctcgatcattaatgtacacgaagtgcttggtgaaggctttacttatgaacgtaaacgatggtctattttttgattttggcgcagcttgtctgcgctattgttttttgattatgtaggttaaagtaacttttttatgttatactgttgttaaaggatgtgatcttattggcttacccttatcaaaaaaactttcaacattacctggctgaaaaagaattagccgatgttaccattactgaatacgcccgtaccttagatgatttctttaactaccttcatcgctttaactgggcctttagtagtgaccctagcttagacaatattctagaaaacgatgttcgtgattatttaagcatgctgctgagtcaacgcgaattaaaaaacgacacgtataataaaatactgtcgcatttaaatggctattttaaatttttatttacccatgaattaattgcccactacccaaccgttgctttaaaaggtttgagtaaagagactttgcaaccgacgattgattttgcttggttggcgcagttaccgacactgctgaccgatcagcgcttaagttactacacgcgcgctttattgttattcagtgcttacggctttactagccaagagatcttagcgcctgggttcgccgaattggctgctaaattaccttttactccagttgagcgcgatttcatgcacgatttgcacgtttacttacagccattacagacgctacaaaacagcacggaactctttttaaaaactcgcttggaccgccagcatccccaattaacggctcccgccttgcataaatatttaaaaaaagacgccccattattagattttgccctaacaccacgtaaattacatcaaggctatattctgcactatctgctgcagcatcggtcaactagcgcaactgaattacagcaacaactgcgccttgatccggcttccctagattattatcgcagtctattaccataaaaaaacggtgtggctatcacagccataccgttttttcttagcgatcatcgtcagctaagtaatcatctaataaataaaccatttcatcatcagttggtactaacttaacgtaccgctgcagtgccgctaaagtctctgcacgtaagcccatttcccggaagaaagtgatgatttcctttaggaagttaggctcatccttgaacgttgggtatgccaataaataattagaacgtgcagtctcatcgtgaccaagttcggccgctgaccgagcaaagttccaataggcctgcggatcaacatccccttgctgtaatgctggttccaacaaggcatagttttcttcatgtcgagctaatttcacgtacaaattactcaactcgatcaaggcttgcatattttccggatcgatcgttaatagctgctgcaagtatttttctgctgttgcgctatcgtctaattttaaagcgatgtgcgcacctttatcgaataacacctcattatactgatcaacagctaaacccgcctgaacgatgcgtaaagccgcttctagctgctgatcagcctctagagcgtcagcgtaatacggatagacagaactatactgcggatcctgctccaccacttgttcgaaactgtcgattgcccgggtgtaatccttcagctgcaaggcaataaagccgctttggaatagcgtgttactatccatttccccagctgggatctcatttaaataatcgcgggcctgctcaaactcaccgctattcgcatacgcaacacctaagcgctgataaagattgacctgagcaatttctgtctcaccagcagccaccaacgcctcataatgggcgattgctttttgaaattcgccactatcaaaataaaactcagccaaggcaaaactaataattggctcatcgggaaataaacggcgtgccgtcagcaatttctgctcgctgacctcatacagtccttgttgctgatagagatcagcgctcactaacagactctcggcataagctggtgaatccggtttgaccgcttgtaaataagtcagcgcttcatcagttttaccatcgctgatagcaatatcagccaaagttgttcgtaattcatcttcatcgggatactttttcaataattgtaaataggtacggcgtgcttgccgcagaaaacctaaggcgtacagatcctcggctaaactgtacagcgtttcatcgtcatcatggcgtaatgcatgattaaaggccgtcttagcttcctccaactgcccagcgcgcaattgatctaacatttgttttgcgtaactcaaattaaccgcaccttccattcgttcacgttattcaaactaaactagtttagcatatttaagcggaaaattaaaaagattgaacgcaaaaaaacagcggtgggcttttcgccagcaccgccattttttagtgttttttcttatctgatgctgcacgtagcgtagcattttctgcttctttagcttttagtttacgccggttaaagaaccagagaacaccaatcaacaagatcaagacgactgcaccaatcagtgtatacaaccaagtataatctggcttgatcgtgacatcacgcttgttcaacttagtagcttgttgcccagcgatcgtaaagttacgcttaaaatgccatttatgatccttggatgtcgccactagatccagtgtatatttaccggcctttagcggctgaccatttaaacgaactggaaaagcaaattgcgagttaggcgccatctgcatccctttattcgtttgccgatagctaattttctgactaccctgacgataaattttagctttgaccgttaattgattgatataagtggctgtaacgttgcgtaaagttgtgttgatcacattgcgataattaacttgactagcagccactttgcctaatttcatttgtggcgtcactgttttcgtattttggtgtaaaacgatcccaatgatatacgcatattgattctggacggtggttcctttagacgattcagcagtttgcttggttgcattctaatcttgcaaccgtaatccaccagcaatcacgccattcatctgattacgaggcatggtcaccttcagattcaattgttttttttgctgtgccggaacggtcactgtccgttgttcaggtcgcacataatcggctaacgaataacgtcggctggcatctgccttagttttggttttagtgtactcgacgaccccatttaagttagttgttgccgcgttaacttctggcttcaacttcacttctttatttgtgctgttggtgatcgttacactgatcgtctgttgctgacctggatcaagctttagatcgaaataattaacgtttttagtcaattgattgtcgggcaaattagtttcgactccgaaagttaattcattcgccgccaccggtcgcgttaacgtcaacaaacctaaacctagtgcgaggacagtcactaccaaatttctttttttcaacagacacacatcctttattcgttagtctatgcatttcaccaataactttctcagcgtattagtcataatttttaggtgttagctggtgtatcagtcaacgaccaagttaagtttgcggtataggcctcagcttctggatgggcggccactggtacagctaattttgcagtagaactacccgtatcgccccatttatctgcccacgtgccaaagcctttacctgcactggcgtccatgataacagttgacgtccctggagttaaagtcacatcatgtgtggctgcgccatctgcaattgaagcattagcggtgattgcggtgcctgaaaaggatatttgtgcaccatctaaagctgtatcactagcactagcaaactgtgcattctgcgtcaccagcaacgtccatcctttaggtgtaccagcacgctgatcagtcacctgaacatagttaggaatcgcgttgccagtggtatcagtatcatctttggctgcataaatttgatccgtggttggcacctcgtgggtcccaaaatctaagtcagaaacataatccaacgataatggtccagcattaccggtaccagggccaccaccaggattttctggatcggttggatcagttggatcgatgggcgtagttgggtcagtagcgttggtaaaggtagccgaggcttttgaggtcgcactagacgtctctgctgcactaacactcgaagttacgccaccaagtaataggccgctcattgcagctaccgttaataaagcactttttttcatcatctaaaatcactcctattaatttatactgtttttaatttagttcgtaagtgaaaactcgctaaacttactagaatgatcatccctaaaatagaaaaatcccaggaagatcgttcactagtttgcggtaaaactgattgctgcgattgattagattgatcgacatgctgattagcgatttgattgggtacctgcggtttcgtagtggtgggtgcagtaacagtattattagcgacaaaaccagtttgagcatgactagtggttgtagctgcctgactaatggtactgaaccccaggagtgtcgtcagtaacattagacttaaaaccaactttggaaatttcatcggcggcactcctttcacttattagctggagtctcttgtaaattccaagtgacactaccgctatattgctcagattttggttgtcccggtgttggttcaaaagctaacccattttgcgcgttccaagtatctgagattactgtattcttaccgggcgtcgctgtttgtaaactcgctaccggactagcagcactagataaagtatagtcagtaccgttattcaaataatgtaagctatcagttagcacggttccagtactggcaccagtcatctgttgtgccaagctgactgttaactgccagccattgatcgttgaactcgctggaaatattcgcgtatcattaactgccaatggttgatcaccagcggcaattttacctaagaaagtccgtttctcagtctcagtcacacttaaattatcgccgaaattaaccatactcggtgcagtaagccctaaattaccctgcacataagctaactgaaaattagcactaccaaaattacttgtcgtttgccgtgcttcaatacgcacacgataatgcgagccagctgattgtgtattcacatccggtaaataactatccggaatcgtgaattgccaactttgttgcacgttgctggcaacttttaccgtacctaacaattgctccttggcaggtgtagcaccattaccatcgcgtttagtcatcattgcgtaaaacgaaagtgtttccgcagtattatcccaaacagtgccactaacctgataatcaccaccgtagtagttattagttaacaaactgctggtaccagatgactgatcaacttttagcgaaattgttgaagacgctcttgattgtatgatacttttactgtttaaaactggggtagttgaggttgaggctgaaaactctttttcgctggtgactgaactgctagccgtcgtggtactcgaactgctcgtattattactttcagccacggacgtacttgagttgtcttctggtgttgttaccgttgcagtcgaatcattcttttcagttgtagtttccgttgcgctttgcatatcggttacggtaacggtctgttggttagattgtaaagtggtggttcgtgcttgtaattggtaagtccccgccttcgccgctatcacaggtaggctcaacttcattgccattgcggtgtgaagagtgattaccaattcagcttgttcacggtgaatactgatttgttcttcagtgacatcagctcgctgcttgaattgagcctcatcaaattccagcccggctggtaatgataaggtgatttgcgtctctgccgctagatttgtcgtagagacaattagttctttgctttccccaacttgtagttggttaaccccactaagggtaatctctggctgcgctgtggtcgccgcatgtactgaactgatcgcaacacttaaaaataggctaagtatggctaacaagttcaaactgcgacgccacatcctttttcccataagctcacctgctttcatcaactattttgctacaaactcattgtacccgatgtcaatgaaagcgcttatcagaaatagcaagttttatatcaaaaatgataataataattttatataatagctattaataaaaataaaggcattaaaaaagttattttataactaatttaacgcctttatttcagttattaagaacgactaagcccttttcaattagactcatttttataactatttttcttatatttttaaaatatcgtaaactagctaaatcagcaaaacgataaatcggctggctcttttctgtctccgtcaattgtcgattagtcagtactaagtcataatcatgtcctggttgataaggcgtgatttcgatcaaagcttgtcccgctaaatattgatgcaatttattgatcagcaagtgcaccgtactgtctgtaaagtcaggttctaaaccaagcttaagctcgtgagtctgctgaccttcaaactcatcaactactaataataaacagcgcctgaagtaagcctcatttttgagtacgatttgacgtaacttcacacaagtactctgcttaattcgctcaattatctgctcgacatttcgctgaatttcaaccggaaaataaaactggcggtaataatcagcccgcctaggcgtaaatttactgagttcgccggtgaataaatacggccgggccaacgtatcaaataacgccttggaaaagctgaagccccattgttccggctgaatcgctagactttgacataacaaacgattaaacaccgttagtaactgactaagttcagtgtcattatgcaagtaaatatctgcaaactcccacactaaagctgcttgactattaaaaacagacatcccgaccaacatcgcaaacaacgctttggtttcaaaatttactgccgtcgcatccgtttgaccgaataactgacgatagttagcgttcatttgatcgaataaaacgttattgcgacttaaatcaatcactgccgctggtaaacgccgatcaaactgcgtaatcgttaactggcgctgccgagaaatggtgatccataacttgattcgctgtgccgcaactgcattaaattgataagcaaaatgttcttccaatccgcgaatatattgatcatgtaaaacattctgtttagttgctgcaattggaatcaaagtaaataattgataataaaaataacgaatctgtaactcggtgccacttaattgtccttgtttgatcgttaatttaaattcggccaataatgaatttaattgttgcaaatgccggtacaatgaggcctcactgagcgccaactcaaaaacaaactccggtaacgtcactttgcctttttgataaatcaacatcagtatttgataattgattgcattacgaatcgcttgatcataatatagctcatcaaacatgacctgacccactagttttagctccagttgattagattgaatattcaaaataaccgcacccgcgttaatttgtggcgctaatagctggtttaattgcgcaatatagcgattcaacgatgataaagaaactgctaactcttggcttaatttctgtttgctaacggcaccatcagctaagtaaagcgcctctagtagcatcaccacgattcgatcttgtttatccagtaaatccgttttaaacatgtcgacctccttctactattagctagtccttttatttaagttaattttaagatgaaggtacgattaaactttagccaaaaattgaagactttgtgaagtcaattaaacgcctagacacataaaaggctgccccatcaatccatgacggaacaaccttattctgagtataaaaaaactagcaaccgaaattgctagttcatcatacattatttaactgcatcttttaatgctttaccaggtttgaatgcaggtactttgctggctggaatttcaatttcagcaccagtttgtgggttacgacccttacgagcagcacggtcacgaacttcaaagttaccaaaaccaatcaattgaaccttttcgccttttgctaatgtatcttggattgaaccaaagacagcatcaacagcagcagttgcatcttttttagtcaaaccagtttgactagcgacgttttcgattaattcagctttgtttgccatagtgaatgtcacctcctgagcaacaattagaccgtagtctaatataaaatgagtaactgcatctgcagttctgaaataatggttaacaacatcatttctgaatcaaagatatcataggaacgccttgatagcaaggttttttcacatttttaagcgctttttaccgaaaaagtgcgaaatatgagaaaagtcttcataaatcgacgtttttattgctagatcaaggtttaacctacttccgccgccgcacaataatatgcactggcgtccctgaaaattcaaacgcatttcgcaactgattttccaaaaaacgttcatatgaaaaatgcatcatatctggatcattaacgaacacaataaatgttggtggcttaactgcgacctgagtcgcgtaatagattcgtagccgtttaccgttggatgatggcgttggattagttgcaatagcatccaataacacatcatttaacgttgaagaagcaatacgccggctctggttttcgctaactttttcgatcatacctggtatctggcttagtcgctgcttagttttagcggagacaaaaacgatcggcgcataatccaagtaagcaaaattagcgcgaatagcctgttcaaagttactcaacgaatggttatcctttttcaaggtatcccatttattgacgacaataatgatcccacgacctgcttcatgcgcatagccagcgatcttcttatcctgctcacgaataccttcttcagcatttaaaaccactagcacaacatcagaacgatcgatggcagacattgcccgtaaaacactatatttttcggcattttcataggccttaccccgcttgcgtaaaccagcggtatcgatcatattaaattccgtaccgttagccgcagcaaagcgcgtatcgatcgcatcacgcgttgtaccggcaatatcagaaacgatcacccgattttcgcctaaaatagcattaaccaacgatgatttaccaacgttaggccgcccaatcagactaaaacgaatccggctttcatcttcaggttcaatatcagttggaaaatgcttgatgatcgcatccagcaaatcgccgacaccgataccgtggaccccagaaataccaattggttcgtcaaagcctaatgcatagtagtcataaatatcctgacgtaaatcctgattatcgactttattgacggccagaacaactggcttatcagaacgatacaggatacgcgcaacattttcatccgcatcagtaatgccttctcggacactagtgacaaaaacgatcacgtcagcctcttcaattgcaatctccgcttgttccttaatctgttcaacaaaaggttgatcaacaatgtcgatccccccagtatcgatcaagttaaactcatgacccagccattcagctgatgtgtaaatccgatcacgagtcacaccaggcgcatcatcaacaatggatacgcgttgaccggcaatccggttaaacacagttgatttaccaacgttgggtcgaccaacaatggcaactactggttttgccatattatcgcctactttcttaaaattttcatcatcatttaattataaattttcagtcacttgataatagcacaaatcgcactaaaattatagactatcaccgtttgactaagttaggtgcaaataaaaagagattggtcattaccaatctcttccaccactacctaagatcaattatttttgatcgtcgtcagtactgtgttttaattcatcaccaatcaaatcgcctaaagtgaaaccaccttcgtcgttatcttggtaactagaattattttcttgataatcatttttttcagcttttggtgctgaatgactctcttcaccggctggttttgatgttaaagccttgattgacaatgccaaacgatgagcttctggattgacttcaagtactttaactttcacatcttcaccttcagaaagaacttcattaggtgttgcgatatgctgatgtgaaatttgagaaatatgcactaaaccttcaacgccagggaagacttcaacgaatgccccaaatgtagtcaaacgtttaactgtaccttccaaaacgctaccagcaggtgctttttcttcaatatcggtccaaggttctggtaaagtagccttgattgataatgaaatccgttcgcggtcagcatcaacagacaagaccttaacggttatcttttgaccaactttgagtacatcagatggtttttcaactcgatcaaatgagatttcagaaacatggactaaaccgtcaatgccgccaagatccacaaatgcaccaaatgatgttaaccgggctactgtaccttcgacagtatcgccagcttttaatgttgctaatacatgctcacgttgttcagccttttcagcttcaacgattgcacgatgagataagatcaaacgattttcgcttggttcgatctcaatgatcttcaattctaattctttacccttataagcatttaagtcatcaacaaaatgatcttgaatcattgatgctgggacaaagccacgaacgccagcatcaacgaccaagccacctttaacaacttcggtaactggtgcagtgatgttttcgccagcattaaatttgtcctgaatttcagaccaaactttgcgggcttcgaggcgtcgcttggaaagtaagtagctaccattttccttgtctttgccaattgttgagatgacaacaagatcaagaacatccccgaccttagccacttcattaatatcagcaacaggttggctagctaattctttgacgggaacaaccccttcaacaccagtaccttggataccaacgatcaattgcttgtcatcgtcgatcgccaagatctcacctttcacaatgtcaccgacttttacatcgtggacgctgtttaatgcgtccgccatggcatttttattttcaacttggtttgtattatcttcgctcatgccaaaatcctccttaacagcttgaaactacaatatctattttatagtaaaacggcttgaattgccacaaaaagctgctatttattcatatctttctgtttttcgttagtgatcgcgatgatttttgcaaccacctgttcgattgacagcgctgtcgtatcaactaatacagcatcctttgcttgtgttagtggtgaaactgcacgcgtcgaatcttttttatcgcgaacctcgatttcttgctgcaaaaccgccaaaggtgtatcgatacccttgcgaatattttccgcatatcgtcgttgcgcccgctcagcaacactggccaccaaaaagatcttgaccgctgcattaggtaaaaccgccgtcccaatatcacgaccatccatcacgattcccccagcagccgcaattttttgctgatgctgaacgagttgctgccgcacaccgcctaaagcagcaacggttgaaacattattggtcacatccggttgccgaattgcttgggtcacttcttgttcatttacaaaaacttgttgctcaggcttacctggcttaaaactgatcgtgatctcagccaaaactgccaaaaccgctggttcatcatgcaaatcaatttgtttttgcattgccgctaaggttaaagcacggtacatcgcaccggtatcacaatatgtatagtgcaattgtttagccaccaatttggccaccgtacttttacctgctgatgctggcccgtcaattgcaatttgtaaagctactgtcattattcaaaccccttatccaaaaaaatcgagatcacgacctacgccgcgatctcgccataactcaattttattatttaacccgtaattgttgtcctggcttgatagtactagtactagtgagtccatttaactgcaaaagttcagaaaccgttaagccattattagcggcgatccgatagattccttggccagcaccaactgtaacatagctaccgctggaactgctagcactactactcgaacttgctgctgagcttgaactagcatcacttgactcactggttactgagctcgcatcagcgtcactagtgctatccgtcgttgtactagcagctgcttgtgttgaatttgtgtctgcggctttcttactagtggtcttagtcgtcttttttgatgatttgaccgcaacttttttagctttagaactgctactactagaaactgagctttcagtggctacgggacgattcatctgattttgccaaatcgtccatgcaccaacgggtaatgctgctaaaactagtaaagcaatcgttaaaatagtcacaaataacgcattactcttatctttgcgatgggtcgctgaccgtgacaaattacctttatcatcgcgatcatcctcaaatttggcgtcccaaggcttatcatcagttattttctgatctcgtttactcatcaatgctccttcttgctcaccaagcgtcatgttcaacaggaaataagccagtgagtaactagcatgtgagcaattagcaatagactttcctgccaaacctacagcaaatattgtaacataatcttatttaaaattctttaaatttcgtttaaaactatccagcagtcaaggctcagaatcaaacaagttcagcatgtactatctttttaactgcagtaatcgcgatcatttaattcgtgaaaagtgctgccaaacgttcctgccagttttgatcaactgctacagtatcggtcgccgttgccggtcgaatcaaagatagcgccgctaagtccaatggttgtcccgcattacaacaggtggcatcatgaacaatttttgtcgtatcggtaaaataattcagaataaattgccgcttacaattaggcgtctgcaaaaaagccaacatactccgcaatgccaataatttttcgttacgccgtttagcaaataattgttgtaccgccgcctcactttgatgatgctgacgatagaattgcaataattcaatttccggaattgccgcggttgcaaagcgctgtggctgcgcaaaatattgtttgatcaaagcagcatcaggcaatgtattggtcaccaagttagcctgcagctgaaaatcacgtgcttcatatagtaaaatagccacgctttgctgcccatctcggccggcacgaccaatttcctgcaaataactttctaagctgctaggcaagtgataatggattacaaagcgtacatccgccttattgatccccataccaaacgcattagtcgcacaaataatcgccaatttaccatgcataaattgttgctgtacggcaaaccgatcctgactggtcatcgcaccgtgataaaaggccactcgtgggctcactttttgctgcaacaaagcagcaatttcttctgccttttgtcgactggaaaaataaatgatccccggttgtttgagttgctgacataatgccactacgcgctgatttttttccgcctcatccgcaacttccgccgttgccaaataaatattacggcgatcaaccgaatgaacgatctgtttcgttgcttccggatcaaggcctaatttagccaaaatatccgcccggacacgcttagtcgccgtagccgttaaagctagagttgcctgcggcctgatcgcggcacgcaatgattttaaagctaaataatcagggcgaaaatcgatcccccattgagaaatgcaatgagcttcatccacgactaataacgcaatatccaattgctgtaacttacgccgaatctgttcttgattagccatttctggtgatagaaaaataaacttatactgttcaaaatgcgctaaactataacgccgcatccccggatcaagtgcggaagttaacgcaagcacccgcttttcgcctaaataatgcagttgtgcgacttgatcttgcatcaatgacagtaatggtgatacgatcacaatctggccggcaagtaaataacccggcaactgataacacaacgattttcccgttcctgtcggtaaaatggcgaacgtatcttgaccgcctagaaccgcacggatcacctcagcttgtcctggtttgaacgccgtatagccaaaacgctgctgcaatgtttgcatgatctgctccatctcgatcacaagcttttcctccgttcgatctgatataagcgaaattcaaagaaactaagcgcagtattggtcaattgatcaaaccgccaatcagctagtggttgatcactaaaagcagttgccagttcttggcgtgctggcgctgataaataggttgcaaaaggaaactccggcaataaaatagccgcttccagtagatgctctttaagcgtatttaacttgactcggcgttgtcgactaattgcagctaaagtattaccttgctgtaataagttgatggtttgcgtggcactttgacttaagggaccactagccaatggttgccataacgctgccagcaatggaaaacgcgcggcttgtgcggtgaccaagctcaacaagtgatgactaatatcttgccgcaccaactcaccagttaaagttgtccagcccgctaattgatccgcttgggctgtcgttgctcgctgcacctcatgccccaacaaaaattgactataataattagcttgcaccgttggtaatatcgctaaaaaaagttcccactcatgctgtaatcgttctgccacgatactgatatcctgttgccgcaaccactgtttaacccgctgctgtgtcaataaactaactgccaatggaaaataacgccgattatgcgcctgtaactctgataccacctgcgtcgctaaaaataaacgatcactaaattcacggctgtgttgaaaagtaaaaccagaataatgttgcggcagaaaaactgtcgcacgatgcgcttctttaattgctgtaccagcagcggttaaacgaactgcacgggtctgctgttctaataaaccgtccgcaatcaacctagctaaggcctgctgaaattttgacgccgccaaatggggcaataattggtataatggtaatagatcgtaatccagtccagcataaagattcgagaccgtccgtttacctttaagcagtgcttgaatcgctagtggtcgacgccactgattttgatcgaataaataaagtaagtataagcgatcgtccattttaccaccttttagtcttattctagccttatatcagtccatagaacaactggaccaattattaaccttaaattctaaggagtctttacatgtatagccgtgttcaacgtgaagaatgtatcgcctgtggcttgtgccaattacgggccccagcactatttaactatgataaagaaggaattgcttattatcgtcctgataacaatcaggggaccacaccgattccgcccgatcagctagcagcctttaagcaagcatatcgtgattgtccgactggcgcgatcaaacggcaaaataagccattcccgccagaaaataaaagtacgacgcacttataagcgccccgcacgatcattcaaactataattagttcgtattggctaacgcaatttgccagtacgggctaatttttttagagccgcaacttcttgtggttgcattggtcgtgaatcaccagcagtcatcccctccgtggttaagaaggcgtaccgttcgcgacttaatttattgactggatagccaactgcttgtagcatatcccgaacttcgtgattcatcccttcatggatcgtcaaactaaccaacgccattttctttgttcgatcagtggacaataccttaactttagctggtgcggttcttttcttttctaatttgaccccagcacgtaattttttcaacgcttcaactgtgggaataccttctactttcgctgtatattgcttttcaatccggtaacgcggatgagtcaataagttggccaattcaccatcattagtgataatgatcaaacctgaagtgttatagtctaaacgcccgattgggtaaagacgttcattgaactcagggaaaaagtcgatcactgttttacggcctttttcatcgtgagcagatgagatcacccgccgtggcttgtataataagaaataacgtttttgttcggttgtgaccggcacgccatcaacttcaacatgatcatggggctcaacttggatccccatttctttgaccacttgtccattgacttgaacatgaccagtactgatcagttgttcagccttacgccgcgaagcaattcctgcagcagcgatcactttttgtaatctttccattaatgattttcttccttatcttttaattgggcttcaaattgtgcaaatagatcttgattggtggttgccgtagttgacgcatcagcttcaggcatcggcaacggtggtaattcggccattgatttcaaaccgaaataatccataaaaaaagcactggtgccatagagaatcggtcggcctggcgcatttttacgaccccgctcttcaatcaactgacgcaacatcaaccgctgtaaggccccaccactttggacaccacggatttcatcgatctctacccgtgtaattggttgcttataagcaatgatggccaaagtctctaaagaagcttgactcaggttagtcgtcaatggcgtttcaaaataacgcttgattaacgctgcgtaagctttcttagtcactagcttatagcgctcaccaaattgaaataaaactaaaccacgttgattatctgcccgcagctgttccgcaaaggcactcaacgcccgcttgattgtcgcccgcgatgcggacaataaatgatctaattcatctaaactaatgccgtcatcaccgacaacatacaacaaactttctaactctgccgtgatattcatgcaacttcctctttcaaggcaaccgtgatcggtgctaacgtttgtgcttgaaaacaagcaatttgcttattcttcattaattctaacaccgccataaaagtcgttacggtttcttcgattgatggttcgatcgaaagtaaccgggtaaaatctaattgtccttgcgcactgtgccgcaaagcttgagtaatctgtgtcaccttttccgcaaccgtaatcgtctcacgctgtacattacgcgttaccggcgtttgtggttgctggcgccgcaatagggcagtgaaagccgctgtcagttcagtcaaggccaatggctgatctggcatcggtattggttcagcactagccaataaactaggtgctttactaaaataatccttgcgttcctgctcgcgattttgcagatcagctgccgcttctttataggcctgataagtcaaaagttgtgcaaccaattcatcacgcggatcttcactatttacgtcttcatccagtaatggttcttccggctgtggtaacagccactgacttttaatacgcattagcgtcgctgccatcacaaaataatcgccggcaacttccaattgcacttgttgtaatgaatgcaagtaatctaaatattgtgacgtgatcgccacaatgggaatatcataaatattcatttccgaatccttgattagatgcaataacagatctaaaggaccctcaaattcaggtaacttaaccgttaaggccactaaactcatccttcttatgccgttgttcccatttaccgatcaatggggaagtggcaatcgtacccattaatttatcggctggatataactgcgctaattcatctaaaatcgtaaaactattaccttcatcgcgatcggatggacttaatgacaagtgccgtacgatcaaataatctttactttgctcgaccccaacgacacctgctagatcaccagttgtatttttccataaaaacagctgccgaccagtctcattttgataccattcgatctcagctttcagatggctaacatcattcagatcaggaataaaggaaagaagacccatcgcgatcttctcgtagtccgttttatactttaataacatgctagacctcccagcccttaccgcttgtttctaaccatagctatcctatcataacaatatttccgacacaatgctactgtcagttaccaaataccaggcttaggcccggggatgatagcgatcgtaaacctcacgcaaatgcttttgactcacgtgtgtatagatttgtgtggtcgaaatatcagcgtggccgagcagttcctgaaccacccgtagatcagccccattttccagtaaatgggttgcaaacgagtggcgcagcgtatgcggcgtgatgtctttttcaattcctgcagcacgcaccatctgcttaaggtttttccaaattccctgacgtgtaaatggccggccgtaatgatttaaaaacaaaatcggctcactttggcctgccttcaaaaaagtcggtcgactcgtttctaggtagcgtttgatccattcgatcgccacgtcaccaattggaattaaccgttctttatcccctttgcccaaagtttgaatcagcccaaggctcaaatgtagctcagccaatttcagatgagttaattcactgacccgcaatcccgttgcatatagcacctccaatatagtccggtcgcgaatgcctaaagctgttgtcgtgtccggtactgctagcagccgtttgacctctgcttgcgataaaacctggggtaaatgctgttgtttcttgggtgagtcaacttgttgcatcggatcaatagtgatctgttcagtttccaataagaaccggtaaaatttacgtagactggacaccatccgaataacgctattattagccattgcttgcgcttttaaagttgccaaaaagttgaggatcacaaaccggtcttgtttaaagtcagctaatttttgttgttctaaataagccttgaatttcattaaatcacgtgtatagctgctgaccgtattttgcgatagtcctttttcgactaataaataacgcttaaaatcagcgatctgattcgtcataacatccaaaagggttccaactctctattcttgcttagctttagcttcccgattacgccgctgacaatccgcacagatgccttggaaagtcagtttatgatcttgaacttgaaaatgatattgctgttctacaagccgctcaacatcatgcagtagatcttcgtacacttcttggatcttcccacactgcaaacactgtaggtgatgatgaaagtgatgctgagcaccttcacgccgcagatcatagcggatcaatccatcagtaaaactgaccttgttaacaatatttaactcggttaagatttctaatgtccgatatactgtcgccaaaccaatgtcaggcgtagactctttgactagcaaataaacttcttcagcgcttaaatggcccgtttcgttttgcagcaaagaaaccactgttgcttcccgctgtggtgtcaatttgaacccagcttgatgtaattgtgccttgatttttttcacatacgcctgatcgaccatcttgatcccccgctttcacgctcatcacttattcttcgttttgttcaaccaaaattgtttcgccagcgatctgtttgatcacacccgctttcatcaaatggcctaacgcacgcttaaactgccctttactaataccgaagtattgcttgatatcttcaggactacttttgtcagtgtacggcattttaccttctggttggtgctgtaaaaccgctaaaatcatttgtgcatcgtcgccgattgcttcataagcacgtggccgtaaagaaagatttaagattccgtcaggccgaacaccgatcacccgtgccttaacgtgctgacctaaacgtggttctgcatcgcgttcactggggtgaatgaaacctaaatagtgttccgaagtgaagacataactgccaactacttttagtcgataaatcgtgccgacaacgttggtattttttaaactggcctcagcttttttagccatttgctggaaccgatcttcatcagctaaatcgccccataaacgtcctttattatcaacagtcaagctgaccagtaaataatcacctcgtgccggccataattgcttcatcgtaggtagttcatccaacgaaacgacgacatccttattaggcaaaccaatgtccacaaagacacctagatcatggcgcaccgctacaactggcacaaaatcgaagcgaccaatctgcacccgtggaattttagtagtgatttgtaactcatgattctcattttcgtaggcaaacccagtaattgcatcggtcaccttatgttctttagtaaattcggatttagccacccgataggtgaagccatcccgctgtgcaaaataataatcctgattctcatcggtaacggttaccgaaattttttgtccaattgcttgatttactgccataatatctcctatctcacattcagctttatgctgtttttatttaattatttgatcaatgataatgactgcatgacttgaataattacaaaagttattccggaagcgatcactggaccagccgcgatgcctttgaatagaacaacccccataatcgtaccaaaaaccaatgccaccgtgatttctggactttgggataatagcccaacgcccttactcgacaagattgccaccaaaacaccacaagccaccgcaacaaaaccgactggcgacttaaatgcattcagtaaatccttaaaaccgatttgaccagtcgcaatcggcaccaagatagcgacggaaataaccgtcactccccaattaatgcctttagcctgaattgtcgttaataatttctgggtgttaggaattaattttaaggctaaaaccaccagcgatgcaataactaatgactgatttttacctaaaaaagcgaccactaaaataatcgctaaaaatagccaactttccatgaaacctcctcagtacctcaactttgcagattagaaaatcgataataaggtatctttaattttatttagtctattcatgtaccatttttatttctgatcatacttttattaatcatagcacaaaaaaaagccgtcgtgtcaaacacgacggctttaatttaaaaattaaattgcgttagaagcaccacgatagatgatcccacgacgtgaatcaactgtaatgacttcgtcatcagcaatcaatgaagtagcatcagttgcaccaacgacaactgggatacccattgcaataccaacaacagcagcatggctagttaagccaccagcttcgacgatcaatgcgcttgatttttcaatagctggtaagtagtctttatcagttgtcttaacaactaagatcccaccttcgacagctttttgattagcttcagcagctgaagtagcgataacagtcttaccgataacggtttgatcgccaacaccttggccttcaactaattttgaaccgatcaattgaatcttcataacgttagttgtaccacgttcgccaactggcacaccggcagtgatcaagatcaaatcgccttctttagcgaaacctaaatcttgtgctttttgtgaagccaagttgaacatgtcatcagttgatgcaggcttgtcagttacgattggttgaacaccccagttaacggctaagccgcgacgagtgcgttcgtcaaaagtaattgccaagatatctgacttaggacgatacttggagatcatccgggcagtgaagccagattccgtagcagcaacgatcgtacggatacctaagttacgagcagtatgggcaacagattgaccaattgcttcagtaacatcagttttgctgaattccttcaaagcaaatgaatcttgatcgaccattgacttttcagcacgttcagcgattttagccattgttgcaacagattctacagggtatttaccattagcactttcaccagaaagcattgttgcatcagtaccatcaaagatggcgttcgcaacgtcagtagcttcggcacgagtaggccgtgggttttcttgcatagaatctaacatttgtgttgcagtaataactggtttgcctaaaacgttgcacatcttgatcaaacgtttttgaataattggcacattttcaacaggaatttcgacacccatgtcaccacgagcaaccattaaaccatcagaaacctttaagatttcgctgatgttgtcgataccttcttgtgattcgatcttagggaagatttggacatgttccatgtgcttttcttctaacaattcacgaatatctaaaacgtcttgtgctttacgtacaaaacttgcagcgatgtagtcaatatcatggtctaaaccaaaacggatatcagaagcatccttttcagtgataccaggtaagttgattgatacaccaggagcgttaacacctttacgggagccaagtaaaccatcgttttgaacttcaacgacaagttctttgttagcatcatctttttcggtgatcttcatgtcgatcaaaccatcatcaaataagacatggccgccaacatgaacgtcatcatataaacctgggtaggtaaccgcaatcttgtctttagtcccttcaatggattcatccattgaaatacgtgttacatcgccggttttgaaggcaattttaccttctttttcaactgtagtgcggatttctgcacctttagtatccagcatgaagccgatcattttaccagtttctttgactgcatcacgtgcttgttgcatccggtcttcatgttcagcatgatcaccatgtgagaagttgaaacggaatacgttagcaccagcttcgatcaattttttgattgtttctttgtcggaactagcaggaccaagtgtacttacgatcttggttttcttcataggtagaatctctcccttggaattttttataaaaagactttaatgtcatttttatcgaattttgaataactacttagattagtaagaaatatcgttgtttaagtcaaacaatgataattcagcatggtgtttggaatcgaataaatcaagaatatcatgagcgacgatcttgttattttcgataccaacagctaagccgcctttgccttgtagcaaaagatcaacggcataagcacccatttgtgaagccataacacgatcacgggctgttggtgaaccaccacgttgcacgtgtcctaagaccgttactcgtgtatggaaatcaccgaatttgcctaattcttcggcaaactcatcagcgtgcataacgccttcagctaaaataatcaagctatgtttcttaccccggttacgaccagcgcggatcttgtcagcaattgcttgcatatcaaaatctttttctggcacgatcacggcttcagcaccaccagcgacaccagaccataaggcgatatcaccagcgtcacgacccataacttcaatgacaaaagtccgttcatgacttgttgccgtatcgcgaatacgatcgactgattccaaaacggtattgaccgctgtatcgaaaccaattgtgaagtcagtgtaaggaatatcattatcgattgttcctggtaagccgattgcgttataaccatgttcagttaaacgtaaggcaccatgatatgaaccatcaccgccgataacgactaatgcttcaataccaaacttgtttaattgttcaataccctttaattgaccctcaacttgagcaaattctggatatctagcagaatacaagaaagttccaccgcgctgaatcttgtcaccaactgaggattcgtccatcttgaagatgtccccggcaactaagccagcataaccgtagttgattccgtatacttctagtccttcgtggattgctttccgagtgactgcacgaattgccgcgttcatacccggcgcatcgccaccactggttaaaatcccaatgcgtttcatttcttcacctcaggcattttgtttaatttgttaaagcacaagcacctgcactcaaacccagacaatatcataccacttttcagaaaatatgtctgctttatctttgaatttttcatcacaaattcactttaaatcggtttcaatcacggcgccggcaacgtttgcgctttcacgaccacattatcatcgcctaaaacagccgctaactgttcaaccacttcactggctaagtcgatccaataattttgccgcaataataatttacgcttcgttgtcggataaaataataaaactggggttgcgcccttgtgtttttgcaacaacttttgcacttgcgtggtctgagtcgcctctaaacgcagaaataacattttttgcggcaattgttgttctaaatcagctgccgcttgaatttgttcggcgatcaactgcaattcaccacgttgggcatccgctttacccgccacataaatgacttggcccttttccaaccacggactaatttgtcgataaagacgcggaaaaaccgtgacatccacttcatcggtaggatcatttgccgtcaaaaaagccatttgctcaccgcgcttagtccgaataactttaatacgcttgacaaataataacacggcttgccgtttaccggccactaattcgcttatcgccacagtcggcttaagccactgtaagttggcatatttttctacgggatggccagataagtaggcacctaaataagtttcctcttgatctaatttttccgccaagcttaaatcaggtaccgcctcttcctttagagctaattcttccgccaataattcgctttgcccactaaaatttgtattggcgatcaattgcggtacccgttttaagagcgccccacgattgctattgaactcatgaaaagccgcactatagatcaacggttctagataattcatgctcaacaatttatcatctaacttggccaaacgttgcaaaaattgctccaacgaagtaaaacgaccattggcccgccgttccgccaataaatcagtaacaaattgacgtcgtaagcccttgatacataataagccaaacaaaatcttgttcgggcgccgaacagtataagttaactggctctgattaatatctggcggtaagatcgtcaagtgtctttttttggcctcagccaaatagcttttagttttagtcggattaccgatcactgagttcagcaaagccgcaaaaaaagccgccggataatgtgccttaaggtaagctaattggaaagcaaccatactataggcgaccgcatgggatcgattgaaaccataattggcgaaacgctcaatataatcatacatttgagttgccgactcccgggtatagccacgttttaacgcgccggtgacaaattcatcccgtttagcatcgatcacggcctttttctttttgctcatcgcccgacgcaaactatcggcctcacctaaactaaacccacccatagctgcggcaacctgcatgacttgttcctgataaacaagcactccataagttggggccaaaatggtggcgatccgttggtcaggatagtcgggctccttttgctcgtgtttacgttgaataaacgtgggaatatttgccattggccccggtcgatacaacgcattgaccgccacgatgtcttcgaaactagttggttgtaattcacgcaacacatttttaataccactcgattcaaattgaaagacaccatccgtatcaccacgctgaaataaagccaacgtagccgcatcgtccaatggtacttgtgcaatcggtaaaacttgcccggtttgcaacttgatcaaatttaaagcgttagccaaaatactaagattacgtaaacctagaaagtccatttttaacaagcctagcgcttcaacatttcccatcggcaactgagtcaataaaataccttcgctaccggtttgcaaaggcaaatagtcagtaagatcctgatcacttaagacgatcccagcagcatgggttgaataatgtcgtggcaacccctccagtttagtggcagtagcaaataaaagttgattacgcggactatcactgaccaaattacgcaaacgtaaagattggtcataggcggtttttaaatcaatatgcaacacattaggcacagcttgggaccaatcggccatttcaaactgagtcagccctaaaacgcgcccgacatcccgcaatgcctgcttagctgccaacgtcccgaaggtgatgatctgcgccatatgctgttgaccatatttttcatgcacatactgcagtaactgctcccgtttattatcaggaatatctaaatcgatatccggcatgttgtgccgttcagggttcaagaagcgctcaaataacagattatattccagcggatcaacttcagtaatggctaatgcataagcaactaaagcgccggccgctgaaccacgtcctggtccagtcagaatattgaccttatgcgcatactgcatgacatcccagataattagaaaataatcatcgaaacccattttctggatcacgccaagctcataatccaagcgttgctgataggcaggcggaatcttaccgtcactaaagcgctgctgcaatccagtttcagcgacctggcgtaaataaacgtggcttgattgcttggttggtacgggaaacttaggcaacaacgaattgtgtagcttgatgtctaattgactagcagccgccaatttagtcgtttcgactgcagcagctgctaaaccattagcctgataacgctcggcaacctgtgctgctggcatcaagtaatgggtaccatccgcctgagtcgtggtatcttctatggtcgtaccggctttgatgtgttgcaaaaccgttacactaaaagcatcttgtggatccaagtactggacatcttctaaggcaatcaacggaacattactcagctgacttaactgctttaatgcggctacgtatggttgcccttctggttgtaaactgacaccaatacgtacttgcgccggcgcaagtgcctgcaagcgttgtacataccgctgtgcttgcggcaaatcattgaccgccaattctggtaattcagcagcataagccggggtaatcaccgctagatgacttaaatagggctgtagctcagccaaagataataaagtttcactagtcataacctgagttgatagctttaataaagtttggtaccccggatgatctaacgcataaactaacaatggcgcagcttgttctgccgcaaacaccccactaggtgcaatggttaaacccaagattggttgaatagccgctgcttggcaagcgttataaaaatcaatactagctgataatgattgaaaatcagttagcgccagcgcaccgtacccccgctccttagcatttttaactaaatcggcgatcgtcaatgaactttcaagtaaactataagcactttttacttgtaattgtacaaaggtcaactcgccacatcctttctagcgtgtcaaggaagatgttcaggatctgagcatcgcctagcaggcagtccaccacgacctcccttttttgacacagtttcccaattaaaattatttactagcaaacagcattagtgaatcccaacgatccgcgttgaatcaatcgtattatgacgacttaattcaaccgctcacgcaaagcactacatgctaaaatgaatactcgttaatcatatgcggtaacccctcattacagcaaaagtataccgtcaaaacacaaggttactccacaaaatcattactatactaataattataacaaacgaaaacaggttcccctagttgattgaattttttccaacaacactataaaaatcacagctaaacaatgaatcatcgctttcacttatccgcaaattatgctaaaatcagcaaagtagaaagaggtggcggcatgaaagaaattatcgtcgttatctgggcattagttcttggccaattagtaggttacatcggttccgccgtaacttcattggcgtacagcccagtcactgtggcaatcatttcggcaattttcggattgatcgtttgcattttaccacatgttttgaatacgaaagcgacaacaagtaaataaaaaaagaccggcgtaactcaccggtctttttttatttagctgtcttattttcgaacaccaattgatcatttaacaaattaatattgatcgtagtatgtggcgcaacgcgaccggcaatgatctctttagctaatggggtttcaacctcacgggtaatgaagcgccgtagtggccgtgccccaaaagcaggatcatatccttgtttagccaaccactgcttagcactatccgaaatcgttagtgtaatttcttgatttgacaaccgttgttcaagttgttgtaataatttcactacgattgcttgcacatcacttaagcttaacggtgtgaacataataatatcgtcgatccgattcaaaaattctggtttaaatttagtttggatcaattggcgaacttgcgcttgactctcagccgagatttgaccctgatcatcaaccccatttaacaaaatctctgaacctaaattagaggtcatgatgatgatcgtatttttaaaatcaactgtccggccttgaccatccgttaaacgcccatcatccaaaacttgcaataaaatgttaaacacgtctgaatgggctttttcaacttcatccaataaaacgatcgaataaggattacggcgtacagcttcagtcaattgaccgccttcttcataaccaacataaccaggtgctgccccaactagacgtgacacggaagatttctccatatattcactcatatcgatccgcaccatatgcgattctgaatcaaataaattttcggccaaagctttagccagctcagttttccccacgccggttgggcctaagaacaagaatgagcctaaaggtcgattaggatcctgtaacccggctcgtgaacgtagaaccgcatccgtaaccgctgtaacagcttgatcttgaccaacaactcgttgatgcaggctatcacctaagtggagtaacttttgccgttcaccttgaaccaattttgccactggaatcccagtttcccggctaacgactgcggcaatctcatcatcagtcaccgattcttgaaccagccaatcttctggtcgatcttgctgttcaagctgcgccagtttcttttccagttcaggaatcgtcccatgctgcaagcgggccgctttttccagatcatagttgccttgtgcatcctgcaactcacgcttagccttatctaattcagattttttagcattgactgaagtaatatcttctttctctgcttcccactgcatctttaagttattcgcttcttcccgcaaattacttaactcaccttgtagttcagctaatcgctttttagatgcatcatcggtctcttttttgagggcagcttcttcgatctccatttgcatcaaccggcgggtgacttgatccaactcggttggctgcgagttcatttccacattgatattagcactcgcttcatcgactagatcaattgccttatcaggtaaaaagcggtcggtgatatagcgatcggataaggtggcagcagcgactaaagcattgtcgtggatccgcacaccatgaaaaatctcaaaacgttccttcagtccccgcaaaatactaattgtatcttcaacagttggttctttaatcaaaatacgctggaaacgtcgttctaatgctttgtctttttccatgtattgacggtactcatctaacgtagtcgcgccgatcaaatgaagttcaccacgggctaacattggcttcagtaagttaccggcatccatactgccttccgttttaccagcaccaacaatgttatgaatttcatcaataaaaagaatgatctgaccgtcactttttttaacggccttaagcacgccctttaagcgctcttcaaattcaccgcgatacttagctccggcgatcaaagcgcccatatccagactaaagatcgttttgtcttttaggttatcgggaacatctttgttgacgattcgttgggccaaaccttcaacaatcgcggttttaccaacaccaggttcgccaatcaagacagggttatttttagttttacgcgacaagacacggatcacattgcgaatttcttcatcacggccaataatcgggtcttgatcaccagtccgcacagctttgactaaatcgatcccgtacttttctagtgcttgatactgtgcttcttgatttttagaagtcacacgttcaccggcacgcatttcagtgatcgttgcttgtaatttagcttcagtgatcccagcttgagtcaaaaactgtgtcaatggatgatatttcaacgtcattaacgccagaacaacactttcagttgcgataaaatcgtcattgaaactagcccgcacctgatcagctgcttgcaataattgatataagttctggctcatactttgaccgtacttaacgttaccttcaaccgctggcgcttcgtctaataactgatcgatccgcgcttcaaattgattcagatcaacgccgactttttcataaattttccgccccaattgaccgggttgaatcaaaaatttaaataaatgcgccacatcaatttcctgatgcttgcgcgtgaccgcaatttgttgtgcctcagccaaggcatcttgaacagcttgagttaatttttctggattcaaaatatgacctcccattacataatcatgatacgtattcccgtcgtgcagtacataactgcaaggaatattttcctactttaaaataaggtttagtgattaaaaaatcggcagttattcaccgccgacctatcctttaattatctgatggttatatcatatcacgaacgtatgttctatacaaatgttttgaccatctttgatcaattgatcgacaccttacgataacatagcatcaatcacttttacctcagactcaagactgaattatttctgactattcaaccgcgtgatctctagaatcacatcgacggctttcgccatgacttgctcggaaataaattcgtaacggccatgcatattttctggaccggcgaacaaattaggtgtcggtaagcccatgaaggagatctttgacccatcagtccccccgcgaacaggttcgatcagtggcttgatatccaagttttccattgcctttttggctaattcaacactagtcatatcttgttttaatatttcactcatattataatattgatcaaaaatatcgagagtgattcgttccagccccaattgctgattcaatttagccgctaactggcgggccttttctttacgtgcttctaaaccatctcgttcaaagtcgcggataatgtacgtcatgtctgcttcttcaaccgttccattcaattgatataaatggaagaaaccgtccacaccagcagttttttcgggaacttctgcctgaggtaaaccgttttgaaaatcaacagctaattgtaaagcgttgaccatcacacccttagcagtggccgtgtgcacgtttttaccttgaatatgaactttcatttcagctgcattaaaggtttcatattccaattgcccttcagaaccaccatcaaccgtgtaagcaaaggctgcattgaagtccttaacgtcaaaatgatcagcaccagtaccgatctcctcatcgggaccaaaaccaacccgcaattcaccatgcttaatttccggatgctgaaccaaatattccattgccgtcatgatctcggttaccccagccttatcatcaccgcctaaaagcgtactgccatcggtggtgatcagggtatgcccagcataattagctaaaaaaggaaaatcagttgtattcagcgtaaactgcccagctgcatctaacttgatttctgaatgcccgtcataatccttaacgatttgcggattgatcccttcagcattaaaatcagcagtatcaaaatgtcctaagaagccaattaccggcacttcatgatctaagttgctcggcaaagtaccgaccacgtaaccgttactcgccaaataatgaacattttgtaacccaatcgtttgcatttcttcagccaacttgtgagcaaaagcgaccaagctaggagttgacggaatcgtttttgaatctggatcggaccgtgtgttgacctttacataacgtaagaagcgtggaactagggttgtataggttgccatttaacttacctccaactaattgattatttttattgtaatctaaatttgactaaattaccttaattaatgaacgtaaacggatcagtacttaacgttgaagccataaatgttacatcatgccagtcagctgcttgcgcccactgttcaaacagcggcactgcttttgccttaacaatgctttccacatgatgaccaggatcgattgccgatagaccagcagctaacatatcatgggcggtgtgatagtaaacatccccagtaacgaatacattggcgtgttgctgcaataccgccggataaaatttaccgccatccccaccgaggatagccacccgttgaaccagttcatcaggtttttgcgtgactaatcgtaaaccgtgcaaatcaaaagcagcacgggtgaattcagcaaattcacggatcgtcatttgctgctgcggttcgccgacacggccaataccaaattgctcaccagttttattatccaagtggaatagatcataggcaggttcttcatacggatgcacactaaacatggccgctaacaccttgttggtcaaatcctcaggaaaaacaacttcaaccttagtttcagcaactgcttcggcttgatcaatttgaccaataaatggctgggcacctgtcccaggcgtaaaccgtcccgtcccagcgtaactgaaactagctgctgtataatcgcctaactgcccagcacctgcggcagctagcgcttgacgcatggtggcagcattagcttgcggaacataagtagctaatttcataatttggcggcgataattaggctgcaggatctgcacattttgtaactgcagttgttccgccaaccaatcgttcatgccaccattagcactatccagattagtatgagccgcataaactgcaatatggtggcgtaataactctgcatacattgcattttgtggatcatcagtcactaaattctttgctggccgaaataccgctggatggtgagcaaaaataaaatcgatttttttagcaatcgcttctttgaccacttctggccgcacgtctaaggtgactaacacccggtggattgtctgttccgtcgagcctaattgcatcccgactgggtcaccattttccgctaaataacgcggggcaaattgttcaaaacgctgaataaaatcttttactttaaccatgaagcacctccataatctgctgattttctgtctctaaagcagcgattttagcctgtggtacattttgtgcttgggctaaatttgcgaggattcgttgattagttaacaattgatgctgccacttagcctgaaatactggtgattgtgcctgcattaaatgcggcccaaatttaatctgctgagtcgtgtagtttaccggttgatcgcttggctcagcaacaatgatttcataggtatgattgtcttctcgcaaaatcgattcagcgacaatcgtaaactgttgttgggcgagccaagtgcggaccacatcctcctgtacgtttggttccagcactaaccgtttaactgttttcaatgtccgccaaccacgtgctaaaatatcccggatcaaaattccgcccatacccgcgatcaccacggtatcgatttggtcaccggcttgaattgccgctaatccgtcagctaaacgcacttgaatttgcgtcgccaaaccagcatcagtgactgccgcttgcgcccgcgaaaatggcccagtaattacttcgccggccacagcataatcaattttgccactagccactaaattgattggtaccatcgcgtggtccgagccaatatctgccaagcgagcaccctgaggaacaaaattagcaactgccgttaaacgctttgttaaatgatgtttattcacaagattcaatcctttatttcatagatgaagttattaaaaagcctaactttgaagacattaatagtttcaaaaaatattgtatgaccaaacaggccacttctattgtaacagtcaaccaagcgcttgaacatgcgctacttagtgttttttagaaagattaggtacaaaaaaagcaagcattaaataatgcttgccgtaaccaatgctaatctaagaaatcttttaattgtttggagcgacttgggtggcgtaatttacgcaatgccttagcttcgatctgccgaatccgttcacgagtaacaccgaaaactttgccgacttcttccaaagtccgcgtccgaccatcatcaagaccaaagcgtaaccgtaagacgttttcttcacgatcagttagtgtatccaacacactttccaattgttcttttaacagttcataagccgcatggtcagctggactagtggcgtcctgatcctcaataaaatcacctaaatgtgaatcatcttcttcaccaattggtgtttccaatgaaacaggttcttgcgcgatcttcaagatctcacggactttatcggttggcatatccatttcagcaccaatttcttctggtgttggttcccggccaagatcttggagtagctgccgttggatccgaatcaatttgttgattgtttcaaccatgtgaaccggaatccgaattgtccgcgcttgatcggcgatcgcacgggtaattgcctgacgaatccaccaagttgcgtaggtcgagaatttgaaccctttacggtaatcaaacttttcaaccgccttcatcaagcccatattcccttcttggatcagatccaagaattgcattccccggccaacataacgcttagcaattgaaacaactaaacgcaagttagcttcagccaaccgttgcttagcctcaccgtcaccttgctcgatcttcaaagctaaagcaacttcttcatcagccgtcaataaaggtacccgaccaatttccttaaggtacatccgtactggatcattgatcttgatccccgctggtgcagatgtatcctgcaaagcctttttagaaactttcttttctttcttcaagctttgttgtgaaggctcgccgttttcatcgactacactgataccttgatcttcaattcgaagaataactttttcaattgcatcagattgcaaatgaaatggtgcaacgatcgtctcggtcagcttatcttcctgaatttgcttttcaggcttatattctttgatgagtgctttgagtgcagcttccaatttcttattatcgctcttcacagtctcttctgccattagatcggcctccctatttcaatctcactataaaaactaattaattgcttgtcatacgagtaccgaaaacttgcaataaccgcagttaactgattatcgcctttataataacgctaatcagttgcttggtacagaatggatactcaaatatataattaaaaatcaagcagctgcttaattttttaccactgttcccgaacccacactagactgcatttgtcgcttaagttgcacgatcgtttgcactgcatttagcgaaccgacactatcaccgattcgactggcttcttgcaactgcgtttgtgctgcattcaattgctgctctaagtttgcttgttgtaaagcacgcaggtaatcctgatattgttcctgaaccgtattttcatcataaactaattgatcaatagcaatcaccaaactttgcagacgatcatcattgattcggtccataaattgtgcgatcacaaattgatcatgatcggcaaaataggccgtggccaattggtaaataacttgatatggttcgtgaataaaatggaaatcaggttgattgcgcaaagcaatacggatatcagctaatttaaaatacaaattcagcaacccacgttcagcccgctcagcccgcgtcaacttagcctgctgttgatgaacctgcggtgttgcagcaacttcatgctgcacttgtggcgctggttgccgcttaaccgttgcatcaaccaaataatcttgcagctgcgtgaccaaggcctcataagtgacctgtaacgactcacttagtcgattcaaataaatatcccgttcgactgccgaactaacattgaccaattcatgtaaagctgcatcaatgtaggttaacttatcttgttcattatctaaattacgcccttgctttaagtagcgtaagcgaaacccaacggctgtttccatgccaccatttaatacgtcacgaaaacgttccgcaccatactttttgacatattcgtcaggatcgagttgctctggcaaggtcacaatacttaactgaaaacgtggatcgtcgtgtaacaaagcaataacgcgatcagtggctttcatcccaggcaggtcaccatcataacagacaactaaatgatcagttgatcgttgtaataaataaagttgctcgttagtcaagcttgttcccatcgaggcaacaccgtacttaataccggcacgataagccgcgatcacatccataaagccttcaaacaacaccacttgcttagccttacgaatctcggccttagcaacatcaaaattaaacagaacattccgcttgttaaataactcagtttctggactgtttaaatatttgggttggccttcacgcttagtcaacgcacggccagaaaaggcaattacatgcccctgaccatctttaattggaaacataacccgatcgacaaaacgatcacgcaatgtgccatcactattttcaataaataaacccgagtgccgtaataaattaaaatcgatctttttttccgcaaaaaaacgggtcaacaaattattctcatctggtgcatagccaatattaaacgtatctaatagctctgctgttaattgtcgttgctgtgtataagctaatgctgtctcaccaagctttgtattcaacagaatatggtgaaacaaatcagcggcatcttgatagagttgccgtaattgctgttgctgcgaatttggcgctacctcaggactagcctgtgtcgcataaccagacagatcaatatttacatgaccaagatccgcaactcgggtcaccgcttctggaaaagaaagactttcaatttccataataaacttgaagacattcccaccacgaccgcaactaaagcaatgaaaaatttgcttgtcttcagcgaccgaaaaagaaggggttcgttcttcatggaagggacataacccaaacaaattacgaccggactttttcaactggacatactgccccacgacatcagtgatattaacagcaccgcgaatttgttccacaacttcttcgggaattctggttgccaattcaatcaccctactctcaagccctaagcttcgaaaagtcgcacccaaaatgagtgcgacttttcagctcctgttgagcacaaaaatacatcattaactatagcacaacccgctcaaaccagcaaccagtttgcttagtctacaactacgatcagctatttaacgatcaattgatttaaatcagcaatactaaagatcagatgcgctaaaatggccaattgtttcaggcgattattccgcactgcttcatcatcgaccatgaccatcgttgcttcaaagtaatccgcaatcaatggtcgtaattgttccaatgcttgatagttttcagcaatcgtccgttgtgctgcttgattgcgaaccgcttcaacggccgaataaagttgttgctcagcatcattttcaaataaagctgggtcgacagttaaactagcttgactcttaaaatcagccttttcgcttaaccgtaagacacgcgtcaacgcttcaatggttgatttaaaggctggatcgtctttgcgctgttccaaaaccttagctgcagcaaacatttgttgcagatcattttcatgactagccaaaacagcatcgacaatgtcataacgaactttatgctgaccaaaccattgccgcatccgttcattgatgaattgttgtaactccgtgatatgcgcatcaagtttcaaaccaaaggttgcattatgttccgccaataactgactactttgttgttgcaaggtcgaaatatctaaatgccaattttccgctttgacgatccgcacgattcctgctgcttgccgccgcaatgcatatggatcatttgaaccagttgggatcaagccaaccgcaaagaaactagcaatattgtcgattttatcggcaactgccaaaactgcgccaaccttggtctgtggtaactcaccatcagcagagattggcatatagtgttcccgaattgcggtcgctacggctggtttttcaccttgtagtaaggcatacttttcacccataaccccttgtaattcagggaattcgccaaccatccccgtcatcaagtcaaacttatagatctcactagctcgttgtagatcagctaattcagtgctagtcaaacctaagtttttccctaacaactgaccaatcaattgcacacgttgcatcttctcgtacattgtcccaattttttcatggaaagtcacttttttcaagcgctcaacataggccgcaattgtttgttgctgatcttcattatagaaaaattgagcatcttctaagcgtgcggtcaatactttttcattgccgctgatcacgttgtctaaatagtcacggttaccattacgaactgaaatgaagattggtaatagcttgccagcttggttgcgtgcatagaagaaacgttgatgatccttcatagaagtgatcaacacttcatcaggcatctgtaaatatttttctttaaaactacccgcaaaagccgttgggtattcaactagattgtttacttcttccaacaagtcggcatctaattcaacgacccagttatttgcttgggctaagtcagtgatctgttgcttgatctccgccttacgtttagttggatcaacgatcacaaattgagcagccaaagctgactcatagtcagttgcttgggctaaatcaaccgatttgcccaagaagcgatggccccgagttgtgcgaccactcttaatatctaagacctttaaaggtacgatggcttggtccaacagggcaaccaaccagtgaattggccgaatatattcaaaatcataactgccccaatgcatgtttgttgggaacgtcatgctagtgatcactttatccatgctacttaaaacttcagttgcggatttaccaggaataaatttattaacgaagacataatcttcacccttttgttgcttaaaggtgatatcgtcggtcgttaagccttggccacgaacaaagccttgcgctgccttagtccagttgccatcagcatcctgcgcgatccgtttggctgggccacgtagttcttccttgatatcagcttgtttagccgcaacctctgtcaccataattgctaagcgtcgtggtgtagcaaaagatttgatttcaccataatctaaccgttcttcttttaagaaatcagcggcacgcttaactaattgttgccgacttggtgtaaccacatgtgcagggatttcttctaatccgatctctaataaaaatgtctggctcataattatacctcctcctttttagctgcttcttttaacaatgggaagcctaatttctcccgctcagcaacaaatgcacgcgcaaccgaacgcgccatattccggattcgtgctaagtagccagcccgttccgtcacactgacagcgccacgtgcatccaataaattaaaggtatggctgcatttaagaatgtagtcataagctggatgaactaaaccatttttgatctgcttctttgcttctttttcgtacatatcaaataactgtaacagcatttcttgattactttcttcgaaagagtatttagaatgctcatactctggttctttaaagatttcaccgtatttaacgccatcgccccattccaagtcaaaaacattgttgacatcttggatgtatgacgctaagcgttcaatcccgtaagtaatttcagaagtgactggtttaacgtttaagcccccaacaacttgaaaataagtaaattgagtaacttccattccgtcaagccaaacctcccaaccaacaccggcacagcccattgatgggttttcccaattatcttcaacaaaacgaatatcgtgttctagcggttcgatacccaattcacgcaaactacctaaataaagttcctgaatattagcaggtgatggcttcatcacgacttggaattgatgatgttggtacaagcggttaggattttcaccataacgaccatccgctggacgccgcgaaggttcaacataggctgcattccatggttcaggaccgattgcccgcaagaaagtatatggactcatggtgccggcgcctttttctgtatcgtatgcttccatcagcatacaaccttgtttaccccaataacgttgcaaggtcaaaatcatatcttgaatattcaacttctgattcataagaaatcctccaatttttatttatgttggtgactgtcactagtagtacagtcggactttaatgaacgacagcaaaaagtccctatgtcgccaaaaagcacgacatagggacgcagctgcgcggttccaccctagttctaacggatcgctccgttaacacttaattatatttcaattcgaactcgagagtgccacgctaagtcatgacctacctgtcttccactaccacaggctcgcttgaggcttccttaacaccgttccgtcttcattcactgatacagattctacggcttttcctaaaagttgtcaatcatggttttagtaaatcgtcccactttgccatttcatcaataaaatgtttgctcttcaatgacagaccaacactatcttgataaatacgatctagcatccgccgtaattcctgcttagtcgcagctttgaccgtaatcgaatttagtttacgcaagtcaatcactgaaaatagccgtaacaagtagatcgcccgggcactagcatggaagcgatagggatctaaagaccaatgctgctgacacaacaagccaccataactctgtgaatagtccagaggtaggtccgtccgttggcaaacaacgcaactttctaaccgcggagcaaccccaaaaatctgtagcaattgtacttccatgatattagtaatgatttgtggatcgaaaccatcgtcaatataacgtagtgccaagtcagtttgttcataccaccgttccaacggctgaccatccggaaatgccgtatctaccaagcttaaaatataagttgcgtaggcattcaaagtgatatcttgactgatggtttgccactggcggtattccttagctgtattaataaacgacagcccttcgtcacgaatattacccacaaaagtcccgtgagtaaacggtaaaattgccgctgccaagcgaaacccctttttgcgtgcaccacgaataaagaacattttcttgccaaaccgatcagttaaaatcttaaccaacatgtcgcgttcgcgataatctttacgtaacatcacgatgccattaaagtcagtaatttctcgttgtgccaccgcaacctcctatgactaattccgatagcgttaaccgcaataccagctgacgattgcgctcaagataacctatctaatagtttttcttctgataacctaattcatttagatagcgctgattgtcacgccagttcttgtcaattttgacccataactgcaagtaaactttgtcacctaacaagtgctcaatgtcacgtcgtgcccgagtaccgatctctttgagcattttaccacctttaccgatgataatgcccttctgaccatcacgttcgacaatgatcgttgcttcgatcttaagtttatcttgatcattacgccgcatccgttcgacattaaccgcaaccgaatgaggcacttcatcacgtgttagctccaagatcttttcgcggatcaattcagaaaccacaaagtactccggatgatcggtgatctgatcgtccggataatattgcggaccttccggtaaattctgattcaatgtcgccagcaattcatcaacattgttaccctgcaaggctgagatagggaaaacttgggcaaagtccaattcagcttggtactgttcaacgaatggtgctagatcattggggtgaactgtatcaattttattaacgatcaaataaaccggctgcttcactttttttaattgatcaataataaaggtatcgccggcgcccatgcgatctttagcactgaccataaataaaactgcatcgacttcatttaacgccgaagttgctgagttcatcatgaactcatctagtttattttgtggcttatgaatacccggtgtatcaataaatacaatctggctatgctcagtggtataaataccttgaatcttgtttcgtgttgtctgcgccttattcgacataatagcaactttttggccgacaactcgattcaagaatgtcgactttccaacgtttggccgaccaacaatggcgacaaaaccggaatgaaatgctgtttcactcatattttaatactcctctatctcacaattaaggttaatttattagcaaaaaacactaataaattcctgatgttcgtggcgatgtccattcttgtggcaaaaatcgtaccgcaagaagcatggctctatctcacaattaaggtcaatttattagcaaaaaacactaataaattcctgatgttcgtggtactgtgtcccaaacctgttgtactaactcataattaaattagccataataatttaggtaaaaagataattagaccaacaacgatcgcaaaaatggcggcaaccaaaaccgcagcagcagccatatcttttgcatacttagctgccaatgcatagtgttgatccgttaacagatcaaccacattctccactactgtattggccagctcactttggatcactagaaaaattgctaaaatcagccacaaccattcactgcgatcaacctgtagccaccaaccaccaactagtaccaagatactagctaacaaatgccatcgcatgttacgttccaaatgagcgaccgcaatcaagccagcaaatgcatggcgcatactttggcctaaattatggtttttcgtcgtctgtttatcttttaagcccataagcatccaagatttcccgttgtagactaaacattattttctcatcttctggtgagcgcatatggtcataaccgtttaaatgtaagaaaccgtggaccactaaaaagcctaattcacgttcaaaagaatgaccataatcatcagcttgttcttgggctttatccaccgaaaccattaaatcaccgatattccgtggtacatgaacattatccggcaaaatgatcacatcttgatcgtcaggatcttcttcgattgcaaaactgatcacgtcagttgcccgatcagtattacggtactccttattgatttggtgaatttcatcattatgcattaaagtaactgacatttctgtatcttctggcaacttcatgtagttaccagcaaattctaaaacatcctgaattaattttagatgttctggtgatgctgcttccgtatggtcaaatatttctaaatccacacaacttcctacccttcaaaaataatattatgcttggcgactttgttcatcataagctgcaataatgctagctacaactgggtgccgaaccacatcagcagcactaaagctaacaaaactaacatgtgcaatatcttgcaagatgcgttgagcctgaaccagaccgctgttggcattgcgcggcaaatcaatctgcgtcacatccccattgacgatcattttggacccaaagcccagccgcgtcaaaaacattttcatctgtgctggcgtggtgttctgcgcttcatccaaaataacaaaagcattatctaaggtccgtccacgcatataagccagtggtgcgatttcaatcacgcctcgatccatcaatcgcgtggtatgctctgcaccgagaatatcgtacaaggcatcatagattggccgcaaataagggtcaaccttttcctttagatcacctggcaaaaagccaagattttcaccagcctccactgcaggtcgcgttaaaatgattttctccacggaaccactttttaacgctgcaaccgccatgaccactgctaaataagttttcccagtaccagccggaccaataccaaaggtcacatcattgtgctgaacagcctgaacgtattgacgctgaccaaagtttttgacccgaaccggcttgccacgtcgatctttgatcaattcagtggcataaagatcctgaaaatagtctaaagtacctcgggtggccattttaatcgcactcacaacatcttcactaccgatggcgatcccttgacctagcaaatggagcaaattagtcaaaactgcataagcctgactagccgcttcactagacccagtaattttgatttcattaccaaacgcatttaaggtgactttcaagccatcttctaacaaactcaagtttttatcttgtgtgcccatcaagctcacagcttgttctggactactgacacgaaatactttaacgacttgttcttctgccaaaagcgtactccctctactccacaatagtggttaatttttgtaccaaaaatttctgatgttacggtcgatagccattcttgtggcaaaaaccgtaccgcaagcaacatggcgcttaatcaaatttatagtcattgcttattttcttaaaatcattaacgtaattatcattaaaaatgatagcacaaccgcaccaaaaaagcatccgccagtattttaagccaaaaaaatagccgaactttcgctcgactatttttgctgactatttggttaacgctgatttaactaatcgattaactaaagcgccgtccgctctgcccttaacttggggcatcaacgtttgcatcactttaccaaaatctttcgtcgacgttgcattaagcttcgcgacggttgttgtgactaagtcactaacttccgcttcggtcagctgttgcggcaaataatgttccactatcttaatttcaccttgcaaaggtgtaacgagatcgtcacgccctgccttttgaaattcatccagtgactctttgcgttgcttcagttcagtggcaagtaccgctagcccttcttgctcatttaattcatgaccaagcttgatttgttcattcgtaacggcggccttcaacatccgcacaacagctaaagttgctttgtcgcgtgctttcattgcggtctttaagtcagcatttaacgtatcaatcagactcatggatactcatcccttagtaggcaagtaaactagaacttcttgcgttttcttgctgcttctgattttaatttacgtttaacacttggcttttcgtagaattcacgtttacggtattcttgcaatgtaccatttctggacacagtgcgtctgaagcgccgaagagcatcatcaagagattcgtttttacgaacgactgtctttgccattatgatatccctccctccgagctcaaaaatggaaccgttttgcaagattgctctcataaaattcgattcgttttttattataaccaacggttgctgccccgtcaataagaaagcggcttgcaaacgataatatttgcgggttttttaatttaatacaactcgatccacattttatgctatcatgaaaacaattacaaaaacgtgagtttcgcgcgcttgcttccgcgactactctaatctatttcagataaaggagccttcctctcatgccaagtaaaaccgaaattaaatttttcattatctctgattctgttggtgaaacggccttaaacatggttcgtgccgctttagcacaatttacaaaagttgatccgatctactatcgttttccttttaccaactcagacagccgtcttgatagcgtcctcaagcaagcggaaactgagcggccaatcatcattcaaacattggtcaccggtgatctgtccaaacgagtcaatcaatttgcggcagcgcagaatttaacttgctatgatctactgagtcccatcatgcaaaaaattagtcaactttctggtgaaaccccacgcggcgaagcgggtgcgatccatcgcctaaatgaccgttactttgatcgcatctcggccatggaatttgctgtaatgtacgatgatggtaaagatcccaaaggctttttagaagcggatattgtattgcttggtgtctcccggacatccaaaaccccgctctcgctttttctggctaatcgcaaccttaaagttgccaacttaccattagttccttctgctcatattccggaacaaatctggcaagtcgatccgaaaaagattattggactcaccaccgatgttgccgtactcaataatttccgtcgtgagcgtatgattgcttacggcttaaatcctgatacggcttattctgacatgaatcagatcaccgctgaattagattttgcgcggcaactttatgataaaattggctgctacgtgatcaatacagctcatcgttcgatcgaagaaacggcgaccttgatcctagaacatatgggattagatcactacggtaataaagatgagtaagcaaaaagcttgcgatttaatctcgcaagcttttttattttatccaacgttctgactgaatggttgttgtgccacaatatccgccatcaaagtgggattcattttttgcgcagtcaacatggcgatctcataaccataaggcgcaaagctttctcccgtatcagttttgacccacggtgtttccatgatcttaggtactttcgctaactcagggagatgggccatttcatttaacgctgcaaagccaatcgttcccaaaccaagattttggtgccggtccttgtgactgccttggggattttttgaatcatttaaatgcacgacctgtagccgttctaaaccaataatttgatcaaattcagtcagcacaccggaaagatcttccttaacgttatagccagcatcgttggtatgacaagtatcaaagcaaacacttaatttatcatttaaatgcacacccgcaatgatctcagctagttcagcaaagctacgaccaacttccgttcctttaccggccatagtctctagggcaatctgaaccgtttgttgtggctgtagaacttcattcagacccttaacaatattcgcaatgccagccgcagctcccgccccaacgtgcgcacctggatgcaaaacgatctgtttagcccctaaggcttcagctcgttgcacttcggcctgcaaaaattttaccgcaaaatcaaaatgatcaagcttgatcgtattagctagattaataatgtaaggcgcatggatcacaacactttgcagttcatgttgctgcatatatgcttgaccagctggaatattcaactccgcgatcggtttgcgtcgcgtattttgcggtgctccagtataaatgctaaaagtagtggcgtgataactagccgcttctttagctgaacctaaaaacatttctttaccccgcatggcaacgtgagaaccaattaatagcattatgtaaccttccttttacttttattctaaaattaggtaatctaataaggtcgatataaactaagcgctgtttaaaataagctttgaactatttctgtaatgaagttcgcgtaatttttaaacagatattagttttatttaaacataatccattgtgcaaaatcaatctcatgtgcgcctgctggttctacacacaaaattagcattatttagtggcactactagtaacatccttaattagtggctttgttaatcactaccttaagaatgagttagaggaggaaataatctatgcagcatcgcttaaccaagcgcgaatacctttatatcggttcaatgttattcggtcttttctttggcgccggtaatttaatttttcccgtttttcttggtcaaagtagcggacacaatgtttggacggctaatttaggctttcttatcaccggtattggcctaccgttgttaggggttgtcgcgatcggcttgtctcaaagcaagggcgtctttgaacttgctgaacacgttggccgcccctacgcctatatttttacgatcttactatatttaacgatcggcccgttctttgcactaccgcgattagccacaacttcgtttcaaatcggaatcattccttttttgaaaagtaaccaacaaactagcgctttgattatcttttcaattattttctttgccgtcacttggtggttcgcccggcgaccatcacaattaattgcggttgtcggcaaatatttaacccccgccttcttgatcgtattggggctgttattactaacggcgctgatcaaaccgctgggcagtatcaaccatgctgcagtagctagtgcttacacgcagcagccgttttttgtcggtttcaccgaaggctataacacaatggacgcacttgctgcattggcttttggcgtaatcgttaccgatacgattcgtaaactaggcgtgactaagccaacgaccattgccatggataccatgaaatctggcttgatcagtatcgttttaatgggcgtaatttacacattattagctatgatgggaaccatgagcctgggtcaatttaaaccggcagccaatggtggaattgctttagccgcgattgccaaatattactttggtggttttggtagcttgctcttagcactattagtcattctagcgtgtatcaaaacagcgatcggtttagtctcagcttttggcgaaactttccaagaactttttccaaaaggtcattatctgtggtacatcactggtgccagtattttacctggtattttcgccaatatcgggttaactgccattattgcttactcgaccccagttttgatgttcatttatccgctggcgattacattgatgctactcggaattagcggtccgctattcaaacaacgccgtgtcgtttacgtaaccaccactatttttacgttgatcaccgcaatcgctgacggtgtgcacacggcaccagcgatcattgctcaaaccacagtcgctaaaacaatcgtggctctggcacaacaatatctgccctttttcaacattggtatgggctggttgattcccgccttaagcggctttatcatcggcttgctccttactaaaattttaccaactaaaaatgtgtaaattaaaacagtgacaccacaaagttataataaattgcggtgtcactgcttttttaaatcatcggttcataaaaatggcccaggatcttaactgtatccgaaatactaacaaatgccttaggatcagaattgcgcatggccgcttgaagatcatgcatttcgtatcgcgaaataacagtgaatagaatcgttttttcatcgtgttggtaagcaccttcagcatcatgaacgatcgtgatcccacgccgcatccggttctgaatgtggtcgatcactttccgtggcttatcggtcacgatcatgacttgcattttttgctggcgggtataaaccatatccatgacttttccgttaacaaaaatactcaatgcactataaaaggcgtacggccaaccaaaaacaaaacctgccgcgatgacaataaaggcgttaaaactgatattgatcgtaccaatacttttaccagttcgcttaccaatcaccaagccgataatgtctagaccaccagttgagattccatttttcaaagctaacccggtaccaaaaccattgactaccccaccaaaaatcgcacaaataattggatcaaacgtgatctgtgtgatcgggatcattttcatcatcacactggaaaatacaaccgcaataaacgtgaaaatcgtgaagcgatgactgatctgtcgccaagctaaaacaaataagggcaggttaagtaaaaatagcaaaatcggaattgaaatgctgaccgaaaaaatacgcccacttaaggtggacagtaattgagcaaaaccggtaatcccggatgcatagatgttacctggctgccaaaaaaagttcattgcgattgaaacacaaatcgagtacaaaaaagccgtggaaactttagcggtatattgatggcgccgcataacgcgctgtaaatcatccatgttgtctttatctaacctcttttaattaattctgggtcaccccaccgaagtacttgttgattgcattataacatatccctgtatttaaacgacctttacgctaataaatctaatttttatcagcaataattaccgcactttttcaaaaaaggattatactagaaggtgaactaagagattagtccgttaactaaatctaggaggtaagcattatggcagaagtcacagaagcacatattcttaacgaaaaaatgagcgaggcatttgactggagcgatagcgacacagtggtacgcgatgcgatttgggattatttcatggaaaaaaataatcacgacaccgataaaactgttgtcgacgttaagccttacaccagcgataaaagtgaggacgaaatcaagcagttcatcgaagctaatttgaaaaaataactttggtcttgctaaatagccgcggaaaaaatcagttaacgaattgattttttccgcggctatttttctaattttatctaagattcatttaatgattactgttcgttaataataattatccgaaaaataccgccacctcaattgaagtgacggtatttgtcttatttatcgtagaccgttaagtcaagatctaataattgtttatttgatactttacttggtgcatcagtcaatggatcgccggcttttgagttcttcggaaaggcgatcacttcacgaatattatccttacctgctagcaacattgcaaaacgatctaaaccgattgccaagccgccatgcggtggaaaaccgtaagttaacgcatctaataagaaaccaaagcgttcttgtgctttttctggcgaaatacctaaggccttcagcatcttttcttgaatatcgcgatcatggatacgaattgaaccaccaccaagctcataaccgtttaagacgatatcatagctttgagcatgtgctttatgcggatcttcgccatcattcaagtaatgtacatcttcttcatttggcatcgtgaatggatgatgtgctgccgtccaccgttgaataccttcatcgtattcaaataatggccaatcaacaacccagatgaaagcaaacttactttcatcgatcaaatcaagctctttagcaaagaatttacgcaaatagcctaaggtgtcagcaacgactttccgactatcagcaacaaataatagcaagtcgccggatttagcccctaaacgttcaccaataacgtcttcttggcccttgaagaacttagcgatgggaccagtgaaaccatcgtcagttaatttcaaccaggctaagcctttcgcaccgaaacgtttaacgtaatcttgaattttatcgatatctttacgtgaatatttatcagcagcaccaggtacacagattcccttgacttgaccgccatttgcaaccgcaccactgaaaactttaaattcagtgtcagccattaagtcagaaaggtcttgtagttccatcccaaaacgaatatcaggcttatccgaaccaaaacgcgccatcgcttcattccaagtgatccgtgggattggcgtttctaaatcaatgcccttagttgctttcataacagctttcaacaagccttcagttagatcctgaatttcttcagcacttaaaaagctcgtctccaaatcaatttgtgtaaattctggttgccgatcgccacgcagatcttcatcccggaaacaacgggcgatttgataataacgatccaagccagcacccatcaataattgcttaaataattggggtgattgaggtaaggcgtaaaaatgaccaggataaactcgggatgggactaaataatcgcgagccccttccggcgttgacttagttaaatcaggcgtttcaacgtcgataaagccagtttcatccaaataacgatgagctgcctgggtaatcttgttgcggatcaataacccttgcaacatctctggccggcgcagatccaagtaacgatatttcatccttagatcagcagaaacattgatattatcttcaatataaaatggcggggtcttcgctttattcaaaacagtgacgtcatgaatctcaacttcaactttaccggttttcatattaggattaatggcatcgtcagcccgcttagtgactttacccttaacttccaatacatactctgaacgaactttatcagcaacggcccaagcatcatgaccaaattcctgactgaaaaccaattgaacgataccttcacgatcacgaagatcaatgaagatcaaattacctaggttgcggcgtttttggacccagcccattaatgtgacttcttgaccaacgtatttttcatcgatcaaacctgcataagttgtgcgtttatccacgttgttctccccttacttgtgcgagtacggttgcaaaatcttgttcgatctctgcaagcggtactgtaatttcattacctgtcgccatgttcttcaaatgtgctgattgggtagctaattcactttcaccgattgtgatcaccacttcagcatttaaccgattagccattttaaattgggccttgggtttacgatctaaataatcatgttcagccacaaaaccagcattacggatggcttgtgtgacttgaacaacggttggcactgcttcagcgccgattccaacaacgtaagccgctggcgctttagcagtcggcacttcaataccatctgcatccatcactaacaacatccgctcgatgcctaaaccaaagccgaaaccaggcgttgctgggccaccgatttcttcaactaaaccgttataacgaccaccggcgcaaacagtcatatactgaccaccaaaagctttagagttggacatgatctcaaaaattgtgtggttataatagtccaaaccacgaaccatagtgggatcaacttcataagcgatacctaaattatccaacaacgtcttaactgtcgtaaaatgagcagtcgattcttcatccaaataatctagaattgaaggcgcatcagccacgattgcctgatcatttttgtctttactatccaagacacgtaatggatttttgtgcaaacggacttgggaatcctcgcttaattcagtgaaatgtggttccaagaaatcgatcaatgcttggcggtaagcttgccgtgaggctaaattacctaatgtattgattactaacttcaaaccgccgatgccgatttttttaaataacccaagggccattgcgattgtttcaacatcaactgttggactagcactacctaaagcttccacaccaatctgatgaaattcgcgcatccggccagattggggccgttcataacggaacatcgggcccatataataaacctttactggtttgggatgttcagggccaaataatttattttcaacgtaggcgcggacaatgccggcagtaccttccgggcgcagtaccacgtggcgcttccctttatcataaaaatcatacatttctttagtgacgatatccgaagtatcacccactgaacgtgaaaaaacatcaaaactttcaaagattggtgtccgaatttctttaaattgataattgctaaaaacctgtcgtgctgtctgctcaacatattgccatttttccgattcacctggcaaaatatctgcagtcccttttggtcgttgataaaccatgaataaactccctttctacttcacaattaagataactaattagccccgatgttacggacgatgcgacttggacttgccgtatttcggcactagcccaatcgacatcggcaagcaagcccctgtttagcagataagcacaaatgctaatacttaccaacctatcttgttaagaacgagcaacagtgaccattcttgtggcaattttaaggagcgtagttgcaaagtccgcaactacgtttcctcacctcaaatcgtttcggtcaccgcaagaaacatggctctacttcacaactaaggtagctaattagtataaaccactaattaaccttgatgttacggacgatgaccattcttgtggcaaaaatcgtaccgcaagaaacatggctctacttcaatcgcgcacaataaaataaaaagcgcccctgtcttcgacaagggcgcattgattgcacggtaccaccttaaattacttgaccattattaaaaacttaattttgatcacttatcagataacgctgttcgcgaaagcacaaggctttacctcaaaagtgtcatgttgcaggggtgtttacgtcagtttcagcctagctgacgctctctatgaaacaactttcctacaagcttactttgtcatcggtcatattaagttcacaattacgttaccgaaaatatcgcgaaaagtcaagtcagcattgcgaaaattgctgtttcggcacctagtatttgctataatgaaattaattgattttttgaaggtgaagagttgttcagaccaactaaaaaactcattggcttagtcttgttactaagtttaatttttgctggcagtagtctcgcccgcccaactgttacccatgctcgtcaggaaacgatcaccgttaccgcaaatacggtcaacgtacgtatggggcctggattggcctatgataccatggcccaactaaaaaaaggcgacaaaatcacggtgatcacgcaaaaaaatagctggtatcaagttcgcttaagtagtgacaaaatcggctgggtcgctagttggctattgaaaaacaccgagatcagctcagccaccaacaccgaaggcacgatcaacactgccaatgtgctggctaaggaaaatcccgccgacgacagcgacacactgggaaccttgcaacaaaatgcaacagtaacagtagtttacgaaaaaactggttggagccagatccttttcaaaaaaacggtggcctgggtcaaaagcgcctatatcacagaaaaaaagaccagcgataataccactgaaaacatacaaccaaccgttgattctagcattaagagtttaaccctgcatgatgataacgttaaattacgtagctcaccttcaattggtggacatatcaaggcaaccttaagcaagaaatcgcaactcacttatttggcgacggctggtgattggtatagagtgcaaaccaaagacggtaaaaccggctatgtagcgaattggacggctactccatcgacttcaaacaaaccagtaacaactaacgccaatgatttggccgaagcgacgatcgttttagatgccggtcatggtggtaatgattctggcgccttatcgcaaaagaaaacttacgaaaagacgttcactttgcagatcgtcaaaaaagtggccgctaaactgcgtcaagggggcgctcacgtcgttttaacccgtaggtcggataaatacgttggtttgtcgccaaggcccgcattggctaaaaaagtgcacgctgacgcctttatcagtattcaccttgattctagtcccgaaaataatcaagccagtggaaccacaacctactattacggtaaatctaaagacaaaccattagccaacgccttaaacaagcaattagatcacttaccattagacaatcgtggtgttgaattcggtaacttcctggtattgcgtgacaataaacagccagcagttttacttgaactaggctatatcaatgacagtaacgattataagcatattcattccagtagctatcaaactgagatcgccaatgatatttacaagggtttgacccgttatttcaaatagatccacttaacgaccacaaatactgtggtcgtttttttattcattcatgaaaggtcgatattgctgatcctgcatttcaaattccttgatcagcgtaatctgttggtgcactattttaacgattgagcagcctctaaacactgactctacaccgttgtatcgacaacgaaatcgccactcaaagaaatgaacctgttgtattggatcaaaataggtagctgaaatcgtccaagctaatactttattttctgccgaccgatgccaatgttcaaaccagcgttgcgcctcatctttgccctgatagcaaggcccataacattcgtagatcaccacatcagtagctaaagtcgctaaaaaaaccggttcatcttgatgcaaccaactagctacataagtagcaaatattttttctggagtagccatataaaattcccccataacaaaaaagccataaaccctaggtcaacacctaaagtttaccgctttataactagaaaattaaggctaagcccataattgcgattaaaccaacaaccacggttaccagcatcgactttgttttagccgctactaggaagacaagaatcgttgaaatgatttcagtcaagtttttagcattataagtatagtgtgaagtgacgaaaacgtctttagcgatcaaagccgtaaataatgccaccggaatatatttcatccattcattaaaccaagctggaattttgcgctttgaaaaatatagtaatggaatcacacgcgggataaatgcgaccatggccgccaatacaatcaagatcaggtagtctaggttactcatggtcgtcggtcgtctcctttggtatatctttaaagctttcgtggcggcggcgtaaacgtagtgaccgcaacagcaatggattggacttgccctctaagccatgttctaccatgaaaccaacaaacgaggctaccaacgttgcaacaaccaaacccatcgtactccgcattgcaatgatcaaccatacggacaaaaccgcggataaaccagccaccaagatcgatagcaagtttttgacctgcatcactaacatatagccgaacaacgccgtcaatgtgaaattaaccaagttcacgtcaaagtggatcaaattaccgatcgtcgaacctatcatattactgacggtccaaaataatagtgaaaaatgattgaccatcacggcctgatgaccatcccatttcttatctgttgcgaattttaaataattgatcgcataattttcgtcattcattgaactggagaagtaaatcaaaaaaggtaatggttcgttttttaagtatggtgataaacttgcggataatagtgcgtaccgcatctccaagaaaaaaagcatcaataagacttgcaagagtggtgcgtgaattgccaacatcgacgcaattaaaaactgagcaccaccagaaaaaactaagatcgataacaagccggtaaacagaatattaaagcctgctgaatgtaacaaaataccgcaagctaatccgattggtacgtaacttatacaaagtggcaaggcaattttaaatacgttaaaccaatttttgtcctctactttcaaaagtaagcctccaaatctagcaaacaaacctaagcgattataacataccgggtcagtagatttatagcccctcttttaatttctcgcttgaaaataaggcacgatctcaggtaactgatcaataatgatgtcagcagttggtgcactatggaattggtcaacatcaaagaaacagcccttaacaccagcattttgcccagcaactacatccaaaggccgatccccgatcatcaccgtcgtggctgggtcaagttgatgctgcttaactaaataatttatggcttctggatcaggcttacgtttaaagtgttgctcactagtaacacattcagtaaatagcggtaaaaaacccccggctgccaaaaagcgctctgaaccacgatcacgatgcgtcattagaaagttctgcccaccttggtcgataattgcttgacaagttgctaaagccccagcataaggctgtggatcacgctgcgttgcaaattcgatttcatggtaacgcttagacagtttttctggtgcaatggccaaagtctgtccaaaattctggatcgccgttttaactgaatcttccttgatcaggcggtacaaatcttgacggtcaactttaagccgatactcatcagctaattgcaacaaagcctgcataatgccagcataagtatcataaagtgtgccatcaaaatcccaaattgccgcttgtaacataaaataatcccttactttctatttgcctaaatggtgaaatggctgttatttgttttctgtatcaaataaaattgtcactggtccatcattgatcaacgcaacggccatatccgcgccgaattccccagttgcaactttgataccattagcccgtaacttctcgttaaaacgcgcataatactgggcagctttttctgggtgtccagcatcagtgaagctcggccgattacctttacgggtgtccgcatataacgtaaactgcgaaaccgacaaaatctcaccagcaaccgcagccaacgctaaattcattttgccttgtgcatcttcgaaaacccgtaaattagtaattttatgtacgagataatcgatgtcagcctcggtatcagcatcgcgcacagcaactaataatagatagccgcgcttgatcgcaccgacaacttgatcatcaatcgtcacgctagcctgtttgacccgctgtaaaacaactcgcacaacatagcctccttttaatgacagtttcttagccagatctgctaataaattttgcacttgcagtggtcgataatcattcttctagcaaaaaccgtaccgcaagcagcgtggcgccagacaattattcgttcgaccgcttaacgctgtaaacatccggtatatttttgatactatcgatcaaccgagttaaatgggctaagttagtgatggccacggtaacgtgaacagttgccatattgtcatgatcaactttgccactaacggaagttaaattctttgtttgcgcattcaaagtctgcaaaatatcatttaataaaccagaacgattgtaaccataaacttccaagttagcgtcgtaagtggttcctttagctgcagcatcttcccattcaacttcaatcaaacgattagcggtatccgcagcattttggacattgggacaatccgcgcgatgaatcgagacaccccgacctttagtaacgtaaccaacaatttggtcacctggtacaggattacaacacttactcaaatgaatcagcaagttgtcgaccccttgaatgacgacgccgccttcgtgcttgatctttaacttttcatttggttccttcggcttggttttacccttacttttagccgcagtcgtatcagtcaaaacatcccgggcttgctgatcttgctcggctttttcccgctggtggcggactttttcggttaaccgattactgaccactaacggtgataactcgccataaccaaccgccgccaatagttcatcactattgctgaaattaaaccgattgattgcttggcctaagacttccttattcaaataatccttcggtaaaaagcccatatcggtaagctgcttttcaagcatgtcgctgcctttttcaatattttccgagcggtcggcttgcttgaagaaacgcttgattttattacgtgctttgctggtactgaccaaattgatccaatcacgactaggtgatgaatttggtgaagtcaaaatgtcaacgatatcgccatttttcaactgataatttagcggtacgattttgccattaactttggcccctacggttttattaccgacttcagtatggatcgtgtacgcaaaatccaatggtcctgaaccttgagataattcgtaaacgtcccctttaggtgtaaaaacataaactcgatcagagaaaatatcacctttaacgctttccataaaatcagcagcgttagtggtttcatcgcctagttccagaatttcccggaacatgtcgatctttttgccattcgagtcgtatttgacttcgtcacgtttgccttctttataggcccaatgtgcagctacaccatattcagcgacttgatgcatttcttcagtccgaatttggatctctaatggctgtcctttaggcccaatcaccgttgtgtgtaatgattggtacatattggctttaggcatggcaatatagtctttgaatcggccaggcattggcttccatttggtatggatcgcccctaaaacggcataacagtccttgatcgtatccacgatcacacggatcgccaataggtcatagatttcctcaaactgtttatgcttatcacgcatttttttataaattgaatagatatgtttcgggcgcccataaatttcgtatttaatattaaaatcggtcatcgaagctttaatctgtttgattgcttcgtcaatataggcttggcgctgtgcccgctttgaattcatcaaatgaacgatacggtaatattgttgcggatttaaataccgtaacgcagtatcttctaattcccatttgaactgactgatacctaaacgatcagctaacggcgcatagatctccaacgtttcattagcgatccgccgctgtttttctggacgcaaatgcttcaaggtccgcatattatgcaaacgatcagctagcttgaccatgaccacccgtagatccttagccatcgctaaaatcattttacggtgattttccgctaattcatccttatgcgcgacatacttgatcttgcttaacttagtcacaccatcaacgatcaccgctacatcgtggccaaacagctcttgaatgtcgcctaacgtaatattagtgtcttcaaccacatcgtgtaaaaacccggacgctaccgtcgcaggatccatttttaactctgctaagatcgccgccacctggatgggatgaacaatatagggctcaccagactgacggaactgttccttgtgcacatagttcgcaaaatcaagtgccttttttacaaacgccacatgctcatcattcatataagtttcaactaacttgatactttcgttagcggtgtaaactttttcttcagccataaaccccacatccttatctgctttgatacaaaaacagcacggtagctatgcagcatgcgtgcttacttgaccgcattttagctgaatcaactgccaaaatgtagctaataatttagataccgatcatgcagtaattgttgatttaattataccacgtaccgtatgatccttagtcagcaaattcactatgaattatacctgagcccacctattttgcaactgtcagcgccgtcttgcgcatactataggccagataacttaaaattaagtacgcaccggcaaaccaataaccatagtgaccatagcgcaagtagatgattccggtaaataacccgggaaagatcagtaaccaccagatagcaaaatggcgattggctaaataaattcccaatgcgatcgccgcgaccatattgaccacaataaataagactgcgattcgaatcactttagcgactgccaaccagtgaaaaattaagggtaacagccaagtaatgatcaaactaaataaaatgagctgaatcactggctgtttaagtaattgtttgattttcgtcaaaattaaacctccgcgttttttagaatcgacgcaacgtgttatcggtaacacgcgaatcatttgttttggggagctaataattcccacaacgttgataacgcacttaataaatataaaggcgccgtttccgcacgcaaaatgcgtggtcccaaacccgccacattaaaatcagcttgtcttaattgctcaacttcagtcggtgccaaaccaccctctggaccaaatacagcgatcagtgtttgcccaccaaccaattgttgcgcggttgccactaacgccgccgtttcgccttgtttagccgactcttcatacgcaacgattccaaagtctttagtaacttgcgttagttccgttaacccagccatgatatcgactgtcggaatttgatcccgatgcgattgtcgtgccgcttccaaggcaattttacgtaagcgcgtcagcttcttggcctgacgtgctggttcccatttagctaccccgtattgactggagaaaaagataaagccactggcaccaagctcggtacctttttggacgatccaatcagccttgtcttttttagcgatactacatgcaatgatcacttgattaggcagttctggacttgtcaatgctgtatctgctaaatggacactaacgccatcaggttgtaacgcctcgattttactacgataagcgcggcgatctccagtcacaacctcaagctgatcacctacttgcgcgcgcatgacccgttgaatatgacgcgccgactcgccagtgatcgtcacttgtccaccagcaggcacctgatcagaaataaaatagcgctgcatcctagtcctcccgtttctgcgcgatcacgccgtaccaatcgccttcatttaacacctgaacaatcgctaaatcagccttgagcaacgcctgtttgatgctagccagcttatcggcaatgatcccagaaaggatcaaataaccattcggattcagtaagggttgcgcttgcggaatcaacggtaaaataatttctgctaaaatattggccacgataatatccgctgattgcgtgacattcgtcaataaattattggccgcaactttgaccgtagcagcaattggattcaacgctaagttattcgctgcagctcgaacagccacatcatccagatcataagcataaactgacccaacaccaagttgcttagcggcaatactcagtacaccagagcctgtcccaacatccaataccgtttcgccaccacgaatcgtggtttcaagcgcttgtaacgccaatttagtagttggatgcgtcccggttccaaaagacatccctggatctaaaatgatcaactgctcatcagcctgttggggttggtatttttcccaacttggaaccaccgtcaaataacgggtaacacgaacaggatgatagtactttttccatgatgttgcccaggcgccttcatcaacagctgctgttgtcacttgattagcgccaatagctaaaccaaaatcagtcaactgagtcacccgttgcttaattgttggtaaaatctcaggtaaaaaaaccgtctccggataataagccgcaacttcagcacctgattgaatatgcggatgcttactggggtcaaatatttcgccaaaagggccctgtgattctggcttaaagtcagccgaatcattgatctgtacgccggtagccccagcctccattaaaatattagctacagcttcaactgcttccgttgaagttgtgactttcacttcagtccattccattaagttgatcgcctttctacactacagtgattaatttgggtaacaaagctcataccacactgatcaataccgcggatacgctaaataatcagttgctttaattgggccttgcgccgctacttgttgctcgaaaactcgtggttgccattttaattcaaaagtcgtgaccgtatcttcgtttaaaaaggccatcaaatcacttaaaccatccgccattacttcaggtaaatacgcaaacaatccatcgatagtttgctgcgctaaaccagttttacccgaaaatggtaacaaagccaagtaatcttcagccaccgccgctggatctaaacgcttttcatcgtagatcaagatttgatcctgaaaatcaattttatcctgggtacttaatttacccgccacatcggtcacttcttgcccagctttattctgcgcagtcaaacttaaagttatttcaaaaacatgctcttttttatcccagtttagatctaactgaccttcaccagcatagtcagcaacttgtgtcgctagatagtccaacatcgttattttcatgattgccacccataattttctagattcattgcccgcttaggcattttggaaacaaatggattatgcgccacgtaaaagcgtaacggcgcagccttccagatacctttatcaccaatgccgattcgaggcgccgcattaactgctagcggtcgcttttccatcgttaaactcaaagttagcgcactcgtggcatagctttgtaaattcaaactaagatcttggatgcctagtgcagccattaatttaccagggccgttggtcaaatcaaaaacagaacgtggttgtcgccgattgagctgcattacttcctgacctaaattaggttgtaagccccgaatcagtacgccctgtggcacgccttccggttgagtgatcacattcagcaaaaactgcccatagatcgtataaatatagatcgtacctccagcgtgatataaagcctcatttttagccgaacggtgcccggcaaatgcgtgcgctgcctgatctttttcacctaagtaagcttcagtttccacaatataaccggatagcagccccgccggcccctggtagaatagctgtttgcccaatagttgctgtgcgattgtgatggtgtcggtttgttcaaaatactcagtaaatgtcatcgtcattgccaattcctctactcatctacacgccttaccacgcgaaaaactcgtcagtgttgccgacgagtcctgaccgcttaattaagattgctgaccccaaagcataatatccagtgtgccattgccgtagtcatagtattcaatacctagttcctgactagattgattaagcacttcataatactgtttggtatctaagccacctggatgaacgacacgagcatacaagtacttagccatttcgtgctgcattttttgatcaactgcctgtggcgcggtaaaaataaaggtcgtgtataacatctctttagtcgtataatcgaacgtcacttgttcgatgggaaagccaccgaaattaggttctttcttcaaatcatcgacaaacgtgtgtacctgttcagccgtgaatcttttggtataaaacaaaacgtgccaggtctgcttgatcgccacataaattcctccaatttcagatttctgtatatagataactaattgcgtattttctgtttcaattatgccatactcaaaccaccgataccagtcctctagcctttttctgaaaataggcctaaaagataacttcatttagctgggtgcagtagttaaaagctggccgaccatttcaatatggtgcatcaataaccattgtttgactttacctaaaccaggaaaacgctgctcattcagactttgtgttaatgcttgcaagcccattgtttgtggcacttcaggatgttcagctaaccaagccagcaaatgaactcccgcactgaaatacttggctttcggttgtttaaaatcagtaaattgatccgaaatgaaatgatgcaaccagatctgctgtccagtgggaaagctaagcgataaacgcacgcaaggcaagggatagcctttttcgctataacttgagccagcaatcgcaaaatcactaaatccacttagcccatcagcaccagcaaaccaaggttgatcactaaaaaaagtttgcggctgtaacagataatcggccccatcccaactacgtggcagcggatcagccaaggtaacctgcggtgttagcgcacggcgcaagcgatgactaggaccggcaattactaactgctgcggtcgtggtaaaggcagtgtttccagcaatccaggttgcgtatagatcagtactgtagcggcattataatcacttagtgacacttcagtactgactaataatccagcttttaaattaggatctgtccaccatttagttagtgggaagcgttgttggcggtgctgatcataggtgccaacctgcggattaacgatcacgatcaacggccgttttgccgccataaattcagccacgcaatccactaaatgatgcgaatcacgaactggctcaatgatcggcaccactgctggcgctaattttccgaccgcttgtagcgctaataaagcctgtaattcaaattgtttaccacgtaaataaggatagtaatgcagcatcacagattccccgctttaacttgatgatagcgacgcagtagctgctggtagtcagcttcagtggcaaataactcagccttcaactgctcaaccgcatcagcgcgaacatccttgataaattgttcataataattaggggtcaaaccactgggatcataatgatggccacgtttacgcaactccgcataaagtcgttccgttgaataagctgctaaaccaatattggcgcgcttaaacttgtccgcttcccgggccaacgccaacataaaatgagtcgtcaaggttgctgccgtcgtagctagctcctgccgccgtgccgctttggccacagtcaaataacccggcaaagcaacttctagtccttttttaaatgggtgaaaaactaaaaccccaacgtgagctggaatttccgcagcgacctgagcgtacaagggtgccgttaaaacaaagtaattgtaatgccctacaaacgacaaccgggccgtagaatgaaaatcaggcttggaaatctttagttcatagcagcgccattcttgttgctgttgttcgtccgtgcgcaatgccagcatatcaacgatccctaaatcatctggcaaggccacttcctcaactgccgaataacccttttcactacaatacgcatataaagtttgctccagcgctaatgttaacttcgttttcacgttctagatcccttcaccgattttttgagtggcattacttagaatttcaacaacgattcagccttagtgaccgttaaatgctctgcagtcacagccgtgatcacaacttcgtcaccaagtgttaacggttcgttggcaacaaaatgataaaaaataccaaaaaaactgatcgtgccctgctcattagtttgatcaatgataaaatgtcgacctaacaagcgcgcatccaaagattgattcatcaccaaaactccccaccgattttatttgcttcatattgtagcatttttccagtttatgtagtgataaattcgtcagttattactaaattttacagattatctacgccatagaaagcagcttttggctgcggacttttgtgataatttgtgttactatatctgtaagcgcatacaaaaggagaggtgatcatcatgagtaccattggtaattacgcagaaacagacattcgtaaagctaatccgattttctcgcaaattcgtactactattgagtccgctttttatggcaataatatggttgctgtaaatgatctcactaccgcttatgaattgacaaaagcggctccagaaacgaccgttactgacttgccgatcattcataccgacgagttaggtttaccagccgatgctgtcatgttagttaacaatcatggccgagttgtgggccgtacagccgcagcacgccgccggatcggtgacgcagatgttgatccagctaagtttgctggtattttgcgtgatgccatttttgccggcacacaacaacagttttataaaactagcgtcgttgtcggacttgatgaagatttcatggttgaagcccatttagccgttcccgaaggttatgaaaataatctcttatcttatatgctgaattttcaaacacttaatcagacctatcaagctcgctatcagcaatccaagccttaccaagaaggcaatattttcatctacgcggatccaaattttcatcatcctgattttcccgatggtttagccttatttgacgcgcaacataacgttgctgctattttagggatgcgctattttggtgagctaaagaagtcgaccctaacgctagcttgggccactgcacatcgtcacggctacgttgcgtgtcatggtggcgaaaaagcttttcattttaacgatcggccagatcaagtttttgctatgtttggcctttctggttccggtaaatcgactttgactcacgccaagcatggtggccgctttaaaaccacggttctacatgatgatgcttttgttatttcacgcgaaaacggtagctcagttgcactagaacctgcttattttgacaaaaccaacgactatccatctgggactgatgaaaccaagtatttcatgaccttaatgaacgttggcgtcaccttaaataaagcagggcaaaaagtgctggtcactgaagatctgcgtaatggtaacggccgtaccattaaatcgcgttacgcctcggctaatcgggtagataaagaggaagccccaatcaacgcaattttctggatcatgaaagacgacagcttaccaccagttgtccatattactgatccgaccttagctgcaacatttggcgcaaccttagcaaccaaacggtcatcagccgaaaatttagttggtaatgttgaccgtaacgccctagtgattgagccgtttgctgatccattccgcgcttacccgttggccgaagattacgctgattttaagagcctatttgcgcagcgtcaagttgattgttatatcctcaatacgggttattataatggcaagaaaatccctaaggaagtaacgttaggcattctagaagatattgtcaaccaaaaaatgacttggcaagattttggcccactgaaacacctgagctatgccccattaaatgattttccagttgattttactgataaggattatgtggcaatgctacggacacggttacagatccgcttggattggatcacaagctacacagcaacccatcaacaatatcccctacctgctgaaattagtgctggattgactgacttgattgctcaactcaaataaatgactaaatactgcagctttccagttgcagtatttttttgttttctaaaacggaataaaagttcttttaaaaataaataagactatcgtataatttttaaaattaaaaaatgtattaaattaggcatttataaaagaacgtttaataatattgcggttctaaaaacagtgaaaaaataaactaacggccatgatggaaatcaccatcacgaccgttagtttacataatttttattatgttacttattcattagcagttaacttgctaggatcgcccattttataacccgaatttttagtcaatttaaaggtcttcttcaaaccgttgctgacgtaaactttcttgtctttagtcacaaatactgcctgaatatttttctggtgcttattgttgatgtaggctaaaccacctttaacgcctttattgaaggcagcgtttgatagcgcatctccgtcaactgatttcggtgaaacgatcgttacccctgctagactgttctcatacgggtagccagttttcatattaaacaaatagatgtaggtatggccgttagccttcaaatacttctcatagataccggccgtcacgactgaaaggtttttagctggtaacgtccctaaggctgtgcctcgcgtaccgtagggatcttggacgcctacctgccatggcttgttcttacctgctggtgaactacccatcaccaccacgttaccaccaagatcaataatcgccgtattgaccccatttttccggaatacctcgcgtacttgatcagcaatatagcctttggcaataccaccaaaatctaaccgcatcccttttttagttaaatacaccgtccgtttgctggcatccaatttaacatcatgataatcaactaaaggcagtgcctgatcgatttctgattgtgccgggacccgcgcaccgggtaaaccaatcttccacaaattagtgatcgcaccgatcgacatatcgaaggctccattggaatttttgctataatacatggctttttccattaatggccacatatctttactaactttaactggcttgatccccgcattcgcattgattttatctaactcagaatgagctttagttaaggttgcttgcttttccgttctagcaatccgatcaaaccccttctgtaatacttttttcttacctttattgtagatcgataacgtgcagatcgtccctagcatgaactcactacgtttatatggttcagaaatgaccggtgcggcttgctttttcgccgtacaggcacctaacaccaatggcaataataatagcatcaccgccgcaatgacggatgatcgttttcgtaacatgttctacttcccctccacaatttggttggtcattaagtaatgatcgttcttagctatgaccaaccatttttggtttcctaatctagtttatctaaatgagaacgctattacaataactcgcggttgaatttagtaaattgtcatttcttttctactacaaatcctttacaatggtgacggaaactaattgtgaggtgttcggattgaaacaggcaaaaattttaagtcaaattgaaaaagccaagcagcaacacacgctggtggaagtctatgtcaagaagcaaaccggtgaattcgaagtcggctaccccatcgtcagtgatcatcgttggctgatcatcgcgacggtgaacgcacagggacaatttgctggttataccttatttgcgttaaagcggatcaaacgcgttcgtagcacgacgccttatttaaaaatcattacaacttatcaggacttttttaaagcacacgagcaatacgatccattccagcttagcgaaaaagaaacaacgatcagtcagtggtccaaacaactactacccaagctcttcgccgctttgactaaggaacgggcttatattaccattgctggtcggtttgatattaccccagttgaccaagtcgttgccgcaaccgcccaccacttcacttgcttaccgtttgatcccttgacttaccaacatggcgagcctgtgatcttagcttacaaggacatctcatttttgcaattctgggatagcgctgacctgctttatcagcaaaccagcgagaaattaagtgaaaaaatctaaaaaaatggcgctgatgcataagattttatgcaccagcgccttcttttatagctcttgtttaaacatcagcatgtctattgcttgcagcttattttcatagattggttgcggataggtcgcaaagaaatcgtgttttattcgatccatgcgaaaaccaacgcgctgataaaaacggatgttagcaatactcgaattggccgttcccacaatgcaagtctgataaccctgttcccgcaataatttgagcaattgttgcacaaaccatttaccatagccatgatgctgttgctgcggcagtaagcctaagtttttcaattcaacgacctgcttattttgcggaataaccagcgctacgccaatcgttagtttatctctttgtagcaaatacaactggccttgatctaggtaactagctaccacttccgctgcgtcatccccaattaatagcaaattttgatacgctgtccgtgcaccggtagccagcttaattgttaattcagccactacttcaccctcgtttataatattttttatactgataaaccactttaccaacaccgacgcaagacaataccaaccacgaagcaagcgacaaaatcagtagattagtgaagctgcgcggctgtttaaattgcaagatcaatgtattacggccgatttcttgcggaacaacaggcgcaccaatattagtttcatcgtactgataactatttaagcggtgcccgttcagctgtaaaatagactccttgtacatgatcagtggcacttgccgataatcacgccgctcagcattccaagttagctgtaatcggccaccactaagtactttatgttcaaattcacgatgtcgatcaatgatttgtttttcatattcatcggaacgtttaaagttcaaacgtttaaattcgttgggaatcggcaaataatctggatgacgcttttccaccaatgttaataattgacccggatgttcggcgtgtaatgagctgcggatctgatcaggcgtgtctgctaaaaccgttacgccagtccaactatccagcacatccactgaatgataagtctccgcctttaacgccatgctaagcatatttggcgctaagcacaataacacggcgatcaacgccccgaagcgatagtaacccacgcgacgctcactgcttaaacgcaactgcgtggcactgatcgccgccccgcaaaacagtaacggataggcaatgatcgtgaagcgaactggaaattgcaatgtactctgtaaaaaaggcaattgatgttgcaaggttacccatgggaataaatcagaggcaataaatagaatcaacgcgccaatcaccgttacgatccgattaacagttgtagctcgcttactgacaagcacataaaccagctgcgccgcaaaaaggaccaagaaaaccgcacctaactgattccgctgcccaaggatcatcgaaaactgtaatgcattttgctccagcgtaaattttgccggctcagcaatactattatttgcaaaaatagtcagaaaacttccccagatgttggccgtcaataaaattgtcaataaagccgctaaaatcgtatccagcagcatctttattttatcatttgcccgccataaaccaatcatgaaaaatggcaataaaactagcgtaaacagaattgtacttaatatatggatctcgatgatgatcgccatgatcagcgccaacggtattattttgattggccgctggtggtcgctgatcatccgtactgcacagatcaatacaaatggtgctaaagcagcgccccaggagttcaaattttgtgacaagccccagcgtggcagccagcccacattcataaataatagcgccgcaatcaacgcaatccgcttagtcgcccgcactttcgttgccaacaagtacatccctatgccgccaatcaaatacactagcaaagtcgaaaagatctggaaatgataccaactacgaaccaaaattagcagtacgccgcttaaataagcaaagtatggcccatataatgcattgatgatccgaccactttgttgaaacccataattggtttgaaaatagctaaaattaaagttgtgcatctgcttagctgcatcatagattcgattaaaatgaaagatcgcgtcggaaccaacgatcgtactatgcaaaattaactgtggcaatattaacagtaccgccatccccgcaatccatacatacggtaccacatcccgccaataaatccttttaaacacaatatcaaaccccatcaatcatatttagccccgcactaatgtatgtccaactatactacagtctttatggttatataatcatgtttagtattttttaaatcaattttagaacaatatttactttataccggttagcctgaaaaaagcaaaaaaaaggcgcacagctaaactgtacgccgaaaatttatttagatttttttaatttgctgcggtaataccttacgtgatagccatggtaacagtcgctcatacgcgatcaagaagacaacgctgaccagcacccctttaatcaaattaaatggcacaaccgttgtggccactaaattcagtgtggtagcattgatttggatacccgaaaatttcatatagatcggtaataacacaaagagattagccaaactcataaaaatagttaaggagatggtccccgtcacaaaaccagctaacatattcttccggttggctttaacgctgtgatcacgtttaaagaaataatagaccggcagtgtaaagcacatcgtcgctaagaagtatgctgcttcaccgatcaagccaggcaggccagacccacgcgtgataaagtccaataaaccagtgatcaacgtggtaaacgcccctgctgctggtccgtaaagaaacatactcaagaagatcggtaggttactaaaatcgatcttaaggaacggtgccgccggtaataccgggaagctgaacaacatcagtaagtaagagactgctgctagcatggcgatcatgactagctttctgacgcccattttttccataataaatcctcctacaaggattcacctcaggtaagtgagttcatcttacgcaaaataaaaacgctaccaaaatgtcttttaggggcatctcaatagcgttagtcttatttttaaattacgtaaaataagcctatcttcttctatctagactttaactatcggtattggtatcacaccaattcggccaccaataaattgatgggtcgcggactattaccgccggtcgggaatttcaccctgccctgaagacgaacctttattaaatttttttacaaacatagcttagcatgaaagcggcataattacaactactttgttgtcagcccgctttcagtctacattatttatgttattatgcttctactccgattttttcttataagtttaacgacctgtttactgttttttaaagcgttttccgttacaattaagataaccaaatgaaatacagggagtggcgccgatgaacgaaattgtttttttcaatcctggtgacgcgatcgccagcggtcacgattttaatgaagcgatgcgcagtgcagaaatttttcaccgtgatcaaaaacaacatgaactaatgatcgttaaagaagtcgatggtgaaacttacgcgatttttaacgcggccgatgcgcagattgacgacaccgccgctaatcgttaccaagtttctaagcgcttaaaataatgactagcaaaaaagacgagtgcgctcgccttttttcgtctgcttaggtagcaactacagcggcttcaataccgcctgcatatccgccggtaatggactggtaaaatggcgctcagtttgagtaaacggatcgtagaagttaagttcataggcatgcaaggcttggcgggtaatgccttgatccagcggaccgccatatagctgatcgccaagcaatggatggccttgttccgcaaaatgcacgcggatctgatgggttcgtcccgtatgcaactttacctcaactaaagtggcccgagctaatttagtcatttgccagtattccgtcttagccggtttaccggtggccatgactcggcggcgaatctcatcaccctgacgacctaagggctgggtcaagaaaccatgggtcgtcgttaaatgtcccgcaacgatcgcataatagcgtttatctaaggtatgatcagtcaattgtcgagcaatcagactatgagcaaaacgatggcgtgctaataaaaccagcccactcgtaaagcgatccaaccgggtcacaacgtgcggtaccgtttcagtattattttgttgttgcaaccagccctgaacccgatttaacaacgtatcggtttggttggtgggcccaggaatacttgagagatccgctggtttatccaccactaaccaatttttatctgcataaatcacatttagcggctgtgtgctgacagcgacctgctgttctgctttttctggcggtaattggatcgttacacgatcattttgttgtaaacgaacgccggttgacgccgctaagcgaccgttgatcaaaatccgtccctgaccagttacctgcttaaataagcgcccactaaccccatggtgctgcaaaaaataacgtaccttttcttcttgctcatccgttttgatccaactaaattccattacgttctgctcctcatcggccacaatttggctaattcactagcttaattataccggatattcccaataaccactatattagattataattagaattagccctattaataacggcaaattttaagtataatagatacaatttatgacaaaggtgagtgagttgaatggcaaatgaatttccacaagtaatgaccattgctggttccgatagcgatggcagtgcggggatgcaagcagatctttataccttttttgcccgcaaagtccatggtgctgcggtgatgacggcggccgtggctggtaattcttacggcatccacgctagtattgctttaccaaccgactttatcgatcaggaattcgctgatcttgcggacgattaccacatattagcggctaaaactgggatgttggccgatagtaccctgatcagaaacgtcgtcaaaaattataaaaaatacgattttggtcccttggtcgttgatcccgtgattatgacaaaacacggcgcgcagctgttagaagaaagtgccttcgctaccctacgtgaagaactggtgcccttagccaccgtgatcacacctaacttcttcgaagccgagaaattagcagaaatgaagatcacttcggatgccgatatggaagcggccgctcggaaaatcaaagcgatgggcgctaagaatgtggtcgttaaagggcagcatcacgacagcacccaaactgaggttcgcgatttcgttcttttagaatccggtaaatctttctggctgacggaaacttacgtcaatactgaccgagtcaacggtaccggtgattcgctgtctgcttgcatcacggctgagattgccaagggcgttgacatcgaaaccgcgatccgcacagccaaaaagtttgttcacgttgcgattgccaatgaaattcaagttggccacaagttcggtccgatcaatcattgggcctaccaagactaattttgtcaaaagcttgcgtcactgaaaattatctgctatgattgctttcagcaaagtacatagcgtcttatttttaaaaaaagtgaggtcttcaccgtgtgccgtaagttctggcgtaacgtgatcattagcgttattctattcgtatttattttaccaattctagaaatttcttggcaaattgccttgtttaaaattatttttactagcttatgtgggttagttctggtaaccagtatcttctactttgaagatcgtgccggcatgctgactgaccaaccaaaaaaagagtaagtgttcacggctaattgccgcgcagcacttactcttttttataactcacttaattgttgataacgttgccagatcttcaattgtactttaggttgagctaattcattaaaagccgccggcgctacgactcgtcccggaaagtaactgagatcaggtacctgggctaactcagcgtacaacaaagtgatctgccatttttgatgagtaaaggtatgcgtcaccggtcggccaccaatcaatgctgggatcaatttgatctgtgtattagcggtaaattgttggccagctagcgtgactaactcgggtaataataattcctctggtgcagtggtcagatctgcccatttcagcaacggaaccgtccagagatccgctaacatccccgttcccggtcgttgctcaaacaaatagcccgccggcgttttgatcaccaaggcaaaataatctaccggcactggccgcggctttttcgacttaactggatagtctaactctttcccatccaaataagcttgattgaactcacgcaccggtgaatgagcactatcaggattttttgccgtcatgtaactggaaccaaggtccatgattgcctgattaaagtcccctggtcgctcaactgaaataacttctttgatcacatcataaaagatctgccgtgactgcggcttagcaatatcggcgtcgatctcaaataagcgggcaaaaacgcgaaacgcattcccatcgatcgccggctctggctggttaaacgcgatactggcgatcgcgccggcggtataaggcccgataccgactaattgttctaattcagccgccgtttgtggccagacaccttgataatcagtgacgatctgttgtgccgctttttgcatattacgcacacgtgaataatagcctaagccagcccacgcctgtagcagcgcggcttccggagcttgagccaagtccgtgaccgtcggaaaagcagccataaagcgctgataataagggatcaccgtctgcacttgcgtctgttgcagcatgatctccgaaacccaaatatggtagggatcatgatcacgccgccaaggtagatcacgcttttcccgatcgtaccaagttaataacgccttttgaaaggctttgatttttgtttgtgaccattgttgcatcaagttacgccacgacctcacttttaaagattaattatttaactaaattgacacgtacaggcttgccgggcattgatcgagcttggcttcagtacattacacctgaaacgaatcgaagcacgccactacactgctaatagccgctcaggtcgattcatgcaaaaaattggcatgcgccaagaaggcattttgtgtaacgcccggcaatttaaaggccaaaccgttaccgaagctatttatgcgttgacggatgcagattttgccgccgccaaacgataagcacccccagcagcatgactaaaatactgccaccggctaagctaaacagcaagccataagaaaagaaatcaactagtagaccgccaatcaaggggccaaacgcacgaccaagtgaaatggccatgtttaagtccccttgcaggcggcctttttgatcggcactcgctagcgtatcgacccataccggaatcagcggattaccgagcatttcaccgatcgtcagcacgagtatcgccaccacaaaaccggcgtatgtttgcgcatagatcaagcaaaaaaacgatgctgcaaacagtgtcacaccaagcatcaccacttttggcaaagcaaatcgcgcaccaaaatgggtcaccaccggttggccaaaaacgatcagtaagccattgatcgtccacaacaagctataatagtgaaacggaatgtgtaagctagtcaaatgaacggagaccacactttcccacagcgcataacttgcataaataacgaaagtcagtccacataaaactaataacagccagcgttggtctgattttaatttaagtggttgggttactgcctggtcacttttggccttgatcggcacgcgaaaagtcaacgcaatgatcagtaataatagtaaataacataatccggcgaccgcaaaaacgtaacgaattccactagcatataaatagcccaccgttagcgtgccgatcacaatacctaaattaagcgccatataaatcaaattaaaaacatagcgccgctcatgactggtatcctgcgccgcataagcgttgagcacagtcatattgattccatcaccaaaaccaacgatgattagaaatagtgcgaaaaatggccacccgtgaaaattaggccaatcaaggcggctagcgaaatacctgtactgatcaaagctgtttcataaggccgccaacgatcaaacaactgaccgccaacaaaattcccaacgatcatcaataacgacatgaccaacaaaacaagcccggccgtcgtcaagctttcaccaagatcatcgtgcaaataaatcgttgttaagggccacataaaggcggcgccggcattgatcaacagattagccaacaataaccagcggagtttaattgactgcccgctcattttttatgtgcccgccgttgtcgttgaaattgggtcaggctcacgatcaataacgccaagccggcgatccataacggcgtcaattgccgagcgagccctaataaaagtaaaattatgccagccaaaaaaattgaataagttgttttcgatatcaattgcattatcccactcctctatcgtaaaagtctgtacaaatcaggtcgttgattgaaatcgacggcgccaaataagaccaagccatattataccatgccaccaactaagtctaataattaattgtcgctaacaaaaaaactacgactttttagccgtagttccactgctcaacacttattcagctgtccaccataacttgactagcgcctgtgtgccatcatcacccaacgctttgtcttccaccaaacgccggtacaactctgcagcagccttagtcgcaggcagatccaactgttgcttctgtgcttcatctaaagcgattcgtagatccttcagaaaatgctttgcaaaaaagccaggtgtataatcatgggctaaaatacgtggcccgtaattagtcaagctccagttagcagcaccgccagcgctaagtgtttcaattatgtccggtaagcttaagccagcctttttagcgtagaccaacatttcggtcatcccagtcatggttcccgcgatcatgatctgattggccattttagcatgctggcccttacctgcaccaccaaacagatgataactttgcccgatcaccttaaatagcggcactaactgttcatacgtcgattgaacgccaccggccatgatcgtcagcgtaccgtttttggcgccaatatcaccaccggatactggcgcatcaaccgcttggatatcacgtgtaattgccgttgcggcaatccgctgcgccaaagttggcgtacttgtcgtcatatccaccacaatgctgccagtattcgcaccagcaaaaataccttcatccccatagtaaaccgcttcaacatcctggggatagccggccatcgtgatcgtaatatcactgctagcggctacttcacaaggactatctgcccaagttgcgccactggccaataccgctgcagcatgagccttagtacgattataaactgtgaccggaaaattagccttcaataaatttttgatgatacctgtgcccatgacgccagtaccaataaaaccaattttttgcatataattcactcctctatcggacttaacggattgtttttgcacaatctactaacaaattcccagacgcgcgtagcttttatcagcaataataaatacccagcataacaataagcttgcgcctttgaacgacgacaaaaatgttgatagcaactaactacacgcccccgccagaactacctaaattcttcataactacctttattctaacattattcgctaggacttcacttgcaaaacccttgaaaaatgctatattaaggtcaatcacagaaatgaaaaagagggcgattttttgaaaagaaagttacgtaatattttgcaggttgtcgaagaacatggtgatcagatcgagacgttgatcaatcccagtacgttacaattaaaatttgccgcccaacccgcgtttgtcgatgatttgatcgttgatagtgaagtttttcaactacttaaattatacgcgccagatgaagcggttagcgtcacggcaccaatcaccgatctgcctaaattttttcaaaaaatgttccagaaaactagtgccgctgcggccaatgattataaaaaacatatcactgaaaatagtgagatcacagttacagttgagttgatcactgatgctgagcaccacgacatcggaacactcacgattcaattctggaaataatcacttaattatcgtgtccggtacggctgggcaataattttacgactaatacgtggggctaaacggttaaaagccgctagccactgataagccagcggtaagcgtaaaatttgttgtccgcgcaacgcactagtcacgatttttttagccactttagctggatccaattgactatgcgcaagtaattgggcgatcagtgaattagcttttaaatacggggctgtttgttgctgaaaatggccggtagctaataaacttggtataaccgtcattaaatggatctgcgtcacttgtaattcaaagcggctaccacgagcaaagccgagcaacgctgccttacttgctgaatggaacgctgcgtacggtaacggtagttcgccaccagccgaggccagattgatcaaataactcggccgccgcgtccagtagtgagcctgaataaatagctgacttaaagtcaatggcaccgcagtatttaactgcagcaccttttgcgcctcagccaatgacaaatcattaatggcgccaaaacctggtaatgcagcattattgactaaaatatccggcacaccacagcgcgccacacagcggcgccaagccgatcggccgttgtcgttcaataaatcagttgccaaaattgccactggggcagtggttaacctggcggcttgccgagcaacttttgccaaacgttggtgatcacgtcccagtaaaagtaaacgcatctggcgccgtgcaaaggcataagctaattgctcacccaatccggcagaagcaccggtgatcattactaattgcgtcattgtgccctcctcatttaaagcgtttacttttagtatagcacgccaatattctagtctcccaacttgcggcttttcactttgcaaattattaaaaatcacgcgaccctatctaattgtagagtttgcgatttttagttgacttgttcggcgaccgcatcgatcagcggctgcattttatctatatcttcatcacactcaaaataagcaccgtgatagatgtgctgcacctcagggtcaatatctggataacgttgatcaaaggctttagcttgataactgccatcaggagccacaataaacaccacacaccccgccgcgattttatatttatgcgtaaacgtcaccggcaatgtgaattgatcaatcccattcttggcttgccgtaatttaatcgaatgcgccacattatttacgatcgtttcaaatttcatttttcgacctcactttttctcttgcgtccttaaaattttaacacaaaataagtgtcatttctttaccgactaaaagtaagttgatataatactgccaaccaatcaactaagggggccattcttatggctaaattactcggtttacatcacgtaacagcgatcacttccagttcaccaaaaatgtttgcatttatgactggtgtacttggtctacacttgattaaaaaaacggttaatcaagatgatgtgcggacttatcacctttattttaccgatgatcgaggaactgccggtaccgatattacattcttcgattttcccgggcaatttcaaggcactaaaggacgtaatagtatcgatcgcatcggtttccgtgtacctagtgatgctgctttagactactggcaacagcgctttgacgaccaccaaatcgaacatgaagcgatcgtcactgaatttggtgccaagactttgcgcttctatgattttgatcatgaacgttatcagttgatctccgatgaaattaatcatggtgtgcccgccggtaccccttacctagccagtccagtaccaaaagaatttgcgatcagcggcttaggaccaatgcgaatcaccgtcaactatgcagcaaaaatggcgcaagtgctaactgaactacttggctttgctaaagtcgccactgaaggcaatcaaaccttgtatgaagtggctaatggcggtcatggtgctcaagtgatcgtggctgatgaacaattaccagccgatgaagtacaagcttatggtaccgtccaccacttggcctttcgtaccgccgacgaagcggatttacgtgaatggatcaaaaaaatctccgcagctcggttggctcactctggcttcgtagatcgtttctattttaaatcagaatatttccgtcctggtcgcggcgtcttattcgaaatcgccaccgatggacctggtttcttagttgacgaaacttatgaagaagctggcgtacatctagaactaccaccatttttagaagaacaacgcgcagatattgaagcacacctagttcccttcaatacggataagaaagcagccgattaaccatgactgaactcaattactattttcaagcaggtgaccctgcacaagcaccacttttaatgctccatggtactggtggctatgaggatgaattagttccgctagcacaaaaaatagcgcccaatagtccgctattaggtattcgcggccgtttagttgaaaatggccgtacccgttactttgctcataccgcaacgggcggctttgaccttaacagcctagcacaagagacaacttggctgctgcaaaccatcgaccaattggccgttaaacatcatttggcggctaaccgcatgatcgtcctcggttattcaaacggcgctaacatggcagcacatgcttggctgaccgggcaagcccagtttaaaacgggcctattatttcaccctatgcagttaacaccgtataaaacggtccaaccattatctgacgtaaaaatctgggcttcccacggtagttttgatccaatcgtaccggcagctaactttcaaacactgacccaaagcctgacaactgctcaagctgatttcaccgtgtttgaagctgagcagtctcacgccctcagtccgcaagaaataacggcagcacagcaatggttacagcaaagccaacgcttataaactaaaaagaaaccaacgcaagatcgacttttgcgttggtttctttttataaccgtggaacatcattttcatgtaagcccctatttcttatggctttcttcctcgtcggtacgtaaaacagccatgaaggcttcctgtgggacttccactgaaccgatctgtttcatccgtttcttcccgcgcttttgtttctctaacaatttacgcttacgggaaatatcgccaccgtaacacttagctagcacgtttttacgcagtgctttaatattagtccgcgcgatgattttattaccaatagcagcttggatcggcacttcaaactgttgccggggaatgattttttgcaatttagcaacgatatcgcggccccgctccattgcgaagtcttgatgcacaatgctgctcaacgcgtcaaccgcttcaccgtttaataaaatatccattttgactaacttactttcgcgataaccttcaatattgtaatccaatgaggcgtaacctttagtactggattttaatttatcgaaaaagtcataaataatttctgacaacggtaaatgatagatcacattgactcggttattgtccaaatactccatggtatcaaactcgccacgcttattttgcgacagctccattaccgcaccaacataatcatttggtaccatgatcgaggcgtgaacgaaaggctcttcaattgaacgtaccgctgctggatcgggcatctctgatggattagccacaactttttgtgtgccgtcagtcaaattaatgtgataaattactgatggagcagtggtaatcagatctaaatcaaattcacgttcaagccgttcttgaataacgtccatatgcaacaaaccgaggaaaccacaacggaacccaaatcctaaggcttctgaggtttctggttcaaagcttaaagcagcatcattcaagcgtaatttttccagcgattcgcgtaattcattatattttgatgaatccaccggatatagtccacaataaaccatcggcgtcattttacgataaccttgaattgctcctgtcgctggattatccgctaacgtcactgtatcaccgacttcagtatcctgaatcgttttgatactagcggtaatataaccaacatccccggccatcagcatctcccgctgaacagcctttggtgacattacgccgacttcagtcacttcaaaagttttgccgctttgcattaacttgatcgtatcgcctggcttgacgacaccttcaaaaacccgtgtattcagcacaaccccacggtaactatcgtaaactgagtcaaagatcaacgcacgcaacggtgccgttagatccccagttggcgccggaacatcactgacaactcgttctaaaatttcttcgatcccaattccttgcttagcactggctaacacggcatcttgggcatcaatgccaatatcgtcttcgatctccgccttaacgcgttcaggatcagcagctggcagatcaattttattgatcaccggaatgatctctaagtcattatcgatggccaagtaaacattggccaaagtttgcgcttcgaccccctgtgcggcatcaacaaccaaaacagccccttcacaggccgccaaactacgggaaacttcgtaagaaaaatccacatggccgggcgtatcgatcaaatgaaatgtataagtctgcccatctttagcttgataagccaattcaacggcatttaatttgatcgtgatcccgcgctcgcgttcaagatccattgtatcaaggatctgtgcctccatatcacgcttagcaactgtatgcgtcaattctaagattcgatcggctaaagtcgatttaccgtgatcaatatgagcaacgatcgaaaagttgcgaatatgtttttgacgttcttgcatcgctttaatatccattatcttgcctactttctcaatgcccactcacgtaggctattcctttaaattatagcaagctcgccgcgttggtgcaattacgattaccgtactcgcaaaaaaacaggtggcatttagccacctgtttgttgctacttcttgcgtttaccgaataacttatcaaataagttgccttcggtttcagtcatgtcttcaccactagctttggcaaaagtcttcaaagcttctttttgttcgccatttaaatgcttaggtgtaacgactttaaccttaacgtgctgatcaccacgaccattaccacgcaaacgtggtgcgccttgtccacgtaaacggaaagtggtgttggtctgtgtgccagccggaacctttaatttcactttaccgctaacggtatcaacttgcagttcatcgcctaaagctgcctggacaaaactgatcggcacttctaaatagatctcagcaccgtcacgttcaaatttatcacttggtgccacgcggaaaacaatgaatagatcgccgtaagggccaccgttttctcccgcttcaccttgttccgacaaacgcatttgttggccatcttcaaccccagctgggactttgactttaacactatggcgttcttcttcgtgaccagagccatgacaagttgggcacttttctttgatttctttaccggtaccatgacaaacatcacagacttcacgtgattgcatccgacctaatggcgtttgccgtgtgacttgaatatagccagagccatgacatttatgacaagtatcaggtgttgtccctggtttagcgccagtcccattacaagtatggcacatcgcctcgcgggtataagagatcgtggtttctttaccaaaaaccgcttcttcaaacttaagatccatctggtattgcagatcagatccttgccgtggtgcgtttggatttgagcgttgaccaccgccaccaccgaagaactgactgaaaatatcgtcaaaaccgccaaagctttgaccgccaccaaaaccaccaaagtcttggccaccaccaaagccgccgaagccaccttgaccttgtggaccagctgaaccatattggtcatactgcgcacgtttatcagcatcacctaaaacttcataagcttccgaaatatccttgaatttctgttcagcatctggtgccttgtttaaatcaggatgatatttctttgaaagcttacggtaggcgcgttttatttcatcttgtgaggcgtcgcggctaacccctaaagtctcataataatctttatccgccatgcgtattaagaacctcctagaaatttacgcaaatttgacgaaacttgccaaaacaagcgtcaaactgcactccgttaccattaaaaacttcatcaagcataccatagattaaaacaaaaagccaaaagccgcgatggctttggcttcttgttggaaaagatatactactcgttttgttaagcataaacgtgtttcataaggcaacttcttccatataactacgtttgccaaacgagccacgctgtgtctcttattagcaaactaggttatattccagaagctgaccgccttacggcacactctttattttttatctttatcggggtcgacttcttcaaagtcaccatcaacggtgttgtcatcatctttcttagcatcaccagttgcttgacctgcagcgtcgccgcccttagcttgttgctctttagcagcttgttcatacattttaacggataaatcttgtacgatcttattcaaatcgtcgcgtttagccttcatgtcgtccaagttgttttcttcttgagctttcttcaaagcatccttagcatcttctgccttcttgatttcatcatcggatactttgcctttcaactctttcaaagtcttatcagttgtgaagaggagttgttcaacgtcattacgtaaatcaacttcttctttcttcttcttatcggcttcagcattttcttcagcttctttttgcatccgttcgatttcttcatcagaaagacctgaagaactcttgatcgtgattttttgttctttttgggtgcccatatctttggccgaaacgttaacgataccgttcttatcgatatcgaatttaacttcgatctgaggtacaccacgaggtgcagcaggaatgtcagtcaattggaaacgacccaaggtcttatcgtcagctgccattggccgttcaccttgtaagacatggatatcaacggctggttggttatcagcagcagttgagaagacctgtgacttgctggttgggatcgttgtgttacgatcgatcaacttagtgaagacaccgcccatagtttcaatacctaatgacaatggcgtaacgtcaagtaaaacaacgtctttaacatcaccagtaataaccccaccttgaacagcagcgcctaaggcaacggcttcatcagggttgattgaacgatctggttctttaccagtccattgtttaacggcttcttgaacagctgggattcgtgtagaaccaccgtttaagatgactttatcaatgtcgcctaagcttaatttagcatcgcgcaaagcattatcaaatggtactttagtccgggcaactaaatcggcagtcatttcgtcgaatttagcacgagtcaaagttttctccaaatgcaatggacctgcgtcaccagcagaaataaatggcaagctgatctgagcttcgttaacaccagataagtctttcttagctttttctgcagcatcctttaaacgttgtaaggccatcttatctttagaaagatcgatgccattatcttgtttgaattcagcaactaaccaatcgatgattttttggtcaaagtcgtcaccaccaaggtgtgtatcaccattagttgaaagaacttcgaagacaccgtcgcctaattcaagtacagaaacatcaaatgtaccgccacctaaatcgtaaactaagatcttttcatcagcgtcgcctttgtccaagccataagctaaggcagaagcagttggttcgttgatgatccgttgtacgttcaagccggcgatcttaccagcatctttagttgcttgacgttggctatcattgaagtatgccggtacggtaataaccgcatcgttaacttcttcacccaaataatcttcagagaatttcttgatatattgcaagatcattgctgagatttcttgtggggtataagatttgccatcaacatcaactttgtagccagcttcgcccatatgacgtttgatcgaagcaactgtatttgggttagtgattgcttggcgtttagccacttcaccaacttgtgtttcaccatttttaaaagaaacaacggatggtgttgtccggttaccttctgggtttgtaatgatttttggttcgttaccttcaagaacggcaacggctgagttagtcgtcccgaggtcaataccaattactttagccataaatttctaacctcttttactaatttttatttttattgtgcgacaacgaccattgctggtcgtaagacgcggtctttgagcttatagcccttttgtaatacctgtaccacggtatcaggtttttgatcaccttccaccgcaacggtttgtaccgcttggtgaatggtcggatcaaaggcctgatcggcagccgcgatctcaatgatctgatgatctttcaaagtccgttccaaatgatcataaaccatttggacacccttcttcaattgttcaccgttcttatcattgacatcaactgctaaggcgcgttccaagttatcgatcactggtaaaatatcctttaccagatcctgaccttcatacttaagcaattgctcgcgttcctttttgaaacgtgtattcatattctgaatttcagcttctgcccgtaaatacttgtcttctgtcgcgtcaactttttcttgtaacgtcttgatctgctcagcttgtggatctgctgccgcagaagttgcttctgcagtggcatcagttgctgaatccgcggctgaatcagctgttgcagaagttgcgctggcactcttaggtgctgtgcttgccgttaaatccttctctgaaggaaaatcagcgttttgtgctaaagcatcttcagctgcggcttgttcatttttagccaaacaaattcacctccaatgatcactcatccccgcgatgggtataataatcagttatttttttggccaattcttcgcggaaaacatcgagtaaaccgatcatccgtgaatatggcatacttgtgggacctaataatgcgatcatccctttgccgtgatcgcccacgtcataagtggcagtgatcaaactaaagttacgcagtaaatcgctagttagttcgtcaccaagtcgcacttcaatggaccgatcagggacaccgatcaatttagctaaatcatcgttttgatcgatcaaactatacaatgatttcaattgatcaacatttttgacggtggccggattgatcaagttcatcttaccgtccacataaaagcgttcctgggccgcctttttcaagacgttaccaaaaatatccaaaaagccagttggcgtgatcagatattgggtcaaaagctggggaatatcgctatgcagacgcttgatcacgtcagtcaacgataaaccgaccaattgatcattgataattcgaatggccttctctaagctctcactatccagctcccggggaacattgaagatttgattctccaccgccccgttatcagtgactaaaatcgccataacttgctggtcgcctaaaggaactagccgaaaaccagttaaccgtgcatcgcgtaactcagggcctaatgaaatagcggtgtaactcgtcaaactcgaaagaatcttggctgactgcgcaatgatctgatcaatttgatgatagctttgatcaaatgacgtttcgatcaccgctaaatcgttggcatcaacactacttggttcaactaaatgatctaaatagtaacgataccctttagtcgatggtacccgccctgaagacaaatgcgttttttcaatcaaacccatatcttctaaacggaccatctcgttacgaacggttgctgaactgacatgcatgggtagttggtcgagcagctttttagaaccgacaggctgaccactttcagtatacaaacggacgatttcctttaagataaccagttgtcgcttggtcagcattcgaaccacctctttttagcacttaatacatttgagtgctaacacaattattaatataccaactccacacgtttaagtcaaggcaacagctggtttttccgctaaattatccaaaatcagtcttacgacggagaaatcgctcagcactaaaaattcgctcactttccaaggttaaagttgcgctacaaatggctaagtttcgtcatccaataagaaagcttgaaaaacttcattccccataaattcaccacgacgagttaaatgaatatgttgctcatcctctgctaacagcccacgcgccactaattcagcgatcgtcgttccatagagttctgccattggtagaccaaacttagccgcaaagcgtgctttgtcgacgccgacaaccgttcttaacccaagaaacatttcttcttcgatttgttcactacgtggcaagacatgccgttgcaagacaggcacgtgtccctcatgtagcggggttaaatattgttggatcggaccaaaattttggtaacgttccttacctaaataaccactggcaccggcaccaaagccgaaataattgtcattgcgccagtaggtcaaattatgttgtgattcgtagcctggtcgtgcaaagttactgatctcatactgaggtcgtcccgcagccgcaaatttttccaaagccaactcatacatatcagcttcaacatcttctgaaggtaaatgtaatttaccctgccgcattaaattatagaaaactgtttttcgttccagaatcaatgaataggttgaatagtgtggtagatccagcgcaatcgctttatccaaactatcggtaaaatcagccatactttgccccggtaagcgaaaaatcaagtcaatactgatgttttcaaaaccaactttacgtgcatttgcaatcgccgtataaacatcagcgctacgatggattcgcccaatctttttcagcacgtcatcattaaatgactgcaccccgatacttaaacggttaacaccatgggtatgcaataccgctagcttatccgtagttagtagatcattgggattggcttcaaaagtgaattcttgaccagtaaaaggtaaaatctcctgcataccggttagtagacgatctaattgtgtcggcgtcaaggttgtcggcgtgccgccgccgacatataacgtatcaattgttttttcaggatgggctgccgtgactaagcgcatttcttgtaataaacaatccacataatcatctaccggttgtcctgccaaaaaaactttgttgaaatcacagtaatagcaaatatgctcacaaaaaggaatgtggatataggcaccggtcatagtgtcacctgcccactatgctgggtaaaatagtcctgagtatgctgtttatcttgctgtaattgttgaactaagccagcagcatccgcaaattttatttccccgcgtagccgcgaaaaccacgcaacttgcacctgttccccgtagaccatttgatcaaagtctaaaacatagatctcaaccgtcactgcgttatcatcaccgaaagttacattacggccaatcgaagtcatgccagtgtaccagcggccagcaatggctaatttaaccgcataaataccgatccccggcacatgttgtgcaggatcgatcgctaaattcagtgtggggaagccgatcgttcgcccacgggccacgccatgtaccacgacgcccacattgcggtagggataacctaacagccgatttgcttgatccacatcgccagccttaattgctgcccggatccgcgttgaactgattttagccgcattatcttgctgctgagcgacctcgaccacatcgaagcgcccattggcataacggggtaaatcttgcatcgtcgcctgctcaggaccaaaagtatagtcaaaaccagcaaccgctacttgagcgtgcagtccaacaatgtattgatccacgaaatcagcgggtgataatgccgcaaacgcagacgtaaactccacaatatataaaatatcgacacctaattgcgccatcaaatcagctttcatcgcaggcgtcgttaaatacttcatttgttcagcatccaattggtggaataccaagccaggatgctgattaaaggtcatcaccgctaagggtatttgccgttgccgggcaatggtcgcggcccgtttgatcacagtctggtgaccacgatgcaccccatcaaaaaagcctaacgtcaaaaccactggcgtcgcactaatttgatcaacagtatatggatgatgaattcgtacgatcttcattaaaccttgactccaatctaaatagaattattcatttgccagaaacattttaactggctgaaataagtgcgggtactctggatgcggccgataaagggccttgatcttttgatcataaactaacgcgatcacttcatctaattgcgtcaattccgctcgcggtaaaaaggcgccattttgcacctttgcccactgttctgccgttaactcaacttgtggataagcgcttagggccgtctccattggacgcaaaatcgttgccaatttatcttcagcgcttaattttgccacggtatccagatcaatcgtatcggctaaagtaaagccaccactttgtacccgagtcagtgctgacatcaccgccgcaacacctagtttgcggccaagatcaacggctaaagtacgcacatatgtccctttagaacagctgacctcaaaacgaaacttctgtgtcccggcaaccgcgtcgaattctggttcatttaagcgtttaaaatcagttagcgtcacttgccgttgtggtcgttcaacagtttcaccagcccgagcatagtcatacagccggcgccctttaaccttaaccgcagaaaacatcggcgggatctgcgtgatcgttccaataaaagtttgcatttgcgcatcgatctgagccgtactaaaggcagcggtgagtggtgttttttcaaccacctcaccatccaaatcttcagtcgtggtcgcaaaacccagcgttacctcaccctgataagttttgccgccggccaccaaatagtcaacgaccttagtggcagtcccaatacagatcggtagcaccccgtctacatttgggtccagtgtgccgccatgaccgacacgacgcgtatgaaataagcgccgcagttgggcatcacaatcgtggctggtcatgccgcgtggtttatatagtggtagaattccgttcattattttcctccgccttcatgattcacatggctatctcaccgtaaaagtcttaatattcatgactcttacaaactaaatcattatagcacatttagcctagtcactagtcggccaacaaaatagcgcaaaaaaacagacctgaagcaaaattgctcaaggtctgctaaattttaacttaacgctcttcccgatgtaactgattgatcagttcatcgattcgattaccgtactgaacagattcatcccgagcaaaagtcagttcagggatcttaaataagcgaatccgttggcctaattccatccgaattaagccggtagccttctctaagccgcgctgtgctttttcaccgtcgccggctttgtcagaaagaatactgtagtagatcgtcgcttgctgtaaatcgccagtgacgttaacgccagtgatggtgacgcctgcgacccggggatcacgcacacgcttcaataaaatgtccgttgtttccttttgaatttcttgggaaacacggccaatccgatattgtgccattacgctacctcctattacacaattaaggtgatttattggccaaaaacactaataaattttgatgttcctgtcggtgaccattcttgtggcaaactactcgccgcaagaaacatggccctattacacaattatggtgatttattagccaaaaacactaataaattttgatgttcctgtcggtgaccattcttgtggcaaactacttgccgcaagaaacatggccctattgcacaattaaggtctaaacgtatctaaaactattcgacgggaacttcttccatgatgaagacttcgatttggtcgccttccttgacgtcattgtagttttcgatcattaagccaccttcgaaaccttgtttgacttctttaacatcgtctttcaaatgcttcaagctagcgatcttaccttcgtaaacgacaatgccatcacgaattaagcgaacgccagaatcacgtttgaccacacctgaagtcacgataaagccagcgatcgtgccgactttagaaactttgtaggtttgccgtacatctaactgaccgataaccttctcgcggtaagttggttccagcatccctttcatcgcagtttctacttcatcgattgcgttgtagataacgttatgcaaacggatatcaacgtcttcggtgctagcttggtctttagcccgtggtgttggacgaacgttgaaaccgatgataaccgcgttacttgcagcagctaaggtgacatcactttcattgattgcaccaacggcttcatggatgatattgacccgcacgccttcaacatcgattttttgcaagctattagctaaagcttcaactgaaccttgaacgtcagctttgataataatatcgacttctttaagttgaccttcttgcatggtttcaaacaaattgtccaatgtgacatgcttcgtccggttacgttgagccaaaacagcttgtttagcccgttcttcaccagcagcccgtgctgttttttcgtcatcaaagacgataaacttatcggctgattctggtacatcacttaaaccagtgatttctactggtgttgatggcttagcttttttgatccgacgaccacggtcattagtcataacacggacacgaccaaacgtgttaccgacaacgattggatcaccgatgcgtaaagtcccttgttgaactaataacgatgcgacagcacccttacctttatctaaacgcgcttcgataaccgtaccggcacctttttgcttaggattggctttcaattccagcatgtcagcttccaataagatcatttccaataattcgtctaggttcttaccgaacttagctgaaattggaacgaagatcgtatcgccaccccagtcttcaggaatcaattcatattcagttaattgttccatcacatggttcgggttagcattcggtttatcgattttgttgaccgcaacgataattggcgcattagctgctttcgcatggttaatggcttcgatcgtttgtggcattacaccatcatcagcggcaacaactaaaacaatgatatcagtcacatcagcgccacgtgcacgcatatcagtaaaggccgcatgtcctggggtatccaagaacgtgatcaaacgatcattcgacttaacttgataagcacctattgcttgggtgatcccgccggcttcgccttcagtcacactagtatggcgtaacttatccagcaaggttgttttaccatgatcaacgtgccccatgatcgtaacaactggtggccgcttttcttgataactagtattcgcttcttcagcagcaaagaatttatccaaatcagaaatatctacttgaactttttcttcagctttgatgccgtaatccgccgccaaaacttcgatcgtatctttttctaacgactggttttggttgaccataacgcccatcatgaataattttttgatgatttcggctggttcacggtggatcaacttagcgatatcttgaacgttcatgccttcagtgtattgtaatacttctggcaaagcccgttctttccgcgttgttggtggcgtaacagaatggttctggcgtttgttacgacgattgcgcttcttgttgaaacgaccgccgccagcattgccaccaaaacgattgttaccgccacggccgccgcggttactattattgttaccaaagcgactgttactattacgattaccaccagcagtgttgccaccaacggtaccttgattacggttattgctgcttcttaccgtagaattagccgaactgattggttttgctgcatttactggtgcccggttatcagcgcgattttgtgggtttggtgctacccggttattgctagctgatacccgtggcttgttattgtggttgttattatggttataacgatcattacgattttgtgaatgattgttgctaccatgctggttttgattactacgttggcctgagttgttgttactgtgttggccttggtaattccggtttggttggttgcgatcacggtcattatgtgcaggtgtatgcgcgtcatgactgtgttcgttacgcgtcggttgttgtgggcgtgctgcctgaggtgctggcgctgcctttttggtgtgatccaccggctgagtatttggcgtattggccacctttccgccactgatcgcgttacgcaatactttttcttgcgcatcgtcaatcgtggacatatgattcttaatatcgattccagcttttttcgcccgatcaatcactacttttgattggacatctaattctttcgctaattcgtagatacgttttttacccatatcttcacgctccctacgttttcagtaaggcaataagtcggcgggcaaacccagcgttggtgataccaacgatcgtacgcggtcggcctagcgcctgactcattgcttccttcgtgaaggctgttattactggtacgtgataaaaatcgcctttagcgctaaatttatcacgtgttgcctgactagcatcagctgcgaccaacaccaacatcactttctgttgctggatcgcttttaaaactaagccttcacccattgtcaatgcacctgctcgtaaacttaatcctagcaggtttagtactttttgattattttccatttttatcgccaaaaagttctttacgcgctttttgatgtttcacataagctaatagttcgctataaaaatcatcgtcaacggtggcattcaaagccttatctaagatatgcttttttgcggcttcttcaacggcagtgggttcaagtgaaacgtaagcgccccggcccgactttttaccagtcggatcgattgcgacttcgccttctttactgcgaaccacacggaccatttctttttttggtttcatttcattgctgacgacatctttacgcatcgggatctttcttggtttcatactcaagttttgctccttttccgttgattagtcgtttaaatcagctgcgtcatcagggacagttggcgcatcatcagttgctggcgccgtttctggctctgccgcagaagctgcttcttcagcaggtgcagcttcagtcgttgacgcagtattagccaattcatcagcctcagtttctgacttgatatcaatcttataacccgttagcttagcagccaaacgcgcattttggccccgtttaccgatggctaatgataattgataatcaggtacgatcactgtaacggctttgtcattttcaggatcaaaagtgacatcaacgacttgggctggattcaatgcatttgcaatgtattcagctggatcgtccacccattcaatgatatccatgttttcaccggataattcattgacgatggcttgtacccgctgaccacgtgggccaacacaggtcccaaccgaatcaacgttggcgtcatgactgcgaacagccattttagtccgatcgccggcttcacgagcgattgacacaatttccaccgtgccatcatagatctccggaacttcttgttcaaataaccgtttaactagatccggatgagttcggctaacgtagacttgtggtccttttggtgtattttcaactttggtcacataaactttgatgcgatcatgcggttcgtaatgttcgttcggcatttggtcactcttagacaaaatagcttcgatcttgcctaaattaacgtagatataccgactatcacggcgttctacgaccccttgcatgatctcattttcatacttgatatattgatcataaataatgctacgttctgcttcacgaactcgttgcatgatgacttgcttagccgtctgggcagcgatccgtccgaaatcttttggtgtgacttcaaaacgaatatcatcgccgacttcgtaagcttcgttgattgccaaagcttcctttaggctaacttctaaacgtgaatcgaacacttcgtccgttacttctttaaccgcataaacgtgaatgtcgccttttctctgatcaaattcaacttccacattttgtgcttgaccataattacgcttgtaagccgaaactaatgcagcttccagcgcctcaatgacaacttcttttttaacgcctttttcagactcaagggcatctaatgcacttaacatttccttgctcatggtaattgttccttcccgattaaaattcgatggctaatctagcttgcgcgatctgtttacgcgcaaatgtaaattccttacgccgagttttaattttaactgacaacgttagctcttctggcattaccgccgtcaaagtaccttcataaatttttgtcccattaactgcttggtacaatgaaatatggatgtaactatttaaagcgcgctgataatcagcttctttttttaaaggtcgttcagcgcctggcgacgaaacttctagatagtaagcttgcggaatcgggtccggatccattgaatccagcgtttcactaattttttcactgatcatagcacaatcttcaagggtaatgccggcaggtttatcaatgtaaacccgtaagtaccagctcttaccttctttaacaaattcaatatcaactaattcaaattgatgactgtccacgattggttggacaacatcttggactctttcaacaaccgagctcaaaccattgcctccttttcgcaattttagtttgttccggcaaaataattcccctaatctttttaaaaaagcttaaaagtcctattaaacgtagaacaattgctgctcaataatggtgcattgttgcgctaaatgctgtactggcaacgtttttgcctttggtaaaactcactttatccaataaaaagagtgagcatcgctgctcactcgaccaaagtctctaaatacattcattatattaccacaaattcggttctgacgcaacttacacgctgatttacatcatatcgaacagggataactgattctcatctggtaaatcttccaagacgcgattttcagtcaagtaatcgatcaatgttttcgacactttcccacgcttacttaaatcttctttagacaagaacggtttttcttcgcgcgccgatacgatctgcttggcgacgttcatgcctaagctaggtactgcgcggaatggcgctaacaacgttttgccatcgtcctcgattaaaaattcagccgcatcagaacgggtgatgtcgaccatttcaaacttaaagccgcgctccaacatctcgttggctaattccaacacagtcagcaagttcttttccttagccgaagcgtccatacctttatcagtgatctctttcatcgctgacttgactgcgtctttcccgcgcgacattgccacgaggtcaaaatcatccgcccggacagtgaaataggccgcgtagtacaaaatcgggtaataaactttaaagtacgccacccgcagcgccatcaaaatatacgctgccgcatgggccttcgggaacatatacttgatcttcaagcatgaatcgatgtaccaatcgggcacgttaccgttatcgcgcatcgcttgctgccaatcatccgggataccgcggcccttacgcacgtgttccataatattaaacgccatcgatgcatccatcccatagtggatcagatccagcatgatattatcacgacaaccgataacgtctttcaaagtgacgatccccttttggatcaattcctcggcgttacctaaccacacgtcggtcccgtgagataaaccagagatctgcagcaattcagagaaagtcgtcggattagtttcttccaacatgccccgaacaaaacgtgtcccaaattcaggaatacctaatgtccccgttttggagccgatctgctctggtgtgacgccgaggacgtcggtacctgaaaataacgacataactttggggtcaactggtgggatcgattttggttcgatccccgacagatcctgaagtttacggatcatcgtcggatcatcatgacccagaatatccattttcaaaatattatcatggatcgagtggaaatcaaaatgactggtacgccacgatgcgttttggtcatcggccggatactgaatcggcgtgaaatcataaatatccatgtaatcaggaacgatcaaaatacccgcgggatgctgtccagtagtccgtttaacgccggtagtgcctttagccaaacggtcaacttcggcgccacgataagtttggccggtatcacgctcgtaagctttaacgtaaccgtaaccggttttatcggccacggtaccgatcgtcccggcacggaagacgttattctcgccaaacaacactttcatgtagttatgggcgatcggctggtaatcaccagagaagttcaaatcaatatccggcactttgttcccggtaaaccctaagaaagtttcgaaaggaatatcgtggccgtctttttccagctcagcgccgcaattcgggcattttttatccggtaaatcatagccagagccatattcacctttagtataaaactctgaataatgacattgcgcacaacgataatgtggtggcaaagcattgatctcagtgatccccgccaaaaaggccactaaacttgaaccgacagatccccgggaaccaactaaataaccgtctttgttacttttgtacactaacttctgcgcgatcaaataatggaccgcaaacccgttaccgataatacttttcaattcttggtcgattcgagcagcaacgatctccggcaactcttccccgtataatttatgcgctaacgtgtaggtcatattcttgatatcattttccgcaccaggcattttcggcgtgtacagtttgtctttgaccggcgagatctcatcgatccgatcagccagcgcattcggattagtgacgactaattgctgcgccacttgatcaccaagaaattggaatgacttcagcatttcatcggtcgaacggaaatgaacatccggcaaattgatccgattgagcgggttagccccaccctgcgaattgatcaagatcttacggtaaatcttatcttctgggtttaaatagtgcgcatcaccagtcgccacaacgggaagctgtaattcctcgccaatcttgacgatattgcgaataatatcttccaagtcgccattgttgttgactaattcacgctccaataacggtgcataaacgggcttaggcatgacttcaaggtagtcataaaacttcgccttatcccgcgcttcattgtagcctttttgcatcatagcagtaaaaacttcaccactagaacaagccgaaccaatcagaataccttcgcgatactgattgaccaaactacgcggcatccgtggaatgcggtagaagtacttgatcatcgatagcgaaactaacttaaacaagtttttcaagccagcttgagtctgcgccaataaaaccgcgtggaacggtcgtgcctgcttatacgcttcattttcgccgacacgatcatttaattgatcaacaaattccatctggtagtgttgcttggcttcctttaagaagatatacaacaaatgcccagtcgattcggcatcggcattggcccggtgatggtgttccaaactgactttaaagcgtttggccaacgaatccaacttatggttcttaaactcaggatgcagcatccgggctaattccaaagtatcgatcaccggtacgtcgatctgccccatattatgccggccaaagccagcgtttaaaaagcccacgtcaaaagtgacgttatgtccgactaatacagtgcccgcgtaaaatttttgaaacttagcgaatgcctcttcttcggtattggtgccacggaccatgtcgtccgtaatactggtcaaattgatcgtcgtttccgacaacggatgcccggggtcgataaattcctcaaattcagcgatcacttcaccgtttttcattttaacggcagccaattcaatgatcgaatcgtaaactgctgataaaccagttgtttcggtatcaaaaaccacatactctgtatcgtcatttaacggtgtatgatccaagttataggcgatcggcacaccatcatcaactaagttagcctcgacgccgtacaaaatcttaacgccgtttttcttgccggcattgtgggcttcgggaaaagcctgcaaggcagcatgatcggtgatggcgatcgctttttgcccccacttagctgcttgggcaacgtaatcagaaatactattggtcgcatccatctgactcatattcgaatgtaaatgcaattcgacccgcttttgaccttccggcgcagtatcttggcggacagcgtgtttgacttcttggacgtcacgagcgttgaccaccaagtcacgcataaagttgtcttcttgaacgctccctttgaccttgacccagatcccctttttcatcgccgcaaacagcgcttcgtcctcatcattacgggagaactttttgacggtgaatgaggatgtgtagtcagtcattttaaagatcaataattggcgcttcgaacgcaacacccgaatttctagatcaaagacgtagccttcgatcaccaaggaattttcttcttcttgaatatcgagcatctggcggacaggttcattaggattgattgcgcgacccattgtaatggggccactgatcgtcttctcactagcttgttgctgctgtcgctgttgggcagcttgctgcaatgatgccgccgcttgttgggccatcgccgcatcctttttcgccttggctgcttgaaacgcctcaattttagcttgtgatgctgattcgtcgatcaaggcgtggatcgataatttaggaaaacccacatcaacataagtatcttcaattggtcctaacgcttgcgtcgtcaaaaaattcttaacgatctcgttatccgctaacaacatgacccgaccatcgtccaagtatggttgctctttttcacacagttcttggatcagtgacgacgtgatcccactggttttgaccacataagtccaataatcgcctaaattttgatcagttaattgcggcaatcgcgtttggatcgttaattttatcttggcgatctcactaaaggcttgttgcaagtgctgaccgaggtcaatgaacaacggatagggtaaaatatccgcaaattctaagtggaattgccaaacacgcgaacgctgatggaccaccactttattgactttagcatccgtgaaaaaatgttcattttcagcagtgacttctaacttgatctgctcgcgcagtttattaaataattcaatctcgtttaaactcaacgcagccatccttccaaacttaataagaaaagagtcgaacggtgaggctcagccatttgctaaaccgtggtgcttaccgttccactcttatccgctttattctaaagtgtgtttgaaaaagtaacttgccttttcaaacacacttacgctaaattggcggtaaaaactaactggtagtattttccaaacacaatttagtttaactcaatttacgtttaggtcaactcgaagcgacttgaaattttacgcgcgaaactagtccgtttgcttgagtaaaatctggatcgtattgactaattcagatttctgcacttcaatcgtttcaccggttttacgtaacttaatttcaacgatcccttcgctggctttcttaccaacggttacccgcactggtagcccaatcaaatcggactccgcaaacttaacgccagcgcgttctttacgatcatcaaccaatacactgtaacccgcttcttccaacaaagcttcagcttcactggccaaagtaacttgttctttgttcttcacgttaactgggatcacgtggatcgtgtatggcgcaatattttcgggccaaaccaagccgttgtcatcggactgttgttcagcgatcgccgtcagtaagcggctgaccccgataccatatgagcccatgatcaatggttggctacgaccattttcatccaagaaattagcgttcattactttagaataacgcgtacctaatttaaagacatggccgatctcgattcctttagtgaatttcaagacgccttcaccatcaggcgatacttcgccttccttaacgaaacgcaagtcagcataagcttctggcgtataatcacggtcggcattcacgtttaaataatggtagccgtcttcactggcaccaacgacaatattagctaagttttgcacactgaaatcagctagtaggcgcacatcagctgctaaattaacggggcctaatgagccaaaattggcacccatatattgaaccgcttgttcatccgtagccatttctaaactatccgcttccaaatagttcttcagcttaacggggttgatctcataatcaccgcgaactaaaactaaaacgggcttttcgtcagcgatgaataacatgctttttgctgttttttcaacctcaatgttcaataattcagcgacttcagcgattgttttggctccaggcgtcgctactttttccaactcagctggtgcttcagtcgttttcttattcagagtcaggctcgcggccatttccaaattagcggcatagtcgccggcatccgaataaacgatcgtatcttcaccaatagcggcgggcgcggaaaattcaacggaatctttaccgcccattgccccagcgtcaccgataattgcccgataatccaagccacagcgatcaaaaatcgcccgataagcggcttccatttggcggaaaattttatccagatcagccacatttgctgtaaatgagtacgcatccttcatgataaattcacgaccacgtaataagccagcccgaggacgcttttcatcccgatattttggctgaatttgataaagcacttgtggtaacttcttgtatgaatttaagttatcgcgcaccaaatcggtaaatgattcttcgtgcgtcggtcccaagataaaatcacgttcatgacgatcacgtaatttaaacaattcaggaccgtacgtgtcataacggccagattcctgccataattcagcagggataacttcaggcatcagcatttcaacggcatcgattttttccatttcttcttcgatgatccgattgatcttctgcaatactttataagctaatggcaaataactgtaaatgccggcgctcatttggcgaatatagccggcgcgcagcatcatttgatgtgacttggagtcagcatcactaggcgtttcttttaacgtagggataaaaacttttgactgtttcatggataaattgctcctttttagagcgtagcgcaacatggtacgctacgttttacttcttattaattttaaatccgctcagcgcatgaaaaagcgttgaaaatcgttccaggtaacggcaatgatcaataataacatcaacgcgaaaccgatcaaggtgatgatgccctctttttctgggtccatcggtttacgccggatcgcttcaatgatgttcaacaataatttaccaccatccaaagccggtatgggtagtaaattcatgatcgcgatactgatcgacaacaagcccattaaattcaagatcgtggtaaagcccatcttagtggcttgtgacgtcatcgagtacatcgccactgggccgccaaaattattgatattaaaaccatggacaaacatgccacctagtgtgcttagcgtattcgttagaatttgccaagtgtaggtaaagccgtacgtgactttggcgcctagcgaatgatcctgcgccacggccaccccgatcacaccgaccttttcgccattactagtggttgctttcggtgttagtttgaccgtactcgtcttaccgtcgcgaaccacggtcaaactgatccgtttattcggatattgattgatttgttcagcaacgtcaataaaagtcgccgttttcttattgttgaccgcagtgacttgatcaccgctttttaagccagctttttgcgcaactgaatctggctggatcgcacctaactgattggagtccgaacgggcgacaccaccagctaaaaaggccaccaacataaaggtcaagatcccgagaataaaattattcataaccccggcaatattgatcatcatgcggcgtaaaatcgacaccgactgaaactggacatcgacgggggcaatttgtacctcagtgccgcttttttcaatgatcgtggcgtcatgatcgactggataccgttttaagttatcctcatcaccattttcataaccgctaacaaataagtccttttgcagatcactttgggcaatttcaaaggggatcccgtcatttagtaaaactttttgactggcgttgatccgagtgactttttgatcagcgttcaacgttaatgtcactggtgtccctggttgtagctcatcatcttcgtcatcctgcatgcccgccatccgtacataaccgcccaagggcagtaaacgtagtgtataggttgtcccattataacgtttggctaagagtttaggtcccatgccgattgaaaattcgcgcaccaagacgccggcccgcttggcaaagtagaaatggccaaattcgtgtacgatcacgatcgcaccgaatatcagtataaatacaattaaggtctccacagaattgcccctttctctgactagagtgtgctagaaagtcaagcactctagatcaaggtaaacagatgtacgatcggcaaaacgaacaatagactatcaaaacgatctaaaataccaccatgtcctggtaaaatcttaccggaatccttaacaccgtaatgccgtttgtaagatgattccactaagtcgcctaactggccgcaaatcgagaagatcaatgtgaacaggatcatggttggtagtgaatacaattggatctcaggtacaaaggccacgaagacgccgccgatgattaccgcacaaagcgtcccaccgatagatccttcccaagttttgttgggactaacttgcggggctaacttgtgtttgcctaacttgcgcccaatttggtaagcaccaatatcagttgcccaaatcgtgaacaaaatataaaacagcatcattaaactttcctgccgtgcggcaatgaaataatgaaaaccaagtccaatataaactgccgccaagctagtcacaccaacgtcatcaaagttgacccggtttttagaaaataccatgttgactaacattagcataacaatcaagtaaaagataaataaacgattggtgccgaccggtaaccatgaattaggtatcatgattgctaacaccgctagaccgccaagtaaggcctccagtgagacgatgattttcttacgcataatgaaaatctcggacattgcaactaagcctaggacaatggccatgatatcataagtgaccccaccgagtaacacgatcgggatgaaaataattaatgcaataactgcagttataacacgttgtcgcattcaggtaacactcctttttccactaaataattaatttttactttttaatgccgccaaaacgccgatcacgccgctgataggccagaatcgctgcctcaagttcttgatcatcaaaatctggccacagtgcatcggtgaacaccaattcactgtaagcaatctgccacaataaaaagttagagattcgctcttcaccgctagtgcggatcaatagatcaggatcggcgtattcacctaaattggctgtcatcaatgcttgagcgactttttgttcgtcgatcgttgctggatcaagctcaccagtcgccgcttgggccgctaatttttgtacagcggtgacgatctccgcccggctaccgtaatttaaagcaaaattaagcaccataccagtattttgcgccgtgtcggccatcgccgcgcgcactgctttttgcgttttcgccggtaattgatccacgtatcccatcacgttgacccgaacattttgtttaatcagatcagggacaaaagtatcaaagaaatcaaccggtaactgcatcaaataattcacttcgtcatcgggtcgtttccaattttcagttgagaaagcgtacaacgtcaggactttaacgcctaagtcgctagcatgccgagtgatccgcttaacggtttccataccttcacgatgaccaaagacgcggggccggtgcttttgttgggcccagcggccgttaccatccatgatgatcgcaatatgcgcaggaattcgattaggatctagcgttacgggcgtggtttgctgtttttttccaaatgagaacaaagattagcgcctgctttctaaattttcaaactaatcttaattgtatcaaaaaagcgctgggctgaccattaattcccaattaaatcagtcatacgccaacaaaaaagccgcgacattttgccgcggccatcaatgtgtctagtcagtcaaaatttctttttctttagtagcagcaatttcatcaagtttcttagttgctgcattggtgatcttttgtgtttcttcttctaattcgtgcagatcatcttcggttaattcgttattcttttcccggcgacgcatgttttcaatcgcatcacgccgaatattccgaatcgcaattttagcttcttccgtctgttttttgacatctttagctaattcttcacgccgatcttgagttaattgtgggatcactaaacgaataaccgtcccatcattagctggtgacaaaccaagatcagaagccaaaattgcccgttcgatctctttcaaagttgatttatcgtatggtgtgatcatcaaaacccgtgcttcaggaatcgtgatcgttgccaactgattaactggtgttggtgcaccataataatcaacggtgacccgattcaaaatgctggcattagcgcggccggcacggatctgacctaattcacgttgcaaagcttcttcagccttgaccattttttgttgtgcttctgcaattgctgaatcttgagccatattatttctcccctttaattgttgtgccgatctgttcaccttcaacgacgcgcttaatgttgcccgattcgtttaagttaaagacgaccaacggaatatcattgtccattgacaaggtgcttgccgtggaatccatgacgtttaaccctttgtcgataatatccaaatgtgttaactgctcaaacttagttgcactcgcatccttgtttggatcagctgagtaaacaccgtctacattgttctttgccattaaaataacatcggcatcgatttcagcagcacgtaaagcagcagttgtatcggttgagaaataagggttaccagtaccagcagcaaaaataacgacccggtctttctccaaatgacgaatcgccttccgccgaatataaggttcagcgatttggcgcatctcgattgaagtttgtacccgtgttgggacatcaagttgttctaagttatcctgtagcgccaatgcgttcattactgtggctagcatccccatgtaatcagcttgtgcacgttccatgcccatttcagcgcctgtttgtccacgccaaatgttgccaccgccaacgacgatcgcgatttgtacacctagggcgtaaacttccttgatttccttagcaacatccttaatgatcggtgggttgatcccgaaacctttgtcgccggcgagtgcttcaccactgactttaaggaccacccgtttatacttgattttcgtcatgaactgcttcctcctgcttcaccattaattgtttatctgactgtaagagtttcctattccattctagcatatctaagcccgtttgaccttaaaaaaagggagcgcaggggtctgcgttccctaaaattacgaatgcttacttgtttaattcagcttgaatttcggccgcaaagtctttttcaactttttcgatgccttcgccgacttcataacgaacaaagttgacaactttgccgccttttgatttagcgaattgatcaacggtttgatcagaatccttaacgaattcttgatcgtctaagctgatttcagccaagaatttgttcaaacgaccttcaacgatcttttcaacgattttttctggcttgccttcttgtaaagcttcttcttttaattttgctttttcagcagtcataatgtctgctggtacgtcttcgcgtgaaacgtaacgtgggttgatggcagcaacgtgcattgcaacgtctttagctgcttcgtcatcagcaccttctaaaagagttaaagcagcgatcttaccacccatatgacggtatgaaccgaaatgaccattagctgttttagttaataaagcaaaacgacggaagctgatcttttcaccgatcgtagcagtagcgttgatgactgcttcagcaacggtcttgccatcagccattttagctgcattggcagcatccatgtcagctggttggttagcagcgatcgtatcagcgattgcttgaactaagctttggaaatctttgttgccggcaacgaagtcagtttcagcattgacttcaaccatggctgcaacatcaccgttaacggcaacatcagctaaaccttcagcagccacacggccactcttcttagctgcagttgctacgcctttttcacgtaaagcttccattgctttttcaacgtcaccgtcagcagcaactaaggctttcttagctgccatcatgccggcgccggatttttcacgtaattccttaacttgtgccgctgtaatctttgttgccattgtgtacaacctcctatttaataactgcttattttgaacgcttttgggcttgagtaagcgcgaacgtgtttgaaaaaacagattgttgcatgtagctacgctagtcaaacgagccatttcatgtctcttattgcctaactaggctacactccataatctaaacgcttttccaaaacactccacaaaaaagggccgcctcgtaaataaggcttgcagattgtgcctaacctttgagacagccctaaatcactcaatttaaaattgattttatgctatttgtttgtgtttttgccttcgacagctttttgtagatcttgtaagctctctttgcttggtgcttcatcatcagctgctgctgattctgctggtgcttcgcttgcagctgctgcttgttgtgcagcggcttctgcttcttcaccttgacggccttcaacgatagcgtcagccatcttagaagttaacagacgtacggcacggatagcatcatcgtttgatgggatgataacatcgatgtcatctggatcactgttagtatcaaccatagcaacgatcggaatgttcaatttttgtgcttcttgaacggcgatcttttctttgcgagggtcaacaatgaacaagacgtctgggatacgaggcatatcttcgataccgcctaagaatttttcaagtttttcacgttgtttgttcaactgtgaaacttccttcttaggtaacttatcaaatgtgccatcttcgcccatttgtttgatttcctttaggcgtgcgatccgtttttggatggtttgccagttagtcaaagtcccacctaaccaacgatggttaacgtagaattggccagcacgagttgcttcttcagcgattgaatcttgtgcttgcttctttgtaccaacaaaaaggacgataccgccatcagcagccgtgttcttcatgaagtcataagcgttatcaactaatttcaaagtcttttgcaagtcaatgatgtagataccgtttctttcagtgaagatgtaaggcttcatttttggattccaacgacgtgtttgatgaccgaaatgaacgccggcttcaagcaattgtttcatactaataacagacatatttgtttcctcctaggttttttcctcccctgcggtcaattaacaagtgaacttgcactgcaagcaccacgcttattatcgcgcaaggtgtgaattgtgatgccttaaagcaccgagtaatagtttaccgtaaaaccagttgtgacgcaactactttttacgttttgccaaaattacgcttagaaacaaaaaaatccgctcccgagggaacgaatttttgttagtaaacgttaaattagaatttaacttcgttacggctttcgcctttttcaatcatgctcttagcagaatctaaggcaacgtcgaccatgttacgtacggctgtttccgtgtagaaagcaacgtgtggtgtaaccaagatgtcgcgttgtttcattaattcaactaaagttgcatctggcacttttttgccagtaaagtcgctgttgaagataccaacttcgttttcgtaaacgtcaagtacggcaccagcaattttacctgacttgtagccagctaataagtctttagattcgatcaattcaccgcgggcagtgttgatgatgatgacaccatctttcatcttagcgatggaatctttgttgatcatatgatgattttctttaacggctggtacgtgcaatgtgatgacatcagcttgggcgtataattcgtccaatgtgtcaacgtacataccttctgcttcaagttctgggttacggaatacatcgtagccgataactttagcgccaaaacctttgtagatgttgatgccggcacggccaatacgacctgtaccaacgacaccgacggtcattgtgtgtaattcacgggcaatatctggttcccaagtgaagtcacctttagcgagtttttcgttgaattctggtgtccgacgaagtaactgcatcaaaccagtgattgccaattcagcaatggcacttggtgagtagctaggtacgttcgtaatgtgaaccccgtttgctttagctgcatcagtaggaatattatcaacaccgacgttacggattgataaatctttaataccgtattctttcatagtagtaaagatttctttgtcataaggcaattgttgataagcaatgattgcgtcgtagcctttagctaacttaactgtttctttatttaataaatcagcaacaagcttaacgtcaatcttgttttcctttgaccagttatgtgcataaccttcttcgtctttacgaacaccataaacaataaacttcataatatgtgattgctcccttcatagtccttttacattataagcatttactgaaaataggtaaagctaaatttactgatttcagaaaattttatcgtaaccttacctgaacgccatgcttttgtaagaattctagcttatcttcccgtggctgatgcttaaagtgccattcagcctgtaatgccgcggttttggtggtaaattcttcgtgaaaaagcaatttcaccggtcgccgcgtttttggtttggtatacttggcgcctttagcagcgttgtgggtggcaacccgttttgcaacgtcagtggtaaagccaccgtataaagtgttgtcagcacagagtaaaacgtaaaaataaaattttttagttgtcgccatataataatcgcctgacttctggtaagtattgattattttgatcataaaccgtcaatggtggtaaaaagcgctgaccaccggggcgaccatccttgatcagctcgatcagcaccatattggcttcgcggtcggctttgggatggatgaaacggacacgtttagtttgtaaacgccacgctgctgctttagtgataaattcattaaagcgatcaggccggtaaacaaaaaaagctttgccattcattttcagtaagccgctggttattttcaatattgcttccagtgaggtggtgatctcgtgacgagcaattgccaaatacggattgggatttttcttgctcgtggctagtggtgggaagtatggcgggttacacgtgaccacatcaacgctatccttggcgatctgactaaaggtgtccttaagatccagttggtggaccgtgatctggtcagttaattgattcaacgccaccgagcgctgggccatatccgccagccgcggttgtaattctactgccgcgatcggccccgcagttttacggctcagaaataagctgactgcgccattgcctgcacaaagatcaacgctgcggctacgcggcttgaccaccgcaaaatccgccagtagcaccgcatccagcgaaaaggaaaaaacactggggctttgaatgattttgatatcttgactgtaaagttgatcgatccgttcatcggcttttaacacgattacgcctcgctttctttgaccagattagcgaaactcaaatgaaaaaacaagtcaatttgcaattttttggtataatgaaataaattaagcacggaaaggaaccaaattatgttttatacttttattcgcgccgttgttcgcggcctggtttggctgatcaacggtaacgctcattatgaaaataaagaagtgctgccaaaaggcgcttatatcctagtcggtccgcatcgaacttggtttgatccgatctactacgccctagctggcagtccgaaaaaattctccttcatggccaaggaagaactatttaaaaatccgatcattcgctttatcctggtgcacgccaacgcttttccagttaaccgcgctcaccctggtccctcggcgatcaagacaccggtgaaaattttgaaaaaaggtgacttatcgctgatcatgtttccttctggcacccgccactcggctgaattaaaaggtggtgcgttagtgatcgcccgtatgagtggcgtaccgctggtgcccacggtttatcaagggccgctaacctttaaacgtcttttcacgcgcaaacggatcacggtgcgctttggcgaaccgatctacattgaccgtaaacaaaaaatggataaagacggcatggcagcgatcgatgatcaaatgcaagctgcctttaaacagcttgatgcggagatcgatcctaactttaaatacattcccaaataaaaagcgaccgcctaattacttaggcgatcgtttttttatttacctgctttacgcgattgagctttcattgaagccatcatttggttcaacttcttttcagaaggtttttggcccatttgcatcatcattgtccgcatcatatcttcagagattggcggattgtcttgcaaatatttcttcatatactgccgtgcgccaaagaaaccgccgatgacaccgagtgcagcaccgatcacaaaaatcagaatgtacattcccacgttgttttcccctttcaaaacgatctcatttatttattttacacaattattaggcaaattaaaaggcaggaaccaaattaaagcgcatgctaaaaggtggtttgacttttcagtctcgcctagatccattgaaaaaagaaataggttacagcaaattgacttagtccttacgccagccatttttacgttgaatctcttggacctttttcggcgtggtttcttgaccttttttgttgaagatctgcgtttgttcgatctgctggcgtagtccttcgcggaattccttgacgtaggcctgacgcagacgcttttgctctgcctgttcatcggcatttaatccgtctgctttagctttacgggctaattcgttgattcgtttgagatatttattttccattattaaagtcacctttcacaatatcagctcaatttgacatcaaatacggcgtgaaaactgattaaaccaacaatcacaggccgaacatttgtttgaaatgagtgaatgagtatgctacactaaaattaataaaatatgactgaggtgtcaaccatgatcaaaacgcatgaacccaaacaaatagaagtcttacgtttcattcatgaatgcgtggctgagaaaggatatccgccaacggtgcgcgaaattggcgccgcggtctccctatcatcaacatccaccgttcacggacatttagctcgtttagagaaaaaaggcttactccaaaaagaccctactaaaccgcgggcaatcgaattgactgacgccggtttgaaagccttaaaaattgcccccgcccgtattccagttttaggaacggtcacggccggtgaaccgattttggcggttgaagaagccactgactttttcccgatcccacctgatcttgacgataccgaacaagatctgttcatgctgaccattcgtggtgaaagtatgatcaacgctggcatcttagatggcgatcaagtcattgtgcgcaaacaagctaccgccgacaacggcgatattgtcattgccatgacggccgaaaacgaagccacgtgcaagcggctcttccgcgaaagtgatcatattcgcttacaaccggaaaatgatacttttgcgcccattatcttacaacaagtcacgatccttggtaaagtggttggcttataccgtaatcatatgtaacctaatcagtcttggcatttagtgccaaggctttttttaaccttgaattaagctaacggaattttgtggtacaggtaatgcccagttgtcaatgagtggcgctcaaatggcgtcgcggtcaacagcgccacgatttcctgcgcccgcttttcactacggtaggcacgcaatacttcaaaggccggcgccgctgccgttgaattctgataacagaccacatagatccattgattcaccccactcacctccgttttataatttatcaccagccaagtattgtatcaataaatcagctagaagtaaatcctattcttaaagccactccgttaagagcgacgactgacgggctaatccagtgactaaaaaaagaagaacgccacattttaattgtgcgttcttctttgatcttatttagttaaacggagaaaaatacccgcgtcggctagatcttgggcaaattcagatgaagtgtcatgccgattccaatcacgttgtagctcacaagctaattgcgcgatacttgtcggctgcgcgcccgcccgttcgatccgccgtaaagccgcctcatgtgcgactactgaagtgccgccaacggcatcgaccactgggaaaacattatagccttcacgtagtgaatccagcgccggaaaagtcaaacaagcttcggtccaaagtgcggcaataatcaaatttttacggccagtttttttaactgcggcgtaaaattcttgatcttcccaagcattgatcgtcgtgcgatcataactaggtacaccaggcaataactttttaattgctggaatcgtttcttgattcatggtcgtagccacgttgacggtcgataaaaccgtcggaattttaaacgtattgatcaatttaacggtactgatcacgttacggatcaactccgcacggttgatcgagttgatcgaattgatctgcgttggttgataatcaattaacaaaaaagccgaattttctggggtcaacaattcatccttaagtggatcacggcgtggttcactggtcatattgcgtcactccttagttaaataacgttgtaagaacagtaaaatatttgctttcacttcatcaaaatacgctttaccgtggcgactaccggttaagctgatcgtttctactggcactttgacctgggttaaccgctgactcaagcgcgctaccccagtgatcggcacaaattcatccagcgagttgatcaacaacattgggccactggcagaactaacgtgctggtaggggagttgccgcccgtgactgttcatcagtgacataattggtgataaaccacttataaaagctttcatcggtcccagcctgattaatgaccgcactgtctaatttatccaataaatcagcagtttgccgcggtttagcgactacagcaggatgcgttgtcaaccaatgggcaatgtccaaaattcctgacaatgagaccgccggaataccgtagttcaaacccaactccacagctaaattaccaccagctgaggccccgatcgctgctagcgggacttggggtgcattttgttgcaaccagttaaataagcgattcatgtccaacagtggtgccgggaatttatagctcggtgctaacagataatttggtaccaccactaaataaccctgttcagctaaccattgcgcaacgtcagcgtctttagccttatcaccttgaaaccaaccaccaccatgaatggcaatcaataatcctttcaatgattgcccttgcggctgataccagtctaaagctaaaccagctgcgtattaaatatcttttttaattgttagcgtcaaattgcattcacctcatttagaatctctaagtttattgtaacacctccttgcgctactactgtaaaatatttctgtaagcgaatgcaactattttgtcccgcaatagattagtcatttcccttattcagttcacctagtaagctatgctaagctataactaatgtgatacataggaggaaactgaattgacacaaccaaccgttgagttagcaactggcagtttgcgtttagagcagctcaatgccatttttgccacgatcgaccaagaatttgattttatcgacgaaaacgatatcgtccgctggtactccaacaacagccaccgcttatttaaacgcgatcctagcaagttaaatcagcacgtgttagacgttcatccagcgcatagtgctggccgcgttaaacaagtgctggcggaaatgcacgacggcgccaccggtaaagttgcgatgactgtcccaattcgcggcaaacaagtgcacatggccttttacgccctacataaccctgctggcgagtacgtcggctgtattgaagtcaccgaagatgtgactgaatatactaaaaccacttggatcggtaatttattgaaactaatgaagctgaccaaaaaatataaataaaaaatgagttgtccggcaatttgctgggacaactcattttttgtattacgcgatcaccgtggcgcgcgcgatgtatgccgcctacttcgtttgtagcaggactttttgcttaagctcgtcactggcaaatagcaagtgctcgtagtcattttgcagcaggtaaaaagccgccatgtgtgagaaataaacgaagcttaacatattcaaatattcgggcacattggtgatcttaaggagtttacggacaaaaaagttgatcaagtgatcgccgaatttaacgtagcctggaactttgatgtaatgaacctcgtgaccagcaacttgtaccgtgtggtcacgggtgccaggcagataaactaccgtctcggcgggcaacttagcgatcataggtgaatcgaaaataaatgctgcttgcatataatatcatcccttagttaaatttaatttcataacaaaaatcaagttttttatagtaatctaactccaccaaatcagttggtttcacgttgccatcggctttggtaaagtaggccaagccgctgaggcgtaacatttggtagacaaactgtgaacagaacataatattgggccgcaatgagcgtttgaccaccaagccaataatgttataggcgctaccggtctggttgatctgcttgatctttgcggcgatctgttgcttttgcgccaacgtggtcgccaagcgataaactagcaccgaggcgtcacttttttgatggaacgcagcgaccatttctgggttcaaacccggtggatacacattttcgccaccattataactaatgatcgtctgcaagtcacggccaaaactcagcgacgcgtgattgtactgtttttgggtgaacaacgagatcaattcactggcattgctgccggtgttagagataacgatgtaaatgtacggatcggccatcgttgccgccaccgagtcaaaatagctttgggtcagcgaaccgtcattgatgtagcgcatcgagctgtggcgcttcaaatcagtaaatagcggcatcaacttatccaccgccagagcttgcttgaccttgcccaagctctgcaccgaatggataacagcgtctttttgtgcattaaattcagaaaaacttagcgttgctgcttccttgatcgacggtaaataaaaatcagtatcctggcgaatgatcagcatccgttcagccaataatggcgctaataccagtaatgtaccgaatacacggctgaaaaagccggcgcctaagtaaatatgttggcggaagatcaccgcactgctaaaggtgatctgcagcaccatgatcaataagtacactagcgaagtcgtgatcttcacccagcgtaacgcccgccccagccaagtgcgcatgatcatcaacatcgccaaaaagacgtaaactaagataaaaatcggcaacgtgccaaaaaacgccatccctaacaaaacgacccagacgatcatgttcatgaattttcgttcagttaccaaatcccgcattattttgccccactctagctcactgttaattagaagtccgaccgattataccataatggttaagggcatcatatcagactataggtgtataaaaacaacgttataaacatgccgcctagaaaagacaactaaatatttactttaactttttgggtatacctcacattggccagcctatcatttagttaatttaaattatattttacgctccatttgtacatctcataataaacggcgagtagatcctgaccttttgtagtaatcgcatattcaacgtgcggcggaatttcattgaattgcgtgcgtgtgatcaagccatctttttccaactcacataaggttgaacttagcatggtattcgtgatcgtggaaattgctttagcaagttgaccaaatctggcatttttcaaggcaatgatctcaaacagaacttgattcttccatttgccgcgaaatagctcaaaaacgggattcagtggattttgggtattatcacaattggcactattttgtaacgcctgggtcatcaattcttttaaagttaacatttttcctccattagtacggttaaccgtacttactcagtttttttgcgtacttgacggtatgataagtgtactagtacatttactatacattaaatattggaggaaacaacatgaaaacaattgtaattactggtggtactagcggtatcggcgccggtttggccgaacattactcggctaacggggagcaagtgatcattgttagtcggtctaaaggcacactaaccaatgcaatctacctacaagccgacttaagtcttgccgcggaaaattaccgggtgagcaacttaatcaatacgcaatttggcaccgcgtgaacggacgcgatgtggcgacagttgtgcaaaatatcggcactattttgctgcgagcgtcaacaaatcaatttactgcctataaaactttaaatccggttaatttatcgctgaatacttttgatctggataaggccaaaaagctggagcaagcaacggaacagctgctatctaaactgccttgacctactgaattaactcaccgtatcttgcaattattttcctagttgaatgtttatcagccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 541 - DNA, 1407 bp, Unknown
  Metagenome-assembled genome
ttggccggattaatactgtgcgcgtacagaactaaccaactagaccactcaatccttaagtcgatttctacagttgcatctacaccaccttctgaaccacggttttcatagaacttttgacgttaccttgagtaacatttaaactaaaaaaacgcccctgactaaatgtcaagggcgacgaaatcgcggtaccaccttaaatacgaaataataattatttcctcagtgagcttacttagctctgcgtaataacgaacgcattccgtcagtggcttaccttacgctcaccactgattcgatccaaagaccatcttcaactgctaagtcgacttcttcccacttgccagaagctcactaaacgacgtcacaatctactcatctttttctaatcaatatttaaagattaccgcggaaaagtagaactgtcaaccgtcgtttattttggctgttcgttatcactgtagtattgtggtccactgccaatcactggatgggccaccagccacgcgctgatttgctgacccaacttttgcgccatccccgcggcggcattgatctgctcctggctgatctgatcaacgtgtacaccagccgtgatcgtacaactgccggtaatttgcggtttgatctgttgtgcgaccattgttgccagcacatcatccttgtgcacacgcccatcgtggctaggaaaacgtaccgtggctaaagcggtggccacgccaaaggtagtcaccgtgccaatatagggatgatcaccaccgataatattgatcataacgtcagggccgatctgctgcacttgggcagtcattgtatactcacttgcggtaacactaaaggtagcttgactcatttggtcaccccatccccttgccaacgtggtgccgaatgattgaggatcgccagtgcatccaataatttcattgtttgatgattaactagatcttgaatcgtttgtggatgatcgtaaaaagctggaatcggtggaataatttggacgcctaatcgtgccaatttagttaaattctctaaatggatcacacttaaagacgtttcccgcggcacgatcactaatttacgttgttcctttaaagcgacatcggccgcccgcgaaatcaaattatccccaaaaccggcggcaattcccgcaacagttttcatactggccggcacgatcaccatgccgtcgttaagaaacgagccactagcaatagccgccccttgatcattaatgttataagtcacatcggccattgcctgaacttcttttaaagaaaaatccccgaattgtcaaatcaagtgcaacactttctagatttcacttataagtggtctaggtgttggtcatgcaagcaactgttcagctaagaattcattagccgatttgtagccgaagattttacgtgg

SEQ ID NO: 542 - DNA, 4835 bp, Unknown
  Metagenome-assembled genome
cgcatgtaaatctcatctttttatattgcacttcttgcgatatctgataaaagttgttcgcttaataccggtattacgggcgacgtctacatcactcatgcccgtctgataaagcttaaaagcatgttgcaaacggggatcatctttggcatattggggcttacgtccatgatatttaccctgctgtttggcgagggcaatcccttgttgctgacgctcgatgattcgcttacgttcgctttcagcctgatacttatacagttcaatgatgaggttagtcatgagttgacgcaagttgggatcagcaattcctgtcatggacggcaaatttaacacatctagggtgggccccttattttgaatggtgttcatgatcttagttaaatcctgattatttctgtctaactgatctagtttggcgaccatgacagtattatcttcctggataaagacttacctattgagaatacatctagtttttattcaaactattagctaattgctgagcagccaacaacattaaatccttaatttgttctggtggctcaggctgatcttggcctaaccagacgcgtagaatattggtaaaaccacctagttgaaaagccatcacataattcacttgggtaggagtgccctgaacatgccagggagccgcaaactgttgataacgggggattgctttttgctgccaaatttcattcatatgatcaaataagccttggcggatcaataattgaattaaatctcgtttttgccaccaaaaatttaaaaaaatgtcaaaagtagtttttagcatcatttcccctacctgcggtttctgatggagcaattgttcaaagtactgatcgaacaactgatcacacaggtaattaataaccgcttctttatttttaaaagaatgatagaacgtttttcgtgataattcagcggtttgggcaatttcagtaatagaaatatcctgaaaattttctttcgtcattaaatttataagggcgtcacataaccattgcttagactgctcaaccatacgctgctttccgttcattttgctgtcctcccatacactatcggtaacaaattatagcaatctgtaacatttagccaataaggattgttttaatgcttagggctaattatactaaagactgcaaacaaaggtaacaaatgtttcctttgtgttcatctgttaccgaaaggagcgcttgatagatgtcaaaagctactaaaattatcagttttatcgggttaaccattgcgatgtttatgggcaccttagacagtactatcgtcaacattgctttacccaaaattatgacccatttcaatgccagtttaactgatacaagttgggttgccaccatctatacgttagccttagccgtgtttatgatcactggttcaaagattgccgatcgttatggtcgtaaaaaaattatgttattaggattagccttatttggtggcttttcggcggcttgtatgctggcaacgtcgttaccagaattgattgcttttcgattttttcaaggattaggcggtgccattatcaccccgattgtcttaccaatgggaattgaaatatttggcaaagcacatatgtccaaaattgctagcgttgtgggcgcggtaacggctttagccgctgccggggggccaccgattggtggcgtgattattgaatatgcttcttggcgctgggtattcggcattaatgtccccttaaccattgtagcctttctaattatagctatgggggtaagggaatcatatgacgaatccttggcggggagaattgatttaccaggaacggttcttttaacactaggcttgggtggtttaacctttggcctactagaaggccgccaatatggttggcaatcgggcatcatcttaggaacactcattggcggcgtattagctattggattgttcatctttatcgaaagtaaagtcaaacacccactacttgaattagatttgttccgtgaaaaaaccttaactgcttctagtttagtttactttttaactggctttgcgttagttagccccaccctgattttaaattattttttgcaagacgttctgaacgatacagcgttacatgcagccctaattattattccagtttccttaacaatcatggtagcgatgcctttgggaactaagttatttgatcaagttggcgcagttccggttactttgcttggcctcttagtcatggcagctagtttactgctcttgtcgtttatcaccaccaccacgcctaaagctgttatcattacttttctggtgattaacggtgttggttttgggttctcttcggtttcgttagtggcctcggttaaacatttgcccaaaaataaaagtgggattggttcgggaattgttaacgcagcgcgtcaaattggcacctgtttaggaattgcaattctagtaacggtccttgataataatgtcaatacagctaagcagcatactcatcaagatgccattcaaattgttgatcgacagcaattatcacccaaagtaaagaaagtggctcatcaacaattgaatagcctattttccgctactggatcagccaaattaacaactaaaaacaaacagacgaacctaagacgtgcccttaaacaagcggccaaatctcaagttgatttaccacaaccccaaaagggaaccgatcttcaccaggtctatcaagcccagaagaagttagcactagctactgacaacttaaaagcgggtaaccagcaactaacacttaccttaaccaggttagaaaatcaaaataccgctatatctaaactgtcagtagcttctcaaaaaattaatttgggaaatcagaaaataagccagggccagaaaaagttgttagtaggtctcaaacaattggcacaaaaagaagctttaacgacagctttgagaaaaattaagcatactaagaatcgacaaatcagccaggccttcagtcatacctacttagtaggcgcgatgattgttttgattctgtcgccgattgctttgttgacagatcgtaagccattaaaaagttaaactggaggctagtcattaattctaataaggattatagatataaaggggcctcatattcgaggtcccttttggtataatgtaagtatttttaaaatgtattgtttttaactaatttaaatcgtcgctgttacgtgcgtttactaatgccagtttttcgttcaatcattttataagtcgtaccctgttttcgtaactcgtaagcaaatctgatctgctcatcagaatatgttttcggccgcccttcccgaaatgacggatcatgttgtttggcatacccttaaatgcataaattcattattctcaacgtaacaccaatgattcttttagagctggtcagttgtgccactgactattcgcatttatttgtccgaaatcttgacataggagctggctttgattaactgtggatcgaagccagcatggctattagtaatgatattcgaagaattatttttaattaggtaaggcgccttcatattttgagataagacatgaacttttatgtcttgcctggtaatcgtgtgttttaaaagattaatgttaggctgccaagctttattagagtgagaatagttttaatagttcaccgctaccagtttccatacctaatagctgcatatctgactgcaaattaaagttctttatcaaccaattctttgaaactagtttgtatcatttttcgaggttctataatatcttcttctgggcgaaagctttttaaagaatactgtagtaatttttcattgtctttaatagaaattttaggattcttactgcttatatagaccatatataactttttttgtacaaagttgggtaagctattttcctctaggaaggtgtttatatctttatattttagtataaggtagattgcaaatttgtccaaaaatccggattaaatttgcaatctaccttataagtgtcattcacactatctcttgtaggatctccttattagacaagcaaattaaaatgtggaataatactgttgtaacaaatacattatgggaggttatattatgagtctagatgacaagattgatagcaccaaagataaggtaagtggaaaagctaaagaagttgaaggcaaggttacgaacgacaaggcccgcgaagctgaaggtaagggtcaaggtattctaggtaaggctaaagataaactgtcagatgccaaagatgctgttaaagatacggttgataacgtaaaggaaaagttagataaagacgataaataaattatcatttttaagaagaccaaaatctggtcttcttttattttttcacgcttgttaccctgtttttttctccacactgtaatacgcggctcatgtggtcgctgcggctttttacgttaccaccgtccatctttaagctgatgttctaagtcacccaagcaacgtgtctctgtgcgactgacaaggccaaatctgctatttaccatctggcccatgccggccacctccaaattttgggcaaaataaaaacgccacgctatttagcacgacgtctattatccttacaccatcttatcgagccgagcacccgcctgtgcccactccggaaactcatacccgtatttactatgaattaatcatgatatcgccacctcctgaccatatgcaaaaaaacagtgattagctgaacttttgagagcgtaaaatatcttgtgtaaatgcataaaagatttctgaattgtatagaaatagggaatgccttcccttatgatatttagtaaccacagaaaacatcacaggaggcattccccatgaatgaac

SEQ ID NO: 543 - DNA, 1689 bp, Unknown
  Metagenome-assembled genome
acctgaattattcatactaacaaaaattccgtgttggtaaccgttaaatctgctattttaatgttagtcacgtgcccctgaccaaaaattaagttaattctagctcggaactaagtatgatcggctatcgagcagtcttttcgctacttttagctgcacttaaaaaagcctgaccaaccaaaattttaaattagcgttgtgcgtatagtccttgccactgaattgattggatcttagctaatagttgataaaacaacgcctgatgcacatgatacgtactaagtttcaattgaattttacggccactatgcacgagttttccggcgatcttgaataaccatagtcgaatcgtattgatctgtagcccgcgatgacgttccggtaaggccaatcgtttcatgaaactcacgagattataggcgagtacactaagcatcatccgcgcgtgattgtcactgaaccgtgaactatcagtcttatcgaagtagaagccagccttgatttccttaatgtaattctccatttcaccgcgttgccggtataacgtaaacgcagcttcagcgctcaaactagtaaaattagtgaccaaatattcatgttcaaaaagtagttcaccagctgggcgcgtggatttaatgtagatccgtcgtggcactggccatgatttagcctgataagtggtcgcataataatgagtttcagtcttttcccagcactgtccatcatcgatctgaatcaggttttcggctaattgactaagctttcgattcacttttagccggataagatagaaagcatgatttgcttcacaagtcgcataaagttcaggcgtcgcgaaaccactgtcaccgcgcacgacgacctcagtacaaggcaatgattgtcgataatgttctagtagtggcgttaggaatgggtcaacttcactgctggtatagacgttacccggtcgtagttgggcttttaagcaatggccattttgaccgtcaaaagcgactaatggatggtaacccattgtgccataatgggcgttaaaatcagtctgttcttggtgaccatacgtatccgcatgagtcgaatcaatgtcgatgatcaattcagtttgattcgcggctaagcgcactttatccaacatagcctgatttaaagcttgaagtgacgtgatcgtctggtcatcacagcgtcgccaaaaacgtgaaagcgaggcttgtgaagccaaacttgatttagccaaaagtagtttaaaaataggatcaatcctcagctgattcgctgctaaatcggtacaataaccggcaatcagctgtaaaataacttgttctaacaaactgacgttagtatgccgataataccgccgttcatccttgaagtgaaccaactgctgggccaaagccgtaaaatcaagttgggtcatcatttctttgactagaaccaagccggtatcggttgaaagttcgccgccagtgtgcgaaacctgaacttttgtattgaaatcaaagcgtttttccggtaaagttaccaatgaagaggacctcttttctggtggcttaatagttacgtttggcgatttaactataacagaatcgaggttctttttgtgcacttaaaaggtgttaagcaataatttagtggtgccgcgggctaacaaggttttgcggcagttaaacaggtactgtaaataatctaggt

SEQ ID NO: 544 - DNA, 54903 bp, Unknown
  Metagenome-assembled genome
gctataacaataacacggaaggtgcttttttggtacaccattttggtgaaaccctcaatcaaaggtaaaacgatggtgtagcagcattctcgttaaggtttaggaaaagatatgcataattcaggttaatatatgttatttttagtgacggtattgttttttaccatcacaaggaggagttattcatgcgcgctaatttaacaaatccacgaaccaaccaattgaaacaagttaaggtcggcttttcgtggacaacatttttctttggtttttggccagcgttatttcgtggcgattggttatgggcagtaatcggcttaattatccagctctttatcggtctaccctcatacggtatcggcgctagtatttattcaatcattttcgcctttatttataatcgaatctacattaataagcttttaagccaaggctatcaagccgctgacagcgcatcaaaacaaatattacttaatcgtaattttactttacgcgattaattctaataaaaaagcagactacgtgtctgcttttttagtcctccggtgtcaccttaagtaatttaaatacctgctcgacactgccaaatcgcgctgccaataatgcatcggtgatgccgtattgctgcagtgaagttaagctcactggatcatcagcgaaaatctcgctggccatattcagtagctcgcccgctgataacgattgtggtgcaaatgccaaacccgccccacgtttaagattgtaccaacttttattatagtgctgcataatttcttggcgcgtgggaaaatcttgcgcataacggtcaaagtcatcaacaaccgtgggatcaacttcccgataagttgccgcaaattctggtaaaaacgcagagtactctggccagtcccactgtccatttgctaatttttgaataagtcatcattcctttactaaaacttccggtttaattataacagaattctcctgagatcctttatttcatgtttgtattttagtgacacttaatcaataataaaggcaaacctaattttgggggtcctattattgaagatcaatcaatttgcacaaattcatgttgacgccgaacaagcgttagctgaattacagactatcggcttatttacagtcggtgcaacaaaaaaaccgctagccaccaatttagcgcacttcctacattcgtgctttcctgaagctgccactaaaagtggtcaagacgaagccatcgctaaactcttacttgatggacaaaccactgttagtgactttttagcagcaccaacagccctttcagcagcacaattttataatctagctttacaattacttggctttgaagttggcaccgattttgacctagctgacccgcttaaattcatgcgcaccagtcagttgacctttgatgccactgatccagtggataatacgaccttgttgaccaacatctacctattattaacgactcataccaagttaggactaacattcttggatgatctcgctaaccgcggcttctttgccaattatacaggtccgcggccacttttcttcaacggtaaagcccaggcagtttttgatacgcaaaatttgatcaaagaagtcgtttacgtcgaagcgccgttagacaccgatcaagatggtcaacgcgatctattggccaccacgattttccggccccgagtcactgacgacttaaaaattccggcattgtacaccgctaatccttattttaagggtatcaacgacgtcgatgcgatgttgcacgatgtcgatcaagaattagcggtcaaaacagcgacggttaaaccgacggtaacgccgcaaaaaccgctccccgcaccacgacaagttgctggtcaagccaatcaaaccgaaaaaacggccactgatctcagtagctacgctttaaacgactacatgctcgcccgtggttttgccagtgtttacgctggcggaatcggtacacgggattccgatggcattcgtacttgcggtaccgttgaagaaacaatctccacgattgcgatcatcgaatggctcaacggtaaacgccgtgctttcactaaccgcaccgataatatcgaaatcaaggctagctggtgcaatggtaacgtggccatgaccggcaagtcctatcttggcacgctggccactgccgcagccactacaggcgttcctgggttaaaaacgatcattgctgaagcggcgatttccagttggtacgattattatcgcgataacggtctagtggtcgccccggttgattgccaaggtgaagatacagacgttttagccaagctatgtttttcccgccaaaaagacgctgccgactacgccaaagtcaaacaagtcttcgctaacgaacttaaccaactacagatcagccaagatcgtactaccggtaattacaatgacttttgggatgaacgtaactatcgtaatcaagcagctaacgttaaggctgacgtggtgctcgttcacggcctcaacgattggaacgttaaaccgcgtaacgccgaaaaaatgtggcaagccttaaagcaaactaaggtccaacggaaacttattttacatcaagggcaacatatctacatcaacaatatgccctcattagatttcactgatatgatgaatttatggctaagttacgagttgtacgacgtggcaaataacgcacctgcgatattgccgaatgtgacgatccaagataatttacagccagaaacttggcgcggtcatcatgattgggcccccgccgaccgaaaacggcagttataccatttcacaccagctagtttgactttggatgaaccaactgatgctgcttttgtgacttttaaagacgataaccgccgtttatttgaccaacatgagcgaaatgaaacacgttggctgcacgacttcattgctgaaccaaccgcttaccaggcacaacagttccgcttaaaaacgggcccattaacgcaaccattagtgattgacggtaatattgtagtgaccttgcaagctgccgtggatcaaccgactgggatgctcagtgtattggtcgttgattatggtaaagcacagcatttaggtgaggtaccggcaatcatcgaacgtaacggttatcaacttgatccagctggtaaaacggataatctagttgaattcaaattacaagcagccaccgattttaaattgatcacccgcggccacatcaacttacaaaatcgtgtcagccgcagcactagcttgccagttgaacctggtagcttctatacagtgaattttgaactgcaaccaactcattttcagctagctgctggtcaccaattaggcgtgatcgtctatgccagtgatatgggtatgactgttcggccacaaaccgttgctaattatcggcttgatctcaacgcttgtcagttgagtgtaccatttaccaaacgttaatcaaaaatgcgtcaagcagctaaattcagctgtttggcgcatttttgattacttatatttagtataattctaagtattgatcgcgttcccattgtgaaacaacttgacgatatgaagcccattctaatcgtttagattccataaagctttggtataaatgaccgcctaaagccgtccgcaatacttcgtctttttgaaggtccttcaaggcattatgcaaagtagaaggcaaatcggtaatgtgattggctttaagctcatcctcatccatccgataaatattgcgatcaaccgctggccgtggttcaactttgttacgaataccatctaagccagcctctaacattgcagcaaccaccaaatatggattagccgttggatcaacactacgtaattccaaccgggtcgataaaccacgtgctgccggaacacgaactaacggtgaacgatttttaccagaccaagctacataaactggtgcttcaaaaccaggtactaaacgcttatacgaattgaccgttgggttggcaatcgctgtcaaaccgcgcgcatggttcaataaaccagctaagaaataataagcttcagtagataattgcatttcacctttggcgtcatagaacgcattacctttgtcatggaacaaagacatgttcatatgcatcccagaaccgttaataccatcaagtggtttcggcatgaacgttgcgtgcagaccatgcttacgggcaacggttttgacaactaacttgaaggtttggatatcatcagccgcttccaacgcatccgcatatttaaagtcaatctcgtgctggccaggagcaacttcatggtgactagcttcgacttcaaagcccatgttttccaattctaacacgatatcacgacggcaattttcaccaagatcgactggcgcaaagtcaaaatagctacctttatcgttaagctgtaaggttggttcgcctttatcatctaacttgaataagaagaattctggttctggcccaatgttaaagtccgtatagccagcggcccgcatctcatcgagtacacgaatcaaattattccgtggatcgccgctaaatggtgtaccgtctgtattatagatccggcagatcaagcgggcaaccttaccgtgctcagaaccccaagggaagatcatccaagtattgaggtctgggtataaatacatatcactttcttcaatgcggacaaaaccgtcaattgaagaaccgtcgaacatcactttgttatccagcactttgtccagttgatcaacgggtacttccacgtttttgatcacaccactgatatcagtaaacatcaaacggagaaactgaacgttttcatcttgtgcaattttgcggatctcatctttagtgtagttctttctagccatggtcatcgctccttcaatttagtaaccaaatcaattcacctgtgtagtgtccttaaagcagcttatgcgtatgaaaaagtgttgatggcccttgttcatcagtattgtttagccgcccctgttgcagtaattcgtcatggaaaatccggcgaacatcttcatcagttactggacgcttcatgtcagcttgtttcttttgctttgcctgctcttgcatttcatagatatgtttgattccagccatattgatgccttcagctaagtaatctttgatctccagcagtacatcaatatcatttaatgagtacattcggcgattaccgtcattgcgttgtggctgaatcaattcttgctcttcgtaataacgaatttgccgagcggtcaggtcagttaatttcattactgtcccgattggaaaaaccgataatgaacgccgtaattctttctctttcatagcgaccctcctttaaaagacaaatttatcatagcaagctagaaagcgtttgtcaacaggatatgttatgttttataacatatatttcgctaattaactgacattttctatttttcggcgaaaaagacggaattggctgctgcagtgatcgccaatttaacgtgttcaaacgtcaacccaccttgaatgtacaatgtatacggtggccgcagtggcccatcagcggaaagctccacactggcgccctgtacaaaggtgcccgcagccataatgatcggatcctcatacccagccatttcacttggaattggtgcgacaaaggcatcgatcggcgaaaactgttgaatcgctttcgcaaaagtaaccatcgcatccgcattaccaaagttaacggtttggatcagatccgttcgcggtgcttgccaagttggttggacgtctaaattcagttgtgctaataaggccgccgtaaagattgcacctttgatggcttcaccaactacatggggtgctaaaaagaagccttgaaacatatcgcttaaattatttaacgtggctgcttcttcagcgccaataccaggcacggtcagggcataacccactttttcaactaggtcacgccgaccagcaatatagccacccgttttagccaaaccgccgccaggatttttaatcagtgagccggctattaaatcagcaccaactgacaacggttcttgtgtttccgaaaattcaccgtagcagttgtcgacaaaaatcgtcacttctggtgctagttgccgcaccgctttaatcattgccgcaatttccgccaccgtaaagctatcacgactggcatagccgcgtgagcgctgaatcgcaacgactttggtttgtggcttcaaatgcgccgcaatttgatcagcagccactttacccgcagctgtcaacggtacataatcaaaaccgattccaaattcttttaacgagcccacgccgtcaccggcaacgccaatgacctcttgtaacgtatcataaggcatccccgtcaaatataatagttcatcaccaggccgtaacaagccaaagaaagccgttccgatcgcatgggtaccagaaacaaactgcggccgtacaattgcagcctcgccaccaaaagcttgcgcatagaccgcatcgagctgatcacggccttcatcgtcataaccataaccagttgtacccgcaaaacttgcagtcgctacccgctgatcacgaaatgcacgcaaaactttgtgttgattatatagtactcgtgcactgattttagccaattctggttgaatttgttgatcaacttgcgtgaccaatgctgctaatttaggatcaatttgttgccaattttcttccatgatgatcttcctctactccacaataagtggttaatttttcgtaccaaaaatttctggtgctatcgacgatactattttgatcactacaatcttacctatcaaaaacacggctttgtctatggcgccaaaaaatcagcgacatctgttttaatttgctcaaactgttccggctgtgcaactaaatcgtaccagtgcgtggccatctgattacggaaaaaggtcaactgtcgtttggcaaaatgacgtgaattctgttgtaccttggcgacagcggttgctaagtcgatctccccagcaaaatatgggaaaaattccttatagccgattgctttactcgcttgtggtacttgttggcgttgactgtaaactaacttagcctctgtcaataacccttcagccatcatttgcgttacccgctgatcgattcgccgataaagttgttgccgttgcgtcgttaagccaataataaacggctcatagcgttcattttgctgatcggtttgcgctgagatcggcttacccgtcagctcaaatacttccaacgcgcggatcaaacggcgactatcaccggctggaattttgcgtgcactaatgggatctacttgcattaacgctgcttgtacggctgcaacccctttgtcagccacaacttgttgccatttatcacgaattgcttggctagccgcactagctgcacccccaagttgataaccgcgtaacagcgactgcaaataaaagccagtcccgccaacgacaaatggctgatggccgcgttgggtaatctcggtaatggcttgatcggccaagttttgaaaatcagccaccgtaaatggcatggtcattgactgaatatccaataaatgatggggcacgccctgcatttcagttggtcgaatcttagccgtaccaatatccaactggcgataaacctgcattgaatcaccagatataacttcgcccttaaattgatgcgctagttcaatgctcaaagcagtcttgcccactgcagtcggtcctacgatcaaaataattttttgctttttcatctatcaaaccgcccttcaactacttaacgtcaattcatagaaaaaaggttgaccacaatcttttgattgagccaaccttttagcttgctatttgcgcttcgtcttgccgttccattcctgaaagccgcgtttcaaccagaaaatcttttgatagcctttgcggtgtaattgaatggcagcccgcgtacttagcgtgcggccctgatcatacaaataaacaggtaggtcaggccggatctcgctgtaacgttgttttaactgtgaataaggtaaattacgcgcccctaaaatgtggccagaatcaaaatacttactttcacgtaaatcaatgatctgcgctttacgcattccggcgttaaattcttcttcgctcagttccgttcctactcttttgcgttgcaccataaaatagacttgttgccccactatatagagtaatacaacgataacaaagatttctaaaatcagattcaacatgaccaactaacctcccaataaacgaaccgactagacaaactctaaggctaacgaagctgcaccaatgacgccagcaacattacccaattcagctaatttaagcttagttgtctcacgaacttgtgggaaggtatattcatcaaagtaagcctgtacttggtctaacaagaacgtaccagcggctgaaacaccaccaccgataacgataaatgctggattcaaagtattgccgacattacctaaagcgatacctaaatacttagctactttgtcaacgaccattttagccaacggatcgccttgcttagctaaatcaaacgtgattttagaagaaatttcgttaccatcatctaagatctgtttcaattgtgaagtaccagcatactcttccgccatatcgcgggctacgcggacaacaccagttgctgaagcaacggtttctaagcagccatgcttgccacaagtacaaaggtaaccctttggatcaactgtaatatgaccaatttcaccagcagaaccggctgttccgtgtagcaaatgaccatcagcgatgatcccgccaccgacaccagtacctagtgttacgaaagccacgttatcatcgttttcgccagcacccttccaacgttcacctaaagccgcaacgttggcatcattatcgatagcaaactcgatacctgtaccggcttcgatttctttcttagcttgctgtaaagtcttccagttcaagttataagccccgataactgtgcctaacttacgatcaaccgtaccaggtgaacccataccgataccagcaaattggtctgccgtcatatcatataacttcatatgatgattgattgattcgatgatatcagggatgatatgtgccccttcatccaaaacattcgtatcaatactccaacgttgctgaatgtcgccttctacagttagaatggcaaatttagtggtcgtgccgcctaaatcgacaccgatcaattttttatccatgactcacatgcctccagtttgtttttcatgacgttcttcaattcgatgctcgtgctcgagtaccattttcgcacgcaggtacgtgtcatgatcgacgacggctgcttcgtacaaatgatctaattcgattgccatcaattcaatatcccatagccgttttccgacgtacacgtaaatattgtatttcttcagcaattgttgaacatcatataatgttttcatttcgcaataacctcacaattataccgtgaaagttcagttagtaaaacccatatagagaaaaattccgctagctaacactaaaattattaaagtaatgattcgccgcaagacagaaacactacgtattcgcggaacaccgacaatattagctactaaaaaaccgcctaatagaccaccaacgtgtccagctaagtcaattcccggattaaatagatcaaaagctaaatttaatacaatgaacagcgcaaactgctggcccattgcccgaatcgcggtattttggcgaaaggcctctactagcatgaagaaagccccaaacaagccaaacagcgccgtactggcaccaaccgagatccccgtattaaacacaaaactagcgatattgccaacgattccacttagtaaataaatcagcgtaaagcgccaatgaccgaatagcgattcaatctgcataccgataaaatacagggttactgaattaaccgcgatatgcatcaaaccactgtgcaaaaagatcggcataatcaagcgccaccactgaccttgctgaatcaaaatgttgaccttagcgccaaagaaaaccaatacgttactattttgactaccaccaaacaaggtcatcactaagaataacagaatctgtaaacctagaaaaaagtacatcatatagggttcgtcgcgccattgtcttaattttcgttgcatcttatcacctacttaccgtaatgacttgatcaattctgatatcaaacggttctaccggccagtctgccactgggtaaaattgcggacttaacgccaaaccaagcgtggtttgtggatgctgtgctaagaaacgatcatagtagccaccaccaaagcctaagcgttgccctttaccggtaaacgctaagcccggaacaatcaatagatcaaatttcgtttgcactaaatcagcttgataagcaggttcacacaagccaaacttgctttttattaaacgagtcgtttttgtataaggtaaaaaagcaagttgccgttgaggcattaccttaggcacatacacgttcttaccagccgtccaagccgcagcaatcaacggttgtgagttgacctcaatggcctgactgatcgtcaacgccactgattttgcctgttgccactgcggtagcgcaaacaattgttggtataattgctgctcctccacagttttagttggcaatgttgcaagttgtttgatcagtgcctgtcgtagggccgctttatccattgaatcactcccctatatagaatgatcgtttatcagttaaaatactaacaaatgttgctatcacagacactaattactattcctaaaaaaataagctcggggattagcccgaacttacttacacgttgatcactactcggtgagtaatggtggccgtgcacacatttacccagatacgctaagtaaacgcgcaatcggtattacttagtttcgcgatgtaacgtaactttccgttcgtttgggcaatatttatttaattccaaccgatcaggattgttacgacgattcttgctagttaagtagttgcgatgatgacaatctgtgcattccatcgtaatgttgacacgcatattgaaatcctccctgatatttatatttttttcgaccttcgtctcaaacgagtattagtttatcattttttactaacgctggctagtccttttgacaaataatgtaaagttaatttactttacagcgatcagatgccgctatatcagcatttatttgttgtaatgcggtttttagctcttagcaaataaatagatttttatgaatcgttttgtattttcgctgtctgtggtaagtactgtggtaagtttttaaaaaataaatgggcacacgatcacaagttttcctacatatttaaaatataaatcacccctttgcgaatgttaaagtaaaggagtgattttactatgcgaattatctacttgcttaacaatgtacagatcagaattatcggcgatacgatctttacggtggtggtcgactcagataataaagtaatggcctaccgcacggattatcgttaaaaataaaaatagcaccctggctgcgtggttggggtgctattttaatcgctagaagttaacatattgactaaacttcgtcgcagcttcttttcttgcagatttggtcacgtgagtataaatgttcatggtcgtctggatgctaccatgacctaggcgctcctgaacttctttcatgctggcgccagactcaaacaacaatgatgcgtgggtatgtctaaaaccatgcaccgatattctttttaattctggatgttttttataaatctgatacagccaagtcctaggctggctaggattgataaacgtgttatttttgttcggaaaaaccaactgttcattctcttttgactcagtatgcaagcttttaagtgtctttgcagtaatctcatcaatatcaattgtccgaaatccattgaccgttttaggtgtttgggtaattaattgtcgctgtagccctagcgctacggttttgttaatattaatcgttctaccattaaaatcaatatcagtccaatttagcgccaaggcctcacctttacgcataccggtaaatgccaaaactcggaaaaaaactttagcacggtcattggttcctgaattaagagccttaaaaaatgcggtaagctcggttttatcataaaaattaaccggtttatcctgttcgctgacctcatttcgcggcaacatcacaaaatcaaatggattatctttaataagtttacgttttatggcgtagttaaatactacccttgcgtaactcaaatacattttaatctgtttaaaatttctagcccacttatttacaacattttgacaatgtaggacatcaatttcatcaattggaaagtttccaaagtacggtaatatctgccgcttaaaaattcctagcgttttgttaagtgtgctttcccgaactgaggaacgatatgcagccatccactgattgtagatgtctctataggtcttctttaccagaccctttgccatgcgttcttgtaataatatcattttgtcttacttacaagcgccgctgctacggcttcacggatttgccgcatcgtaattctgtcgtcgcgttcatccatgcggtttgtcgccttttgggcaatctgagtaattgctggatcgtcatagtgattttcttcgccgggaccgccgtaaacgttagtccagacactcatatcagacgggtcaaaatagacccttgccgcaccctgccatctattaaagtccccgactgctttgcgaatacctgtaattttaagttcttccattggtgtgtcctccctatgatcgttatagaatttctgtaaaccagcaagatatttgagattcatattttcaaaatccgccaacccttgacgatagttgttgatattccgtggcttaagcccactttcttcagcgatttgtggtgccgtaaaatccgacttaagcacggattttacctggtctgtattaataatcattgtttagtcctccaattttaagcaaacattaatttaacatcttcagcttcgacatcttgagcttggccgttgcgaacaataaagaatttttggttatgatcgccacggttaccgtaattgtaaacaccgtcctttaagtaaaattcgtcgtcactgtcttctggctcagccttcataaatttacgagcaaaaccatagcgtgcgtccttgccttcgattcttgcaatccagccagggtatttgcggctaccctgtaaaacaaagtaatatggttgattttttaagctagcatagacaattttcaaactagccgcaaagtagtcttttgatgatccaccaaaacgtgctgcgcctgcattagctaacttccaagctttaacaaaaatttctgatttactcatttttaagactcccttgtttgttttttgtctgatcaactctatgtatataatataaaacgcaaacaaatgcttgtcaacataataagcaaataaatgcctatttaattttatgcaataaaaaaagacggttgcccgcccctttttatcagtaattattcatcttcgcaaggacttgaatagctcttaaacacgttttgccatttacggctaatctgcaaatcatttaattcgtccaatctgtcccactctttcgatgggtcgtctaaatccttttcgtgccgatcaccaaatgggccactggcatcaggtttgattgcaccaatcgcatatagagctgcgggcaatttttgaacttcattgaccactagcttttcagcttcaccataagaattgatcagactaatttcaaaagcaatcccgtcttttttgagcacgcggacaacggtgaattttttagctggcataaagctaactagcggtttatctagcgcaaccgcattatattcgctatccattgctcttaaaatgtcatcagtaatgttatcccgtaatccccgttttggaagttccttgtccttgttcgccattaaatcacgctgccaaatgctttcttcgatcgcatatagctcatttaacacgctcccagcgtcacgattaaagtaccgtgcgatctgatcaatcacttgcacacgtagatcgtcgacgctactctctcgggttaaccgagaaagcgtgggatagctaagcgtagtgtgatccgcgactcgtttcgcgtttgtcttatatttgccaaaaagtactgccaatggttttttagtttctgtcattttgtaaatcctcccagtttttaaagcctattgattttaactcatacttataaagttgatcagtggtcagcggttctctatagcccactgcgccatagcctttgctgccaaaacttaaatcactatctgcggcgccgttaggcatacaaccaggcgacacgccgcgatacattaatgcgtaccagtgcaacttaccaaaaataccgtgaaattccttttctgtcatagtgtcctcctagatcaattcggctggagcagtcaagcctaagtcattgatttttttaattactgttgctttcttcatgcgagcacgcaagcctttaacgccgtggtctttagcccaagcttttaaggcatccattttagcaaacgcattttgtttacgatcatcatttgcttttaaatcagctgcagtcatcaaagctgattttggtgcccatactttgagatcccaaccttgatatgagataaagtcaagcttgacagctttagcagtttcagtaactagcttaacgtctacataaccgccacagacaaggtttagttcatcgccggtcaaagcatctggcgtgaaccaagacttgaaaccgttgaagcggaagtcattttgatgtttgatttcagcccaagcaattttgaaactatcggataagtaggaaacaactgaaccaccgaattgtgactgaccgtaacgggctaccttccaagcttttgttgcaactaacttcaaatcaaacatcttaatgacttcctttctgttttcctcttccttaactctatgaccttattataatatcatatttgatatatgtcaatgcaaatataccatttttaatatttatttttggcaataaaaaaaggcctaccccgcaagggatagaccaatgttgaatcgatagtattaaattaataggccaatgtttgaccaggatagatcaagtttgcgttgccaatgttatttttagctgctaacgatgataccgtggtgcctagccggttagcaatactacctaaggtgtcaccactgcgaacagtgtaacgccgtactgctgataccgtttgtcgtgaaccataggaagcaccgcctagaatgcccatacaaatatagcgatcataaccagaatagctggtgtagtgtgcccaaactagtccgttacggatatagacatgatcgtaaagcactgattcaccagcatcatagttggcaacgaccgagtaattcgtcccagcaccgctgcggacattaagggctgtgttagtcgtgaagacaccagtttgcgcataatcttcgttagttgactttgctggcgttgttggttcggtcactgctggtgcaactgtttgcttttcatggttatcgggaatacttggttgtactgtagtttggttagttggtttctgatcagcagtaaagaagttatcatgtagctcagacacatcaaaattaccgtaagaaccattaaactgcattttgctggaatactgccaagcgtgtttattggtgaaataatgcaggttatacggattgccaggataacttgcttcccagcccacttggctatcagcaaaacgataaccagaccagctggccatcgtataaacggtagaacgataaccatatttagcaacctgatccatgaacaattgattattcatagtattgatttgataactagcgtaagtttgttcttgcgcttccacatcatcagccagcactgcagaaactggtaagccaactgctttagccgccgtcccagcaaaatcgccttcagcaacagcaccagctgcggtattataacgtgcaaaatgataaccgttaacataaagtccagatttctgagcagtcgagattgcagtggccgctgtagggtctttataataagttccctcactaatttttgtaaccatagatttaacaccataattgttgcgcatatccgtccaattaccgattgtcatgtaaccattgtgattagacacatcaaccatatctaaacgtgctgcagacgcatctttagtcggtatcaaagctactggtgccaacaaaaaagccgccgcaattgcgacagctccaaatttatttgtcaatctgatcgcctccggtaggtttgttcgtatcggttaaaataccagtggccgcaagcagtgacaatacggcggtgactgtgctgtaaagtgtcgtggcatcagtcggcttaatcacgatacccagtgctgccaaaatcgacacgccagccccaattacagcagatgccagtgctgcccaagctttgacggatttaacattaaaattaattttcatgattgttttcctttctgagacgctcattctcacgtctcaaacggttattttctgcgcataatctgtcgttcatatcctcgagctcatcatgcttgttcttccgtttaccctcacggtaggttagaaaagctatgatagccgaagcaaaaccggctaaatatggagcaaaatcaacaattgttttagtcattgctgctgtcacggctgtcactccttcgcgccagaatcagcacgaaggctgttatgatcgcattgctgatccaacttgagtatattccagttgatagtgaggtaagaaattgcagtattgtcaagaaagacattaaaaagctggtagttgtgagcagcagacgattggtcattgctgactgtgtttcccatagcacccaacccccaatacagagtccatcaatgacaaacaaaaaccccacgatgtcatcgtttaaccagtcggagtaatgtgggggccagacgaaataatggtcattgatgatcagaaacaagccgatggcaaccatgccaatggcgagtgctgcgtgtgtcgggtggtctctgatttttttaagcatgtaatcaccttctctcgaatttaggcaaaataaaaacgcctaagctgctgggcgctgtgctgggtaatcttgaccggtgatggtcttaaattgatcagtggtaaatgtgccgtaggacacaaagtcccacatatccgccaagttataaatccccattttgaaataatcaataataaaaggtgtaaacatattattttgcctcctgtgttgtgtctgtgtgtgtttgtaatgcggctacttgcttgatcagttgtgcgtttaatgcagtttgctgagcattatttttgatcagctccgccaattgctgttgttccgttgttggctgtggcgctaattcaggatgttcctttagtatctcggattgcttagcatcttgtgccgcttgccacactgctttgtctgtaccaatccaatcagttccagtccaagtgacgggttcatacaacccatcaaccggcttaatttctgtttcaccggctgctgccacataattatcatcaaccagctttgagtttttaaactcgcgactagtctgatcgtacacatatactgcttttgtcaaatttatccctcctattttgcttccaaaaagcttagctggtcaatccagatgccatcgcctttatgcagcttggcatctgcagtaccggggtaagtaaccagatttataacacctgtattactaacacccacctttgccttcacattacgtacaatactccgaccaacagtagatttaatgtgatatttagtatcatcataataatcggctagattagtgggtagcttggctacatcaccgtcagcaccagtaccgctaatataaccagtgagcataaataaaataagaccaccaattttaactactcggtagccaatgggatcactagaatcggccacaaagccattcaaatatgttataccggcggacgaccacccactatccgtagtatttacggactcaaaatttgcgtcaattgcttctggccctttttccatgccagaaaaaatcttagttaatgtcataaattaatcctccttaataataaatagccttatagccactaaatgcggcataactgccatcagactgtaacactaggcttgtaccgtctgtgaaacttgcgtcgccggttgttaattcaacgaccgaattgccgctacttgaactaataaccgtggctgctaatgttttttggttaccgccaccaaacatgcccgacggttctgtcccaattgcgactaatcccaacgaatattcttggtatctcaaactgacagttgcaccgacagttaatccgacaggaataatgagctgtatgccacgcgtcttaaacgtaacgctggcttttgtaccatctcgcaaaccattgttaggcacaacgccgaacatatacgatgttaccggcttcaatccggttactgtgtacgacttagcggttactgtcgctaacagcgtcgtgccgttataaatcttgtagctaatagccatcgactagtcacctctttatgaccacgttagggttgtacctgttgttgtggtaccagacgctgccagattggttacagtaaccaatgccgcatataccgtgactgaaatagccgcagacgtaatcgtcccaaccttagccgtaatgtttgcggtaccttctgcaaccgctctaattgctccagtgtttgcgtcaaccgttgcaactttcgtgttacttgaagtgtaagacgctgctccatcagtttcgtccgctggcgtaatcgtaacgctggccttagctgtcccaccgacttctaatgccttagtatcaactgcaattgttacggcagttgttgcaatgttagcagtcattactgttacaaccgctgtcttgtctccttcacgtaatccgttggtggccgtgaccgcaaacgtatattctgtcttaggctttaagttgttgacggtataagtctttgccgttgctgtccctaacttagtccattctgctgcgtttccctctttttgataaacattatatgaaattgccattattatttcccttcctttgtatcccaatccaaacgatcagtttcgtcgtcgattggagttgcttttaaattagttacttccggaactgttgtattgtcggtatctgtgcccgtaccagaatcatcaccagcaccacttgaatttgtcgacgtttgattgctaccatttccggctgttgctttgccatcgtcaatatcatcgcccagatcaaatctaagcgtcttgtacccatcaattagataccaatagccggccttgtaggtgacaacacccgtcaacgcataagacaacggcaggtgcacaatacacgtgtcatcatccggataatcaactttggctggtatcgtttgtacagccgactcgcctaatccgtaaggacctgtgcctaacccatcagtctcggtcccgattgcgtactcgtaataatgcaccacaactttcggctgccgattctgattatgcttaattgtgacgttaaatccagctggtacgtatgctgcaagcaatgactccatgtactccaatcgatcatcaagcactgtaaagttcccaaaatgtgatgaatcgcgagagaggatcgtttcgctgtctttcgtggcattgacgatgactttcttgaatttatccaacacatcactcattgtttgttcaacttcagtttgacgggcttcaacgccttcttgcttattctgcaattcaatcttaaattccgtttcatcatcattgatgtacctcagcactgctaaattaacttcgacccactgtgctaatgattcacgaacgtcaacgccgtacgctttcgtccggataaactgtgcaatctttgtacccgttatagacgggtctgcgttaagatcaaaatcggcagcggttaggtgtgttgggtctcgataattactcatttattaactcccttccgcctaaataaaggcttgattatacgagtagctggcgtcgacgtttaaaccgttccagttatcgctaaattgccatgcgtccgcgtttgcaggcttgtcactcatcgaatctgaccatgctgcaatccacgaatatttcgcgccggtggccgtatgatcgaatcgactgctaaaccagcttgaactgccgtaatcgacagtgttgctatagccagtatctgtcagtatcttgtagaaagcagtcatcatgctagttaaggtgtctttatcttttggcaaggtatcagattcgatgtcacatgctacaatcgcatttttatcaatgtgattagcttgtaacttagataagaaatattttgcttctagctgcgcacccgcaactgttgtcgaagttagaaagtggtaagaaccgataaacttcatgccagcgctaatcgcgttagctttttgactagcaaacagtgggttagtgtacgtcgttccttgagtaagtttgatgattgcacctttagccccttttgagactaagttgctataccagctagcctcttgatcagtaatcgatgttgcaccattattactcgacaagtccacgaaaatactacccgctgcccagtttccactattattttgtaagtctttaacttgctgctgaagcccggaaattgtagcttgcattgtcttataagtttcagacaaagtggtcgttgtattcgacagtgttttagctgtattgcctacagtagcgacttcgtttgataaacttgcgatcttagctctttgaataataatcagcctatctaaattaactgattgtgcccgctggtaatccaaaatcgtcttagctgtgttgttaagggtaacatctgtctgctgagcattgtcaaatggataatattgatactccaagacttgcacatgagtcgtgtaccccatcggtcgtatttccaaacgtctaacttcgccggcaatcggcttacttaattggtcactcttaatctcaattgacaaactaggttctggaatcatctgtgttagcgcgtaaatacgcatcgcattggcgtctgtaaaacgttcatccgagacgtcatctccactgtgtattccccacttagcaatgctatcagtatcttgtacgataaaaggattgaagtaatatcgtgtggtatctgcatcagaactagatgaagatgtatcgactgttttaccaaaacacttaaccgaattcacgatttccgttgaatcataagttagggttacttcttttgtgtcgtataggtagtcgatccgattaccataatctttgccaaagctgttagatgagtacactctgatttgcttattgtcgggatagataaccgcagtcggccatgtgctaatgatttgacttaacatatcttgcccagaattattacccaagtctgtaatttgtgcacgatcaaagttcccaattacttgataggtataccccatcgtattacaagaactgtcgttaaggtaaaaagaaagaacgtcagaaactgaataggtcaacgttcccaccttagtattatattgtctaattcgcgatatttctgcgtagacgtgggtagctacaattgcggcagtcgttacgccactagaataatcaggagtaaattgtttgatgataaattcttggttgttccagtacaagctagcttcaacacttagactgccatacgcaaccgaaccatcatcgtaaacagttagctgtaattcccacgtactattggattgccagtgctcataaaacgagctgtttatgatgcaattaagtggtattttcctcgagtcattgtgagctttaacaagtagcttatccaatttttaccccccttaatctaggaatacatacggaaaattgaaagtaacatcgaagtcagaagatccaccaattgcaatattattctgcccaacgtctagcgacaacgtattgtagtctgtactgtcagttgctaactcattattaacataagtattaataccatcaattaataccgtgtcgcccttaattagcgatttattaatcgtccaattactgccattggtgtgattaaaaattgataactgttgtccagaataatgaatttttattttgagatcatgatgctgatagtatggatcaatcttaacgtcaccgccattcaaaacattgatataactgttagcagtgaagtagtcatctgcatcttgaatcggaatattgtaccccagagggtaatcatcaaagatgtcgtccatctcatcagttcgcaggttactatacttgtagcctgtcggattatcaaaaacaatactaaacaggctgtctagtgagccattttcgattactttgatgtcaaaactatttgagtggacatacatcaccatattgggttgtacatcagttcgcaggcgaattgattgtcgattatcaaataattgatagacccgatttttgattccttggaaattccgccaatcagaaaagtgagtaatgaaattagccgttatactgcttttattaaacacggtgtaattaaaaattgatccgtcagttccgccattatctgtatacgcattagttatcaccggtgatgtatctaatcccaaaaagcgaatttctggtatcttgtcctgcaattcaaattccgggtcagaccccacttggatatataattgtgctttgatctgtaatgcctccctataatgcagtccatttttgcgtgctcaagtcacgagcttgttgccgatataattgatccttgctaaaagcagattgctgaatagccttgacttgtgccacattgacacccagtaattgtgataatgagttgttaaggctagttaagccagcgataacagcttgcaattgtttagtgctgccgtcagaagagctagtgaccacattattagcaccgtcttggcccttgaaatagtcaagagactgctgcattacttgataagcgcgagatcgtttagacaaatcaaggggtacaactgcttctggtaaatttccttcggcaattggagcaatttgtgcctgggtaacaatgccaccattcgcatagccatgaccattacctaaaaatgaaaggcttgaaccataacgtgctttggcatagcgcaatccagcaagaatatcatcatagccattgaaaatatcaccatgtcctggaaaagcattagcaagaaacgtacccattttggtttgcattaacccaattgctgggccactaccatcaccatctggatctgctccaggttgccgtgctttttcgttaccacctgattctgtttgaatttgccgtaacacacggttaaccattgaatcactagtacttaagccattagcctttaatgcttgtttaacttgaccagtccagcgcgtcactcctgatccctttggtgcacctttaccgccaccggcatcaccagttgcatcagaagcagacttaattaatttcttaagtgcatcagcaatactagtaatcgatttgtcaaccattccctttgaagcgccccgctgcatgctcccaacaccagaaatactattaatgttaaaagtttttgcagctaaatcttctagtgtctttttaggattagtgattttgcttaaagcatcactagccgcgtcagaaacatcgtcaaatacgtcggaagcaccacttttaattttgcttagaaattcggctatgccagtcgttcctttggcataaccaggtagatttcgaccataatttcctgctaaaactttttgggtatcctgagcatttaaaatctgatcgccaggtctaacatcgataaattctggaccatgagcaccaattaaatcaactttgccagaatatggttgatacttaagttccacaccagcttcaccaacaagagcttttgcagcacgcgtaatgccaccaccagtcgcataagcaccatcggttgcccgtgtataggcaaaactagaagaaccagcatcaatggctttaacgccgaagggcttggtcaatccattgaagaaactagcaatagatttccaaatactatgagtgccttcgccttgcttcttgttggcttccatcgaactatttgcttggttagtagcatgctttacgacgcctttagactgattcgatgcagcatctttcacctgatcacgctggtttttagcatcactgataactttgtcgtgctgttttttggccttgtcgatcgcactattggcttgattgcttgcatgcgtgataactttatttttttgatcaagagcggacgatattgctgaatctcgttgctgctcggcctttttcttaacggcagctcgctgttgttcggccaatttgctattgcctttatactgattattcgcggcggaaactgtatccttatactgcttcttcgccgcagaaattgcttcgttggcttgattgttcgcagccttgcgcactgaattagctgttttagtcgctgcggtagttttttcgctgtattcctgattcgcgtatttaacagtatttttatactgcttttgcgctgaatttaaagcatcttgtaactgtttattatttaatttacctttttcagcagttagcttttttaaaatactagcttctttatttgatgccaactgaattttgccatttaaggttgtatggagtcttgcttcttgagcagttgcagtagtagcaaatttaattctttgttgatcaagtgccttagactttttgttttcatcagttttaattgccgctgcttttttagcctgatctttttgaactttttcggaattggcaccatatttagcggtgtcttttaagatttggttatcccatttctttttatcagcagcaatctttttattccaagttgtctctaacttagctcttgattgagcataatatttagtgatggcattgcgatcggcttgcgacaacttttcaagctttgacgcctgcttgctttcatcgccaattgctttcaatcgtttctgatattcagctttggttaaatcaccgtttttatagagcaaagcaatatctgccttgtcctgcttttgtttgtcggaataatactttttagcctcagaattcagttggtcataggcctttttcatgctttcagcttcaactttaatttttggtactttggcctgtttaaaagctttggctaagcctttagtgattttttgtgcagttttagtgctacctaattggtcaccaatactagcgccaatcatgacgccggttggcccgccgatagcaccaatggcaccgccaattacagtaccagctgtttttccaacagccttgtatttatcctgagctttgcctgagccgacagccttagcaattgatgagccggcgtcccaagcagtaagtgctagaccagctccgttgatcaagcgtccacccaatgatttgcctaataaattccacttactgccacttttagtaacagccttttcggcatcaccaactaggccggcaccgtcagtagtactactagctactgtggcagcagtgctttcaatttcaccagtaccttttttaacttttgaagtaacaccaccagtagaaccggcttgagctgcttctaatttagctttagcattagccgcataagcagcggtttgagtgccaactaactctgtttcagcagcaatccgctttgattcacgtgactggatagcaccaagctcaaccaaagagcttttaaacttagccattttattaattgcccaaatagcagctaacgcgataccaatatccttgatttctttggtatgcttggctgcaaagacgccagctttttcaattccaccggctaccttagcagtgtcttttgctgctttttcaacgttatcacggaaattcttttcagaaaatagtttagaaagtcgattggcggcgtcagtcatatatggcagtagttttgatccaaacataattgttaaatctgaccaagcctgtttaaatctagcttctgacatctgtgctgtttgactgttcttattggcaagatcttgtacgtatttgcccttatcgccagcctcttgtgtcttttttgctaaatcgccaagctctttattattttgagctaaaataatgcctgcttgttgaccagttgtaccaaataattggttaaacacaacattttttctttgtgttcccatattcttggtgtgatcgttgataaccgccatcattttatctaagctttttaggttaccgttagcatcgaccaaatcagatttattaatacctaacggcgttaaaatatcgcccttgctaccaatcttgccgatatctttacctaaactgattaaaacttttctcagcccagtaccagctttatcggcttcgagaccatgattacttaattcaccaatagctgatgatgccatagagagaggaactttcatggagtttgcggtatcaccgacgtactccatcgctttaccagtagactggaaagaagtggcggtcatatcagaggcgtaggctaattcgttcacagccattcgtgtgtttttagtcattttggcagtgttatttgttcgcataccaaaagcatcgacagtctgactggcaactgaaacgacatcgctaaaatcgtcgccactagctacagatgcttgaagctctgaacgcatagcacccagagcttctttcgacgtgtaaccacgtttaattaattcctgatattgctcggcaatatctttttgtgacttgccatatttgatggaatacttttcaccgtcagcctgcatttgcgaaacatttttagtagcttcagccgctttttctccaccggtaataagtaagttagttgtctgcttataactattttgtagagtggatgcctttttggcacctgaaattgcagcggcaccaactagggcaataccaccagaagcaacaacagccgcatttttgacaccactaagtcccgacttaaccttatcagtagctagtgtggcattatcccgcgctttagccccgatagttgacatgccaccgacggaactgttaacttttctaatttcagcttcatttagcttgtatttagccgttaaatcgctaacccgaatggactgttcttgtgcgtctttagaagctgatccgtatttggcagacaattccgccatacgtgttttttcggcagacagctgaaccttcatgcgctcatgaacactgactagtccagtcaacttaaccttttgagcttcataatttcgaccttgagcttccaaaacagagacattgcttttagcagagcgttcttctaactcggttgcttcttttaatttcagcacaccagaacgctgcagatctaatgactttgttgcccgctcttgctgagcctgcaaattagagattgaccgtttagcagattcgatctggttttcatatttaatatatgattgccgacctttttcagttgattgatctagcccattttgcttttcacgcaatttatcaataacgagattctgcgcgtcaattgccttgcccgcatctttaaccttttgggcataggcggccatcacaccttcgccagatttaatttcagtgaagttgctttgcatcgccgactttaaaagtttagcttcgtcacgaagtgtctttaacgcgcgggtcataccaccatcgtttaggtcaatggcaaattgatagccttgaatttgttccactgtgatttacctcccttttaaatagccccaatttggcgtgcgagttcaaacggatcttgaatacggtctttgcgtgattttgccttcatagcatcttgcatatcactaaaactgctgtcataaaactgctgtggcaaaataccttgttctaaaaattgttgcgccatgtaatcaatatcctggataaaattgcctaactgccaagctagtctttgtctggcaattttgggtctgtttctacctcgttttccgtgtcatcgtcatccaacgttggcaatgagatacctaagaactggatcaaaaaatcattaaaaatagcatattgatcactataagattggtcttctaatcctgccttttcctttgtggataattcagcaatatcagcaattgcttcgccaataacggctgtcatcataagctgattaccaactagttcagtaatgccgtccttgtcgtcggttttaaattttgtaaccatttcctgatagtgtttagctgtctttttgacatttttagatgagtcaataattttaaaattcttgccatcaatcccgatcgtactaccatcaaattcaacatattttgccatttaatttttcctcctaatcagccgccccattcaggtattgtgattttctttggcgactttaaatcaatgagctaggcgttatttgccagaaacagctgtgtctgaagtgatgtaagtttgacccgggaaaacttcatcgaacattgcttttttatcaaatttagggtcatcttcgtgaaagactgcatacggcttaccgctaaatggcgcataattaagcgccgtaaatgttaaattatcgtcttcacgtgtttcagcagtatcagtatttgtttggatgttctgtgcagtttcattaaacactccgcgaccaaagcagaaataaattgacttatacgtaattggcgactgagattctataattaatccacattcaacgggcgtatcggcatcaatatagccgccttttccatttgaaactcgacctagaattttttctttgaccaagtaattaattaaattagaatcgactgctacagaaggtgctgatggtggattagacacgtctaccacctcattgttacccgtgatctttgtcggtgtaccagacaagccagtgatgttagcagactttgtacctaaatttccttttgatttatctgtatcaagggcataaacaccagtggcactaaggccttgatccacatccaatacagctgaaccatcagctgcttttaatccggcatataacatttttaaaccaattgctgccatgttaaatttcctcctttgtgtaaataaacttcagtgtattttcaatattttgtgtgtccggcgtaagtacgtgaccggcgtcactgttgcagtacaatccgtgtttcaataatcgccatttaaccgtagattcgatggcctccatgtcttctggatagtctttgggataataaaactcaatttgagcttgttttttaatgctaattggctgaccgttaccatagttttgactgtaatctggcaattctgtaattagcaaaatcggttcggtggtattagaatcattgccaatagaaaaagcgtggatatgctccacacttaaattcggtaactgttcgatttcgtcagccaaaatatttctaacatagcttgctgaagtcatgcgccaccacgcacctttcgatcaagttcttgcttgattactgagctgacggccgctccaactttgcccttagcttctcgctgtgtcgcttcccagaaatgtttaccggcaactggcacatacgtcttcccagatttatctttcggtgtccagccatcgttttgaaaacgtccaatatagcccttattactctcactagtaaagccaacgttaactgcaccatttggctgttcaaccttgagtagtgcgtcacgcaaatgaactttttcgcctttccgtaacttagtactttccggaatttttggcttcataatttgcgcaaaggtttctgcacctgccttattagcagcaaatttctccatgtgaccaaagccttgggctagattatccaaaatatgatcaaagctggcttcatttttaatctcattagccatgatttacctcccatttatgacaagtaatcaagtcgtaaccgtctggtggcagaccatcatcaaaattaacattgtcaatctgataaacctgcttaccatcttttctcagtaacatgccttcttcaacttccaaattgtggcgaataaagaatacagccacatttttagcggccataccggctaaactaagtgactgctccagtgacagtgtccattgccctgcccacagtgtaaattgtgggacaaagccttgaataggctcgcccgtattttgattaatgacatcagttgcagattctgtgccgaattctaaccgcaaatacattcgcgatggattaattgccttggtcatcgctagtcgcctcactttgctctgcataaagcccacgtagttggccaacaatcgaattgactgttaagtcaactggcaacgcggcaatggctgataaggacgcacggtaggtgtaataagtggacgctagtgctaatacggctgtattaaacaaattgatgacttcgtgcgaagtgtaaaaaccgactgcatcatcactttctgcaccgatcgccgatttaacatagctttgtgcggctgctaaatagcctttgagcaaagtgtcatcagcggtgctgtcaattcttagcgataattttaaattatctaaagtgagcatggttgctgaatcattatttgttgccatttaaatcaccacctagcttgctgctgtaatagttacagcgaccgaagccttgaaagtgccactagtaaatgtgacagttgctgaaccagctgcaataccagtgatatcaaaaccaccagcgctattaactttaacagtagcaatcttgtcatcactagatgccgctgtagttgctgaaacaattgctgtagcattatcggcgtcagctggatcagctgtaaccgtcacggtcttaattgcgccaactgcttcacttaacgttttctgactggctaataaaccagttgctggattgctggctgatgttgacgtgccatcgtcacttccagatggcgctgttattttgacgccgcttgtaaattccccggttggtctgcaattgttgtaaatgtacccataaccatggcttcatcgtcagcttgttgaacatcaaagcgatcaataacccgaattttagtactgtcattttcaaacgcgccaccaccaatgttagtggtcagcaagctcatttgttcgcgatcaaacagcgtagcaaattgtttagagtcaccgaaatagagtgggtgctcgttaactggcgcgtcggctgtgccggtgttaacatctggcatccagcgatcaccgacaacatggacaaccttgccaccgattgtccattgctctggttgggttggatcacgctgtaataaataaccgcccattgcgttcttaatcttagccaaaacgcctaaaccgctttggttagtgataaagctagaagtcgtcagcaatgcagggtcgagtttggttaactctaaatccttaatgtcatcaaatttcgtcaatggcacttgcttggcggcattgaatactttcaaaattgctgcattgcgagtgacaacaactttcttggcaatccattgtgataaccacgtgatgatgttttcggcggtgtcttttaataacgtatttgtaatagttgtgattcccgcataacgatgaattaagtacttgatcgtatgcaaacgaggatcgtcgttatcaccaattttagccgtttcgtcatcaagattagttaacggagtaacgtcagtccatttttcataaacacgggaaccatttggcattgaagtcgcttcacggttaacgtattgctctaaagcgtcatattgccgcactaaagtgtgaatcgttgtctgaatgtcgtccggaatagttaagccaatggcatcaccgttcgcgtcggttgaggacgtcaccatgttcactactttagggtcgcccttgatcatggccttaaagtctttgataaattgggttttcttactctcataatttttgctagggttaactggttttggttcattagactgattggccgcactggcttgagcagtctccaactgttccttcaaagcatcgcgttgcgccgcggcagtgtcatgtttttctttcaaatccttgtaatcttctactttaaagccgtcgtctaaagcggcagcggccaatttatcgcccaaatcagacacctcttgccctttagcaatccatgcctgatttagcttattgatattttcatttttaacgatcatttagctttcctccttattttttgccaaacaaaatagccagcttctgattttttaaatcagcctgctgactatcacttttttgtgtaattgttggtatatctttgaccttgtctagaattttataggcttgcatttttgccatgatgccttgccacttggcaacggccgctttcggaacaactgtgcttgtactagcaaaagcttgcatcgcttgttgctgtttctctggctctttttcgtcgctaaacgtcatgattgaatcagcaaaaccatatttcactgcatcattggcgccaagccaagtttctttactcatcaaattaagtaagtcaccagaactcatgcccgttttagcttcataggcgttagcaatagattgatcaatgccatttaggacctgcgattcgtgggccaaatcttctgcattgccttgcatggttgaccatgccttgtgaatcatgatttgcgcagtcggtgaaatttttacatcatcagccgcaacggcaattacagatgcggcactagccgccaagccctgaattactgcagaaactttagctgtgcttgacttaagttgcgtatagatttccgaagcggcgaacacgtcaccaccattagaagcaatctgtaattcaacggtatcgccggtttgaactttagctagctgatcgccaaccttttttgggctaacataattagtcatcccgaaaaaatcataaaaatcagcggtattgttatcaatcacatcacttttgattgggatcacgattttggtcatctggatcacctcctttcgatggcaatgtggttactggtgctgcatctggcatatcatcactaaaatagccagtttcctttaaaatccagagtgcttggccagtatcgaccacaccatttttcttgaggttagcaatctgatttgcgtaagtgtccccatttgcatcaattgccggccgcagattagtgctgatgcgcgcaattaatttgttattaagttcggaaacaattgcctgcgcgtaacgatttaaggcgttagcgtacatgccctgaatcataggtaaagatgactgttgatcaccttgaccgtttaaatagctgtcaggaataccataaactttagcaatttgctttgaagtccagtctgtttgagctagcaaaccagcgatatcacttttaatttcgagtggtgtccattcttctaggtcatcaattacaattgggccgccgttagaatgagaaacttgctgcataaattgacgtgatcgcgccgcctttttcttagcatcaagcaaaccgcccttcgtttccttcaaaacaccaggcgctagaatggacttcgccaaagccgcgagtgttaaccggttggattgcttcttgatttccagttcactgtgcaatgcatttagtggactgattccgaccatgccaccagaattactcaataagcggaaatgcagtatgttatcctgtggctcatactccttaacaccttcatttggctcatcaaaagtcacggtgtagagtaagccgtttccatcattttgaagaaaagtgctgacttgcgaaggtcgcaaatactctaatcgctgtaacattccgttacggttgcgccagatataggcaaaagactcaccagcaatcagtaattggctaaacattgcttgccaaaaggcatgaccattagtcgttgcactcggattgtctaagaagctctgaatctgtggcttatcggcaaccaatttagaactggctaagtcaccactaatcgttgagatcacgctatataaatccgaattgtgcaaagccttggttgcagaaacataatgattctcaccgtccggatttaaataattaatagtacttggatcgtcaaaagcaatatcttggccgccagctgataatgaattgcgaaaattatgcggattaaatagcggcatcaactaccaccccctttactgaaataaataatttccgccaaccaacccataacggccaacgaaattgctgtgacgataccaccccaaaaccaacttgcgcagtagactgtgacgtccagtaaaacgatcgcggccaaataaaaaagcccgtcaacaacgctgacaagcttgtgcttaacgttatttaataattttctaccaatcatcatcatcaccaccgccttcatctagtaacccagaatctggatttttaaaccagtccagtacttcttgatcgctcattcgttcgacttgtttcgctgggttattaacgtccgcaaaatcttcaaaatgatacatcccttgataaagtgcatcaatcaaggcatcaaccacatcaatttttagagttgccgctgctttgtcaacttgaattccgatcttgtcttcataaatttgtgcattgattaaggccttttccataattcgatcgtctagccggctgattgagctttcgacaaaagccgattgtaagaattttgtcgggtctttcagctcactggtgcgctgccgaatatcttcaattggccactgaacatttagttcaagctgtttggtcacattagtcgcgccccacgaatcatagccaaaaaataaaacgtccaagctgtgatcctcaacaaaatttaacagccattgataaacttggtcatcattaattaatccttgtgggtgactagtgatcgtacaaaatcctttagccgctagctcccgataattaatgccatcttgtttttccttagcatcaattgagcctgccttttgccacggaataaatgagtgctgacgtaaatgccacattcgcttacccgtgatcggatcgttatacggaaaagcaaaaccgatcgcagtattgtcggaaaacattgaatagtcataaccgatatagacttgtcggttttcaatttcaaaatctggaacaatggcgcgctcaatatcagcaagttttaagtatgagtttgtagcttcttgtagccagagatttaaatttttgttctgaaagtcattaagctcgccggtcatactatcgctatcgcgcttgccagttaagcctgcaagcaattgactagacttattttttagtcctagtagcggattagattttatccaagtttccggtttataggtttcgtcaagcgaatcttgacaccagatcaagcacaaataatcgtcagctttgcggtcaaaatcctgttccatggtttgctgcatcattttttcgtcgtcatgaaacggcaccgacgggtctggataagcggtcgatatctggataaattgatgattctctacatcgacttgaccagagataatcttggatattttctgccgtgttttcagttcaccaatttcgtcaaagaccgcggtcttaaaatggaaactatcatactgtccagattcatggctgattgctcgcaaaacattattgaccttagtcataataatctggtcgctttgtgatcccagcaatttagaatttaatccgttttgtaccgcatatgatttaaacggttcgatatctaaaatcttgcgtagcattgatttaacgtaacctaataatttactagtctgtttaaagttaatagatgccactaaatagtcctggttagatagtcccatcgattcaattaagtaactataaacggtaacaatcgccattaaatatgttttaccttgtgcacgggcaactgagacaatagcgcgagcaaatcgtttcccacctaagttgttgcgccaaccaaataattgagctaacacaaaattttcccatggcattaatttacttggctttcccgtgtcaacatcaggacaaattttagcgaacttcaaaatcttattcgcatcaggaacactataggaatacggaaagtctggactaccttgccgctgtaaatcacgtaagtggcgaaaagctgctagcttaataaaatagccggtaaccactttttcgtctaaaacatcaaaagcatatttggttcctatatcctgatattgttcacgagttgtagaaaaatcaattgcctgataagcgcccaacacatcacgtgtttgggttagatcaattttcatcagcaaaaaactccttcattttatcggcagccgagccttcatttttcttttcattgggaatgatttccattaattcagcacgacttttgggtgacagtccaagctcagaaccaactttggctaggttcttaattgccgaatcatagatggcagtcattggattacgcttataaccgacaaaatcagttccaattttttcacctgccgcattttgtacggttttgcaaattgcttgaacttcatgatgatctcgaatatgtttgtatgcgttccgataaatttcatactgagttgcatacatttcgaccagagcactgtccggtcgcttaacattagattgctcttctaaaaaggggacaattttgcgccaggctattttggcttggcggcctaaataatcgggtggcgttcgtgataatttcccgtgattgatatctttgtcggcctttttgaccaaaattgtcacctcctttaaattgattgacccccctacctaaaaaatttcaaaaaacgtttgcgtcacaagatgagggtaatgtgtgcgctctgctgaaatcaattctaaggggggctattgaattttaatcttctacttgaccaattatacctgtactgtttagttttgcttagagcgcttttcattagcttttaaaataactcgaatcgccgcaatttcaatgcaactatgaatcgtttcaattaaatatcctttatgaaccaaaacggcagctaatgtttgcaattgtctctcagtgaattctggtcgatcaaacgtaattgtttccttaacttgatgtgctgctaatcgtaaggtctcactaacatgcttgatctgttcacctgtaagtactccatctgcaagcgttaggtatgcttcataggttggaatactgtcatactcataatcactcggcttaattgatgtagcctgtgctgatctaggtggtactttgcatgaatgctcagccttgactgagtgcgatgctttgccaaacatcttcatcaactccattcttgtttaatcatcaacgcaactactgctgctgtgtcactgattggtgttacttctttaagctcattgccttggcctgtgccgtaagttagttgttcccaatccgtcttgatacgatgacaagcaccacatatcacagccaagttatcaacgtctgctttaagcttgctgtcgaactcgattggtacaatgtgatcaaccgtctttgctggtgtcagcttgccttgcagtttacagtaccgacacaagtaatggtcacgctctaatacttgttgcctgaggtgtgcccattgtcgtgtccgatagaagttgtattgctgacgcttagtgtcatcgcgattacgcgtgactgtgttgtacttgtgtgagtactgcttatcgtgtgacctagcccaacgctgtctgcttgctaagtactctgcttcgtgctcatagtgctgcttgcagtaatgatctggtagatcaaccattgcatggcagccaggctgtctacagcgtctcactcttgacattgctatcactccaatataaaaaggcacccacaatgtgagcacctcttattgctaagccgccgaaaggagttgcacccaacgacggcagtgttgagaactgggatctaaaactaagtattgatttatatccatctatcaacactaatataataacgcctatttaaggttaaaacggacacacatagcctactaaaaacctatcagaagtctactaaaagcctatcgaaagcctatgaaaagttttattgaaacaccaataattcctcatactgaaatgcttcagcgaatacaataatggcttttttcttagctttatcaaacgttgacttagccatattcatttcgtaagccatttctacattactcagattgcctttaatatattgtccatcaataatagctcggctatcatcatctaatgaagctactgcattaagtattgctggtacttcctcagcggctatcaaccgttcctgtatccttgtttcattgtgattatcgactgactgattttgtggcataccattcattgctggcgactgcaacacggtcaactcacgaccggcaatccgctttaaactatgataactgcgtaataactttttcgccctagcacatgtcatgtccttatctaaattatctagtatcactgcaatcgcccctgtgttaaaattaagtgtcgattaattaaacacaagaacgactgcgcaaggttatcttttaaaagaagccttgcttttttatttactaataccagcagccgtaattttaatgactctacgcaatttgctgcttcgagaagaatctacttcatttttactcaactcttgaataatctgattagttaaagctagcgctatatttttatcagctattcgattattcagatcaccaatttcagccagcatcttctttttcttcattgcttgtcgccatcgatcaattcagtctgattcggattggcatcttcgtcatcatcagtatttaattcagtttgttttggcgtgatggttaaaccaaccatgctgttaatttgtgccgccagtgccacaatattcggccctaaaacaggcgtatcaacttcaagactaagcttagtaattcccttatttgttgggtgcacatcagccaatactgccggaaccgcaatactattatctttgatttctgtcataataaatctctccttaaattaaaatggtaataaaatttcacaaacgacttgatttttttgcttggcagtcaactgccgcatggcgtgcaccaattctgacggtgctgtctgccatttgttacgcatccggataatggctcgctcgatatcttggtcaaccatatccatattgcttaataaataccggcgaaatactttttgcgcatctgtcattgataggcctccttatagtttgtggctctaatccaatcgtaatcaaagcctgtacaaatcagtggatcattgattttacgtttttttgtcacacactgagcgattgatttaaaatcatttcggcgaacaacaaccgcttcgaccggaattttatatcgatgtgcaaacaggttaaagcgcagattagctgcagcatcgattccgtaaacgccaaaagaattcttaacgtcatagacgtgactcattttgccgaatcgatcaaaaatcacaaaatcaggtgtataggcaatttgcctaaatttcgcttggcccgtttgacttggtgcttctaaaacaaaacgcggatgaacttggtattcaaaataactatttttaacaaaacgtctataaaaattagcttctttttgagaatcgaatttaaaatcgtctacggtcactttactgccacgcttatttagtgctgttggtgcttctgtcacttaatcacttcctaaaagttagcttttattgtcaatctggtaaccatctaaccaagcgcgggctaagacatccgttttgctccgaaaaacaccaagaatgatctcaggaatagcagtaactgtttccataacacccagcttccaaggcacgttcatatcggtaattaattcattaagtcccttagcacttccaaatctgtcgcggtattcttcaatcgcatttgatatttctactggaattaccggtagtttttgaaacatttgctcaaaattctcattgccgtcaactactgaatggtcgccgcctttttcagtggttatccagtcaccatcaagaacatgaacaccgcctgttaatgttggaataataatttgatcactatgttgcgacccattcatagtcccagcgtcaatcatgctatatttatcaatcatggcttgagttccatcgaatcgttcggcctgaaagatactcacattaaaaaatttagtcacacgatcacctccgtaaatttaacttttaattatatttaactccttcaaccgcttatagtaagctgataaatagtcctgcatcatggctttattaaatacgaagcaccgagacgtttctaatgatggacgagatatcgtaaaactaataggttcagatttttcttcatcggatgccgtttttaaattaatcatgttacgaagtggtaaattgaaatcaccttcattgtcaaactctttgtcatagtaactgtaccaatctgctgcatctgactgtgcttctttaggtgtgatatttttccaagcggttttacttgcttcagcaatagcttgggcaactagcgtaagttcctcagcggtcatgcaaagcatttctgtgtactcaccatcaacaaaaacattagctacttgtatctccactttataagggcgggtcctaattgacacactttgtttttcaaaaagtttaaatgcttcaagtttaactgtcataatttcctcctaaaagctagtttttaatctgcgaaaaagtcttcaattaattgttcaagccaatcaggagccttattatccaataaacgccacgcaatactgatatcatcagctccattagcattagcccaacctgcggtttcgactaccactcgatatttaagggtatttttaccacttaaccgattttgtaaatgttctagaacaagttggcttaacttgtaacgttcagaaaacatcaggtttttagtgtcatcaagttttaatgctactaattcttcatgtttcatctcttgatcctccgtaaacttagtttttacgacgcttttttctggtccacttaactggatcaacactgatagaattagcagtaccatgtgtttccagccagcggtggtactttgcagttgcataataatgtattgtgaccactcttaggccagtttcttgtgatagctcatcagccgtcccatcacagacatattgctcgccgcgatatagtgcatagattcttttttgttgattgccgcgtgatgccatacgatcacctcttttaattcactagccgttcaaactctagtgcaaccatgtcacgaaattcttgctgattagtgataatagcaaaagccagtggtgtaagattgataaatgcaccgggaaacacacgtgcggattcgatcacattaatcgtgtcatcagctatttgcgctggtccagtgtaaccgtccatactgttcggcagtaaaacatctttgatataacggctcactagagcctgccttaactcattcattttgctcaccttctcttaaattaaataatcaactttgacaccgtatttcttaaggtacggtgccacctttttctgtgcgtcaacaacatctaaaatttcttgtttgtccatcgctggtacataattttcaaacgtctttttgccagtgcccttttctaattgagctagccatagggcgctgtttaacacgtgctgctggtctttcaacactgccgctagtaattgaccctttactggattatcaggctgagattcgatttttttggctttgtgtagcagttctgttgcccatgccatataaaactcaacaccagcagagtactcatagtcgtttgcagccatgatcacggtaaactccttaaagctcagcgtgtgtggtctaaaatgtttggacaaatttctgcacatccttaaaaaagttaaagcttaagtttgctaatcttccctcacgatttttcttaaaattaagtgccactcgctgtctgtcttgtgtgttcgcttggtcgtcaacgttgcttaagaacgccaccacattagcgtcttgctcaatcgatccggattcacgtaaatcggctagtgtgtcttcttgcttttgcagcgaagcacggttcagttgcgacaacagtatgattgggatatcaagttcgttagtcagtactttaaacgcccgtgtgatctcaccgatttcttgcacacggttgtctatccgtcggcttgtgtgtaacagctgtaaatagtcgacaactgccagatagtgtccccgcttagtggataatgcgcgtgaacgtatttgattgattatctcgtcaggcgtgcgacaggtgtcataaaactgaatacccattttggtgaactcacgcatggcatcacgtgctttttgtttttgtgcactatcaagtttgtttttagcattatgaaattttccaacttgaatgcctgtctcgtgagctaacatacggttccgattttcaacattgcgcatctctaaactaaatagatcacccttaaaacctaaattgctcttggcagcctctagtaaaagattaagtgagaacgccgactttccgaccgctggacgagcaccaatcacaaacagattgccaccacgtaaaccaccattcagcgcatcatctagactggtgtaagtcttaattccatctggtaaatcatgagttagctcatactcaagaccattttgcatatcttcagcggtttctactttgattgctgacggttcgtccaaattagcaatactaatctttaagtcatctaaattatcatcgcttggatcattggagtagatatcagcactagtttgtgcttggagcttgttatagtgctgacgcagaacagtcagatatgagttaaaaacactaacaccaagataagcatctgcaatatagtcccaatcttcgttagttaagttgtgcggatatttagcatcaaaatatggtttaatttcgtgccagtcgctaaaatctcctgctctgctatttaaaaactcacagagatgacggtagctaggtgttggaaaataatctggcagaacgactgtagatacgattaatgatggattactgatcaacccagctagaacacctacttcatattcactaggatccatttgcatcacccttactgattattttctgaatcgtatccagcgacacatctgcaccaccttcagctaacatttgtttaatgcttgcattatccatcccatcaatatggcgattaaggacaaaacttctaatacgttcagtccgctccgtcagatcttctctagtaggactgcttgttggtttagcagttggttgctcatttagataagcttcaaacttagtgccaaacaacgtttctggccgcagccacttagctgcatcagtaccattccactcggctgatttcacatcaataactttcttaaactcatcaaggccgtagccttctttccaccgcgcattgattttagttttggtagccgccgctttagttgtgaaatgcttacccgttttctgattcaaatactcaataatttcagccacgggcacagtcgaagacgacaatgttttcttcttaacattctttacattcttgttaggtgttgtcggtctgttgttgctctgttgtccgcctgttgcttggtctgttgtcgaaaattcctcgccttgatattttccccaattaacaatggttataagccttccagaccctgttgtttggtctgttataaattgcaatttggtgaaccgctgcaacgcacctcttaccatctgaatagtggttccttttccagattttgttgccaaactaggtagtgaagtgatgaattgaccaggctgaacttcaaatggttctccattccactcccactttttaccagcgtgatttgcaagtatcaaaattgttatgagcactgaacgttgtcctggagttgataacaaccagataggcttttcaagtaactcgcggtagagctttatccatccctgcattgtctaccgcctcgcttcctaattttttccaagtttaatttcatactcaccaaccctcgtaataccacggcttaataaaccagaaatatagccattattcatgccgagccatctgctagcttccgccatgctgacaaaggtctttttaaaaccattgacagagctaattaaagtggtccaagtatgttcgtgatttaaatcatttaaataagcatgatgctgattttctgaataagtgcaccattccagattctctacgtgattattagccggattaccatcaatatgattaacgcagggctttgaataaggattgggaagaaatgtcaatgcaaccagtcggtgaaccagcaaagttttatgatgaccatcaagccaaagatcaacacgcttatcagtgcgattatttgtatgttcagtcctaggctttaagatatgctgcttccaatgatgggtaccatgtagctctgtataggtagttttgttaggtgctgttcgtatcctaccgtagctactggcctggtaagtttcacgataattcggaatatctttccatatttccattagctatgtctccaatcagaagggaaggctgtcatcgctgatatcaattgattgtccattattagcaaatggatcgttttgctgtggctgtgctgctgactgctgctggtattgctgtgcagtttgctgactagccgtagccatcccttgctgtgccttttgagcagccgaattaaatttcgcatggctttcaattgctggtgccttagtcatttttggaaaatcagtcgctgcaatttttctaacggttaaattcttgcggccattgtattcacgctcagccaccgtaattttaattggtcgacctaactctgcctcagcccactgtgccatttccattgcttttccgctttgtgcaataccagtgagtttaatataaagattcatacgccattgtgacttgtcagactcaacaaaattgtcaaatctaatttcgcttccttgtgattcttgctgaacatcttcacgaattttataatccattgtgatcatattgtggccagtattcttagtcgttccgatcgtataacgagttgcgtaaacctcataagttcctggtttaactgttgggcgtcctgtatcattttcgttataagtaaatgccataattatttatctcctttaattgcttgttttttatattctttgccattaaataaatcttccacacgacaatacttgcgtttatcgagttggttctttgccgccagctcatctgacggtgacaacgcaacaactcgctcaccagttttttgtgagataactaggcggccaactacattacatagccccatcgtgcgctgtagaatttttttattaatatccggataagcacggtcaaaaacttggccagacattgttgtccattgatcggtcatttcccatgcggttaccaatacatccttgttccaactacgcaggtaattaagcattcgtggaatgtagaattgcatccgctgataatcgccttgtgctggtacgccatcgttattgccactctcacccatttgtgaaagagtcaaacgctgtaattcggataaattatccaacacaatatgatcgtatttatccaatagtgtgtcatgaatctcacctaacattttgcccagttcgtgataaacgtcggtgctctctactgggattacatcaatattaggttgcccttttaagacttttgatgagccgtctaaatcaatcagtaacgtttttccctctagaaaggtgacagcagttgtcttgccagtgcctggtgcaccatagatcatgcgcaaagcttggctactatccaatttggttgctggaataatattcatttcataatctcctcaatttctgcaaacccgtgaagctgtttcatttgccgacaatattcacagtgaccacaatatttaggtgcagtctcaccatccattactgcaacaaattcaggcaataatctatttaccttgtcatattcagtttgataacgcccctcatctatgcgaataccgcacttatccggtggtgtttgctttgacactgcaaagatataaggagtaaatggtttgttataagtttgttcaagcagtttcttataaatagccatttgtaaaacatactcatccgcgataacaaacggaacatacttactagcttcgtctgaccagactcgctgccgaatatcacgagttgttttcaaatcacagaagtagccttctttgacattcaaacagtcaattttgcccttccaatttatgccgtcaatttgccctgttacaataacttctttatcgccttgatagacgtccgtaaatagcggatcaaactgcagcgtgctaatcatttcatctgctactacaaaatcatgtttcagctgtcccttagtctttccacgagttgaaaataaaactggttcatagttctttaagaacttagcgtgcgactttttagattcgaaaaatgaatgaacataattaccaacaattaatgcaattggattgctggttggctgccaatcatcttttagttttgccaaggctgccgcctcgcagcgttcaaaatctttgaacaacgaaactgacatgtattcccagtctgttttatgagaatagtaattctctggtgttagcttaattttttgttgcatctagctaaatacctccaattatgttattgtgaggttgtttgacagacctcattaccctagtccacatggttgccgccactgtgggctatttctttgcctaaatcttccttgtaccaatgaacaacctttctggcttcaaccgaataaatattgccaattttgaaccagttaccgaccttaccgataaagacgccgtcggctaaatcaaagtcataaatacacttgtgcagcaatccgtcatttataaatagtgtgacgcgccaatgtcgcatttaatcacctcacttaattaagagccatacaaatctgattaacacataccacgagatagcaccgactactgataaaagagctactacagtccagccgattcgcatgagccaccaccacttcttactattcaaagtagtaatcctcctcagccttagcttcttgctggtcaatactgtcccagttgatattcatctaaattcaccttctcgttgttatcaattgcattttcacatagcttaatcaatgcctgctgttcgccttgagcaaaagcagtattaagtgcatcatttgcagtgctctcaattccttttaaataagcactacgagccgaagctagtctgatcagttccataaactgatctgcatcgatttcaattttcattttccccaacctttcgtatctttgactttgaaccagtcgtcattgtcatatctataaattgccccattatctatagcctcaactacaacggttaatgctaagtgaccgcctaaaccgaacttattactaatttgttctagcattctaaattcgttattgtcgtaggttccaatgagtttgccgtcaaagccgccttgaaaaatggtaactcgctggttttctggaatatttgttaatatcactttggtaacccccagaaccatttctgccatttagatgacttgattaaattaattagtggttttactgctaagccaacagtgatgccaattactagtgctagtaaccaagctggaacagacaactctgctatgcgattacctgccaataaataaatcgtcatttgatcatttccttttatcgctgtcttatgacgtgtgccccacgttttttattaccatttagcgattatttttctaatagcttgttctgcttcatctgggaaatacaaaatcttttttgctttacgcccatcttcctgtggtgcccgatgctcaatgattcgcatctcaggctgatttgcaaaatgattacgaaaatacgaatcgctaatacacatgatttcttcaagcttcttctgatcaactgttagataggttagcttgatatttgctaatgccggctcaaacatttttctagcttcatctcgtgcaatttcatcaaaatgctctgctactgtttctgtcatgtgatcacctgctttgcttaaaggactcttctcggaaataatcagtcgatacccctaggacattggccactttaataatgctgggataagatggatcggcttgtttccatttagcaattgttccatttgataaacccgcttgacgttcaagcttacgaatgctcattttcttactttgagccgcttttacgatttttgtatataaacttgccataataacacctccattcgtagaatatagtctaaaataattgtcgaatatcattgacaaattgtagattatattctattattagtgcgtaagaaataagcgacataatagcttatagctattaaatacgctgattactatttacactttatgctccctcaagcacaaacaaagtataatagattattgtcagcgtgtcaacactttttcttagattattatctattaagggtgaattttatgagttcaattaaagaaacggtgcagcaactggcccaaaaacatggctattccatcgctagtttggaacgaaaattaggcttctctaacggttcaattgctaaatgggataagcaatctccctctgctgatcgtctacagcaagtagctgattatttcgatgtttctgtcgattatctgttaggcagggatacgaatgatgacatgactgataaaaaatctattgatttaaacgatgatgatgtaatcatgactttcgagggtaaacccattcaggaagaggatcgggaattaataaaacggttgttgcgggggaaatagtatggatgaaattttgacggatttaatgaattttgctatgaatcatggcatcggttttactgccacaaaagatttaaacccgtatactgcctctgctgtggatacaaaaacaagacagattgttttaaatttaaactggcatgataaaaaacaattggttttccagtttgcccatgagcttggtcatatcattaatggagaccactctgaccaaatcctatattttacgcctggaaaatttggtatcgaactagaggctaataaagcagctgttgacttgattgcaccatactatttaaacgatcgagaattagaacaaattaatccagttgaatttatgaaaatatacgctattcctagccacttgtttgaaactgtaaaacacgaactaattaaatgctattacgcaaaataaaaaagccccactccgctgcaacggaatgaggttatccaaagtgatacgatcacaaataaattatatcactctggggggaaactgaaatgctgacatttttattggtattattttttatagggattatcgcaattatcgttgctattggaatatttatatatgatttaattaagtctaaaccatttaaagtaccaattattgttgccattgttggtcttttgttagcaattggtggttatcagtttggggaaaaattgaatgctaatcagcaagttgcattagcaaagaaatacagtgagtcatcatccaaagctgctagtgaatctgaagcagaagaacctgttattaaactagatggcaaggcaaaaaattataccgattattattttacggcaaattcaaatcgtcaggcaattgtttcaggcactgcgacacatactaaaacaattaaattacaagaaaactttggcgatctcaatgaaaccaaaataaaagtaaattcagacggcacattttcaaaaacaattactttacctaaagataaggcaaaagcttcttattatctaactgctggtaacgatgagattgttacggctcacattaaatctgtaaattatgaagccgaacaaactagtattgatcaagtaaaagcttctagtcgtgctgaatcatctagtaataaatctgctactaacgccacaaagtatcaagctaagcttaacagcttaaataaaggcactgcagaatcagcaagctatgacgctagcactaataccgtcacatggattggctttgatgactggaaaacttggagcgactctgagttgcaaaaatcaatggatctattgcaaacaatgaccttacgtcaagaaactaattacggaatttcaaacgttcacattgtcgtacaattaccagatggcaccacgattgctaaaaattctgatacagatatggatttacaatttattaaataaggagttaatttttagtcgtgaagagttaccgtttttcgattaaaaatagcacatcgccccttcgccaagaaagtcgatgtggtatcagtgtaattatgctttctgtagatacatgggaaaattgatgaaattgtgaattggagaattaaaaatgaaaaaattagttagtttagggattgtcactctagccaccctatcattggcagcgtgcggaaataataattcaacaaataaagatagttcatcgtcaaaagcacgctctgaaagtgttgctaaagcaaaaaaggaatcaaaagctgagaaagaatcacttgctagagctaaatctgaatcaaaaactaaagctgatcgtgaatcaaaagccaaagcagcatccgaaagtagcgccaaggcagccagtgaagctgcagcaagttctagtgccgccgcagaatctgcagccgctgcctcatctcaagctgcggcaagttcatcacagccggctgaacaatctagtcagcaaaacacaatgcaaaactcaccatcggatagtaacaataacaaagtaaacagcgatcctaatgctggtgcaacagtcaacaatgagagccaggcagtcgctctcgctgaatctacatatggtaataacaatggtgattgggtttggggctgcctatggtcagaaaatggcaactattttgtaaaagctatctctaaaagtgcaactactatgacaggaactgctatgagtgtactagttcattcagatggcagcatggaacaacaataaaaaggtcactactggagctgtaatatttggaggaattaagtatgaatgaagattttaatatcactattgaaggtgggacaaagttaacattaacttcaactgacttattattagaacttcctagtaaaaacaccattaaagtatctctaaatcaggatccttcgttaagatttataaatcctactggattattttcgcacgaaggaacagtcaaattaatggcattcaataccgaggaaaatcaatataaggtgataagtgaatttttcttcaatagcagaaaagatggccattctttaaatgttttcaataaaaagctagctacacaaattaagcagaatcatgttgaaattgatgatcctcgcattaaaacggaccaatttactggagaaagatatattcagtataaaggcattaggctcgctgaaaacggcctttttgtcactgatattatggacggtttagcccgagtggcctcgcaagtaattggctcccctgacgaaatagtttatctcatgttaaaaggtgcattcaaggagtacttgattgttacttcaaaaacgctgtttatcatcaagtctggctatatgacgggtcatactttcggcaatggaaatttttcaatgccattaagaagtattactaatgttggtgttaaccaacaatttggtactggatatttttttgtctcatcaggcggaatgcagaatgttgaaaaaagttattggtcttccgataaaaataaaagtgctcaacaagcaccaaatacaatttcattgagtggcattcaaataaataactttcaacaggctgtccaattaattaatagcactctcattcccaacatattagaccctagccctaagaaactaaataaactggaatctagtaatcctttagaccaaattagaaaattgaagtctttacttgatgacgggattattacacaggaagaatttgacgcgaagaaaaaacagctgctggggctgtagcaaataatgagcacacataaaaatagaaaggaaccaaaccaaaatgtcatcaataactgctcaggatattatagattcccatgtctttgatcatttacgtgagatttcgattaacgaagaaacagaagctgttgttttagcaacgttaaggaaagcctacgaaactgaaattgatagaatgcatatagacgccgacaatgacaaagtttttttctcatggctagcccaaccaatgacagtctattttttattcataccacagagtgttagtaatgcaatgcaaggaatactatgttttgctgtcaatagtaataataacaacgttaagctgattgactataaaggtaaaattgaagaatacgcattcaaaaaatatgatgccaagaaacaattgtcatttttaattaatcagaaacttcttgatgtacagccagaaagcatctgtgccattatacgtgctggtattcagacaaatcttgtatcaataggagaaacttgggcacaagacgaatacaaacgtgcgggatctcactttaagaaacctgtaattgagactcttaatttcaatgagctgggacttcatgctgccaagtatgaatttaatactgtaatacaggaaattgcagatcaacaattcaccgccgaattaaatgaatgcctctcggcttttgaacatgaattttactacgtttgtgccgccggtttaggtggagtactagaatctatactgtatttttcactggataactacaaattaattgatcgttcgtttcctaaggatcccaccatatttgattttatacgcattttaaaatcaaataaaataatcaatcgcagagacgaaaattacattaaatccaattttttaataagaaattcagtatcacaccacaattcaggattcaccaatgtaagccagtgccagacaatgatgctaggtgtaagaaacttattttctactgtttacctgcccagcaaagaatggaaagcaaagcatccggattcaacgtataaagaatacttaacacaaggtaatcaaaaataaagtttatttttaattgactctacagtattagcttgtttcacttcaaaagtttctgcagtacgtttacccgagtcgtcatagtcataataatttccattctcatcaattaacgagtcaaataaatcgtattgatccgaaaaagtttctaaagcaaggcttaacgtttttatctcttgattagttagttcgacaattttcattttgatcaccagctttttctttaatataacacaaaacacaccctcatccccgtcgaaagttttgagagtgtgccaaccaaaatcacacgctatttagcgcgctatttacatacataattttaacttaaaggaggtggtttgacaatctcaaccttgtgacgtgtgccccacgataaaacaatggagtgagattaatgagcaaaattaaatatagtaaaaaatataagcatgtattcagttatgataccgtaaacggaaagcaatatggtttccgtttcccctattatgataacaacgaagttcgccatgaaaaacaaaaacgtaaatttgcaaccgaggaatctgcctacaaagctttattaaaaatacagctagatattgctaacaataatatcgttagcgtatcatcctccgaattgacgtttgaaaaatgggctcggcaatggctagattcgcgtaaaggactgatcaaggactcatcgtattattcatacgacgtcaaattgcgtaaccagatttatccgcgcattggagatcaaaaactttccgagcttaacctagtcacctatcaacgattgatgatcaatccgcttgtacgaaagggtctactcaaaaaaacgattgctgcctatcatcaggttgcgatgatcgtggttaatgctgctgtagataacgatattatcacgcggaaccgcctgacaaaagtaaaaattcccaatgtcggaaaactagatcaccgcattatgaccgggaaagagctacaagcttttaatcgtgtattgcgttccgccccactccgctttcaggcgctgtttatgctgctcgaatccaccggcatgcgtagtggtgaggcactaggcttgcgttgggaggatatcgattttgagaatcaaactatctcaataaaaaggacccgtgataaatttggcgctaggagtcctaaaaccgaaagcagcaaaagaacgatcactgcaaatacagatttactccataccctgcaaaaatatcacactcagacaatcgtagacgccctaaaacgtggtcgaggtgcaattatcaaggatgatagttatgtagtgctgagccgcctcctgaaccccatgaacgctaccgaaatgcatcgcgccttaaaagagcttttgaaatcggctgggttaaacaacttaattggacattttactgcgcatacttttcgccatatgtatggttcatatttactagcaagcggaaaaaatgttgtcgcagtaagcagagaacttggacacgaaaacccagccatgacactaaaagtttatagccatgtcatcccaggtcaaaaagataatatgtcgcaggactttttaaacatcattaattcgtgattgctgtggtaagcactgtggtaactgattaaaaataagtaaaaaaagattgctaaatggcggtattaaagcaattaaaaatcttttgaaatataaatttactttacagccaaaatagccgtgatttgagctggtaagatccaattttaccagaaattgcctctttcagccactagattgtttggttagccgaatatttagcgctaattggttgtaccaaaattcaaagtgatttagtatcataagtagagcgttggttctagcaaaaattgttggcaccaaaatcatccactactgtggcgtaatgccatacctttattgtgcctggttgcggtcattaaaatggcggcgctcggaacatcaaaattatccactatatggagtggtactgtcaaacgtacctcatttttgttattaatttccgaatattaaaaaacacccgaacgtctttttctggtattcttggtgtgcgaacaacaagaaaatccagaaagaaggattcgagtgcatacaccattaatagcctatttag

SEQ ID NO: 545 - DNA, 9981 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccattttaaaataggctcaatactgggctactatttgtgtggaaaaaacatgaggtaatacaccaaaacggggttagttaggtgctagtccgatagtccgtttgtgcgtactggaatggaatttgctctggttctgtacgaatgatctcagaaagtattcttctgaaaatgtgaaatagattaaaaatagatttgacaagctagtaggaactaagctatactctaactaatttaaatcgagaaaaggggaaccgcaatgcaacgacgtcagttacaattgaacaatgcctggtggcaaagccaactgtagacagattgttatctaatgtagatacgctctgtcagaggaacgtatctatgttggccttgctgttctttgtgcccgcatagacaatctatgcgggtttttgtttacttttaagcaatcaccctcaaattggtggttgctttttttcttgaaaaaaatagttgtgggagggttttacatgaaacgtatgttatcattcattggtttgttgctagtttttctcggttttgcgtttttccaagaaggtggcgtgaaacaagacaagccacaggcggtaaaaaagccaacgatcggtattttacaaacgatgtcgcatccggcgctagatgatatccatcgcggcactattgatcagttgcgtaagcgcggttttgttaatggcaaaactgctaaaatcgattttaaaaatgctgagggtgatcaaagtaatctaaaatcgatcgccgaacgttttcaaaatgagaatactgatttaaacattggtatcgccacaccggcggcacaggcgattgctaatactgataaaacgacaccattaattttaggtgctatttctaatccgaagtcagccggcttggttgaaaataacgcgcacccaggccataacatcaccggcgtgtctaatcgcacaccaactgctgaccaattgaaattgattcgtgagcttttacccgatgttaaagtactcggggtgatgtatacgtccagtgatccgtcggcgcaagcagaagtcaaagtggtgcgcaagttagcaccgaagtacggctttacgatcaaagaatttactgtctctaattctaacgatgttgatcaagtggcccaaaccatggcgcgccaagtcaaggcggtttatgtaccaactgataatacgatcgccagtgcgatgcagaccttggtcaaaaataccaacgcagccaagatccccgttttcccaccagctgggacgatggtcgaagatggcggtttagcgacttacgggatcaatcaatatcagttaggtgtagcaactgggaacatggcggcggatgtactggaaggtaaatctgatccagccactacgccagtgaaaatcgtggctaaaggtgatttaattttgaatcaaaaagaagcagacttgctgggaatcaagattccggctaagttacaaaaagaagcacaacagaaaggagaggtttataaatgagtctaattacatcagcgatcggtcaaggactaatgtgggggattctcggtgtcggcttgtttctgactttccgggtgctaaattttcctgatatgacagttgaaggcacttttccgtttggtgcggcagtagcagttacggcaatcacgcatggcatgtcgccattattggcaacgttgttggcgtttgttgccgggatgttagccggtttagctacgggattactttataccaaaggtaaaattccgattttattagccggtattttagtgatgacggcgctatattcaatcaacttacgggtgatgggtaaggcgaatgtgtctttgttaaatgaaaatacactgttcaaggcaaaatttttgacccgcctgccgcaatattttgatggcgttgtggttggcttcttgttcgtattggtcaccttgcttattctgatttatttcttgcaaactgagttaggccaagcctttatcgctaccggtgataacgtcacaatggcgcggtcattaggcatcaaaacggatggcatgacgatcatgggcttgatggtttctaacggctttatcggtattgctggtgcattaatggcgcagagtaacggttacgctgacgtcagcatggggatcggcgtcatcgttatcggactggcttcgatcattatcggtgaagttgcttttggcgagttaaccatgaatcaacgcctagttgctgtgatcttaggcagtattttgtatcgtttcgttttgttgatcgttctccaattaggtttcaatacagacgatctaaagttgatctcagcgatcattttggcgctggcattaatgttaccaacattgcaacaacgttttcacgttcaaaagttaatccggaatggggtgagtcggcatgagtgagccaattttacaattaaagaatattgtcgttacggttaatagtggtaatgaggagcggcaaattttaaaacaactgaatttaaccatcaatcgcggtgattttgtcacggtgctagggacaaatggggccggcaaaaccacattattcaatacgatcgctggtaatttacagcctaccgctggtcaagtgattttgcgtcagcgcgatattagtcgcgacaacgaagaaaagcgcgcacaacatctgagtcgtgtgtttcaggacccgaaaatggggaccgcaccgcggatgacggttgcggaaaacttgttgttagcccaacagcgcggtcaacgacggactttgaagctacgtaaattgcgccaaaatcgtgataaatttcgtgaaatggctgctgagattggtaatgggctagagaatcatctagacacgccaaccggcaacttatctggtggtcaacggcaggcactaagtttgctcatggccaccatgacaacgccagatattttgctgttagacgaacacacggcagcactggacccaaaaaccagtgaacaattgatgcactacacacaaaagcgcatcacccaaagcaaccaaacttgcctgatgatcacccatcatttggaagatgccttggcatacggtaatcggctgattgtcattgatgatggacggatcgaagctgattttaacgcaaccgagaaacaaaaattaagtcgcgagcagttgtatgagttctttgacgaaacattaagctagtcgcgtgtgttaaaagatatttagattgagctagtaaaaaatagttttaaaagggagttagctgttcattcaggctgactctttttgtatactggtatttcccgaaccgactacgtataatagtaggtaagtaaattaatagaatgaggtcgacatggataacgaaattttacagcggacgattgaccgcttacctgaatatcatggcaaacaaattaaaagtacgcttcaattattgaccgatggcaacacggtgccgtttgtggcgcgttatcgtaaggaagttactggtaacttagatgaagtccaaattagggccatcgaaactacttataactaccaaatgggactagttgagcggcaaaatgaagtattaaaaaacattcaagaacaaggtaaattaacgccggaattacaaaagaagattcaaaaagccaccaaattgcagcaagttgaggatctgtatttaccttacaaacaaaaacggcggactaaagcgacgattgcgcgagaaaatggtttagcaccatttgcggcctggttgttggcttttccgcaagttgatatcgtagctaaagcgcagacttttgttgatccagccaaaaagttagtcacagcagatgatgttttggctggtgcccacgaaattttagctgaggagttcagcgataacgcgacgttccgcgaatgggtgcggcaatatacgacgaaacacgctaagttcacggctcaagccaaggataaaactttagatgagaagcaagtttactcgatctattatgattttgcggaaccattagctaaaatggtttctcatcgagtattagcagttaaccgcggcgaaaaggcaggtattttaaaggcgggccttgaaattgaaacacggccgattttgtggcacttagagcaggcaatcattcgtggtcaccagggcccagcggttgattatgttaaagccgccattgcagatgcttataaacggtttattggtccagccatcgaacgggagatccgcactgatttgaccgatcaagcagctgaccaagcgattgctgtgtttggcgaaaatttgcgtaacttattgttacaagcaccgctaaaagggcgcgtggtgatgggatttgatcctgcttaccgcacaggttgtaaattagcggttgttgatgctactggtaaatttcttgataaattagtgatctatccacataaaccagcgccgcaagcaaaacggcaagctgctgctgggacgtttaaacaatttattgaaaagaatcaagtagaaatgatcgctattggcaacgggacggccagtcgggagtcggaacaatttgtggctgacgtactgaaaacgttagattgcaaagtctattacgtgatcgttaatgaagctggcgctagtgtctattcagccagtgatgtggcacgagctgaatttccggagttcaacgttgaagaacggagtgcggtcagtattgctcggcgcctgcaagatccattggctgagttgatcaagatcgatcctaaagcggttggcgttggtcaataccagcatgatgtgccacaaaagaagttaagtgcgcaactagatattgtcattgaagatgtggtcaacagtgtgggcgttaatttgaatacagctagtccggaattgttggaacatatttctggtttaagtaagacaacggcgcacaatattgtgacctatcgtaatgaacaaggtaactttacgaagcgccaagaactgaaaaaagtaccacgcttaggtccgaaagcctttgaacagtcggttggctttttgcggatcatcgatggtaaaaatgcgttggataacacggatattcatccagaaagttatgcggttgctaaacaactgctggcaaagtttgatttgaccttggcggcagttggaactgctaaagtggaaaaaatcgtggcaacacctgagcttgcgactgaattatccgttggtttggtcactttgcaggatattattagtggcttacgtaagcctggtcgcgatttacgtgatgattacgcccaaccgttattgcggacggatgtgttgtcgatcgccgatctaaaaccaggaatggcacttgaaggcacggtgcgtaacgtgatcgattttggcgcctttgtcgatatcggtgttaaacatgatggtttggtccatatttcgcagctggctgatcgttttgtcaagaatccaagcgaggtggttgcggttggcgatattgtccacgtctgggtcttgtctgtagatgagcagcgtgaacgtgtacaattgacgatggtgccaccgcgggaaaatgactgatctagaattaacccaatatattcaacggatttcattaaaatatttccagcgtccttttcaacatcaagctaattttaatcgccgtttgaaaacaactggtggacgctatcatttaaacgatcaccatattgacattaacccgcgtttcgcggaagatagtgataagtcagttttgctaggcatcgttaagcatgaattgtgccattatcacttgcacttggccggcgggggctaccgccatcgtgatcgtgattttaagcagtggttagcagcagtcggtggcagtcgttatgcaccggcaccagttagtcacgcgattcactatcaatgccagcaatgtggccaagaatattcgcggcagcgccatttgaatacacagcgctacgtttgtggtaaatgcggcggccgcctgcagttattacagtaagaggaggatacaaaaatgcgacaaataggtattggtttacttggtttaggaaccgtcggcagcggtgttgtccgtttgctgcaggatcataaagataagatctcagcgatcactgggcgcgagctggtgatcaaacgtgtggtcgtccataatcccgataaaaagcgggacgttgagttaccagatgtaccggtgactgctgatatcgccgatatggtccaagaccctaccgtgcagatcgtagtcgaggtcatgggcacgatcgacccagcagaaagctatattgaacaattgctgcgggccggcaaacacgtggtaacggcgaacaaggacttgattgcacaaaaaggggctcggctggtcgatatcgcccaacaaaaacagcgtgatctaatgtatgaagcaagtgttgccggtgggattccaattttacggacaatcgttaacagctttgcggctgatcagatcttagaagtcagcggaatcgtcaacggtacaacaaactacattttaacgcagatgaatcagaaaaaggtcagctatgcggcggcattgaagtcggctcaagagctgggatttgcggaaagtgatccgactaatgacgttgccggaatcgatgcagcttacaaaatgatcattttgacacagtttgcctttgggatgaatgtgaccttagatgacattgcagttgaaggaatcgataaaattagcttagaagatattgagcaggcgcaaaacttaggttacacgatcaaattgatcggggcggccaagcagatcgacggtaaaatcaatgtttccgtcgggccagctttggtgccaacagctaacccactagctgcggtgcaaaatgaaaataatgcggtggtcgtcaaaggtgcggcagttggcgagaccatgttttatggccctggtgctggtgaattaccaacggcgaatagtgttttaagcgatattatttccgtgaccaaagatatcggtatcggcatcaccggtaacacgttcaataattaccgtcaaggtgcggcgttagcgccagcaacagcggttaaatcagcttactactttgctttgaaaatgcgtgatattccaggccaaatgctaaccttgacgaaagtgatggcagaaacgcaagcgagctttaaacagttgatccaaacttccagtgatggtgattttgcacacgtggttatgatcactcacgaaatcgatttggaccaactacaaaaaatcacgacggcggttgccaatttggacaatattagtttattatcaacatataaagttctatagcgctttcgtcagtggctactaggacacagaaaattagttacaagagcttatgcttatatttgaataaataataatcagtgccgcatatttacggatttttttaagtgagatagggggagcagcagttatgacaacgattcgagtaccagccactagcgccaatcttggccctggttttgattcgatcggcttagcattagatctgtatttgacagtaacaatcgctgaggcacggtcagattggtttatcgaacatgaaatgggggcagaagtgcctagtgatgagcataatttgatcattaaaacagcgttggcgctgatccctgatttggagccacatcatttgatcatgcgttcagaaattccgctggctcgtggtttaggtagcagctcgtcggcaatcattgccggtattgcgctggctgatcagctaggtgacttggatctgacccagtatgatatgctgcagatggcggtcaaattggaaggccatcctgataatgtggcgccggcgatctacggtggttttgtcacggcaacctatgatgatgtcgaagctgacgcgatcagcgcaccatttccagcagcgcgggcattaacttttattcccgacacagaattactgaccagcgctagtcgcgccgtgttaccgaagcaaatgccactgcgggcggcagtggcaacaagttcggcggctaatgtgttggtggcggcagtcttgcgcggtgatttagaattagccggccgcatgatggagcgcgatcaattccacgaaacttatcgggaaaaattagtgccacatctagaacagatccgtgactgcgcccgtgaccacggtgcgtgtgggacttatttaagtggtgccggcccaactgtgatcagtatggtgccaacggtggaagctgatgagatccttgaagaattagaaaaattaccgttgaacgggcgctggctaaatttagctattgcgccagccggtttggcgattgaaaagtaaagatggcgcagcccacgaaagtgagctgcgttttttacaaaattagaaattaatgaaaaccgttgcgccgctacgaattttttgctagaatataacagttggttatttgcggctgtggcggaatggcagacgcgctagattaaggatctagtgggaaatttttcccatgctggttcaagtccagtcagccgcatcaaatacttacagtatgtaaaaacgttgttacaagaggctttgcttagtcttttagttgcaacgtttttttgtatttggcttcaaaaaagctttattatgaaattgtcattagtatcgtgtaaggatattgctcttgggtgaatgactttgatataatcgattctaggttgacgttaggattgattcgctgactttccaacctagtgagcaggcacgtgaacgtcacactatccaccaaatctatacaaaacggctttcgctgtggcgccagttattatttcaagggcggcaattaattttgccaaagcctatgcgataaaaaaagctaatcccaaaaaggattagctaacctattagcacgtgctatactctcgtctttttgtgactcataatgtagtatcacgatgattagttataggaaatggatttgatttgaaatctaagtttaaagattacagtagcaacaaaaatgatatgctttaaagaataaatacgttgatataggagattttaatgaaaagtatttgggagatggacgcaccaataggcttggcttttttctttgggccagctttaattattggaattatgatgttaataagtggttttaacaccgtttcagccattatggtcttagtgttagttttgtgtgggcttaaatacatgcatacttcaataattggtaagtatagaataatgaaatctattgttaacagtattcatttaaaaaaagacagtaagatattagacgctggctgtggtcacggtgcctttatgttgcaatttaacggacaagcggcaaacataagcgaaataataggaattgatatctggagtaataaggatcagggaagtaattcaattgcagctactcaaaaaataatggaaaatagtaatttggctgacaaggtaaagttgaaaactgctaatatcttagacatgccattcaacgataatgaatttgatttgattgtatctagtttggtactgcataatattaggccatttgagaaacggaaagcagcgcttgtaaacatagcaagggttcaaaaacaaaaaggtcagttagtaatcatggatataggctacgaaactagtaaatatgtgcgtattcttgaagacttggaatatcaaaacgttaatattgcaaatactggctataacggttggtggggtaccccaatggttccaacttttgtgataactgcgaccaaataaaaacagtatccgtcacactaatagggagaatacagggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 546 - DNA, 36367 bp, Unknown
  Metagenome-assembled genome
ccatcattgatgaactcttcgatcaatttatccgaacactgcccaataatctggcccaattattgggcaatggcgtgtaataactgaattaactaatttttagtcttcaaactcaggactagcaggagtttgaagttatttgggtactttcaacctttagactttcaacctttagttggtaagttaagctgccattgaataccgaatttgtcattaacaatggcatatttttttgcccaaaaggttgcttctagtggtgcaacaatcttgccatcgctactcaaatcatgatagagttgctcgatttcagcgtcacttttagcttggatcactagggcaatgttgttgccactggtcaattccagtcccatttctggtggcacgtcggaaatcatgacctgcgtaccatcgatcatgatgctggcgtgcatgactagatctttcagttgttcaggtagagggtgttccgggtcggtcggtgcatcgcgataatacataatttcatcggtagttgttttaaaaaccttgccgtaaaaatcaagtgccgcggctgactgatcaacaaagttcaaatagatctccatcccttgagcctccttatgttttaccattatctgcttgattcatcttgagtttaacagctatcaaatgcaggcgcaattttgaaccttttttaactgtagacaagtaattagcaatatgatagcgttatcattagacgagtcgtgataatttgtgaaaaggggctaacgatagtgaaagcacaggaaattctgcaagatccattacgtaataaaggaaccgcatttacagtagctgaacggcatgagttgggcttaactggtttattgccaccaaaggtacagactttggacgagcaagtcgcacaagtgtacggtcagttacagatacgtacgactgcgattgctaagcatttatttctgatgcaaatctttaatcaaaatcgggtactgttctatcgtttattgcggcaatatttagttgaattactgccattggtttacactccgacgattggtgatgcggttgagcaatatagtcagcaatttgttgaacctggtggcgcggtttatttgagcattaatgatccggatagtatgcaggctagtttgattgctgctgccgctggtcgggagatcaaaatggtagtcgtaacggatggtgaaggtgtattaggtattggtgactggggtgtcaacggggttgatatttcgattggcaaattaatggtctacacagctgctgctgggatcaatccgcggcaagttttaccgatcgtattggatgtaggtaccgataatcagcagttattagatgatccgctgtatttgggtaatcggcaaaagcgggtgcggggtcaagcttatcatgcgtttatcgatcagtttgttgaagtggttgaaacgacttttcctaatgtttttctgcactgggaagattttggccgtgaaaatgctgcagcaattttaaatcaatatcagaaccagatcaccacttttaatgatgatattcaaggaaccgggatcgtggttctggctggcattttaggtgcgctaagtatttccggtgagaaattaacgacacaacgctatctgtgttttggtgccggcacagcggggactggtgttgcacggcgcatctttttggaaatgcaggcgcaaggattgtcagccgaggaagcacggcagcatttttatttagtcgaccggcaaggtttattgtttgacgacatggctgatcttacgccagaacaaaagccatttgcccgtaaacgcagtgaatttactaatgccgctgcattgactgatttggcggcggtggtagcggcggttcagccaacaattttggtggggacttcagggcagccgcacagtttcaccgaagaaattgttaaatcaatgtgcgcccatacaccacggccgatcatttttgcaatgtcgaatccgactaagttatcagaagccacggcggtagatttgatcaattggtcagctggtaaagctttagtggcgacaggagtaccacaagcgccagtcacgtataatggcgtgacctacgaaattggtcaggcaaataatgctttggtttatcctggcttagggttaggcgtgattgctgcgcaagcaacccgcttaaatgatgaaatgatctcgcaagccgcacattcgctaggtggtattgttgataccagtcagcctggggcagctgttttaccgccagtagcacgggtgactgagtaccaaaagacaattgcgactgcagttgtgcaaagtgcgttggatcaaggactaaccggccgcaaaattgctgacgttgctgcggtagtcacggaaaatcagtggctgccggaatattaagtaaattgatatatcaaaatcaagtcgctactgaccataattggttattggcggcttattttgatttgtgtcgagcctagtaagtctgctacagtgaagttattattttttgacaaggtgggaacttaagatgacaaaagtttggttagtcacaggaacttcgcgtggtttaggtcgagcgttggttgaaatgctactgcagcggggtgaaaaggtggtggcgaccgcacggcaggtagatgcgatcgccgcatggacgcagcaatacccgcaacaggtattgactttagcgttggatgtcactgataaggcgcagatcgctacggttgtaaaaaaagcgattgcgcattttggacagattgatgttttggtcaataatgccggttatggttattttggtgcggtcgaagaaagtgatgaaacggcggtacgagcaatgtttgaaaccaatttttggggactagcggcagtaacacaggcgctattaccccagttgcgcgcgcagcgtagtggcttgatcatcaatatttcttcggattgtggattgacgacttatccagcattgggctattatcaagccagcaagtttgcagttgaagggttaagtcaaacgttagttcaagaaattggaccactaggtattcggttgatgctggttgagccaggcgcattccgaactgattgggcgggccgttcagcgggcgagcacaaacaaacgatcgctgattacgcaacgactgcgggacaagctcaagcacattcacaggcaacggtggcggttaaacctggtagccctgaattagcagtcaaggcgattctcaaagctgcggcagatccgcaaccgccattgcatttagtgttaggtgcagacgcactagttgcagtccgtcagcaagtcgcagccttgacgcaagatctgaatacctgggcgcccacttcaagccacaccgcttttggtgacgaggcatactggcaataatatggtatgataagccctagtgactggaatattagcgtcaaaatcaggctaataaaccaccttaattgtgtaatagggccatgtttcttgcggcgtggttttggccacaagaatggacaccgcctgcgacttagacttgccggtcttcggcttagtctgatcgacaacggaaagcaagctctgtttcatggaaaaatcagatatctgatacttgctaagtagtgttgttgaaaacgagcgacagtgaaacatcagagtttattagcgtacctagctaataaactaccttaattgtgtaataggagaaaaagtatggcagatttagtttatcaacgcataatcaaagatctaactcggcgtatttttgctggggagtttgctgcggaaatgaaattgcccgatgaacgccatctgagtgaagagtatgcggtcagtcgtagctcgatcaagcgcgcattggcgatgctggctaatgatggtgtggtctttaaaaaacgtggctccggcaccttcatcaatccgttatatttagaaaatcaatcgttgttcaattatgaaggcagtaatttaggtatcaccgacaatttacaaatggcggggaaaaagcccggtatcaagctacttgaatttgcggcgattccggccacggcaacgctacagcgtgatttgtttttgcaaagtggtgagttcgtttatcagattaagcggctacgtttgctagatgatcagccgtttatgatcgaagaaagttttattccgatcaaggtcgtgcctgagctaaatcaggatatcgccggtcattcgatttttaactacttgcaggaaactaaaaagcaggcagtcactaaatcgttcttgacgattggtgcagcaccagctacagcagaagatcaagaactgttacatttgcaggccaacgaaccagtgggcacaatggctgggattttctttttagatgatgggacgccaattgagtattcgtttatgcgtatgcactatcgttatctaaaatttaattcatttgtggcgatcgacaagccataaaaaacttgtttcttggatagggcaagttttttatttttgctcactttttaattggtacgacccaatttacaaaaaggttgacttttaatcataaattggttatcttattaggtgaagtagcgcagtgagctgcggtgacttttggtaaatcataaaatagtcattcaatatgaaaaggagaatcaatcatgacggacacaaaaaccgtagattattcatcaccagaatattttgaaaaattaaacgcttattggcgggcagctaactatctttctgttggtcagctttatttaaaagacaatcctttattgcggcggtcattaaaagctagtgacgttaagtattatccaattggccattggggcacgattgctggacagaatttcttgtatgcccatttaaaccgggtgatcaataagtacaatttgaacatgttctatattgaaggtcccggtcatggtggtcaggtcatggtttctaattcttatttggacggctcatacagtgacatctatccagaaatcacgcaagatgaacaagggatgcaaaagttattcaaacagttctcattccctggtggcgtggcttcccatgcggcagccgaaacaccaggttcgatccatgaaggtggcgaattaggttatacattatcccacgcaactggtgcgatcttagataaccctgatgtgatcgctgcagcagtcactggtgacggtgaaactgaaacaggtccattagcagcttcatggttctcgaatacgtttatcaacccaattcatgatggtgcgattttaccaatcgtcaacatgaacggtttcaagatctctaacccaacgattttggcacgtaaatctgacgctgatttacgaaagtattttgaaggtatgggctgggcaccaatttttgttgaaggtgacgatcctaaagtgatgcatccagctttggctaaagcaatggacgaagcaatcgaatcgatcaaagcaatccagaaacatgcacgtgaaaataatgacccaacgcaaccaacttggccagtaattattttccgggcaccaaaaggctggactggtcctaaaacttgggatggcgaaccaatcgaaggttcattccgtgcacatcagattccaattccagtaaatcaaaatgatatgacgcatgcagatgcgttagttgaatggttggaatcctataagcctgaagaactatttgatgaaaatgggacgttgattcctgagttacgggcattagcgcctaagggtgacaagcggatgtcgaccaatccaattacaaacggtggtattgctcctaaagatttgaacttacctgattatcgtaaatatgcgttggataatactgaacatggtaagcaagttaaacaagacatgatcgtttggtctgattacttgcgtgatctgatcaagaacaacccggataacttccgtattttcggtcctgatgaaacgatgtccaatcgtttgtacagtttgtttgaggcaactagtcggcagtggttggaaccaatcaaggagccgcaagatcaatatttggcacctaccggccggatcattgattcacaattatcagaacatcaagctgaaggctttaatgaaggctacaccttaactggtcgtcatggcttgtttactagttatgaagctttcttgcgggtcgttgattcaatgttgacccagcacttcaagtggatccgtaaagctgatgaattagattggcggactaagtatccatcattgaacgtggtttcaacatcgactagcttccagcaagatcataacgggtatacccatcaagatcctggtatcttaacgcatatggcggaaaagaagccagaatatatccgtgaatatttaccagctgatgctaactcgttgttagcggttagtccattgatctttaatagtaagcaaacggtcaatattttgattacttcaaaacaaccacggccacaatactacagcattgaagaagcgactaagttggcgaataacggtttaggtatcattgattgggcttcaactgatcaaggtagcaagcctgatattgtgatcgctgctgcagggactgaaccaaatatggaaagtttagctgcaattaatattttgcacgacaacttccctgaattgaagatccgttatattaacgtgatcgacctgttgaagttacgcagcccagaacgtgatcctcgcggcttgtctgatgctgaattcgatcattactttactaaagatacaccagtcttatttgcttatcatggctttgaagacttaccacgcgatatcttctttgatcgccataaccgcaacatcatgttccacggttatcgtgaagaaggcgacattaccacatcatttgatatgcgggtcgtcaatgaacttgatcgcttccatttagctaaggatgtcatcatgcacttacctgaatatgcggataaaggcgcagctttcatccaaaaaatggacgataaattacaatatcatcacgattatattcgtgaaaatggtgaggatattccagaagtacttgactggacatggcaaccattaaaatagtatcgactaaaaaatcgactctttacggagtcgatttttttgttgcattaaaaaacgatcagcaaaactaattagtttggtttactggtcgttagtgcctgcatggatttaagtatgatcaatcactttcgttgtggcaaaatcattttcttggagtcgtgcgataaggtggtcgactgatttacggtaataaagttttttacttttaaataaagtatcgccattatcagcttttaaaagtacacgataaacttttttggctttatcatttttaagcttatcaatgtgtttgatcaaaatgtacataaaaccgcctccttatcgatcattgtaacatgcgctggcgaagtttcgagaaagcgctagcatatttctagaatttaattgtgctttcgttatacgattatatagtggataagtaataggttataatgaaagtgaggcttggaccgtggatgatttaggtaaatatattttacaattaggtgtcagcaattttgcccagggatttacctggggattagaagtggaacgtcatcgaattggtgctgacggttatttaagcgcggcaccatatccgccaatgttaggtcagcaacgcgctaatccgtacattaaaaatgattatttcaatacacaaagtgaaataatcactccagtcgctaattcgattgggacagcaagtcactatttagcggcattagattatacattgcgttccgcattggcagcggatgattatctttggcctttttcattaccaccttgtttaacagcaacccacagtgaactaggttacgccgatgttggaccagaaaaaatggcttattatcaggaattagggcgttgttacggcatggaagaaggcttaccttcaggaatccatgttaacttggcccctaataaaaagtggactagcgccattgctaaggctgcacgccgagatacatggcaggtacgtgacgaattgttactcaagcaagcgattggatttatgcagtatcgttggttgttcacctatttacagggagctagtccggttgcggaagctaattatttaactgatttaccggcgcagccagtgcgttcattgcgtaattcgcgtcaatacggttatggttttgctagtcattttaagggagattatacctcggtagcagcttatgtagaaaaaatgcaagcagctattgccgctgatgagttgatcgctgaatccgccttccatgaagctgtgcggttgcggcatccggcgggcttgacggctttgacgactcatggggtcagtcatattgagttgcgtatgttggatcttgatcccacggttacgaccgggatacgtagcgacacgctgttattggtgcaattattagcattttattttatggttgcccctaaattagcagcaacggaattaacggtggcgacacaacaaaatgatcaggtggcgctggaacatccgctggtcactagcagccagcaacaggctggtttagatttactagcgcagctacaagaattggtgattaccgctgagctaccgccagtttatcgttcggtggtggcacaagctgccgaaaaattatgtcggcctcaactgactttggcgggccgcttgttgccacgaatccagcaagattcattactggcgtacggcttgcaacaggcgcgcaattttcagctacgggctcaactcaatagttcgccagtttatcgtgactttcaaaatgaaccgcggccgagtcttaaaaaattgcagcaggtactttttgatcaataccaaggtttaccgcatctgaatccacaggaacaatcagtggtcagctaaaattttaaaaaagttggtaaaacttgatgccgatcaattgccggattactaaacggcggtaaactataaccataagttgatcaaggaggtcactattatggaaaaagaaattatgcaattagataacttaacttgcccgtcatgcatgcagaaaattgagggtgcacttaaacagcaagttggtgttagtgagatcaaagttttgtttaatgccgctaaagtcaaagttgattttgatccggcacaaacaaccgccgaaaagttggccgacgttgtggatcgcttaggttatccggttaagaaaatgaaagttaaagaattaagttaggttttagtgcagggagttgtgacataagtaatttatgtccaactctttttttatgcgcctcaataaatcaatcaaagcggatgctaaaaataatttgtgcaaattaaaaatcaatgagataatttagtccttaagttcaaaatacaatcaagttgctgaatttcgttttaaaagtgatagattaaaatttaggagagttgtttatgcaggaacgtcataaaattggtttattttctctagtcatgctggcactgagttcgatcatcggttctggttggctgtttggttctggggaggcggcaatggttgccggtcctgcagcgatcattgcctggatcatcggtgcgattgtgatcatggcgattgcttttaactatgttgagttaggggcaatgtttcctgaaagtgggggaatgagtcgttatgcgcaatacagtcatggcccactgctcggatttattgcggcatgggccaactgggtatctctagtaacgatcatccccattgaagcggtggcggcagtgcaatatatgagctcatggccgtgggcgtgggctaattggacccgccaatttgttgctcatggggatgtgaccacattcggtctgttgatcgtctttttatttatgttagtatttacgctattgaatttctggtcgattcgtttattaactcgtttcaccagtttgatcgctgtttttaaaatggtggtaccggcattaacgatcattttattaatggcatccggttttcatcccgctaattttggtcataattggcagacttttgcgccacagggtagcgcggcaatttttcaggcgacgacagcgtcaggaattatcttttcatataatgcgtttcagactgtgatcaatatggggagcgaaattcgcgattcacgacataacgtggcacgggggatcgctatttcattgttgatcagtgccgtgatctatacgttgttgcaagtcacttttatcggtagtgtaccaccacatttgttagctcagggtggttggcatggtttaaattttgcctcgccattcgcagatctggcaattttactaggactgcagtggtggtcgatcttgctttacttagatgcctttgtatccccgtttggcactggggttacctttgtggcggtcacaagtcggacgctatgggcgatggccaaaaaccagcatatgccacagtggctaggccgtttgaatcgacgttatggcattccacggctagcgatggccgctaatttagtgatcagtttgctaatggtcagcgtttttcgtaattggagtgtgttggccagtgtgatttccacatcaactttgattgcctatttaactggaccagtgacggtgatctccttacgtaagttgcggcctaattttaagcgaccggtggcgtcaaaatggctacgcgttgttgcgccagttgcctttgttctagcaagtttagccacttactgggcaatgtggccaactacgatccaagtcatcttggttattttgttgggattgcctttttacgtttattatgagtggcgtcgcgggtttcctaatttcaaacagcaattaaagggaagcttgtggctgatcatttatttggtctttctttcggccgtttcgtatcttggtagtcagccatttggcggtaatggttggttacattacccctgggattttgtgctgatcagtgttacggcgtatcttttttaccgctggggtgtagccagtcgaatcgatagtgacgagctggttgcagcagcggaggttaatcgacaagttaaagtggatgatgatgagtaatcgtattgggtggggagttgtgacataagtaattatggcgcaactctttttttgtttctgaaccatatcgtcaaaaccagatttttggccacaagaggggtcaataattttcaatgtaaaaaatcaactgccattgtgaagtagcagctaaatagcttatggcaaactcttatttttcttatggggacaaatggtataatgaaaaacatgtgtgaagtagtccaatcgataatagaaaacaagctctgttgtggaatagggggggatttgagtgcggacaagacagttacaaggaatcttattagcggcagttggggcgattctctggggcgtttctggacccattgcgcaatggttatttacgacgcgccagctaagtttagtttggctgatcgagtctaaaatgttgatctccggcatcttgcttttgttgtttgcggctttgttgcccaaggagcgtcagcgtttatttgcgctgtggcattcttggcggagtatcattgctttgcttgcgtttacaatctttggcatggtggctatgcagtttgtttactacaaagctgtggcggttggcaatgccgcaaccgcgacgatcttacagtttttgtcaccggtattcatcgtattgtacacaatgttgcgtgaacgagcagtcccacgacgcgcagatttgattgccgtattggttgccttagtggggacttttttgctagtcactggtggacagccaacacatttagctatctcaccggcggcctttttctggggcgtagctactggaatggccgcggcagcttatgttttattgccgattcacttattagctgagtatggtgcaatcgcgatctccggttgggcaatgacgttaggtgggttactatttgggttactccatcccggtgcgttgcagataccgcatttggatctggttggtcagctgggttattggtttatcgtgattcccggtacagtagttgcttattcgctatatttggcgagtttagattatatttcagcaacggtagtcggactgttagatgcctttgaaccactagccgcgacggtcttatcagttttgtatttaagggtgcattttgggtggattgaatttggggggacgttacttattttaagcacggtcttcattctagcgctggcccgaccacaatcgctagagtcgtcatagtaaaggtaggtattttagtttgaaacgacgatttattattttgatcagcttggccctaggtttgagtttaagcgccggctccgttcaggcggcgccaaaagcagccacagtcactaagattgcccaacaactcaaaaagcagcattttaccggcaccgttttgattgttcgtaacggacataccgtgctgcaacggagctatggctacgccaattttgctaaattacagcgtaattcagcggcttcaacttatcaattggcgtcagtgcagaaagtgttcaccgctgttttattcatgcagctcgtggagactggtaaggttcggttgaatactccgctaagtcaatattatccacagatcaagcacagtaaccagatcacattgcgccaaatgttggatatgaattcgggattatttacgacgactgagccacaaaaaatgttgtctgatcggcaattgatcaaatttgcggttaaacacgttcaggtcaagcagattgggcagcataattacgagccagtgaattatttgttgttaacagggatcattgagcaaattacgggtcaaagttatcggcatttagtccaaaaacgcctattacagccactaaaattgcaccatactggctttgtattagatggctttaaacaagaaacgcatgcggcgttagcttaccagactaaaattacttttttgccttatttgttccgcgtccatacgactagggtggcggtaaagcgcaaattgggtacgggtaatatgtacagcaccgccagcgaattatttcgcttggaacaagcgatccaacaaggccgcttactaaaaccagctagtatagcgaccttatttaacgcgactgatggcagctatcgcggtggtttatataattaccgctatttttttgttagtcatggtgttgaaaatggttatgagtctggtttagcgctaagtcgtgacggtaattctggggtcatcttactcagtaaccggcgaatcgcaggatcattatcccacaaagcgcgccagatttatcgacaattggaattgtgatcaatcctgcacgattggtgcgttgtgtaaatcttgaatttctttgacaaaacgagccacaagttccaactgctcgggttgatactgagctaatagttgctgcatttgttgatcaagttgtaagtgcaattgttgatgagcgtaatttaattgttggcctttatcggttagcgagtaataaacttctttacgattatcggtccgtttgaatttatcgatcagttcaaatttgatcagcttgttgacggttttagagatcgcacctttggatacttgtaagtgggcagtgagctcagtgccgttgatcggctgatttttgccaatatcggctagtgtgtgcagagagagtaatggcagattgctcagtactttctgccactccggtgtggtttttaagcgctttaataaccactcttgttcaaaagagctattgctggcggtggtggtcgcaatttgcagtaatgttggttcgatcacttgtttaaagtaattgattttatccatcgtaatgaatactccttgttaaaatagtttccgggcaaaaggttaggtattattcagtgaattgcgttaaacttagtttcagagtaaaccatagcataaatgttgtggtggaagcaattacggcaaaaataattttaatgtggaggtcattttatgacaacttttattgttggtgcgcatggccaaattggtcaactattaacgaaacaattagcagctaccggtgaaactgttttggcggggattcgtgatactaagcaagctgacactttaagcgcgcttggtgggcaaccgcggcaatttgacttaactgccttacctcaagaacaagctgcagcgtttaaagatgtggataatgttgtgtttaccgccggttctggtggtgcgactggttacgatggcactctagaaatcgatctggatggtgctgttaaaacgatgattgcggctgaacaagcgggcgttaagcgctacgtgatcgttagtgccttgtatgcagaccaacgggacaaatgggcgcaaactgggattgagccatattatgtggctaaatactacgctgatgaatggttgcaacatcgaacacaattaaattatacgatcttgcggccaggcgctttgactaatgatgctggtaccggtaaaatttcgttgcaaccaacattagctagcagtaaaaagattgcccgcgccgatgttgctgccgccatcgtggctgttttaagtaaactacaagcttcggggcaaatttacgatttagtaagtggaacaacaccaattgagcaggcattttagaatcgctattttaggtaagggagtgcgctaacggtgcattcctttattttttctaatgctggctacgtacagtttcttttttactggtaggaatgtggatcctaggttatactagacgggtgaataacggaagcgtattaccgttatatgaagcggaggtttttaccaaatggaaatgcaaagccaagaatttatcgcggcaatccgcgcggaagaatatacgacgactgcaatcaagctgacagccaacgatattaaaaaagcggatttgaagaagctagcagcagcgtatactgagctacaaacacaactaaccgctaaaaaaatagcgcaaattaaaattgagttaccttttgaaacaccggctacgattgaattacaggcgggtattattaatttaccttatgagctggtagataagattgcgttgttgactactgctgaagagcagtatccattaaatctgtatttgatcacaacggcggaaaatctaaatgcgtcggggatgcgcatcgataaaatgagtagtgttgcagcgttcctgcaagcgccagcgccgacgattgaacagattgatgcagcaattagtgaaaaaattactgagttacaggctgctgcggacacgccagcagaaaaataatcaagcgcgcttaatttgttaccaaagtgaaattgaagcacggcgtaattaatgctattcttatagtagtcattatggttagagcgtgctgaaaagttgcgtcattttgcttatattaatttgaattgctaatactaagcgcttaaatattgctaaattaatttagcgtaaacttggttgaaagcagatcaacgtatagtgatgtagtcaaacaattcagttcgaacttattgtctagctaggttatacgtcataagctggacactttttcaacacactctaagaaaacgaatatttgaaacgaaaaggagccatccgtccatgaatcgattgtcacagttaaaaatgaatacacatctttttgcgacggaccttggggacttaggcgctggggagtttttctgccctaattgtggtgcaccgatcatgaccagcgataaaaaatgtgctaattgtggttatgatttgattgcttatcgtgaagggcgtccgcaaccggcgccaacgtcagcaacaacttcccaagcgtcgtcaactgcgactgaaagtgccgcaccttcggcagcagcagtagccagtactgctaagagtgttgcggtcaccagccagatagctgaatcaaacgaatcagcagaagtaactgattcggctgaatctgcggtaacttcagcaccaagcgcgccagatagcgcgctacctgatgttgatgagcgcgtgatcgagagcgcagcttcagcggccgctattctatcctcaattcaggcagatgaaaatccagaagagatcattgctaagttgcgcgcagctacacagcaactggtacctgatgatttaggtcagcccgctagtgcgcagccacaatccagtgcttcattatcgagtcggcgtgaagcgcatattgccgataaaacgaaggatatcagtgatatcgtcgatcaagtacgcgcagccactgacagcgcgcagccacgggaacatctttcacctgatgatattacgcttgaatcaacagcttccagtgctgcacaaccagcaacgcggatggcgcgtcatgaaaaaacagcagaatcggccgcggagaatgaaccttatcaggcaccacgagcggttacgcccgaagaacgggccgcagcttccatgcaacaggctgacgaagctgatgaaccaacaactagtgaaagtgaagcacccgttaaacctgcaatcgaaaaagctgagtcagaatcagcagaaaaaattcgacctaagaaaagtaaacgtaaatggtggatcattggtattattgtgatcgtcatcttacttggcgcttttttattcggccagcattattttagccgggatgcccagttagatcgtgcctttgcggtactcgccactaataatcctagccgtgtgagccaagtcatgacaagtagtgatgctgatcttcgtttgacgccaggtaattgtcgtccattcattcgttttaccaaagccaacccgcaatacttaaaaacaagtaaagcgcagttgaaaaaggcgaatgcaactaaggatggtaccctgggatttgtcaaagaagggcatcactttatttttactgcgtaccagttgacgatcgctccgacttaccggacgattgccacggacttaccttcaccatcgatttatttagatgggcaaaatgtaacggctaagaagccagctgcaacgcagaaaatcgggccgtttattcccgggacctatacgctgaaggttaccgcgcaaaccgatgataaaaccttatcacggacggtacatgcaacttttctaacagccgacgcacaaacgatcgatttgacgttaaagcccgtgacgccggtggtacacagtaatgtggccaatgcaactgtatacgtcaataatcaaaataagggcacgttgcaaaatggacagttaactttacctgctttaacatgggaagctaattcgaaactacatttagaaacaaaaattgctggagaaaccgttaaaactaaagcggtgacgctaactaaagcagctaagcagaacattcaggctgattttacaactgtaccgacaacggcacaggcacaagatctactaactcgcttatatacaacggctagtagtgcaaccaatgcaaataatgccaatgatacggctgctttagcagcttactttaaaaatggcaccgacgctgcagcgtataaaaagttagcaacgtttattacgcaagcacgtgcaagcaatagtaatatcgatcatactgattttaaagttcaagttgatcaagtcttgacgaagaataatcagactaccgtcgacttttcagttacttatacaaccagctatgtgcagacatcgggtttacagacgcgggttcagacctatcattatactggtgcgcatttgactagtgatacaaagaatctacaagtgatcgattttggtgataatgaacagaaaacggctgataataacgccaattaaggtaaagtaaagaagctaacactgtgatcgcagtgttagcttcttttttgatgcttatagtaattctggaaatagttgttgcagcttggttgtcgctttggtgccatttaattggatctcggtcagctcaactgctgaatgctgcccacaaagttgaatagtggtattgctgtgtttaacccgtaatcctagttgataagcggcaatcaataactgctgttgatcggcgttaagcggtgctgcctcaggggggatttgctgttgctgctgttgtcggtgtagtgtggcttgggctaaggcgaaagcagttaatggttgttgactggcagcgtacattattctggcactgggtgttaattcaggttggctagcccgctgcgcaattgtggtgacggcttgccggtagtcagtcggccaactatgactgaaatcggtgagttgttgtagccaagcttgcaattcattggtaaaagcagaaggacgctccggtgcttctaaagctacttggcgattacgctgttgtgcgtgggctaacgcagccgctaaatcatctggtagggggcgtactgctaagtagctgataaaaactttgaaaaaacgcaaagttgtttgactgatcgcatccgcactaaatggatcgagatcaaaaacacgaaattctaagtaatcgattccttcagtaagtagatcatttaatttggattgcttttttagccgtacagggccgtagaactcgtgctgtgaataaagttggcctgtggcaatagcagcgtcaatatcgtgtagataggcagctagcgacgtataacgcacgttttcagaggtggtattagtaaaaccatattcactattgcgaatactgcgaacaggctgtgctaatgcagttgggaatgtagaaaaataatttggcgcagcttgcggggtggcaccaaataagtaagttaatatccaacgggctaacatgaaattttgcacaatatggaaataaagctgattgcgtgcagcaacagattgtccggtcagtaaagcagtcggtaaactaaaactaacatgactaccagtggtgatcgcatgctggataccatatttctctaataaatagtcgcggtagtcttggtaagctggacgttcaaaattatttgcgataaaagttaagtcagccgagctaacttctggcggcagtgaaagtggccagatcaactcattgggctgtaaagcgtgagcaaaaattgcttgtaaagttgcgagttgccggctaagcgctgtcattgaagtgtgtggatcagtaatgatttcagcttgactttcggcaaagtcagattgaaagtaaggatggaaacggcgactacccaagtcggttgggtggggcacttgacttagatggccagaattattgatgcgatgttcttcaacttcaacgcctaaacgactttgttggagtaaggctatttgctgcggatttactattagattacgcacaacgatcaccactttgttttgagattgaatttattatacagatttcttaggcaaagtggtatttaaatactaaaaagtttgtcagcgttttagtgcgttaggctaggtaaatgctagaatgaaagtattaaatagatggaggttgcgaacatgaaatttgttgatcttggtcgtagtggcttaaatgcatcagctgtatccttaggcttaatgcgcgtcaatggtttagctgatgatgctgcggcagtaaaggttttggaaacagcggtgaacagcggcatcaatttctttgataatgctgatatgtatggtaaaggtgaatgtgaagcgcgctttggtcgggctttacggcaatcaagcattaagcgcgaagatattttaattcaaactaaggttggtatcttagatcatgcttatgatttttccaagcaacatttaattgaagcggtggatggcagcttacaacgcttaggcgtcgattatgtagattcattattactccatcggccagatgccttaattgaaccagaagagattgctaccgtatttgatcaattacaaaatgctggtaaggtacgtcaattcggggtcagcaatatgaatcctagtcaagtagaattattgcagcatagcttgaatcaaaagctgatcgttaatcagttacaattcgggattatgcatactgggccaatcgatgctggtttgcatgttaacatgacagatccgcggagcgttgatcatgatggcggtattattgaatactcacggctacatgatatgacgatccaagcatggagcccattccaatatggcttcttcgaaggggttttcattgataatcctaagttccaggaattaaacgatgagctacaaaaattagcagataagtatcacgtgactaaaaatgggatcgctgttgcgtggattttgcgtcatcccgcgcagatgcaagtgattcttggcagcatgaatcaagaacgtatcgcgcaaatggcagctggtgctgacgttaagttaacgcatcaagaatggtatgacgtttacttagctgcgggtaataatttaccataaataacgcaaaaaaagagactgtgacataaggcgttcagttactacttcacagtagtagttgattttcatactgaaaatctttgctgctgcggaacgttgtctattcccgtggtgaagatcataccgcaggaaacatagcaaggcaaaaccgccaagttgaaacatggtaagcgggttgcgttatgtcatacgttttagctatatttttcgaaagtgcaaaaaagcatttgggattattttccaaatgcttttttattagctatttttttaataaatggcaccgatttgtggtaacgttgggaatttcttgaggtagtattcacgcgctgtcaatagtggtgaaatttctgattcagcagagccttgatgtaaatagcagacccgcttatctgcatgattcttgacgtcaagatagaaagaaatcgatgaagtgaagatcagatcatagtcagcaaagtcagtggcatcataaggttcaatgtcgatgtagttaaaaccgctataaagatctaggtaacgccgataaagcatgctatctcctggtaccattaaaccaacccggatatgatattctttcttgtattcagtgtagatcggtaataacaggtgatacaaggattgtaccatttgttcacgatcaccatggaagtcagcgtatttttcgggtaagttgtcgatataagtgccgatttcgtgatagagatcagcataatcgtagccaccagttaaaatattacgttcagaattggcgatgatcgataaagttggcataaccccgtcaaatacgtaccctgttaaggcaacattgatcacgttacccaccagaactttatcgagtactaaacggttaggcatcctaaagcttttttcttgcatgtaattgagaaattcagtagcaaattgccaaacaatattattccggctgtagcaataatctaatgtggtctgcaagtaacgatctactttccggaaaacaggcaagatgttcaataattgatagccaaagtgcaacattgcctgttttcgatcattggtcaagtcgggataatgacgctgggaaatcaattcagaatccaacaaacgtggatcataattttcattattgtctatcaagatctcgtagcgttcatcgtcttctacataattgccctgacgcatccgtaagctggcgattgctaaaatcaatgggaaaacatcagaattttcccattcactgggaacttgtatccgggtcataaattgatcccgaacttcaagtgcaactgcttggagatgttcaccaaatggccagatcacgccttcagtggctaaacggaaaatacagaataagaagagaattgttttacgttcgtcaccaacaatattcatatgactgaaggtgaaatgtaagccaaagttgtgtaattggtcatttaaaggcttgattttacgaaaaacagttgctcgacttgtttcatagcgtttacaaaaatcatcgattgatggttcgtcttcggtgatcaagtaatagatggcttggtaaggtagctgattagagattaaatgataacgtaaggtgttaaggtcaaccgttaaattagttgtatctaaactaccattgtcagcaatcaatgaatctgctttaggatcgattagggctaattcatcaaccaaaccttgagttaatttgtaagccttagggtaaggtaggtcaacgcgttgagcaacatcgttaatcgaataagcccccgcacgcattgaaatcagcgtactataaatccgaaaatattgataagcccgatcgtttagcatcatttgttcaaagtccatagttatcatttcctccaataataaataaacttgagcgcaactggatatataaaatcaattaaattgattaagtaacttcttcttttacaaaatatattttaataatcttctaaaataattgtaaaccacatacaaaataataacactttattgataaaattccagtcaaaaataaataaaattaataataattttttgcgtttatttaattaaatcgggaaattgattgctatttggtctaatggagtcaaaaaagttgatcatatttgactgattagattgggagccatttaattaatatcgacttaaaaagcgcagagaaaataagtttaatttagtattattaatgatagattttaattgctacgaaggataataatttatttattttgaaaaatataatgaaaaatacgaatttaattactggctgattaattaatattcgggaaaataaaaagacgctattcataaaagtatgaacagcgtcaaaaatgtgtatttaagttttaatcgcgatcattgttgccgaaaagaatgattaggcgcaataattgtaggaaggtggataaagctgctgcaacgtaagttaaggcggcagcagttaatacacggcgaaccattgggacttcgtctgcggcgagaataccgccggaagcaagaatccgaatcgcacgacgtgaagcgttgaattcaactggcaaggtgactacttggaacaataacgctaaggagaacgcggcgataccaatattgatcaacgtatggttcatccctaaaattacacctagcaaaattaagggaaacgatagcgtagagccaatattagctgcaggtacgattgcagtacgaatccgcatgggaatatagttgcgctgatcttggactgcgtggccacattcgtgagctgccacaccaattgcggctacggacgtagattgtgcggttgagttggataaactaaggatcttcgtctgaccgttgtaattatcggtcagatcaccggaaatttcttggacagcgacgtcgttgatccctgattgctgcagaatgtagcgagccgcgtcggttccagtcacaccactacgactgcggacggtatcatatcggcggaacgtacggttaacataggcagaagcggccattgaaatcagcaggccaatgataactaaaatataggtggggtcccaaaaaaacatacccagtcacgacctttcagagtgatagtgagactattatgtcaaaatcgaagtgaaaagtactcagtctcaaggcggattaaactggttctgcagctaaacgcgcttcatgattagcaatgatctgtttaactaatgcctgcgcaacattaacgttttttagtaacggaccgtgagaataactaccgatcgttcctttatagcgcatcccttcaacaccatcatcgggattattaccataaccagtgaccatttttcccagaggctttaatttttccgggtcatcaaaataagtgcggccgctatgattttcaaaagccttaacggtgccccattctgtttcaaattcagtatcaccgatcattctggcgtcagctttgaatatagtgtgtaaggggagaatgcctaaccctttgatgactgtgccatcactgatttcatagtaatcacctagcagttggtaacccccacaaattgctaacattggtttgcttgcttcgatgtagtcagcaattgtttgcttatggcgtaacaaatctttagcaacgacggtttgttcgaagtcctgaccaccgccgaagaagagaaaatcgtagttttgcgcgttaaattcaggtgtatcgatactaacatcatcaacttgagtggtgaagccttgctgcttaagtaagtagctaagaatcttaacgtcaccactatcgccataagtattcattagatcctcgtaaagataggcgattttaattgttttagtcatgttatttaatcctttctacttcacaattaaggggatgattagcaaaaaacgctaatcatttctgatgttacgggcgatggccattcttgtggcaaaaatcgtgccgcaagaaacatggctctacttcacagttaaggtagctgattagcaagaagcgctaatcagctttgatgtcacggcgctgtgccattgctgcgagatgcttatttgctgtccgcaggtcacttaattcaacaaaaagcatagcataagttgcagtggtgaacaacggtttagacttgtttgtcctgccatttagccagtttgcgctgcagtagatcggctagttcagcgtcggtagtgcctagtttttccagtaaggcaaaagtgactagtagcacatcgatatattcttctttggcatcggcgacagataactgtttgtagccatcgccagaaacgccttccattgaaagtagggcttcagctgcttcgcccacttcctcacttaatttaatggcttgttgctccaatgtttttggttcttgttgcgaaagttgcttgatcgtttgccatagattatccatgaattaatgctcctgatcttcgatttgcatgccacgatcggcgacaacgttggaaaaaacaatttgggtagtggtacggccaaattgttgtaagtgattgatgaaatcgtctagttcttcagttgagcgatagatgactttcatgatcattgaatattggccagtgatgcagtcgcattccaaaacgttgggtgtgccagcaacaaatcgataaaactcaggcttttcggttggtgataagtctaaactaacgtaagcttttattacatatcctagtgctttgtaatcgatttgagcttgataaccgtgcagtagtgtttgttctaaatgatttaaacgtgttgcagcggtaggcgctgagatgaacgcttgttgagcgagatcttttagtgaggtacgggcattttcttgtaaaagattcaatattttccgatccgttgcatccatagataaccctccaaattagaacttgatttatgataaagaaaaaaacacaacactttagttattaaagctaaaatacacctagaaaaaatagatgaaaataagaacttagccgcattataccacaaaaaaatcaagtgtgatatcttataacatatagaaagtgattgtgcagtgcacgttaaaggagtcattttcttagcttgataagcgtattttcttaaaaaaatataatcaaaatcaagctaaattctaattttaaatagatatactagtttctgttattccggcttagctcagttggtagagcgtctgactgttaatcagaatgtcgttggttcgagtccgacagccggagtttttagatcagtagtgatgactactggtctttttttgtttttctgggataataaattaaatgagatttaattcaaggagcgtttgcgatgatcacattattcgtagctttattttatttggccttagttatggtggttgggttagttatttatcggatttacttgttagttcgccatgatcaagagcgtggaccactagtcagtcgctatgcactttattcggcagcagcagcgatgttttgtgcaatcgtgatcggcgcattattgcggaaataacaaaagccaccggctgggtgaccggtggcaaaaaggagttggggtgagattacgttgggagggcgtaatctcttttttcatactttggaggagaatgaaaaagttagggttatctggttgttgggtatagatacgcgtttcgctaaagtgaatcaaatttgattggctaaagcgcttcgcttatctacattgacaactataccgaataattgtgaagaaattgtgatggtttcggtatataattttgaagcctaggtaaagaaaatactaaagtagtcggtaatgtgtttggcaacggacaatattagtttttagcgctagtttagctggacctttccggccacatgctagcgtatttcacggtataattaatctaatagtgaggtgttgaagatgacaacaattttagctttagtgaagcaaaatgaagcgctggcgcaattacgtgcgacgttaccggctgacgtgcgcttactgaccgccgatcaagcaacggctgctgatttggcgcaggttgacattatttatggttggaacgaaactggtcgcaaagtattagcactgtcgcaacaacaagttaaatggatccaaacaatttccgctggtgtcgattcattgccattggcacaacttaaacagcagcatattctattgtctaataccagtggcattcacgctgaatcgattgctgagtcggtgatcggtatgctgctgatgcacgtgcgtggtctgcaagaatcggcggttcagcaaacgcaaagtcagtggcacaagccagaacaccatcaactgacaactttgaaagcaaagcagttgttgatttatggaacggggcatatcggccaacgaatcgctgaattagccaatgcgttggggatgcaagtcagtggcgttaatcgtagtggccatccagttgaccactttggtgcaacttattcaatggcaacggtcaaatcagccttacgacaggcagatgtgatcgttaatgtgatgccgctgactgcgacgaccaagcatttctttaatgctgacttttttgcacagctgcagaagcaaccaatttttgtgaatgtcggtcgtggcccttcggtggacactagcgccctgataacagcgctgcagcagcaagtcggttttgcggcgttggacgtttttgaagacgaaccattgccggcggatcatcctttatggcaacaaaaaaatgtgctgttgatgccgcatatttccggtatttttgatggctatatgcgtgccgccaatcaaattttcctgaacaatttacaatcatttttgacgcagggacagttggcgcaaaatcaagttgagcttgaccgcggttattagggatagtattctgatggaaaatcaattagaaaaggtctgatcagaatgcaattacgaccaatccaatcaactgatgatcagcagatcaagacgatcattcagcaggcactagccgactaccagttaaatttacccggcacagcttattttgatccgcaacttgaccatttagctgaatattatgcgcagctaccagatagtcaatactgggtcttagttgatgctactggtaaagtggctggcggcgctggcgtcggtgtgtttaatgcagctaaaggaatcgctgaactacaaaagttgtatatagcacctgaatttcgtgggcgtgggttggctcatcagctgatgcagcagacgcttggctttgcgcaacagcactaccagcagctttatttggaaacttttgcggtgttgcaggcggctaatcagctatatcatcgttacggttttcgccaattatcggcgccattggcgggtagtgagcacagtgcttgcgatacttggtatgtgcgtgagcttacggattgactagttgactttgggcggcgcgataacggtaaagcgtcgcaatcaaagcggcgtttggtaattcgagcatggttgcagtattactgatcgctttgagctgatttgtagcgctgttgcggtcgccggtatacatgtcgatcaaggcaatcgtcattttcagagttaaacggatagcggtggcttgtgcactatgcggctcagctagcatttcaactgccgtttgtcgtaggttggccaactcgtgaccatgatgattagaatctaagatcaattgcgtgtatgaagataaaatactgctgaatggcagggcaacatcgtaccaacgggaataattccggtaacggcggtaggtctgctgtgcttcagtgtaacaagcggttaaggtcggccaatcttcagtcaggcctaagatacccatagcgaaaatttttaggtcggcgatcgtccaatgttttaattgacgtaaatactgtactagcggttgaatcggtgcattatccagttgtaaaccgttattctgccacccataagtcagcgcgtaagcataacttgctaagaagcgagtttgctgatcagcgctgactttatttttgttgtaaagcgctagtaggtgggcaaagtcttgttttgcgtaataggtgtcgatttgttggcgtagcgattgattagttggttgctgataattttggtgaatatagctaaattcgttaaaatcgatcccgatattggctaatagggccgcaaatttttctgcggtcatttgttgctcacctttttcaaagcggccatagaaagtacgcgaaacgacgccactgtaaatttctttttgggtcatgcctttatctaagcgaattgaccgcaatgtttgaccatatgtcattctgacagctcctttttgcacattataaggtgcaaatatctaattttgatgcagcttatagtgtgcacatcgtttaaatgcagtataccaaaattccttaagctggagacagcagccacgaacatcgggaaatttattagtgggctgcgctaagaaacttaccttaactcgtgagttagagccatgtttcaacttggcgtacctcgccgtagttgaatggacatcgctacgaacattggaagtttattagcggactgtgctaataaacttatcctaatttgtgagttagagccatgtttcaacttggcgtactttgccgtagttgaatggacatcgccacgaacatcggaagtttattagtgggctgtgctaagaaacttaccttaattcgtgagttagagccatgtttcaacttggcgtactttgccgtagttgaatggacatcgccacgaacatcggaagtttattagtgggctgtgctaagaaacttaccttaattcgtgagttagagaggatgatggtagatgcaggtgaaagcaaccgtgcgccggcaaattattttggccaccggtagtgacttacttagcatatttagtgcgcaggcgttcaactttgcagtaggattatgtttgttggcactgacaggttcagcatttagttttagtctgattttgttagttggtccgtgtgtgacgttggtgttagcaccacttgttggtaagctggtcgatgcatacaagcatcaacatttgttggtcattagccaattgtttagttgtggcggcttagtggcttttctgttgttattattcttattgccgcagcagcgctttgtttggatcattttagcggtaatttggttgcgggccttggcgttattgacgactacagcgtaccaagcatcggtggtgtatttagtcccagttacgcagcaacagcggctaaattcattagagcaggcggctaattcgttagcgacgattgtggcaccagtcattgctgcagctgcgtatacaagttggggctttatctggtttgtttatgtagaaatctttggcgaattattaaatttgttggcttttacgcagcttgattttagttttgccggtcaacaacaagtaccaaaaaaatcggtacagcagcggctaggccaaacattcagttatttgtggcggataccagcgctacgtttgctgctgttatttggtttgcaagttaatttttttatcagtgtactcaatgttgggttaccttatgttttgctgcgacagttgcattttactaattcactgtacgctttggctgatagcatgctgggaatcgggatggttgcagctgggcttagctcggctaaacgtaaattgcgctggccattaaaaataattgtgactatgatttttatttttggcggcttgttattaatactagcgttagtaatgtggttgccagtttatcaattattatttatctgcatggtgaactttggacttggtttttgtttgttaattattaatacgttagaacaaacttttatgcaacaaacagtaaaacggcagcaacaaggccatgtttttgcgctatttagtgctgcggtgcaaataatgattccgttaggcgcgctattctatggttattgctttgaccattattcagcagtgtggctttttgctgggactggggcgagtattttactgtttagtggtttgttgtggcgttactatcaagctggtacgcgccagtgaatttaacggtagcgattacattgccattctgaaaagcaaccctaatttttcaggaaaagtagtcccattatttttgaatatgtggtagaataaagcagtaaatgtacaacttgattaaacgtgatttcgacggttattatttcgacttagttatttttagctatattcagaatgagtcatcgtttgggatctgtattgatcgttgtaatacaatttaggaggactaatatttatgtcattagtacatggtactgaactgtttgctgctgctcgtaagggtcattatgctatcggtgcattcaacacgaacaacttggaatggactcgcgctatcttaggtgctgctcaagaattaaacgttcctgtattgatccaaacttcaatgggcgctgcaaagtacatgggtggttatgaactttgccaacaacttgttgaagcaacaatcaagagcatgaacatcacagttcctgttgtaatgcatttagaccatggtaactacgaagctgctaaagctgctatcgctgctggctacaactccgttatgttcgacggccatgatttaccatttgctgaaaacttggaaaagactaaggaaatcgttgctttagcacatgctaaaggtatctccgttgaagccgaagtaggttcaatcggtggtgaagaagacggtatcgttggtgaaggtgaattagctgatgttgaagaagctaaacaattagctgcaactggcatcgacttcttggctgccggcattggtaatatccatggccaatacccagctaattggaaaggtctacacttcgaccgtttgcaagaattagctgacgttatcgaacaaccacttgtattacatggtggttcaggtattcctcaagaacaagttgaaaaagctatctcaatgggtgttgctaaattgaacatcaacactgaatgccaattagcctttgctaaagctactcgtgaatacatcgaagctggcaaagaccaagaaggtaaaggctttgatcctcgtaaattattggcaccaggtacaaaagctatcgaagatactgttaaagaaatcattggctggatgggtacaaaacctgttaaattggttccagaagaaatctaatttaacttttagttaatgtgaaaagaccaactcggtttagactgagttggtctttttttggtgcaaaaaaggcgttgtgacatcatttatgtccaacgccttctctacatttccaaacaacaccgttaaaatatgtgacagcatatggaagccggtcacactcgcgctaattttatagccgtttacgttgcattgcccgatcggcaatgatcgaagcgacgatcgacaagctgatcaagccgatgatcactactaatgaactaatattggagatatgcaagttgaagtcgaaatagtgggccgcttcattgagcaccattttgaagccgataaaggctaagatcgcagctaaggcatacttgatatagcggaaaagcggtaaaatgccactgaccgcaaaatacagggaacgcagtcccatgatcgcaaaaatatttgaagtcacaacaatgaagctattttgcgaaaccgagaggactgccggaattgaatcaaccgcaaaaattagatcagaggcttcgataaagagtagcgcgatcaaaaattgtgtggcaaaccgtttaccgtcaatcttaacgaaaaacttagccacggatgcatcttctttgaacgggaaaagccggcggagcgttttaataatgaaattattgtttaagtcgccagattcttccttttcgaatagcattttaataccggtaatgacgaggaaaagaccgaaaacgaccatcaaccatttaaatttatccagtaacacgaccccggcaaaaatgaacaggacacgcatgactaaggcaccgaaaacgccccagaataacagccggtgctggtacttggcgtcgatcttgaaaaagttaaagactagaatgaaaataaagatattatcaatactcaacgacttttctaatagataggcggtgacgaaatcgagtgcgtgattaccgccggctaaagcccagatcccaccggcaaagataaaagctaagccgatccaaaatgcactccacagtagggaggacttgatcgtcggtgcttcattggtccggtggaaaacacctagatccaaggccaacatcacaataataaaaacgaaaaatccgatccaataaccaatactaacttccaaatagggttcctccttgagatgactatcaaatgtctgctgcgttgtcttcgataagataatgggtaggcataaaatagtggcgagacactattcagttgcggttggagcttgatgaattaaattttgtagttagcaggtatcaaagaaagctaaagcctgttttgacacccgctaattgtgtaggtcacaattatatttttgcctgcataatttaccggtaagctgattatactagataaaagcaaaaacttatactactttttaaaattattttcagaaaagctattcgttggtagcaactagttgattcaatgacacttgttcagttgtcgatagttggaaaaagccgtttattctgctatagttcaaaatgaaagtttggcatttattgagaatggagtggtcaaaatgcgccgaaatatgccactatttattggcggaatcgtgtttctggctttatttaatttgacgatcgtcggcgtgctcgtcagcttagtttttaacttgttttcgttatcattagcgccggcacagcaatttttaagcgagttagtgacgttacttttctgggtactgatcaatcgctattatttaaaggtgcgcctgaactggcaattcaaatcgcaccaactgctttatattttacccgtgttggtggttttactgggtgatgcgacgttaaagccgcaattcaactttagcttcaccgcaattttaacggcaattgctcttggcggtgccgttgggtttgtcgaagaatatgtgttccgcggactagtggtcaactttttgactgatcatttgcactccggcgcgggtgcggcggctgcgttgagtggctctgcctttgctgtgatccacttagtcaatctgagtgacggtaacagtctgaatacactagcgcaagtgctgagtgcgtttggacttggttttttcttcgcagtgatctatttactgacgcataacctctggctgccgatcattggccacgcgctgatcgatatttttgaccaactggcatttggcactttgagcaacaccgctggcactagtctgctgactagtagcctctacttgatcttttttaccggcctcggcctgtatctattacgaaaaaaagcgccgcgacttaactttgcccacgaacgaccacagtttgcgcggaaaaatatggtgccacgccccgcattgacttaatcgctacgggattagcttgcttgattccgccagtggaattatggctcggttccttcgtcccgcaattgtttgctcaccgcctgggtcgggtactgatcacggatgtgattttctttgctggtttttgtggcgcaatttggttgtaccgttcagtgctgcgagcggattggcgagaatttaaaaaacattggttcgtcaatttcatcaaggctgtcggtggcgtgatcgcttcatacgcaattttactgttggtacgtagtttgttgaaaccatggctgtccagtagtggtgtcccggatgtgttaagtgtacaaacggcgacggtgacactgatcgccagcctaaccgttctaatggcgccatttactgaagaaattattttccgccatgcgctgttttatcagtggcgtaatcggggtgtgttaacgtggttgatgtttgttttgtcagcaatcttattcgggttagtccattggaataattttgacggtaatattgtggcgatgatcccgtatatggcggttggcgcctggtacgcactgatttattattggtcgcgcaatatttggcaaaatattctaacccattttctgttcgactttatccagtttttaagtgcattactattattcatcctggcattttttggaatttaaaaaagttactcacaattgtgggtaactttttatttttttggctgcggcacgtgtaactgctgaattagttgttggtaatgttgataaacttggggataaccgaattcttgaaggatggttaggttggtagccaagtggctatctgcttgtcgggtcaaaattgcggcggccagtaagcggttgattgtggctaataattgattgtataagtcattcatttgatgcgcaaaatgttgcgctaaatcgcagtaaatgaccgcctggtgcgggtcattattttgtagtgctagttcagctaaattattgaacaagatcggaatattcttctcgcggccataaagctcgtggctagcgatttttttactcattttattgcccagtgttttagctagtggatactcagctagaaaaatactgttggtcaataggcgaatctcatattcatgccagtgtgctgtgttaagcagataggtgaagagcgatcgatatttggcatgatcgatctggccggcttgctgatggaattctaattcacctaataaggtaaggcgcttgtgttgtagataaagtgaacgttgtgcaatttcaacagtaaattcagtttttaaaaaattcgccaagccgatgaaatcacattgattgactaggtcattgctgcggtgggcatagtaatcggcttcgttttcctgttgtaatgttaattcgcgttgaaactcatctagggataggcctaaacggttgaccaagcgtaaaaatttgtcataagtcggatagtaattttgatgttctaattcagagagatgggaccgcgacatgatcccgtgagctaattgagcttgggtcaagcctttatcttggcgcaagctgcgtaggacagcaccaattgtttgcattagttatcaccagctttgtcgaaataagtaacataagtttagcgcaaactgtgattaaagttaaactttggttatgaaagagggcgaggttataatgtttgtgtataaaataaatgcgacaatgacggttgctgccatcaagacgatctaccaggcgactgcttttgataaagatttgactacgctgcggctagcaacaatgctggcacaaacaccgttgaccgtcagcgcatggcagggaaagcagctgatcggttttgctcgctatttgactgattttgaatacagtgcttatttatcggacttagcggttttgcctgcctatcagcgacaaggtatcgggcgccacttgttaaaaattggtcacgactatttagggtgtcgagtgacgattacattacgcgcagcgcccacagctaaaacttattatccacaagtcggtttcacagcctgtgatcatctttttcgactgccacgggcaatccaattgtctgtgaataagttgtctagtattacggtgaccgcacaggcaaaaattagcgggcaacaattggcgcaagtttttcaagcagctggattaaggcggcctatctatgatctaggtcggctgcaacgaatgctgaataacgctacttttatctatacagcatggcaagggactgaattagtaggtattgcgcgcgattttactgatggtgcgtacgttggttatattgctgatttagcagtggcgaagtcatttcagcgccagggtatcggtcggcaactgcttgcccagattcgctgtgatctaggaccacagatcagtttagtattattggctgcgccggcggccatgacatattatccacagctaagttttcaacaggatgccaacggttttacacaaccgcgacaatggtaaaaaaacgagttgtccacagtggataactcgtttttttagaaatagagatattttaaagttaggaacagcacgaggatcactaagctaggtagaaagttagatacacgaatcttggtcaatttaataatatttaagccaatggcgacgatcagcaagccgccaatctgactgataccggccattaaaatcgttaatagtgtgtgtggcacgtaactgactaacacgctggctaatagggtgatcaagccttgacaaataaacacaggcaagctggaaaaaagtacacctaaacctagtgatgccgttagcatgatcgccataaaacggtactgtgccctgtcaagtttacacattaaataataaaaattagttggctttgccaaaacggtattccgctgcggtaaggtcatttctcttcgctgagataaatttttcagtgaaataggtaattc

SEQ ID NO: 547 - DNA, 2770 bp, Unknown
  Metagenome-assembled genome
tcgccatccactagcaaagacttgcgaagagcttgtgagactggttgaggaaggaatcgaatatttcaatcaccacaatcgctcagcacaaagaaacggcctcaccccagatgaatactggagtgaaaccgcttagaaacagattcaactttatattatttcatttgtcaacttgacagggcctagtgcacgttaaggcctttttataatatattattgagcaattgtggtagtgaagtcattactgatataaaacatttgattatcaataccatcaaagtaaggattcaattcattttggtaaacttctgcgttatcgactttttcagcagttagccccaattcatgacgtagcattttggatacacgattaagttccttagttgatgcaatttgataagaggaaccgttgatccaagcatctttaccttgtagttggtcagatttaatgttgccagcagactggcgataatttaaggctaaagtctcgatatcagcaaaggtcagatctgtgcgcatattttttgctaaatcacgggtaatttttttatatttgagtaaaatttttggttgagttgcttttttgaggactgcacgaatcacttgttgttgtcgcaattggcgcccataatcaccgcgcggatcttcgtgccgcattcgtgaataggctagagcctgcgttccatttagatgatgcaccccttttttaaatttctgcccgccagtccaaacactggtaaacgagaacgggatattaacatcgataccgccaacatcattaacgactgtttttaaggcgcccatattgatcgtcatgtagtaatcgatcggcacattgagtagtttgctaacacttttagcggccattttagtaccaccataattataagcagcattgattttttgcatattacgcggtttagcaccaactaatgcggctaaagtatcacgagggatactaactaatttaactcgattctttgctggattgaccgttgcaaggatgatcgtatctgaattacccttatatttacggccatcagcaccggtatctgcacctaatagcaagactgaaaaaggttttttctgttggatcttttgtgatgcgttaccgattgaagcatgcatgccagtaatcgtatctccagcatgtgaatagagcttgtaggcgaaaataccggttaaaaagacagctacagagatgatcaagagaattatttttaatagtggatgactcttcttgggtggtttacgtccactacgggtatttgattcttcgttttccggcatgagggcctcctgcagagattattaactttggactgacaagcttgatttcagtacttgctagtcacgattaaaatatttagctaacttctattatagcgaaatcgcgcttaactgcaattttatccctatttttgtgtaaactaggcttgacgtgagaaaaagatgatgataacatgggtaacaagttaaaaaataatgataagcgtagaagagaagagtaagtcaaggtatctatttagcgagcttcgttaggtgagaggaagcaaagataatttgatcgaagatggtcttggagcttgataaacggtggtaacgctgtttatccgtgggcaagcgttattttgcggagtatagtctgttttgatgtacttactaagtcatttgattgtgagatcaatgtaaattaaatcagggtggtaacgcggaagctttcgtccctaaacgttttgatacgtttgggatggaagcttttttatttcacctaaagctaatttgggaggtggtcctttgatgtccgtaaagtatgaatcaagtaaacgattggtatttaatcaactaggtaccagcacacaacaaacgaccgatttggttgtgttgaatttaatgcctaataagttagaaaccgaaggccaattattagatttatttgctggcttaccagagaacctgacattaacgtttctttatccgcaaacacatcattttaaatcacatgttttaccgtatttacaaacaagttacgcgactttgccagaaattgctgataatacttatgatgggttgatcatcacaggtgcaccagtggaaacattgccttatgcagaagttgattattggcaagagtttactgaaattttagcttgggcacaggatcatgtgcggcaaaacttatttatttgctgggcagcacaagcggccttatacgcccaatatgggatcgaaaaatatgcggtcagccctaaagttttcggtatttttgaacatcgagctgttggtgctgatccgttgttgaatcatttaccacaccatttttacatgcctcattcacggcatacaactttacaatcacaagatattgctgctcaacctgatttaaagttgctagtggatgatatcaatgtaggaccagtgttggtccaaagtcgtgatcggcgacaaacctttattactgggcatcctgaatatgcgcgtaacaccttagcacatgaatatcagcgtgatttagccagtgggatcccaatcacgctgccagaaaattatttttacggtaacgatgcaaatgcacaagtacttgaacgttggcacagttctggacaacaaattattgccaattggctccaacaattaaattaaggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 548 - DNA, 7826 bp, Unknown
  Metagenome-assembled genome
tcaaacacccaaagagcttttctccgctgcttccgccggttaagttaagtccataaaatatgaatattaatgaaaatactgatttaataggatttatcgtgtggctaatttgttcttgcaatttggggcttgaagataatacaaaatcatactaacttagcatttagcccaattaattattcaatgttcagttattgccaaggtggaatggaggcgctggcgtatcagctgtgtcaatgttgcttagtgaccgaattgtggtcgcttaggcaacatgcgcgattgacaagatccattttcttttccgagctggtttttaatcggaaagaaaattagcttgtcaacgcgccacgcgttccatacgccagcgccggaatggaacctaaccagctctgtccgcgtacacttaataaccatacttcagaataaactgatcacttataatcaaggttcttttttaatactgtttacgatattgccgttggtgcgctttgatcccggctagcacgtattgagcgggatcatggcttaaatctagttcaacggtgctgccatcgattggcaattgttgttggaagattttttcgtaagtcggcacatcaacttgctgacgcgcggcaaacattttttgatgttgttcaggcaacaaggcttgtttgaagttggcctgcagaatgccgctgaaaaattcgctgacggcgccggaaccatagctgaataaaccgaggcggtcaccagcttttaaggtggtggtattttccaacagcgacagtaaactcaaatataatgagccggtgtataaattaccgacgatctgattatattggcgtgaatcttcaaagttggcgctcagccgttgttggtcagcttctgttgcttgaggtaaaatcgagcgcaaggctttgaggcccattttggtatagggtaagtggaaagctagggcggcaaagttagctaaggtcatgccgctttgttcgcggtaagcatcgaagacttcgttgaagaaatcaacgtacatgtgaccagagtagtggccgtcgacttttgcttcggtggcgtagttaggccgccagaagtccatgatattttcggtcagtacggtgctgtcttcttctaaggccaagatccgtgggtccttgctgatgatcatcgccaccgcgccgccgccttgggttggttcaccggcgttaccgatgccgtagcgggcaatgtcgctggcggtgatcaggacttttttgtcaggatgtaaggcgatgtaaccgcgagctaactgtagcgctgcggtcgcggaatagcaggcttgcttgacttcaaaagcgcggacttgccgtggcaggtcgagcaaactttgcaggtaaacggcgccggattttgactgatcgatgccagattctgaggcgaagatcaccgtgtcgatctgttggcgattttccggggtcagaatcttggcggctgcattggcggctaaggtgacgctatcttgtgtcggcgggatcaccgccatctttttttgaccgatgccgatcaagtatttgttgggatcttcattgcgcgcatgcgctaactcagccatatcaacaaaataatggctggtgtggaagctgatttggtcaataccaattttcattacgttggaactccttatatacataggtctagttttaatagctgctattttgctcttgcgggctggcttggtgcaagcgggctttgtgtttagccgttttttgcgttaataggatcgcgccgatcaataaaagtgaaggcaccaaggcaactgaggggagcaaccagaaaattaggaaggcgccgatcccagcaatattagccagcaacatggccggaatttggaatgctcgtaaatacgagatcaggtgcaaaccgataccgatccaagtaaaaatggctaaatggcttaacagagcagtccacgcggccataaagttgtcgacgtgaaatagcggcaagatgtgaccgatgcccagcaccgcacagctaagcaataagaataacataaataaagtgtcatataaacctggtaatttgagcaacgaaattttcatggtagccacctcgggtcaaagatgaatttattattagtatagcagagattcagaatcgtgaaagatttttactaagggaaatcgcgatacttataaaatagttcatgctatgatgtgactaagaacagttagatcaatcagtggttcaaagccaagggagggttaataatggaagaagtggttacgcaaaatgtggtaccagccgaggtaaagggttggaactggggcgcgtttgtttttaatatttggtgggggatcggtaacaaaacttatttgccgttattatgtttagtgccgctgttcaacatcgtgtggatttttgtctgtggcttcaaaggtaacgagtgggcgtggaaaagcaacgattatcccgatgtagcgagttttaaacgggtgcaggcaacgtggaatcgtgccgggttggtttcgtttattgtcagcgttgcggcgatcatcctgtatttgattttcttcgctgcaattttagccagtctgcccgattatttctgattgggggtactggctgatgacattggatttagtggtaccgacgctggcgtaccagcaacggcggccatctaacctgatcgctctaaattttagtaagcattatcggccggaaacagtcgtggtcgtgttatactgaaattaagcgttataaaaattctaatttaggagtgatcagtttggcagaaaaaactttttctaaggaagaattggcacaatatgatggtagcgatggcaaaaaagcgtacgttgctattgatggtttagtttatgatgtgactgacgtgaagccttgggctggcggcaagcatcatggacaaacagcagggcaagatctttcgaccgtgatcacgaaagccccacacaaaaaatcggtactcacaaaattaaccgtggttggtaagtataccggctaagggcaagcgtctagctatttggagctaggcgttttttcatttccataattacatgcgttttattatctttacgccgctttccttgttatgctggaagaaaagttaaggaagtggttgcaatgaccaaacggctatggcgcaatgtgttgatcggtttattgttaggcttgttcgttgtgatcgtcgggtatttggcgttattgatccacgcggtggcgatcatttgaattgttggccggcgtagacaccaattaaatgaagtgctaaacttataaaataatagataaatgaaatttaattccccagtgcagcgcggtgtgtttagccgtgttgtctgggggtgtttttttgaagggacggtttatttggatgaaaatggatgagatgtttgcccgggcgccgattcccaaagtgtatatgcagttggcgctgccggtggtgttggggatggtggccagtatggtctacaatctggccgatacattttttgtcgcccaaaccgggaatgcggatctggtggcgggaatcgcgttagggacaccgctattttcatttatgctggcagtcggtgatatttttggccttggcggtagcgcggcaatctcacgcctgttggggcaaaaggcgcatcaggccagtgctcacttaagtagtttttgtttttacgcggcgatcgcttttagtttagtgctgacggttttgatgctggtgtttgagcggccaattttaggcatgctcggggtgacggcggcgacttatcagtatgcggctggcttttaccggatgatggcgctggggtcgacttttattatcgtctcattggtgccagggaatattattcgcaccgaggggttggcaactaaatcaatgatcgccacgctgacggggacgttgttggcgatcgtgctcgatccgatttttttgtttgtcttggattggggtgcggctggcgttggcttagctaacgtgcttggttacgcggtcaatacgacgatgttggtttattttatggtcaaagattgccagatcctatcgttatcgccaaaattatggcgggtcagctgggccgacgtgcggacgattttaaatattgggattccggcgtcgttgactaactttatgcaaagttttggcgtcatgttgttgaacaattatctggcgctttacggggcggtggcgatcgcggcaatgggcatcgtgttgaaaatttacatggtggtgatgctgatcatggtcggctttgcctttggggcgcaaccgttgatcggctacaactatggtgccgctaataaagcccgctttcgggcaatcgtccgttttgattttatggtcgaggtggtctacgctttgatctgcgcggtgatcttgatgatctttgcgccgcagttagtggcgttatttatggataaaccagcgattgttactatgggtaccaaaatgttgcggctgttgctggcgacggcaccgtttattggcgcgatcctagtatttaccaccttatttcaatcgatcggtaaagccagtggggccttgatcatggcgatcactcgtcaggggatcgtttttgcgattgtgatcgtgctcctggcgcgattgtttggtttccaaggtgtgatcatggcccaaccagtcgctgacgtcgtgacgtttttgattggttactggttgtaccgtcaattagtggtcaaaagtgaagcaaaatgatagctgaaaatgcttaaaaagattagaataacggcaataaagtttacctgaccgtttgttggtcaatactttttatattttgctgatcggagatgcggatatgttagcaattattgtaggtttagccattgggatcaggttaccgatgcagacaagtattaattcgcgcttacgtcgtgcaattgggtcgcctatctagcctcactgatctcatttgcgatcgggacgctatttttgctggttatgacgtggctcatgcggcatagtttgttatttagctggtctttatttaccagtcagccgtggtggttgtggatcggtggtattcttggtgtcatttatttaactgggaatattctcttattccctaaattaggtagtgtacaaacggtgatcatgccggtattaggccagattatggccggcttattgatcgataatttcggttggttctcatcgccacaaaagccgttatcgctgacccgggtattgggtgcagtgttggtgttgctaggcgtactcggcgtggtggcgcttgatggctggttggagcgacggcatgatcggttggacgctgcgccgaaaactaattcaggtgagctgtggttgtggcgcgcgtttggcgttttagcagggatgttaagtgccgttcagactgcaatcaatggtcatttgggccaggtgttgcattcagcggtggccgcggctttggtctcctttttggtggggactttaggcttggtcctggtggtgttggtgctgcggcctaaatggcagttaaccgcgcaaaagcgggctacggcgccgtggtggatgtggctgggcggcatcgttggtgcattatttgtgctcggcaatgcgttcctagtgccacaaattggaaccggcttggcagtggtgatcgttttagttggcttgatgatcggcagtttgttgatcgatcaattcgggtggctcgaatcgcaacgtaatccactgaccttagcccaattgctcggtttgatcgtgatgatcgccggcgtagcattgatccgcttattctaaaagtcaaaccgccgacatttggcggccaagtaggctataatgaaatagaacgaatgatttcggaaaggtcgcgattttaagatgcaaaagaagtttacctttgattctgatttaacggtcgatcggttaggctatggcacgatgcaattacctggtaaaggcgtttggggccctgccgccgatgctaaaaaagctgccgcggttaatcacgacggcaatcgacaacggggttaattttatcgatacggctgattcttacggaccgtttttcgcgaacttatatttaaaggacgcgctgcaacaacggcctaatagcaaagtgatggtggcgactaaggtcggtttcacgcgccaaggccctaatcagtggaccgcggtaggtaatcctgcttatttgcgccaacaagttgaattgaacttgtttagtttaggcttggatcacattgacttgttgcagctgcaccgcatcgacccgaatttctcaatcgaggagcaagtcggtgaattggctaaattgcaacaagaaggtaagatcaagcatatcggtttgagccaagtttcggtggaacagatcaaagctgcgcaaaaggtggcgccgatcgtatccgtacaaaatcggtataatttgatcgatcgcgcggatgaagacgtgttgaactacgccgaacaacagcacatggcgtttatcccgtggttccccttggcaaccggtaagctgactaaaggtgataccttgtcttcattggcagaaaaatatgacgctacgccagtgcagatcgctttggcgtggttgctcaaacgttctgacgtgatcttgccgattccgggcaccagctcagaagaacacgttaagcaaaatattgcggcacaagaaatcgagttggaagtcgccgattttgatcaattaagtaaactcgcgtaacgcgttgccccaccaactcagtgtgttagctgagtggtggggctttttttatcacgttcatacaaagatggagggaaattcgatgatccaaattattcaaggggatattacgcagatgcaggtagatgcgatcgtgaatgcggctaacaccacgttactgggtggtggcggtgttgatggtgcgatccatcgtgccgcggggccggagttgttggcggcgtgtcgccagttgcatggctgtgccaccggtgaggctaagatcactgcggggtttcgtttgccggctaaatttgtgatccacacgccgggaccgatttggcgtgatggcacccaaagtgaagcacaattgctgcataattcttacgccaatagtttggcgttagcagcggcccatgattgtcaaacggtggcctttccgtcgatcagtaccggcgtttaccgttatccgttggcgcaggccgctaaaattgcgctgaccacgatccgtgattttttggcgacaaatacagtggtcaaaacggtgacactggtgtgctttgatcccaccactttggcggcttatcagcaggcgtatcgggaaattgtatagttaattaatatacaatggatgtactttgatctatactatatttagaatctaaatacgtgaggaggaagttctggtgcacgaatctaaaacaaaaaaaatcgcaatttcatttaaagtcgatcaacatgataaagaattggcgaccgaaatttacaaaaatctaggcttgaatttgtcaactgcttttcaaatgtttttaaaaaagtcaattgcggaaggtggtttaccttttgatgcgcgtgatccattttatagccaggctaatattgaaaatattctcgcttcaaaaaaacagcttgatgatgatcaaggggcggtgagcgaaggagatcagtaagaaatctaaaggttgaaagttaatattcccaattgagtcccaatctgttggggcttttttgttataaaaatagacacgaaacactccgtatctgtataattgagtcgtctaaaaaataaacatacagaggagttttcgtgccatgtctactatacaacattctacccctaatattcacctagcaatgcaacatttttctaaattggtccagttacctgacgttttacgtcgcgctaatatccat

SEQ ID NO: 549 - DNA, 13679 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccttaaagtaaaaaataattgcttttttgataaaagtataatatccttatttcattaacttacaaaaagtaagtaaaatgaatggaggcttacaaccatggtagacgtagataaattagaatttggaatcgaaacttttggtgacatcgtggctaatgaagacggtagcttaaaatcagccgcagaatcaattcgccaaattattcatgaaggtgaaattgctgaccaatatgggatcgatgtaatcggcgtcggtgaacatcatcggcccgactacagtgtctccagtccagaaacggttttggcagcgatcgccgcagtcacaaaaaatattaaattagccactgccgtcaccgtactaagttccgatgacccagtgcgtgtttatgaacgttttgcaacacttgatggtttatctaatgggcgggcgcaagttatgcttggccgtggctcatttaccgaatcatttcccctatttggttatgatttgatcgactacgatgatttgtttaacgaaaaactggaattatacgatcagttgcggtcagaaaagccggtaacttggtcaggtaagttccgtgcttccttaaaagatcaagaagtttatccgaaaacagaacacggtgaactagaaacttatattggtatcggtgggtcaccagaatcaattatccgcgcggcccgcttcggctataaagttatcttggcaatcattggtggtcaggctgatcggttcaaaccctatacggatctctatcatgaagcggctaaacagctaaatatgccggtttacccactagcagttcattcacacggctttatcgccgatgacgaaactgaagctatcgaagttgccttcaagaatatcaaagctaacttcgatcggatcggtttgacccgtggctgggcaccaatgagccgcgaacaatttgatagtgaaactaaagttggttcattttatgttggtgatccagaaacggttgcacaacgaatcgcgcggacgatcgacttactcgacttaggccgttttgaccttgtatatggtgcgggtaaccaaacggcggcacagcgtgaaagaatgattgaactttttgcaactaaagtcattccacgggtcaaagaaattctgcgggcaaaggaggcggctaaataatgacaattaaacgagttggtattttaggcgccggtaaggtaggcatcgtgctcgctggtttagctttagatgcaggttacgaagtccgcatttctggctccggtgctgtcgataaaattgatttgactatcaggacactggtgcctggtgcaattgctgcggaaaataatgaggtagtcgctaacagcgatatcatcattctagcaattccgttgagtcgctataaaaacatcgcagccaccttgcttaaaggcaaattagtcatcgacgcaatgaattattggtgggaaaccgatggaattcgcgaagaagttttagctccagattcaacttctagtgaacaagttcaaacctacttcaaagacagcagcatcgttaaagcatttaatcatatgggctatcataatttacaggaagaagcacggccacaaggtgatgctaaacgtaaagctttattcgttaccggcgacgaccatgctgctgttgatgaagtcgctcattttgttgacacgatgggcttcgatcaagttatccattatgatatcaaggatggtatcatgaccgaacccggcagcccactttttggggctagcctcagctacaaagacctgaaagatgtgatcgatcatttcgatcagactgaatttggtcaaaaaattgccgcatcaaaattgaattaactagcaacgccactcagaattctgggtggcgtttttttaccaatgaaaaagaccacaatagcattggcttctatcgtgatctgctaaaaaataactatcttaaaattttttcgatctgctcaagctcatcagccgtaaaatcaagctttgtcgttgcctttaaattatcgtctaaatgagccacacttgttgtgccaataataacactagttaccactggatcacgcaacaaccaggccagcgacatttgactcagtgtttgaccgcgatcttgcgccaattgatttaattgatttaatttagcaaccaaagttggcttaccgttttcaaacaacgacttgttcgtatgatggattggaaaatcgtctggaataccatttaaatagtgttgcgataatagcccttcacacaatggaccatacgcgatcacgccagcaccagcctgccgcaaggtttcagttaagccgctagtttccacatgcgggttcaaaatattataactcatttgatcaagtacaaatggcgtgcctaactgtttgaataattcgatggcttgctgtgcttgcggcgtttcgtaatttgaaacaccgacgtagcgcgccttgccctgacgcacgatatcgtccagcgcccgcacggtttcagcaatcggtgtggtcggatcaaagcgatgggcatagaaaatatcaacataatctagctgcaaacgacgcagtgaatcatcaatgccctgcagcattgatttgcgtgaagtcccaaatccgtaaggaccttcatggatcaagtaacccgctttagtcgagatcactaactcatcacgataagccttgagatccgtacttagcacctgccctagcagactttcggtcgagccaaaatcactaccgttgttgccgtaattattggccacatcaaaatggaacacgccttggtcaaaggcatgtaaaataaccttgcgccgttcgtttagtggatcattactcccataatgacgccataaacccaacgaaatcggcggtaacattaacccagttgcaccagcatgccgtactttcaattgatcataacgcgtttttgctgcttgatacacatgatcactccccattattgattcaaaataagttcactttcagtctacaccgttattatcgcggcgacaataacggtttcatatgaaaactttatattcattctgatcgttttacatatgtaacaactatgcattatactatagctatcgaaaatacgaggagtgatgacatgacggtgaaaacacgtaaagtatcaaacacaacagtactcactgttcctagtagttttaaagtccctgaaaatattgattttgagcctagtatcaatgaacgtggtgatattatttatcgccgtgttgaacatatttctgaaaaccgcaaaaaggatattcatacttttatgaatcaatttcagccagttgccgattatttaaaggataagtaatgctgatgccaattaactatttatctaaaaatgatttgattgaaatcaatcgctatgctgttcaaatgaccggcggaaccacctttggcgttcaatcaatagaggcactagaggttattatccaacagccaagtcaaatcgttttcggccacgagctgtaccccacgatctggttaaaagctgccttcattctgcaaaaaatcaccaaaaagcatgtcttcattgatggtaataagcgaactgctttatttgcagcacttaaatttcttaacgataatcattacgtcattaaagatattaacgtcatcaataactcaggtgattttattttggccatcaccaattcaccagataacgaatcaactatgcaagaaattgctcagtggttggcaatcacccataagcgttcataaaaaagtatccaaaaatagacagcctcataatgagagctgtctattttttagcactattgaagaagtttttattagctaatatcatatagccagcgcatataactacgcagcacttcgccgatgccgaatcagataaattgccgcagctaataccagaaccgccgccccgacaacgaccgacacccgtgtatcaggattgataaacataaacaccacgatcaccagcaacatcacgatcgcaaaataatttgtcagtggataaagcggtaatttaaagggatgggtcgccataagcttagtattgcctttgcggaaacgtaattccgccaacagaatcacgaaccacggcaccatcccgggtaaaaccgatgaactaaaaacaacgacaaacagattggcagtcgacttactatagatcgacgccaccatatcaacaataaagcctagtaaaataccaccagagatacctaaaatagctgcgtcaggcacaacatgtttcgacacacggccaaagaacttgggcgcgtccccttcgtgagccaatttgaacagcatccggcttgaagaatagataccagaattagcgcctgaaagtgctgcagttaaaacaacaaagttgatcacagaagcagcagccgtaatgccaactttggcaaaggtagaaacaaatggcgagcccagcgtactcaactgattccaaggatagatcgttacgatcacaaaaattgccccaacataaaaaatcagaattcggaacagcactgatttaaccgacttaataattgctttttgtgggttagccacttcacctgccgaaatacctaataattcaattccttggtaagaccccacaatgatcgacatggaaaagaaaaagccttgaacaccgccagtaaaaaaaccaccatgctgccaaagattacttaagccaactggatgaccaccattgccccagccgaagaaaataataactaggcctaaaacgatcatcataatgatcgtcacgactttgatcatcgcaaaccaaaattctaatgaaccgtatgctttagcactggcaaggtttgccgcaaccaaaaataaaataacaataattccggcaataaaggaattggtatgcggccaccaatattttaaatactctgtcgccgccacgacctcagacatccccactacgatatattcaaaaacattcgcccatttagccaaataccccgccaagggatgaacgtactcagcggcataatcagcaaaggacccagtacctggattaacataaatcatttcgcctagcgcccgcataacaatgtaaagaatcaagccaacaaacatgtaggctaaaatcaccgacggccctgtccacttgatcgtcgagcttgaacccataaaaaggccgacgccaatagcgccgcctaaggaaatcatttccatctgatttgctgtcatcgaacgtcgtaataccggcgctttttctatattttgcttcatttcttctcctgaccagtcatgtaaaatttattttctaactcatttaaaacttagttcatttataatagcatactacaaaattgatcattgatcggtcactagtagtaaattgattcaacaccgctaactattcgtaaatttaaattactttttgaatcgttttaagtaccggctggcaaataatttatggaacttaacccctaaggtagggttagctgtgtcaatatctgtatacatggcatccgtgattttagtcagtaacgctgagagctgttccaattcagtatcagagagcacccgcacgaacggtggcacttcttgagcagcagattcaattttttgtcggcccgcagcggttaaattcactaagttgattcgccgatccttcggtgatttggttaaagtaattaagtcgcgcttggccagtttatagacaaattcactagtggactgtggggatatgccgaggcgagttgcaagttgctgctgtgacagatggtcttcatccgctaatgccagtaaaatcttcccctgcccctctaccgtcaagcgtggtcgtgattgcttgacaatgtcatcatagattttgctgagttgctcatactctgccaattttcctgccactaattctgccttaatttgggttgccattagtaatcattcccattcgttgttttcttaagtatacaacattcctaaatcggcgtggatcagccacttgacattttaatcaggggaccttattatattttcagtcagggtacctgatcaaattcaaggaggtctggaatatgagtcacaacaatagcgttaacgtaacgcatatttatagacaattcggcaacaagacagccgtaaaagatatttcatttactattaagcaaggtgaaatttttggcttactaggaccaaatggtgctggtaagaccaccatcataaggatgatgacaactttattacaccaagatacaggacaaattttgctaaatgggtacgatacgtcaactcagagtcgcttggcgcggcaacagtttagcgtaactggtcaaacggctgcggttgatcaagatttgactgcacgtgaaaacttaatgatcttcggcaaattaaatggactgaaccatgccgctgctcatacccgaactaccgaattattaaccgattttgacttaataaattcagccgatcaaacactcgcaacattttctggaggtatgcggcgccgattggatttagccattagcttaattggaaagcccgcgatcctttttctagatgaaccaaccaccggcttagatccacgaacacggacacagatgtggcaggccgttcgcaaactagctgctgcaggatcaaccgttttgttaacgacacaatatttagaagaagcagatcaccttgctgatcgaattgccctcattgatcatggtcaaatgatcgcattggggacaccaagtgaactaaaacaacaagtcggcggcctacaacttaagctagaagtgcccgacacgcaacgagttagccaagcacagtaaattattcaggagatattgacattaccggttaacgtcaatgaccgcacactaacagcgctactcggcaatgtgaaaatacaattggttacacaagtcttgcagcagcttcaagctgctgcagtgcccatcagcaattttgcaattgaagcaccgacattggatgatgttttcttaaaactaacagtcggtaaaaattaaggagcagaaaattatgacaacaaaaaatcatcctatgagcaacatactgactattacacaccgtaatttactcaaaacattgcataatccagatagcctcagtgatgtcatcattgaaccagtgacctttacattattatttggctacttatttggtggcgtgattgctggtagtgttcacgcctacctaccaatgctagtatccggaattctggttcaaagtattttaaatgcggcttccggttcgggacaacaattgcgcgaagatattaatgctggcgtcttcgcccgattcaaaaccttgccgatctcaccaattgcgccgttagcgggtcaattagttggcgacagcttgcgactcttactttcaggagtcgcagctttaacaacggcttttttgatggggtggcggccaaccgttggtttaccaacactggtagcagttctattgttagctattttcattggctggtcgacctcgtggatttttgctttggttggtttaatggcgaagaacgctgaattaattggcagcttatctatgatcattatcttagtgctgactttcttatctaacgccttcatcccaacaaagacattgccacgatttatccagaccattgttaagctcaatccagtcagtttgaccataactgcgatcagaatgattctgcggactggtaattggagcagtaatgcgactatggtcctcattagtggtggaatcatcattttgatttttatgccactaaccgtttttatttatcaacagcgtgactaaaagcccataaaaaataggcattccccaaaggagaatgcctatttaatagtagttattagtttaactttttcttgctaacaacgtttaacttagcgtccaagtcgtaaacaactggttcgccagtagccatttcaacgtccatgatgtcagcatcagagatgttttcaatgtacttagtcaaagcgcgtagtgaattaccatgggctgcgataatgacgtttttgccgtctaataatttaggtgcaatttcgtcttcccagaatggaataacacgttccaaagtaactttcaagttttcgccgcctggaatggcacgaggatctaagtcagcataacgacgatcttgtgctgctgagccttcagcgtcagcatccaataatggtggcaaaacatcgtatgaacgacgccagatatgaacctgttcgtcgccccattttttagctgcttcagccttgttttggccttgcaatgcgccgtaatgacgttcgtttaagcgccatgttttcatttctgggatccataattgacctgcaccttccaatgcgtaatgcaaagtcttgatggcacgtgtcaatactgaagtgtaagcttgatcaaattcgatgccttcttttttcaacaaagcaccagcgttttgggcttggcgtacgccttcttcgcttaaatcaacatcaacccaaccagtaaattggttagataggttccattcactttgaccgtgacggataaaaactaatttagccatatggtgactacctcacttttaatttatttctttttcattgtacactggataaggtaaaaaatctaatctgttagcgcttttttcataactattttcaaaatcactttaattcatagcagttattccgtaaacttaatggtaatacttataaagggagtttattattttgcgtaaaattagctacttgatttggagcttatcgctactttattttatcgtctatgccatgagtcatgcgttacgcggtgccgtaaaccaaaatgccagcctcgccattttacacggcgggctgggcattatttttcttggtggtatcttcggttttattctgctgcgcttatggcgcgtgtttcattaattttagctaggctgttgataatattagcgacagctgcgtgaacgtatttcggttctgtcgccaagttcaagcggacaaagccagcatcatttttactgaaccactggccaaaatcaaccgctaaatgacactcgtcttgaataaattccttagttagatcagccgacacaacggcccgtagatccaaccaagccagataagtaccttccagatcggccactttgatagcgggaactttagctgctagttcagtgcgcaagtactcataattgctacgaaccacatttaataactgatccaaccattcgccgccggcacgataagctgcttcagctgcaacctgcccgagtacactaacttcggtttggttgatctgcttgtgaaacgtatcgtaacgctgccgtaactcatcgctggggatgatcacatgcgagttgagcattgcggctaaattaaacgtttttgatggtgcagtgaccacgattaaattattacggtagcgaccatgtgctacatttaaagctgaaacaaatggctttttgccgataatgatatcttggtggatctcatcagaaatcactaacacatgatggcgttgacagatagccaataattgtttcagttcagcttccgtccacacccgtcccactggattatgcggtgaacactggatcaataatttcactttattcgcaacaattttggcttcaatatccttgaaatcaattgtataatggccgtcatcattgactaattcagatgtaaccaattgccgatgattatccaacactgcattgtggaatgggtagtaaaccggcgttaaaatgagaacagcatcttgcggctttgtaaaagtattgaccaagccataaatcgagttaaccacaccagtatcaaaacgcagccagtctttttccaatttaatattatgacgcttttcctgccaagcaaagtaagcttcgtagtaagaatctggagtgtaagagtagccgtaaacaccgtgattaacacgttcagtcaaagcagttgtcacagcttcaggaaccttaaattccatatcagcaacccacatagcaatcaaatcaggatctccataacgctgatccaaagcatcccacttcaacgagttggtgcccgtccgcttaaccgcatatttttcaataaattctgttgttgataattccatgacaacgaccatcctttcaagaaagagtgtttcataaggcgctcaacttttgcgcattaacctagcttggcgaataattcacgcagtggattatttgccgatttagctaagcggaaaaagttacctgatggaacacgtttacgttcaactcatacaagacaaatatcgtaacacaaaaaagctcccgcctgtacaaatttgtactaggacgagagctttaactttcgtgttaccacctaaattcgctattgcttcacagcaacagccttagccacatcaattaatgtgctgcaagttatcgtttgcaaacccggacgcgtagccatcatgacccacgccagctcggagctcatcttcatctaacttaattttacctgttctcactaaattcaggctcgctgaaaaatcagttaaactactcttctcgtcaacgctattctattgattactcactatcatagaacaaagtctaactgaagtcaattcttagctgattttaatttttctttttcactgctgatcgatttgacacctaaaatatcaaggaagaacgtgaaaattggaattcccacgatcagaccccaagtcccaaacattcgctcaccgactagtaacacaacaaaagtgtagaaaatcggcagcttcgtgcggctagacatgaattgcggattcagcacataagcttccaatgcgtgaataaccacgatcaggatcagaatgtacgccacatattgaatgccaccaaccgaataaccgatcagcgctaaaggaacacaagaaatgatcacaccggccactggaatcatacttaagagaaaaatcatgattgctagactaggtaattgtggcattttcataatactcagaaaaattgtggtgatcactgtgttgaccatggcaatgaaaacttgtgcttcgatcacgacaccaaatgtgttaacgaacttctgcgcgaaaaagtaaatgtcttggaagaaccaagcataatcactggttaaaaataagcgggaaaacttaaacatacgctgactttccaccgtgaagaaaaagctgaggatcagcgataagaagaacgtaactcccatcgtaccaatactagtcaagtaaccaaaggccacggagatgccacccttaaattggtgcatcaggtctgacgttttaatgtaactattgagccatttgaacacctgattggtattgtaatcaggattctgatagaacttatacactgaatcgatcattttcatggtctgttctgcaatcaccggcaaatacttggtcacggctgaatacaacagaaaaatcgttaatgcataaacgatgatcacgattaacggcgccgggattttgatccaacggcgcacgaattttaccaattgcaacaccaaaaaggtaaatataaacgttaacagaataatgctcatcattttttttgctaaaaataacacagcaataatcgataacaatacaacgatccgccgcagttcaacattcgccaaaaattttttccaaagcgacacctaatatcacatcctctacttactgccaattgtacaagaaatagtagtgagatgcgaacggaaatcacaggaaactaaatcattatctgcacaaaaatagtttaagcacgacatttgcttaaacttaattgatcaaatctaacaattgaaataacacttgctgattttctgcaggaatcggctgcgccaaaatcatttgtggtgtttgtgctaattgggaaccttgcgtgtattgaccatcattgatcacgatctcgcgcacattgctcgctaaagtttctaaatgaaattgcaagccgatcacattttgctggcaccaaaaaccttgttccagcaccaaatcactggtaaataagcgctgagcccctacaggtaaactaaacgtttcttgatgccagtgtaggacggtcattttttctggcaattgaactaatgccttatcttgcaaataaactggcgcccaaccaacttcttttaccggggccaatgtaatctggctaccgaaaactttggccaattgctgagcaccgaaacatacaccaaaaatcggcacgttacgttgcaataattccttgatcaaacgtcgctcggcactgatccaaggtaagtcgtcgttaacactttgtggcccgcctaagatcaccagcatttccgtctccgtaaccgtcggcaaaacaccaaattgatacggatgatagatatacaattgatgttggtgttgttgcgcccaaagtgcgattgcaccaggtccttcattaggtgtgtgttgtaaaacattgatctgcatattgagcctccagctagttaataacttaattttacgctgccttacgttagctggcaatattgttttaatatttctgcaagtattgcaccaataaatcaacccctgcttggcagctctgcgtcattactgactcaggttcaccggggaaatagtatgttttggctaaggtcgtttccggactaactaagccgatacaaacagtccccaccatcacgccctccaatttatcaggaccagccacgccggtaaatgctaacgcaaaatcagtaccggcaattttgcgcgcttgttgagccatgcttttggcaacttcaggactgacgacgccatattctgcgatcaaagcggccggcacgccgagtagcttggttttagccgtggtggcgtaggtgatgaaaccgccgggataaatttgactagcctgtggtgtggcggctaattggctttgaaaggtgccgctagtcaggctctcggcgctggtcaaggtcagttcgcgtttagctaaatattttgccaatgtcggtatatccatattgcattcctcctctactctacagtagtgaataattttggtaccgaaagtttccgctgttacgaacgatacgacttggacttgctaaacttcgctcttagttccaatcgacatcgggaagtaaattctgcttaacaaacatccgatacttgctaatagcgttgttaaaacaagtgacagtagccatttgctgaccacaaccatattccttgaaaatatgtcttattcctacagcgtagcaaagctgcgtacttaactaaagaaatatacctatcgtttaagccgttgattttaccatttatccgcaataatcaaccacctggttaaaagcgctttaatctagttacgcttacgtgtatgtttagcatatagaaaagaagctcacaggaggtcccaaacatgaaagttacgatttgggcctagaataaaaagtgtacaagttaaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattg

SEQ ID NO: 550 - DNA, 1422 bp, Unknown
  Metagenome-assembled genome
gctataacaataacacggaaggtgcttttttggtacaccattttggtgaaaccctcaatcaaaggtaaaacgatggtgtagcagcattctcgttaaggtttaggaaaagatatgcataattcaggttttcttctgtttgcgcggttaaatcacggaccgaatgacggaccacaatttgatgtggcacgatgataggctgcagtttggctgttggttgatctaactgtagcgctagttcagcagccccttcgcctagctgaacaggaaaaacatcgatcgaagtcagtgacggatgggccacctgcgacgcgaacgaattattaaacgaaatgatcgacatttttttactcacgatctgttgtagtcgcaaccctaatagatcatcactggtgacaaacgccgttatttgcggatgctgctgtaaaaaggcggtcacgtgctgatgactttgtgtataatcaataaaatcctcacgcaaacttaatgacggtaactgctgctgcgccatcacctgtttaaagccagccagccgttcctgttgcacaattttagttaaatcagtgtacaaaaatgcgatctgccgatgtccatgagccaataaaaattgcgtggcatcacggccggcagctaaattatcggtatcaatgtacggtggtaatggtccagcggtcgccattggcttaccaatgaccacgtacccgacctgattttgttgtaacagcgtcaccaccggatcatgcaactgcgaatatagcaaaataaaccgattgatccgcccccgcgccaacataaattccacattggccagtaactgctgctgcgagattccggttgcaatcgctaccataaagttgcgctctgtacttttggcattgataccctgcaatgcctgcagaaagaacggattggtaaatatttcatggtgatccactggaaaaataacaacaatcgtattattttcattattggctaaattttgcgccgaaaaattcggtacataattcaactgccgcatcgccgtctccacccgttgccgcgtcttagcactgatcaccggattaccccgcaaagcccgcgatgccgttgatggtgacaccccagccaaacgggccacatcacgaatcgttgccatgcactcacctccaacttgattttctttttatcttacggcagtgcgtggtagtttgtaaagtgttgcattagaaaaaatgaagcacctggtactcaccaccactaaatttaaaacagcgtaaaaaagaaccgttctctagcctaccagcggaaacggttcaagcacaaaaaactctcagagggcgcgctttgcttcgccctcgtatccatgatatgaaaccgtcttcgctcttgatataatcaagaggaaggcggctttatttgttcatcgctggtttattggtggttctt

SEQ ID NO: 551 - DNA, 18375 bp, Unknown
  Metagenome-assembled genome
tgatggtatctttaaattgggtcatgaagtccgtcctaacttattggtttcgtcgcttataagtttaaggcttcatggcctttttggtctagttgtttcggtgttgcacttacattgtaaatccggcattgatttctttagtaatatcaacaatattcacgttagggtccatttgttcactctcactgaataagcctaatgtattaagccgctgattaacatctaaccgcatatcttcatccaggtattgtgtcgagtacggcttgatgtgcaaagtgccaactgtgctgtccagcgtaccggaataatcttcactgatatcttcagctgcatcaacgatcaataagcgataactgagatttaacgcacaggagccaaccttggaaaatttaccaacaccatcatcaagatctaagataatttgtttatcggcgactaaatattttgctaatttttcttttgctgcatctgtaatagttaaaaacattcagattcctccattctctcactatgatcattgcccatagtttaaccgttgcgactgaagttattctcattcagcaattacattgtacacaacacaaagtttaccagcaaatgttctgctcaactatttaagttcatattggcgagttagacgtcgctgcagtaattcggcttgaagcagcggaatggcactcgcgatcatccggacctgacctttttgttccaaaatcagatccgcaacatcggcttgtactggcgctggcttcactcgtaaatgatcactgggactaagcgttaagcgctgtaaattatcctccgcgcgcgccaattctacacgatcgatcgccaaattttcgtctttccaagttggcggtagttcgactttggcaatcgattgttggccagtggtattatcggtccagcctaattttaaatcaagcccgatcgccattttagataatgtcttgagcgttggtaaatattctaagttttctactcgtgcaaccatcgccggtgtcatattagtttttttcgccaattcttcacgagaaatgcctttttgttcacgtaattttactagttgcgctgcaagttctaatatattctcttgccgtctgctcaaaccttcaatgcacgaaacttctgccatcgaaaaaacctcactatttatgaatttcagcttaagcgcttactccattgtaacagaaagcagctacctatggaattttttcacgaatcctgttacgctagctaaagaatattaaaaatataattttcaatacgttcatcctaacactattggaaaataataacgcagttaacttttacattacagatgccggccattctggcgacagggtaaaaaataataagtaggcgcagattagtcttcattaaaaacccggcaagtttaagtcgcagcactgtaatagccagtattttagacacaaaaatgagcagagaggtgtttatgtatgcttttatccttattatgtacgatcggttttattattattggtatcctgaccacacttaaattaaatagtttagccagtctagttgttaatgtcattgcttattttgcttattattgtgccttagagatcgatggcttggttgcggttggtaaggctgtcgcggttttctttggcttcagttttgttatcttgatgaccttgatcagcttttaccgtcagcgccaaaagcaaaactaagcgcgctaggtgatttctttagccaaaactgcctgacaagtcttagttagtgcggtataattaatcaagcgccgttctaagcgcgcttaaccagctattaattaaaaaggatgatttttcatgaaaaacgtttcgggtcaggagtatcaaacacctagacaagcagccgacgaattagatattagccctcaaactttgcgtgcttattctggattagttgagaaagcaactggacgtgcggattattttcatcgtgatcagaacaacggtcgcctatattcggcgcaaaacattgctgatcttgcccgagtgaatcaaataaaaaaagaacatagcaagactttaaaagacgcaatcagtgaggtttttgaacaacagatcattaaatctgctgagcctgcagaatctagcgccgcaacagtgccagcaactactgcagctactagtgcaacaccacagatcagcagcgatagtctagcgccgattctttatacattgaaacagttgactgatcaaaacgctgaagtagtcacccagatccaccaattaaaaacacaattagacgaaaccaaccataattacgaacatttactgaaagcaatcgaagttcgtaataccgctagcgccactgcagccagtcagtcagttgctactagcagcgcagcggttgcaccaagtgctgcttcagcaaccagcactgcaagtcaagcgcctaagccggcttcagcgtccagcctatcaatggccagctcttccgcaatcactgctccaaagaaaagcttttgggcgaaattttttgggcgcgattaaagataacgtcatcagtaaaactgggccattaaatatgacccagttttttcatgcaaaagcgttactaattgagttttcaataataattgagcaaaagtgctgactaatacaataaagttgtgtaaaatataatacagagccaagttgaaccgttttttaagtcacaaaaggtactttgtgaccagctaatcgagccgatttttttgtgacatgatttccggcacaagaatggtcacagcacttatcagtagtttttactgatcgaccgccttaattgtgaaatagggggacatattatgacaaagccaattcgtttggaagagcaactttgcttttcactttacacggcgcaaaaacaatataataaatactatgcaactgccttggcacctttccatttaacttatccgcaatttattgtgttattaacgttgtgggaacatgataccttaaccgtcaatgatcttggtcattaccttaaccttgatagtggtacactgaccccattattgaaacgtttagagaaggacgactgggtcgaacggcggcgggatacggtggatgaacgtcgtgtcttgatccatttgacacaaaaagcattatcacaacgcgatacaatttatgatcgggttaataactgtttgactcaccttaacttcacgctggaacagtataacgacctgaaaaaagaagtcgacctgatcactgcccacttacaacaatttacagaaaataccgatgcactaaaaatctaaatcagtcaaaaagaagagctactgacaatattatgccagtagctcttctttttaattctatgatttctttttataattaacgatcaatttagcaaatttatcttgtaagcgacgaaaatcgtgacttgattgctgcgacgcgcgcactatatctttaaaatcgtgtgacccagtttcagataacttacgatccttagcccgattccttaaatggatcttccgcatattctcgcctccaactacgaactaatcgcccacctatttttgctggatgtgtctattataggttgccgttaagcgagaatcaatatacaaattatgattgcttggctgctaattgaccaaaatattcgactgcttctgttttacctggtagcgcttgccggtcgtagacttcaacttctgtgctggtgatggtccgagcaagtaattcagtgaattgttgcgccattagttgctttgcgtaatcgtctgcggttacacctaaatgtgcataatcctgtggtgaaagtacgacggatgattgatagactgccattaaattttgcctccattctgttataatagctatattataccaaagaaagcggtttgctttactttttagactaaaaaaaggcgctgaaaattttccgcgccttttaatattgtcgaaacctttgctgtcgttgtgccaataaagacgctggcgtcaatgattgcaattgacttaactcgtgctgtaactttttttgcagtacagccgccaaacgctttggcgaccgctcaggaataatggcatcaataataccatgttgataaagtttggtcggcgttaattgcattaattcagcagcttcgggtgcacgcgcggcatccttccacaaaattgatgcaaaaccttctggtgatagaatcgcgtaaatgctattttccaacatccaaacttgatcagcactggctaaagctagtgcaccgccactaccaccttcaccggtaatgatagtgatcaacggtaccggtaactgactggccgctaaaatagtttgcgcaattgcggccccttgaccatgttgctcagcttccttacctggataagcaccaggcgtatccactaagttgatcactggccgtttaaatttagcggcttgttgcattaaccgcaatgctttacgataacccgctggttctggactaccaaagtgcgtggcgatcttttgattcaactgttggcctttaacggttgcaatcaccgttactggttgtgtgcccaagtaggccaagccgccacaaattgccggatcatcccctaaagcacgatcgccatgtaattcaataaaattagtaaaaagcaacgacgccaattctagcggtgttattttggtcgtggcacgcgcggcagcaacgatttcgttagccgttttcttacctcgtttaattgacctcacctccactagtatgcaactgtagcaactgtgccagctcacctttcaagtgttcacggggcacgatacgatcaataaatcctgcttgcagcacctgctcagcgcgctgaaaatcagctggcaactgttcattgatcgtttgctcgatcacccggcgaccagcaaacccaactagtgcacgcggttcagccaaaataatatcgccttccatggcaaaacttgccgtcactccaccagtcgttggatccgtcaacaccacaacataaagtaagccagctgcgctatgtgccgctaccgcttgactcacttttgtcatttgcattagtgaatgaatgccttcctgcatgcgtgcaccgccagaagcagtgaacaacacaaccggtaagcgcgcttgggtcgcgcgctcaaataaacgtgtgattttttcaccagtgaccgtccccatgctacccatcataaaataagcatccatgattcctagcgcacaaaacgaagttccaattttagcacgtccagtcagcacactatcatttaattgcgtcactgcctgagcacgggctaacttttccgcgtagcccggaaagttcagcggatcctgtgtagtcaattgttcatcccacggtgtgaatattgcggtcaattgctttaaccgcgcccatgctgttagccgcaagccataatgacaatgagggcaaactttaaaaggaccgagctctttggtatagcaagtttgctgacaaactggacaacgttgccataaattcgttggcacttgatcccggcgtcgctgtaattcagcttgcgctggaagtttgatgtaacgccgtcgtttaaacagccgcatgttgctcatcccctagcttttgttgcgctaaccactgtggcaaaaagcgctgactaatttcattggtcgttagcgtaccggccaaataacttgaatcagtcaataaagccgccgaaaactgttgattagtagtgatgccgtgaattactaattcttgcaataaacgtgacattttaacgattgcctgcgttcgttctggcgcaaaggtgatcaatttagcaatcattgaatcataaaatggcggaaccgtgctaccagcataaactccgctatcaattcgtattcccaatccacctaacggccagtaaagataatcgattgtcccagcagccggtaaaaagttttgcagcggatcttcagcatttaaccggcattcaattgcatggccgcgaatttgaatatcctgctggcgaaatgataacgcggcgccactagccaccaaaatttgttcacggatcaggtcgataccggtgaccatttcagtcactggatgctcaacctgaatccgcgtattcatttccataaaatagaaattttgctgctgatccattaagaattccaacgtaccagtattcagataggccattgctgttgtggctttacgcgcgagtgccagcaactgttcgcgcttagatggcgtcagtagaacgcatgggctttcttctaaaactttctgatgatgccgctgtgctgagcaatcacgttcaggaaaagtaacaacgtgtccttgctgatcacgaaagacttgaacttcaatatgcttggcagccgtcatcactttttcgatatacatccgctgatcgccaaatgacaactccgcctcttgttgcgccgccataaactgcggtgctacatcagcagcacaggtcaccttgcggatacccttcccaccgccgccagcagcggcttttagtaagaatgggtagccaattttagcagcaaccgctttggcagcagccacatcggcaatgaaaccgtcactgccaggaatgaccgggatattggcttgacgcataaactcgcgcgcattcgccttattgcccatcaattcaatcgtcgctggctgtgggccaataaatgtaatctgacaagcagcgcacatttcggcaaaacccgcattttcagctagaaagccaaagcctggatgaatcgcatcggcgcccgttaaaatagctgcacttagtatattctgacgatttaagtacgatgcgtgcgcggcggcaccgcccacgcagactgcctcatctgccaactgcacgtgtagactttctacatcagcctcagaatagatcgcaacgctggcgatgcctagttcacgtaacgtgcgaataatgcgcacggcaatttcaccgcgattagccactaaaactttttgaaacatttaatcacctactcaattgcaaaaacaagctcggcagcacaaactactttatcggcgactttgatcgtccctttaccgcaaccggcatgatcgcgcaacttggtcagtgttaattctaattgaagtacatcaccaggccgaaccatttgtcggaacttagctttagtgatcccaccaaaataagcggttttcccggtaaactcaggcaaactcaaaatcgcgatcgcacctgcttgggctaaagcttcaacttgtaaaacaccgggcattactggattgccaggaaaatgaccttgaaaaaaaggttcattgatcgtcacattttttttggccacgacccgttcaccgggtacaagttccagcaccttatcgactaataacatgggataacgatggggaataatcgcctggatctcagttgtatttaacatcatcgtttcctccttgcataattaaattttgtgactaggactcaggatcaatttcaaataaaggttggtgaaaatcaaccatagcttcattttcaactaaaatagcagtcactgtgccactaacatcacttttaacttcattcatcattttcatcgcttcaatgacgcagatcacttcaccagcagcaacgtgatcgcccacttttttataaacgggctgctctggtgccgccgctaagtaaacaacaccaactaaaggcgctttgatcgttgttgtatccgtattagttgccgctggcggtaatgttgcagcgttcttaacaaccgcaccactttgcttaccaaaatgtagctcaaaattattatctttcaacgcaaactcgtttaaactactttgatcaaattgctgcagtaactgttggacttcatctttagtcacgtgatcacgcccactttctcaaagctagtaccgcattatgaccgccaaaaccaaatgaattgctcaacgcattagtcacttcttgctggcgattttccgctgtcaccagggttaccgggcaagcaggatcttgctgttgtacgccaacgttgactggcaattgcttttgccgtaaggccgctaatgtgattactgcctcgattgcccctgcagccccgagcaaatggcccgtcatacttttggtactgctgaccagcactggggttgcgaaaatttgattaattgccgcagattcggctgcatcgttggctttagtactagttccgtgcgcgttaacataaccaaagtcagctgcggttgcgccggattcatcgatcgctaactgcattgcgcgcgccgcttgcgttccagccggatcaggtgccgtcatatgaaaagcatcgcaagtactgccgtaaccggttatttcaccatagatcgtggcaccacgctgctgtgcatgtgctaagctttccaagatcaacatgcctgcaccttcacccatcacaaaacctgcacgatcctgatcaaatggaatcgaggcgcgttgtggatcagttgctggcgacaaagctgataaagcagcaaaaccagcgataccaatttgattgattggcgcttcagcaccccctgcaatcatcatatctgcacgcccactttgaacttcacgaaaagcatcgccgattgcgttagtccctgaagaacaagctgtgaccactgccgtacaaatattgcgtgcattgaattgtagtgcgacgttacctgccgccatattggcaatcgactccggcacaaaaagtggcgaaacgcgttgcggtcccttagcattcatcttagtgacctgcgcctcgattgtggtcaagcccccgatcccagagccgatcattacacctaagcgttctggtgcaacggtctcagccgttaagccggcttgttctgcggcttccaatgcactataaagtgcgtactgggaaaaaagatctaggcgtttgcttagccgtttatccaagcgcatagtcacgtcgaagtcttttagctcaccggctaaagtgattcctgtggccgctgctgcaaatttagtgatcggcgcaaaaccgacttgcccagcagtaatatttttcattgttgtggtcacatcgttacctaaaggtgtgaccgcgcccattccggtgacaactactcgttgcgtcatgcggaaagcctccttcataattaggacttaatacatggtcattccgccgtcaatggcgatcgtttgtcctgtcatataatcattttcggctaaaaagatagcagcttgggccacttcttctggcgtgccaaatctttttagcggaatctcagtttcaatttgtgtttttacttttgtacttaaatcttgtgtcatagcagttgtgatcatgcctggagctagcgcattacagcgtacttgccgcaatgccgcctcacgggctactgatttagttaagccgataatacctgctttgctagccgcataattggcttgaccaatattgccggtcaacgcaaccacactagctaaattgataatgcagcctgaacgctgtttaaacagcggcttcaaactatgctggatcatattaaaagtgcccaccaaattagtttgtatcgtttgcgcaaaatctgctggctgcatgcggatcaataatttatcggccgtgatgcccgcattattgaccagcacatccaaatgaccaaaatgggctagaacttgatcaatgatctgcgctgcatcctgggtgacatcaccaacgatccctacacagtcaacaccataagcctgaatggcagccatttgtgctgaagctaaagcatggcggctattcaacgcaatgttagctcctttttgggcaaatgctagcgcaattgccgcgccaataccacgcgaactgccagtgatcaacactgttttaccggttagatccatgtgctacctccaattctgtaacggtcaccgctaaggtctgtggatctgcgatctgatagattttcgccgttggcaaggtctgtttgactaaacgtgacagaactggtgctggtcctaactcaataaaagtatcgatcccttgattggacaattcggtgacacaagctgcaaaatgagttggctgcaccatttgtcggttcaaagtagccgctagcttagttgctgtaaatggcgctactgtggtgttactccaaactggaaccataccggtagcaaagcgactttgcgttaagtatggtttaaatgcggtagcagcggactgcattaatggcgtatggaatgcaccgctaactgccaatggcaacacgcgtttaacaccatgctcacgtaagtaattactggccgctgtcaccccggctgttgtcccactgaggacgacctgttgtggtgaattataattagccaccgccaccaaaccactttgttggcctactacacaggcagcttcaatttgttctgccctagcttttaaaacaactgccatcgctccaggattagtttggcaggcttgtgccattaaccgaccgcgagctttgactagcgttaagccattaactaccgaaagctgaccaccagcaatcaacgcaccgtactcccctaaactcagacctaacaacgcttgagctggtggtaattcggcctgaactgcctgatagatggcccaattcaaagcgactaacgccggttgtgcgtatgccgttgtctgcaagcgttgattagccgtaaaacataactgcggtaaatcgattcccaaaatctggctggcctgatcaaaagcttgcttaaactgcgcattctgctgataaaaggccgcacccatacccgtgcgctcggcaccttggccgctaaataaataagcaacttgcatggtgattgctcctttctacttcactactaataatgattcacgttaaaaataattctctgcttgccccttttgtaagcaggcttgcgcttgggctgctgtctcttgcaaaatcgtggcacaactggtttctgttttgatcaggccggcaatttgaccagccatatatgaaccggtaacttcatcgccggtttctactgcgcgccgcagactaccattgcctaactcttctactgccgcaaaatcaggatcatcttgcaacgctgccgctttttctgcgactaaaaattgacgactcattttattttttaatactcgggctggatgcccaatataggccccagtgactagtgtgtcgatatctttcgcttttaaaaccgcatttttatatttttcatgaatgtgacattctttagcggctaaaaagcgcgtgcccatttgcacgccagctgctcctagcatcaatgctgccgcaactccgcgaccatcgccgattccgccagctgcaatcactggaatatccactgcatcaacgacttgtggcactagtgtcatggtcgtcatactaccaatgtgcccaccggattccatgccttcagcaactaccgcatcgacaccgattcgggccataattcgcgctaagccaaccgaaggtaccaccgggactactttgattcctgctgctttaaatgccgcgatgtactttgccggattaccagcgcccgttgttaccacggcaacgtgtgcttgtaaaatcacctgcactacttcttcaacatgtggtgaaagcaacattacattaacgccaaacggtttatcagttaacgctttagccgtggcgatctctttcgccactactgttgccggtgcgtgaccactgccaatgatacctaaaccgccggcattagaaacggccgctgccaactcaccattagctacccaggccatgccaccttgaaaaattgggtactttaagcccaacgattgcataaaaggactcacaggcccaccttctttctatctcaataaaaataactaactcgtgtttggaaaagttcttacagtcaaacttaacctaaacgctttttcaacgaactctaagcaatttgtttagcaacgaaatctactaaatcactgacagtggcgatttcttcatcagtttcgattttgacatcgaattcgtcttcgatttcattaataatttcaaaaacatccagactatcagcatttaagttttctttgaaattagtagtcatagtgacttcattcgcacttttgtccaattgttccataatgattgcttgtacttgattaaagatttctgttttttccatgtttgttgcctccattgttgaatcgttttaaagtttttttataacctggtctaatcgtgctaaaaaagggaaattattacgtgtagcgacgctggtcgagcggaccactatattcgcttattttcataatctgaacaccttttttagacatgttttaataaatcataatttgtgtacccacagttaagccaccaccaaagccgcttaacactagtatgtcccctggtttgatctggccagcacggacacattcatctagcaataatgggatactagcagctgaggtattaccataagctgccatattctgtggaaatttacttagcggttgttgcagtcttttagcgacttgtgcaacgatccgggtattagcttggtgtaaaataaaatgatccacttggtcagccactaagttagcctgttgcaatgctcgttcaattgaagccggcacgcctcgtgttgcaaagctataaataccgcgcccatccatctgaaaatatggcataatttgattaacgccattaaccatttgtgaggcaccaccgcgataaccagctgtcaactgccccccacgatccccgaaggttgctaagtcactagctagtaagtgcggtgtgtgactattttttagcaaaacaccagcagcgccatcaccgaatagaactgcagtagaacgatcctgccaattgatcagtcgcgataaaacctcaccaccaatcagtaagccataggtctctttgttagtctgaaaataatgctgcacgacactcaagccataaacaaagccagagcaagccgcatttaaatcaaaagcaaacgcgttggtagcaccgatcattccttgaacgaccgcggccgttgcgggtgtaaaataatccggcgacattgtacaaacgacaataaaatccaatgcagtcgctggtaactgtgcctgtcgtaataattgttctgcaacttggccacaaagactgctggttgtttccgtggtcgcaatgtgccgctggctaataccagtgcggctgcgaatccattcatctgaagtatccatgatctgactaagatcataattggtcataattttagttgggacagcatgtgcggtttggacaatttttacgcccacgacatcaccacctttatttaagaatgctcatctaagaaatgttgcagattatctaacgctttttccaccaaggtcacttcttgctcatttagatccttaagaaagctctgcaccatttggcgatgaaatgactgatgcagccgatacatcaagcgccctttgcgggtcaggccaagatgaatgatgcggcgatcgtcatcactgcgcaaacgttcagcataacctttacgcactaagttgttgatcgaaacacttaacgttcctggtgttaccttcagcgcccgtgccacttctgatgaggttttacgatgatacataccgatcgcattgatcgtatggatctctttgatcgataaatctttgaactgacttttctttatttcaatttcttctagctgaacaatgtcgttataaacggcgacaagcttgtcgttgatacgctgtccttgtggtgtcattatttttatctccccagctaattactttgatattcaaaatattagccgtgttggacgtggatgtcaaccaactgttggctgcacaacaaaatgtaactctactgtgcaaacaacctcaccgtcaaccgatgctttagttgcgacgattcccatatttgccttgactttagtcaattccacttcaaggcgtaagcgtgcgcctgggcgaacacgcttgtgaaaaattgcattacgaatactgccaatatacgctgttcgttgtgcaaactgcggtgactttaaaatcaaaattgacgctgcttgagctagagtttcaacgatcaaagttcctggcatttccggtcgtcctggaaagtaaccttgcagaaaatcctcattgatcgtaacatttttagttgcgacaattcgttggtctggcaccaactcatcaacttgatcaatataacaaatcggaaaccgattggggatcaattgctgaatctctgctgcctgtagtacgcacaaatatctcacctcgtacatttaatttcaaactgaaatagtttgatgttcaaagtttattgcagtgatttaaaaaagtcaaattaaattttatttttcacaaagccgagcgccaaaaaagcttgctatacttggaaaaatacagtcaaatttttttcaaatttaacatttcaacaagtaaatttgtcaaaaaaaagcttagccgatttaacggctaagctttaaatttattgttcaagtttttgtaatttttgattttcatctaattgggacacaccacttaaatgaattcgttgtaagatctgcatgatccaccataataacaagagactgaccactagaatacccactaagacgccagtcgaactccaaatctggccactacctaagccagatgtgatagcttgacggaaaccaaggatcgagtacgtcatcggaatatacggatgaatcgcattatagaacgagttagtgatttccattgggaacgtcccaccagaaccacctaattgtagcatcaacaagaccatcgccacgaagcgacctgggttatcaaaggccattgatagcagcatgacaaggaacattgatgctaaagcaaagatgattgcgatcagataaaaggccccaatatgatcgacttgtagaccaaaggctaacatcaagctagcttctaagactgccatcacgatagcaacaacgccaccaacagaaaccttactgaagaaccaagctgtcgctgattggcccttagtcgaaatcttccgaattgggtaagcaaagttaaagacgattgcgccaacatatagagctaatgacaagacgtaaggtgctaaagcgtggccgtaatttggcacataactatacctcttgtggttcaatttagttgggctggcaaacatatcggctgtcttggcagtcgtttgaataccgttgactttcttaccaccggcagttaaagcaactgccaaagtattggaacccgcgtttaatttatcgccaccagcggttaattcagccgatttgctgttcaactgactagtaccatcagctaacttggctacaccagcggttaaagttggtacctgtgcgttcatcgtattcaagccagcagctaattgattagtgccagaattcaatgtacttgagttagcatttaatgtttgcgacccagtgtaaagctgaccgacaccggaaaccagcgttggcacttggctgttcatagtgtttaaaccagcagcaactttaccggtaccacttgtatattgactgaccccagacgctaattggttagagcctgtcgctaattgattaaccccacttgataatgttggaattgacccattaagtttggtcagaccaccagctaaagtagatgcaccagaagttaaagcgctagaattggcagctattttattagaacctgcggctgcagtgttcacaccaccgacatattgttggagtccactagataattgattgatttgcgccaacatatttgaattattgatcgttgcagcgatagtcttttcactgcgtacatcaacaccagcaccattgacttgtgcatttaattgcttagcataactagtaactttatcggagttggcagctaattggttaattccagtatttaactcacccatttttgtaactaaagcacttagttcagcctgtgtatctgagctagtcatatcactacttgcacttaacaagttttgtgctgaactgatcatatctggtaaaccagtcatcacccgttgcgcagttgcaatcgtatccgcactaggcattgcattcatcaaatcattgattgaatttaagtcaatgccacttaatgcgttatttaacgttgtacctacacctgctgtagttgctgcgttatttttagccgaagtcgcattagttccagtcgacttgattgctgcatttagctttgctttatctgcatcgctcaatttactttgatcaatggtttgtaattgttgtgcggtagttgcatcgctttgagctatttgaccatccgttgttgcaatagtggtcaacgttgtttttaattgtccttgtaaattactcagattagtaatttgcgtcttcatattggcaattgtatcttgtgatgccgctaatttctgtaacgttggtactaaagctttcaacgccggtaatgcagcatttaaggtttccatttgcttagaaactgtttgtgactgtccattgattgatttcatttgatcaatttgagtcgctagtttggatagatctacagtttttaagccagcttgaacttgtttaagtccagcattgattccactattgtaagcatatataccagctgctgccatcggcaattgtttagtaccagcaactaattgattgaccccaccagtcacttgatctgagcttttcgacaatgtatttaaacctgtattcagatcaccaacacctgccgtatactgacctaggccactaactaaagtaccagaaccattagttaattggttgaccccagtcgctaatgggcccacattactttgtaacgtactaagtccaccggcaacttgctgtgcgccgctattcaattgacttgatttagcagttaattgattaccgccatcagccaactgttggacgccactagccaacggaccaacactactttgtagtgtaccaatcccgttagctaattggccaacgccggcagtataggcgctgacgccagtcgctaattgattaccgccagtcgctaattgttgcacaccagtcgctaatggcttcacgctgacgttcaaagtttggacgccatcattgacctgcgaaacggccacggtatactgacctaagccatcattcagtgtgactaacccgttatccaattgcgttgcgcctttggcagccgtgttcatccccttacccactacgtgtaattgatcgaacatcgcactggcataggcatttgtcaccgctgcacggatctccttatccaaggaagaagcaccgactgaactaatgacttcaccaatatagttcagcgaatcattggttttataggttagttgcattttcttagggttcttattcaaagcggtcgttgcgttggcggagaaattcttcggcaacgtgatgaccgtataatattttttatcttttaacccttgcgcggcttgtttagcagaaacaaaacgccaacccaattggttattatttttcagcttttgcaccgtttgtttaccgacgttcaaggtttccccattgtatttgactggttgatcttgattgaccaccgccactggcaaactctttgtttcgccataaggatcccaaactgacttcaagaagaagacactgtaaagaaacggaatcagtgtcattacgatcactgatagcagaattaatcggttgtgccggataaaccgccactcatttttgaccattttcataacttaaattccttcccacctaaaactcatctaaaaatcaaatctctacttttaatatccataaacttctctagagaacattttacaaataaactagcgttttgtagccggacactttgcacttagtgtccggctacaataaaaaagcgattttattttagcttacaccctaactcccaacgataaaaaactagatcaaatcagccatataaagttggccaaacaaagataatcgctcccgtttgcgctccttttgtggaatgaagacgccgactttttccaagttaaagccagtgatcaaactatgttcatcaaacacgatcggattttttaaaatctgtggatgtgcctggacaacctcgaccatttcgttaaaagttaaatcatcacccaacgctaatgcttgggttgccttagcacgctgcgccaataaatcatcagtaccgttatcagacattaaaaaaagttttgtgatctccgctttactcaacggtttttgcaaaatattacggatctgcaaactcaaatgctggcgtttaaaccaacgaaccattttattttttgctggatcactagtgtgaaaatacatattgaccataagtctagcctcgctctctttttcctaactaaaggttgaaagttaatattcccaattgagtcccaatctgttggggcttttttgttataaaaatagacacgaaacactccgtatctgtataattgagtcgtctaaaaaacaaacatacagaggagttttcgtgccatgtctactatacaacattctacccctaatattcacctagcaatgcaacatttttctaaa

SEQ ID NO: 552 - DNA, 2350 bp, Unknown
  Metagenome-assembled genome
cgattagtgttagccccacttaatttatccgtaaataatttatcaacgtcttttaaagccgctaactgtcgatctaaatgttgctccttggaactcacacgcgcataaccgattttagccatttccaattctccttttggacagttctaatgaacacttgtaattcctagtatagcacagaaataaaaaagaccattagggtataccctattggccagattggtttagtcaaataaaaattttaattggtttcttataagtgcatataatttcatcatcactacctgtctgctataatgatggtaaaggtggtgatgatttgcgatttatatttaaggctttaatagtagttgttattatccttgcatttcctttgtccatagttcttgtctttaaaaattggtcaatggccattggcactagcccacccatgcaattaaagtttgattggttggatcagtacgaaccgatataccttttttggagtggggtaattctggcggcggtgttaattattttattgcttatcacacttttttggccacggtcacagtcattatatcttcatcaaaagtctgatggtcaagttaccatcagtaagaaagctattgagcattttgctctttcagcacttcaacatgaaccctttattggtaaccccaaggtatcagctaagttatcacgaaaaaggatcacacttaaaatatcgggtgatctactaaattcagtcaatgccaagaaacagactgcaaattttctcaatcaattaaaaaaagatttgcgtatttgtcttggaatttctgaacagaaaaaaataaaaatccgactcgttgatttcaatgagtcggacgataatgtgcaacaatctcgagttgtctaggaggtgataacgtgaccgaactcattaaagcctatttttggccactaattggtggaatcataggattgctcttagcggtccttatcatcacttttggatttttcaagacgctttttgttttgatttttatggcaatcgggattagcgcgggttattatattcaaaaaactggtatcttaacaaatgtttttaaataactgtttgaattataaggaggaaaaattatgcagaatggaacgccaagtgaaaaaacaacaactaacgaaaagtctggtgttaaaggcaatttaacatttgatgataaggttattcaaaaaatcattggtatcgcactttctgaagtagatggcttattaaccgtagatggcggctttttcgcaaatgctgctgaaaaactagttaatacttccgatgtcacatcaggaattgatgtagaggttggaaaaaagcaggttgcagtggatctcgacattgttgctgaatacggcattgatatttctaaactgtatgacaagatcaaaaatgttatcgttcgggaagtaaagaatatgaccgacttagaagtaattgaggtaaatgtgaatgttgttgatgtcaagacaaaggagcaacatgaaaaagattcgacttctctgcaagatcgcgtgagcgatgctacagagaaaacgaaggaagccttcagtgagggcgcaaagaaatcgaaggaaacattaagtgacagcgttgataaagtaacgtctgacaataaatctagtcgtgttaactaagggggtgagtaaatatgggacttatttggtcattaatcgtcggggcaatcattggtgccattgctggcgcaatcactaaccgtggtgctgctatgggctggattgcaaacatcgtagctggtttgattggtgcatggattggccaagggctccttggcacttggggcccttcattagctggcatggcattgataccatcgatcatcggggcaattattttagttctgattgtttcattagttgttggtcgaaccagtaaaaagtaagggggaattttatggacgttttgaaaagtgtatttaagtttatgatcgcttctacgctcattgtaggtggtgttctcatcggcggcaccgtcttggctgctaagaaggtagatggcattggtgatacgttgcaacaaaaattacatggataattagccaaattatctatattagtcatcttagaacgtaaactaaaggttgaaagttaatatttccacttaagccctgatctgttagggcttttttgctacaaaaatagacatgaaaccagcttacatccaatatccgaatccttacctaaacgaacaaaaatcaccgcaaaaactcacatcttcactaacattataccgcgactgttttgaaaataataatcgatcgtagccgtaaataaatctcactttttaagttgtgcatatgatttaacacacaaaaatcac

SEQ ID NO: 553 - DNA, 19758 bp, Unknown
  Metagenome-assembled genome
caatttttaaatggcttatcgattcaaacttcggcgctgatcacgctgagcatgagcaatagttgaaggttaatttttaggctgtaaagcttggtggactaagggattactcgaattggaactttcacgacttagatttctaactaataagtcattctattgattttggtacgaaaagttaatcaagtctgaattgatcaatttgattggcattaaaagtaattttgccgacagataataactgagtgacatagcgttttaaatcgattttagccaggctcatgacaaacttttgtttattatcaatcagttgttcgaccagacacaatgaaaaatcatcaagtgaatcgtttggaaattataattcattcgcgctttgtagaaatcaataataaatatatctaagggtcgtaatcacgcactataaaaattaagtaattctgcgaattatgcagtttctttttgagcaaacgtttatagcattaagcaaagtattggtgttttttgttttcgggtgaacgctcgcaaatcacattactactgctagtatcttttaagcgggttggtatggcagttgagatgaactgaccgaattctttaaattggattgctagcataatttctccccatttaaatgttctcttcaattcaagaataatctgaaatggaagtaacttcggcaatcaggccttggaacaacaaaaagagctcttggataaatccatgaactctttttgagtaactaatttagattaagttaatgacattaaccctcatgaatactttttcgagtttgcatttttgctatatttactgccctatagcaacacataaagaagatctttaaattatcgcaagaaagactacacatctgcttattcttttggtaatgcctgtgtcggatcatagatccaatgccgtccgtcacgcgctaataactcagtcgccgcttccggacccatggaaccactagcataattagggaaatcagttggggttgtttctgcccaaacttgttcaatcacatcagcgaatttccacgtctgtgaaagttcatcccaatgggtaaagttggtcgagtcaccattgagcgcatctagtagtaaacgttcgtaagcttccggactgttaccggcagccgcagcactatgccgaaaatcaagatcaactggtcgcgtttcgaaaccttggcctaagcgcttagcattaactcgtaacccaaaaccttcagtgggttcaacataaatagttaatacattatcgcctagcttatcatcatcactgaccgttttgaaaatattcatcggtaattgtttgaagacaatgtcaacccgggtcgcttttttagccaaacgtttccccgtccgcacatagaatggcacaccagcccaacgatagttttcgaattccattttgcctgcaacataggtctcggttttcgagtcagaagccacttgttcggcttcacgataaccttctaaacgtgtgccatcaatcgtcgctggaccatactgaccgcgaacaaagttacgacgcgcttcttccggcgtatcaatatgcaaactgcgcaaaactttgattttttcatggcgaatatccgtggctgaaaacgaaactggtggttccatcgccaacaaagtggcaatctgtgaaatatgattttggaccatatcgcgcattgcacccgcagtttcgtaatatccagcccgctcctcaacacctaaagcttcacttaatgtgatctgaatattgtcgatataacgattattccatagggattcaataatattattaccgaaacgaattgctgaaatattctgtaccatttccttacctaagtaatgatcaattcggtaaatctgatcttcagcaaaagacgcccggatctgttcatttaattcttccgcactttgataatcatggccaaatggtttttcaatgatcaggcggttaaaaccatcttcagttaaaatttgttctgactttagatgttttgcaattgtgccgaaaaagttaggcgacattgccatgtaatagattcgattatcttgtaattcatacttttgatcaagctttttagctagctcttccaagaccacataatgttccgcattagtcacatcatgagattgatagtaaaagtgactagcaaaggcagcgacctgttcgtcagttgcttgcagatcacttaaagactccgtcacgatctgatgataataatcatcagtccatggtcgccgtgcagtgccaatcaccgcaaaatgttgatctaaatagcccttctgataaagtcgaaatagcgatgggtataatttgcgccgcgctaaatcaccagaaccgccaaaaataataaataaagctactttttcgttttgcatgcctgacaccacttccgttattttttaactctaactaattgtacctattcacttcggtaacagcaagtcaagtagctgaaaaatttctacacaaaaaagtagccaacaaatggctactttattaatggcttatttagtttcgacaccttgcccatcccattcgcgaattaaaatctctttcaattcactgatcaatggttctttcggattggctggtgtgcattgatcctcaaacgccaactcagctaacttatccacactacgatcaaagtgcgctttgtcgacccggttgtcctttaaattcaaggtaacatcaacggaatgtgctaaatcgataaaggcttgcactaaggcttccttcaattcttcatcagtattaccctttaagccaagatagcgggcaatatccgcataatcttgtaatgctgtgaagtgtgaatacttaggccacatggcgatcttagttggtaccgttgcattataacgaacaacttggggatacgtgattgcaatcgccaacccgtgtggtaaatcaaattccccacctaacttgtgcgcaatagaatggttaatgcctaagtaggcactggcaaaagccatccccgccatagttgccgcatcatgcatcttctgccgtgcttcgcgattaccatcataggaagctttcaagttattaaaagccaatttcaaagcttgcaatgcccagccgcgagtatattcagaagacatcacggaaacgtaagcttcagttgcatgagtgattacatccaagccagtccaagcagttgttcgcttaggtaccgtttcaacaaattgtgaatcaacaattgcgatatctggttgcattgcataatcagtgatcggatatttgacgtgcgtctttgaatccgtgataactgcatatggcgttacttcagaaccagtcccagaagtcgttggaatcccaatatattttgatttgttcggtactggtacccggtaagtccgtttacggatatccaagaatttctgcttagcaccgaagaaggaagtttctggatgctcgtacatcaaccacatgaacttcgcggcatccattgcagaaccaccacctaaagcaatgatcgtatctggtttaaaggcatccatccgtgccacacctttgtaaactgtgtcggttgaagggttaggttcaacatcagagaaaatatcgatttcaacttggttggtccgtttgcgtaaaacatcaagtacgcgatcagagtaaccgaactcaaccatcccaggatcacaaactaagaaaacacgtttaatgccttccatgtgctccaagtagcgcactgagttgcgttcgaagtacacttttgggggtaactttacccactgcatgttgttgcgccgcttggcaaccgttttgatattgatcaaatccatatccgaaacattatgcgaaatcgagtttttcccgtatgagcctgtccctaaggtcaatgatggcgtcatattattgtagatattcccgatcccaccaagtgctgatggcgagttaactaagatccggcaagctaacatatccatgccaaattgtttaactaattcatcgtcacgtgtatggatcgaagcagtatggcctaagccaccgaattccaacaattcttttgcccgagcaaaggcagcttcatggtctttaaccttatatagggacaaaacaggtgataatttttcacgtgatagtggatacttaggaccaacgccatcaatctcagcaatcaagactttagtatccttaggtacatcgatacccgctaattgtgcgatttgataagctgatttacctgcaatcgggcctttaacaccgccgcgtttttcatcaaacattgcttcgcccaatgcctttaattcagacttcttaacgaagtaacaattccaatatttaaattcagccttaacttcagcgtaaatatcttggtcaacaatggcactattttcggaagcacaaaccatcccattatcaaaagtcttcgataacacaatatcattaacggcttgcttgatatcagctgttttttcgatgtaagctggaccgttaccaggacctacccctaaagctgggttaccacttgaataagcagctttgaccatgccaggaccaccagttgccaaaatcgtggcgatatcctcatgatgcatcaaggcaccagttgcttcaatacttgggtcagcgatccattgaatacaattagcaggtgcaccggcttcaattgccgcatctaaaaggatttgtgcagtacgtacacaagcttgttgtgcttggggatgaaagccaaaaataatcgtattccgacctttaagtgagatcaatgacttgaacaccaccgttgaagttgggtttgtgactggtgtgaccccagcaataacccctaaaggttcagcgattttgatgatctgttcttcatcatcgtcatcgatcaccccaaccgttttgtcatgacgaatgctgttccaaacatattcactggcgtaaatgtttttaattgctttatcttcaacgatgccccgatgagtttcagcaacagccattttagccaattccatatggtgatccaaggcagccaaagccatcgcttcacagatcgcatccactttttcttgcgtaaaagtagacatagttgctaatgctgcttgcgattttttaaccagaccatcaattgtcttttcgacagaaacgcttttatcttcagtcttgttctcagtttttgtttgttttagcataacacatttctccatttctcaggttgaattagttgttatctatttcacaaattgatgatactacgaattttaaaaattgtaaagcattttcctgttaaataaaaaagttggttttaagcgctttcaatgttgccaattatagcctttcctgaaaaattaaactgatttccatgaaatctttttgtgaatttaataacaattaatcgataaatccaattaaacttacctaacttggtcggcaaacaaccaaatacgcatatctactttttaccatgggcaccggaaacggcgcaacttaaatacaaaaaaacacggacaaaaattgtccgcgcttaggtaccacattatttttcagttttatcgtcagcagctgattgatcagttgccgcgctatcatcaatatggttcgcttcagctgatgattcaacgccagaatcagacgtaacatcactttcgttgctagttggtgcagctggtgttgtcgttttcttatcgacacgcccaattgcccgtagatcaaaggttaaataaactccttcaatatccaattcaacggtttgtgcttgcttgtcgatgctgttgatcacgccatgcaaaccaccaatggtaacgacagaatcgcctttacccatgccgcccatcatttcttttttcttctcttgtgctttacgttgtggccggatcatcatgaagtacattaacccgaacaaaacaacgatcattaaaatcgaagttaacccactaccattagcagcagccagtactaaatcattcatttaaatagacacctcaatcattaatataaactaccttacaagcgtaacagacttatcttaagacttccagcaaaaactagaaattacgggcatttttttgattaaaaccataactttcaaaaaaggcttcgcggaattctaacagattatcatccataattgcttgccgcacttgttgcattagatgtaataagaaatacagattatgataactggtcaaatgaatgccaaaaatttcgtcagctttgatcaaatgccgaatatacgcacgactataattacggcacgcataacaatcacaattatcatctagtgggccaaaatcatgagcgtatttagcatttttgacaactaaacgaccatgactcgtcatcacagtaccattacgcgcaattcgtgttggtaagacgcaatcaaacatatcgatcccgcgaatcgcaccatcaatcaacgcatcagctgaaccaacccccatcaagtaacgaggtttattttctggcaaaagtggtgtcgtaaaatcaagtacatggttcatttctgcctttgattcgccgactgacaagccaccgatcgaataaccaggaaaatcaagactgactagatcacgcgcactttgttcccgtaagtctttgaagccagctccttggacgataccaaacaagccttgcgttgccggattacggtgtgctttcagaccacgttcggcccaacggctagtccgcgccaccgacttcttcacatagtcataactttcgaaaaatggtggacattcatctaagctcatcatgatatcaggaccgagatcattttcaatctgcatcgctttttctggtgataaaaacattttagccccattcaaatggtttttaaaatgaacgccctcttcagtaatatcacgcattttagctagtgaaaaaacctgaaaaccaccagaatcagtcaaaatccctttgtcccagttcatgaacttatgcaggccgccagcttctttaacgatttcttcgcctgggcgtaaccacatatgataagtgttagccaaaataatattggcccccatcttatctaattcttccggtgccatcgttttaactgaggcattggtgccaaccggcatgaacatcggtgttgggaaagtgccgtgtggcgtaatgatctcacctaggcgcgcgccggtgtgcttttcctttttgatcaagtgatacttaattgcaggttccatgaaatgctccttacttggtatttatgtttggttcatcgtttaaaagataactgtcatattttaacacgctcggcaaaaagcgcaagtcagctgttgttggacttaagtagacattgttttgtaagcgcttgtaatttatggtaaaatatacttgtggtgtgtgactcacataagttctaacgttatcgctgataaaatctattccctactttcgaataaatgattgtttaagtatttctccattagcttgtgatgttttcgcgtgtttgatgttcgatagatttaagttttaacttgcgtaacgatatttttgtgacaccccgcgtaatttaattacgtttaacaaaaatcttatgtgagtacacactatataaaaaaggacgagcatatgcccgtccttttttatattatttaataaacatcgcgtcgccaaaactaaagaaacgataacgttcgtcaattgcatgttgataagcatttaaaatgttatcccgcccggtaaaggcagcaactaacatcactaaggttgattttggtaaatggaaattagtgatgaaagcatcaacaacttgccactgatagcctggcttaatgaaaatgtccgtccaaccactatcgggcttgatctcaccattaaacttagtcccaatcgtttccaatgtccgaattgaagttgtcccagtggcaataatccgaccaccgtttttacgtacttcgttcaattcatcagccgcttctggtgtgagccgatagaattcactatgcatcttatgatcatcaatatcatcttcgtcaactggccggaatgtccccaaaccaacatgtaatgttaagtaaattaactttacacctttagcttcagccttagccaatagttccttggtccaatgcaaacctgccgttggtgctgctgctgagccattttccttagcatagacagtttgatacatttctggatcatccaatttttctttgatgtaaggtggtaatggtgtttcgcctaattgttccaaaatttccataaaaataccgtcataatggaattcaatcatccgaccaccatgttctagttcttcagtcactgtggcttttaattgcccatcaccaaagacaacttctgtaccgactttagcgcgccgggctggcttcattaaggtttcccatttgtcgccttcagtattatttaataataaaacttcttcatgaccaccagtgtcaggcttaaccccgtacaaacgcgccggcatcacgcgcgtattattcatcacgactgcatcaccggcatgtaattcatccaagatatcgtagaaatgcttatcttgcaatgcgccagttttgtgatctaaaatcaacatccgcgaagcatcacgctcttttagcggtgtttgtgcaattaattcgtgtggtaaatcataatcaaaatctgataaagacaatcccatttttggtcaggttcctttctacttcacaattaaggtagatcaattagccgagtgcgctaattggtctttgatttttgttcaaacggtattcctaaatgagcgtatgcttggggcgttacgacacgaccacgcggtgttcgtttaaggaagccaatttgtaataagtaaggttcgtacatttcttcgatcgtatcggtctcttcaccgacattggcggcaatcgtacttaaaccaactggaccgccattataatagtcgatcattgctcgtaataatttttgatcaacataatctaagccgcgaccatcaacttgtagtaactgtaatgccttttcaacgatcggtaaatcaattgctgattggtcggctacttgagcaaaatcacgaattcgcttcagtaaacgattagccacccggggcgttccccgcgaacgccgggcaatctcatgcgccccttcagtgacgatggttgtatcaaaaattgctgctgaacgttcaacaatatcggttagatcttgctcattgtaataggccatatgcgccacgataccgaaacgatcacgtaatggtgctgacaataaaccagcacgtgtcgtcgcaccaattaaagtaaatggtggcaacggaaaatgcactggatgtgccgtcggtccttggccaatcacaatatcaacgaaaaagtcctccattgctgagtaaagcatttcctcaacaattttcggtaaacgatgaatttcatcgataaataatacatcgcccggctgcaattcgtttaaaattgccactaaatcaccaggacgttcaattgctggtccactggtcgttcgaatattgacctgcaattcattagcgatcaccattgctagcgtcgttttacctagacctggtggcccataaagtaacacatgatccagcgactcttcacgcttttgcgcagcagtgatataaacttgcaattcgcttttgaccttatcttgaccaatatattggcgcaaatactgtggtcgcaacgatttctccataccggcttcacctgcgtctgccgtttcaggtgaaattacacgatcatctgccattaatacacctcccaccgagtaaaaaattatcttttaacgcttcatcaataggcgcaaggcttcacttaaataagcatctgtactatctgcattaaattcctttaacgctggtctgatccgcttgatttcagtttccttataacctaaggcttgcaaagcagctaagctttcgttcaagtaatcattgccgtcatcagccggtaactcaatttgctgttggtcaaccagcgcatcagttgtgacgagatcacctagcttgcccttaaggtccagcgcaatctgctgcgccgttttcttaccgacacctgggaacttagttaaataaccaatatcgtcaccctgaatggcattgatcaacccagcatggtcgttgtttgctagaattgctaatgctgatttaggcccaatgccagaaacttttagtagtttttcgaatagctgtttttcggctaagctagtaaacccaaataaagtcatatcattatcccgaatagcttgaaaaacataaactttctgcatttctgttggtgatacttgtaaacgaaacggatttgctaactgtaacttataaccaacaccagccacttccagcacaatataaaacggactaacgtaggtcactaaacctactaagtattcatacatctctttcacgactccaaatcatttcaaatgagtacatctgttcgtattgtaccatacttggtcgcagccagttgcagaaaaatactgttaccgcgaacgatctcaacaaaaatagattataccactaccatggatttacgcgcataaaaaaataagcttgaactagttatagccagttcaaacttatttagtcagcgaactaacgatcagttaatccaaaaataattcatcgccagccaaaagctcgctgacgaccgtgattggtaaacccatcacgttataacaatcaccagtaattgccttgatcaataaaccaccatagccttgaataccataggctcctgccttatcgcgatattcatcagttgataaatatcgttcaatttgatgagctgtcagtgacaaaaaagtaacatctgttcgcactacccgctgctgaatttcttgctgagggcgttttaaccataccgcagtatagacttgatgtgtttgaccctgtaataaatttagtgttgctcgtgccgctgctaatgactttggcttaccaaagatttgctcgcgaaaactgacaactgtatctgcacttaaaacggttgccgtaggatattgtgctgatatcgcattacctttacgtgctgctaatgtttgcacatgttgtgctggcgctagcggttcgttaatatgttcggaaacccgcgcaggtatactttcaaaattagtcgtaattcgtcgcaacaattcctgccggcgtggtgaactggatgcgagaatcaaactcatgccatttccccccgtaaacttgtatgactttcttgaatccggcggaacattttctccagatctttaccactgaaatgaaccaacactggccgtccatgggggcaattaaatggattttcacattcaggcaagcgctgtaacaaggccttagcttgttgatcatctaaatggtgattagctttgatcgcacgtttacaactcatcatgattgccgtttgctcgcgaaacttagcaacagtaattttttgatcattaagaatataatcgatcatttcacgaatcgtatcctcttcctgaccagctttaaaccaagttgggtgactgcgtaccacaaaactattctgaccaaaagcttccaagttcaaaccgagttgttgtaacaagtccgcatggtcacgtaaccgaatagcatcgctagccggataatctagcactagtggcaccaataagctttgttgatccgtgctgactttaccaatctcctgacgataatattcatagttgactcgctcttgggcagcatgttgatcaacgatataaaaaccatcttcaccctgtgctagcaaataggtaccgtgcatttgaccgatataatccaaatggggaaaacgttcaaccgctggagctggttgtgctaatggtgtcactgcagcggctgcgcctaaggctggaccaacctgttcatgctgatacttagcatcccaagccgcaagatcagcctgatcggcaaagttagtgaccgtctcttcagtggttgcaattgctggttcactggctaattgttcagcaatttgcgccgctgattctggttcagctgccgagcttgcttcagttgtcgctgaataagtttgtggccattttgtactagccgcatttaatgccatttgtagctgatcagcttttttttgcttactcgaatttaagttctcgttggcatccggaatcaagttctcactggcgatccgcgcgtaaatcgttttgcggatcaactcacctagttcatcttccttgcttaatcgcacctcttgtttggcgggatgaacattgacatccaccaatagtggatccatctcaattgccaatacgatcaatggaaaacgacctaccattaatttagacccatacccagcaatgattgccttatttaattgaaaatttttaatatagcgaccattgatcattactgtgatgtagcgccgtgatgaacgcgttaattctggtaaagacacaaatccgtgcaaccgaaaatcaagatcttcagcactaattgccagcatttttttggcgttattgaccccgtaaattccggcgatcgtttgttgtaattgcccattacccgcagtacggaccaagatgttaccatcgtggctcaaggaaaaagcaacctcaggatgacttaaagctaaccgattaacgatatcaccaatattcgccagttccgtattcggtgatttaatatacttcagccgcgcgggtgtattgaagaataaatcactaacggtcacagtggtgccttgacgaacggcactcgactcttcctcaaccagcttaccgccacgaaaatgaacgcgtcggcccacttcttcgccagtagaagtttctagaatcatatcagaaacggacgcaatactaggtaacgcttcaccccgaaaacccaatgaacgaactttaaataaatccgcccgatcatggatcttgctggtggcgtggcgtttaaaggcatttaaaacatcctcagccgcaataccgtcgccattatcgattacctggatctgttttaatccagcttccgcaacgacaatatcaatttgggtactatgcgcatccaatgcgttttcaactaactctttcacgacggaagctggccgctcgattacttcaccagccgcaatctggttagccaatacttcagctagttcatgaatctttgccatcactttaactcccttctgctccgcaattaagttgctgatattccgaccagcctcacttcgatcaagccaaaacgtacttctcgcttttgcgagcaacgtactttttaacctccgtcaaacggcttataaccgcttttgccacttgtatagagtattcatgacatccatcggcgtcatgctcattaaattcaattctttaagttcgtctaacactttaagttctgacttagaaacgttgctttcttgataatcaaataaagcgagttgttcatccgtttcatcagatgctggcgtttcaacaacttgttctaccggtgctgccgcacttgctggtgttttttccggtactttttccgtcaaagttggcgtttcaactgttgctgcctgactttgcgtctctagaccagctaaaatcgttgttgcgcgtgtcaacaaactatccggtaagccggccaattttgctacatggatcccataagacttatcagcggcaccagccatcattttatgcaaaaagaccaacgtgccattctcttctaccgccccaacgtgtacattacgtaaatgaggtaaatcagtatctaaagccgttaattcatggtagtgagtcgaaaataatgttttagcgtggacgtgatcatgtaaatactcaataatggcttgtgctaaagccatgccatcataagttgcagtcccacgaccaatttcatcaaacaaaatcagactattttccgtcgcgtgcgctagcgcagtgttagattccatcatttcgaccataaaagtactctgaccggaaatcaaatcatctgccgcaccgatgcgagtaaaaatttggtcaaaaattggcaaggtcgctttagtcgcaggaataaagcaaccaatctgtgccatgatcacagttaatgccaattgccgcatataggtacttttccctgacatattgggtccagtaattaaaaggatcgtattgtcagcatccattgtcacatcattgggaatatacttctgttcccccagcactttttcaaccactggatgacgcccagccacaatctccaaatcatgcgctttcgtcaatgttggccgcacgtaatgatacgtctcactaaccactgcaaaactttgtaaaacatccaaagctgcaacacctttagctaaacgttgcaaccgatggatctgctgcttaacttgctcgcgaactgcagtaaacaagtcatattctaaagccgttgatttttcttgtgcttctaagatcagcgtttcttttccctttaattccggcgtactgaaacgctcagcattagtcaaagtttgcttacgctcatagcgatcctcaggtaaagcggctaaattggctttagtgacttcgatgtaataaccaaaaacacggttaaaaccaatttttaacgtgtgaatacccgttgctgcacgttcctttgcctgcaattcagcaatccactgcttaccgtttttcatcgcatcccgataatcatctagtttctgattataatgtggtttgatcacattaccatccttgatcgacaatggcggttcatcattgattgcgcgatcgatcaaatcagctacatcgttaacgggatctaagtgatcgatcacatcatcaaacgtaccatcattaatatccgtcaagattgctttcaacttggggatttgtaataacgaagtcttcaactgaatcaaatcacggccgttaacattgccaaaagcaacccgccctgccaagcgttccaaatcatacactttagtcagttcatcttgcaagctagaacgctcaaagaaatgatccattaagctagcaactttgtcttgacgctgtttgatctgcgtggcgttgatcaacggacgatctaaccattgcttcaacaggcgaccacccatagccgttttagttgcgtccaataaccataataaggttccgctacgttggccagttcgaattgaagtcgtcagctccagattgtttttggcgtaatgatccatttttaagaattcagaaggctcatattcttccgctacttgtaagtgtgctaggctgcgcttctgcgtgactgtcaggtacattaataactgttcaacgactttgacctcggttaaatcagccaagccctgcgtcacaaatgataattcagcccgcggatcaacttgatcctggtaagagatcagaacacctaacttagtcaaattggttaagatttgtggtgtcacctcgtggttagccactaattccttagtccgtaagctcatcacttcattgaccacagcatcagcaccggctaagcgactgacctttaattcacctgtggataaatcagtgtaggcaaaaccatactgatcctttttagtttcaactaaagcggtcaaatagttattgcttttagcggtggccgctttttgctccatgattgtccccggcgtgaccagttgaatcacttcacgtttaaccatgcctacagcagttcgcggatcttctacctgctcacaaatagcgaccttatagcccttatcaactaaaatatcgatataattttgtgccgcatggtgcggtacaccacacattggaatcggatccgtggcacttttattgcgtgccgtcaaagttaattccaataattgggcacctttgattgcatcgtcataaaacaactcgtaaaaatcaccgatccggtaaaataaaaacgcatcaggatagtctttcttgattgcgttatattgagccatcatcggtgtttctttagttttttgtggcacgttcaacttcttcctttctacttcacttttaaggtaaattcttgtaccaagaatttctgatgttgcggacgatgtccattcttgtggcaaaaacgtgccgcaagaaacatggctctacttcacttttaaggttaattcttgtaccaagaatttctgatgttacggacgatgtctattcttgtggcaaaaacgtgccgcagacagcaagaaactacttcttgatcaattgatcaacttgtcgttgtaactcgtcagtaaccatctctaaggttgcattcgcatcaaataacgcattacgataagcaatggttaagggatgttcatccaaggccttttttaactgatcagcctgctttttagcctgtgcagccgccttgggtttatcataatgtgcatcattaacgatcgatttttgtacttgctccaagtcctgctgcaattgattcaaggtttgattatgcttgacttgacgttcaattgtttgataacgctgcaccgtttcatcgttttttagtaaggcacacaatttagccaatacagcctggctgtgtgcatctagccgcgactcaattgccatatcctcaccttttttcaaaattacgcattaaagtcaaacggattatcggcattaatgacgattggttcaattttcttggcgtgacctgtcgtttcatctagatcaatgaaacagccacccaatacgccacgaccatcttccttaacttcataacgagttggtagctgtgtcaaaaagcgttcaatacttttagctggcttaacgccaagaattgcatcataagcaccagtcattccggcatcggtcaaataagcagttccttgtggtaaaattcgcgcatcattagtctgtacatgtgtatgagttccaacgattgctgacacttggccatccaagtaccaacccattgcttctttttccgcagttgtttcagcatgaaaatctataaaaaccagatccgtttgttggtggatctcagtcaataattcatcagccttataaaatggattatctagcgattgcgccattaacgcgttaccttgtaaattgatcaccgctagttttaattgattgacctgaacataaacgtaacctaaaccaggggtcgttgccactggaaaattagccggacgcaccaatttttttgctgaatcaataaaatcaaaaatatcccggttatcccaaacgtggttgcccatggtgatcacatcagccccggcttgcaaaaattccttgtagatcttaccagtgataccacgcccgccggctgcattttcaccgttaacgatcgtgacttgaggccgataccgcccctttaattgtggcaaataagtggcgatcatttcgcgcccccgtgaacccataacgtccccaacaaataaaatccgcatgtgactcctcttttccagaaagttagctatattgtaccatttttccgcaatcgtaccaaaaaaggttgttgtgacaaagtggccacaccaaccctttatttatttcttcaagtgataactataagttgccaaaataatgttctcccgcgttgctaaagcagcacgcaaccggaaactcgtttgattatgcaaaatattctgccatggcttcttcggtacaaattgagggaccaaaatcgtcgtcgtatagttccgttccttagcgtttttagcaatgatgtcggcaaagcgcagtactggccgcgcaatcgaacgatacgatgaatgaatatcgacaaaccgaatatcagggaaatcagccttaaattcagattcagtttcccgttctttgccaggattttcatccatcgaaacgtgcattgcaatgacatagtctccgatcgaacgggcataattcaatgcgccggcagtaacctgagttacgttactgaccaatacaataaccgtactcccatcgtaatcatgaaaattaacggcttcgatcaagcgcagttgtgccgccacttttttgtagtgatcatgaattttatagaagataaagatcatgatcggcatgataataaagtatggccaaaccccgctcatatgatacatcagtaagaagacaaagatggcaaaggagatcagcgccccagtaaagttagcgatactccggccaacccaaccttttggacgttcatgccaccatttacggatcatcccactttgtgaaagcgtgaatggaacgaatacgccagttgcatacagcggaatcaaccgttcagtactaccattaaaaataaagatcaaaatgatcgacccaaccgccaaagtcaggatcccatttgaatagcctaagcgatcaccacgatccatatacatatgaggcatgaatttatctttagccaagttataagccaaaattggaaatgccgaaaaaccggtattagctgccaaggccaaaattaaggcagtggagaactgcagaatataataaaccgttcccttaccaaagatatgttggcctaattgtgctaaaatagtgactttttgttgcggtagtataccaaaataccaacttaagaaggtaattccagcaaagaagaaacctaaaagtaggcccacaattgccaaagtttcggccgcatttttagctttaggcttcttgaaaaatggaacagcattgctgatggcttcaaccccagtcaatgaagaagaaccggaagaaaaagcccgtaagatcaaaccaaccgttaccccaggtacagcggcaccgaccaatgaagtagcgtggaatgaacgtgcaccagtggcaatttccaccaaaccagtcacaatcataatcgtcagcataatgacaaaaagatagactggcaccattagaaatgaagccgaatcgcgtaagccacgcaaattcatcgcagtaataaaaacaacgatcaaaatcgcaatccccacttgataaccatataacgccggaattgcggaggtgatggcttctgtacctgatgataccgaaactgccacagtcagcatgtaatcgaccaataatgagcctccagcgatcagaccaggatacatccccagattttcgctagaaacaacgtacgccccaccaccttgtggataggcgtggataatttggcgataagataaaatcaacgacaataacaagatcagaacaaaggcagcgattggcaatgaataccacatggccgctgcggataacacgactaacgccgtgataatttgttctggcccataagcaacagatgacaatgcatctgacgataatagtgccaacgcttttaatttaccaagctgttgaccaccttcatcggaggatttaagcggtttaccgatgaagaaacgttttaactgctgcatgataaaatactccttttcgtgagtacgcaaaaacacacctgttttccacgtttacgcctagctgtgcaacaaccagacagctcacgactccaaatcattttatttctttatttaattacgacagaagtcattttacgccatttgcgcagatgattctacctaaatctaaaatatgtatgtgtcaagtctttctcggttccactaattgaactattcttttttgctcgactgccggccaggacgacctccacaggaattggcgtggaacggggtgggcacgactttgagcctcgctttgcgagtctcaaagctcggcctctgtgtaggcgataaatcgccaacacagacgtcacccctgacgccattcctgctccggtcatcctggactactgagtgggttcagttgaagatgtgtgctaggtgaccagtgcccgaactagtacttgcgtacagcgctatacgtccctgataagcaccctggtgcgttgtgggcgctggcccaaacagctgaaggctccgaagcgtggtcttcacttctggcttgatttgcgtttccagaaacgccgtagcttccagactgctgaggtaatcatcgttctgcagcgcgtcaatgatcctcaactctgcgatcagaccacttcttgtccatgaacgg

SEQ ID NO: 554 - DNA, 44996 bp, Unknown
  Metagenome-assembled genome
tagccgatcatacttagttccgagctagaattaacttaatttttggtcaggggcacgtgactaacattaaaatagcagatttaacggttaccaacacggaatttttgttagtatgaataattcaggttaaaggttattttttatttgaatgtacatgattattgtttacagcaacaattaaagtaacttccataaaaccaagtcaattagaacgtgataaattataatcaacaatccattttagagttattctttattcgtgtcattagtatctataatggcaatcaaaacaaattttatattttctgaaattataaaaaacctacctagaaataattattccaggtaggttttcaatgttttatattggtggttttattttttaaatattaaagttaaagtaacttttttattattaagccaagtaaaacaaatcttggcctgttcatttgtcagttctagtgcacacgtttaccccaaaattggaataaatcagtccgtaatgccccgttatacaatttacgccgtttcgtcgctttttcaccgtaataagtttcaaattgtaaatcactggttaaaatatatttactccaactagtcaacggccgatacacatcacccatttgctgatacagctgatggacgctgctagcatcacttaatcgttccccgtacggcggattagcaacgatcaccccgttatgtttatccgttcggaagtccttcacggctaattgtttaaaatcaatgtcgtgcaaaacgccggcttcatttgcatttaaacgggcaatttcaatcatgctaccatcgatatcggcgcccatgatatctaaaacaacatcgtcacggcgtgcagccgcagcttcagcacgttgatcagctactaattcagcgggcacccaatcccagccttcaaaagaaaaagcacgcttcaaccctggcgcgatatttaagccttttaacgcagcttcaattggaatcgtacccgaaccgcaaactggatctaagaatggcatatccgtgtgccaattagtaatggcaactaaagcggccgccatattttcttttagcggtgcgtcacccttttctacccgataacctcgcttaaataagctagggccagttgtatccaaggtcaacatcacgtgatcctttagaatactaacttccaaagcgaataaggccccagtttcaggtaaacggccccgacgatgataaacttgactcattttttccacgatcgctttttttgtcaaccgttgtacatcaggtacactgtacagcttggacttgattgaacgaccagcgactggaaattcggcatccaacggtaaataatcgtcccacggtaaagccttaacttgttcaaacaaatcgtcaaacgtaagtgctttaaactcacctacgacgattttgatccgatcagcagtacgtaaccacaagttagtccgaatgatgtccttaatatccccagtgaagcggatccgaccgttttccgtttgaccatggtagcctaaagtctttaactcattggctgctagcgcttcaattccgctggcagttgttgcaatcaaattatatgttgtcatttgttctcctcatttaccctttattttatatttaaatgtttcaaatagactctcaaaaaaaagaccctccaccgaaatgaagggtctcctgataaggtgtaaacctctgtaagccatgttttgtctcactgattggctcaggaacacaaccagtgagggcaatcatctatctacagacactagatctgtctccatgcgtcgttcatttccatacatggagcgcccctaccataagtttgggttactcgctcgcggggtttacccgttccaaacagttcgtttccaaactgtatcgtcactgtggcacttttcaggatattaattgcatagattgctccttagcaacgttctccgccgttactggttacccagtaccttagcttattgggctaagcacgaacactacaagcatcgcagcttgtgcgggcatggactttcctcagcctacaaaagtagaccgcgatcacccgaagtttacaccggttaattaactatttaacttgcgtggaccatcttggttgctgtcatctagcttagcaccaaatacgtgccgttcaagattcgacagccgcttcaagatatcaaagttagttaccgttggattaggttgcgcactttgaacatttttgttcaccgtaacctgtttggttaactcatcgttacgtgaccgtaagcgctgattattaccagctagctcatcaattttggcatcatatgcctcataatccttgatcacttgatctagaaattcatcaacttcagccggatcgtaaccccgcatcttagttttgaattctttctggagaatatcctgagttgtaaaatttaaattatccattccaatacacctcattgcacgttgtcattaacatgactgttaatagtatagcaaagtttattccgcttgaaaaccattttcttgatcttcttgataattatttgccatatcttgtaaatcatcaaagtcgagcaagcttaattcgtaatcatgttgcgcttgatatcgccggattgcctcaactgtatagtgagttttacccggcgctgtttcatcatataatactaacgcaccatctgtgtgcgtcaacatgaattcttgataatttcttaattgtttaggcgaatgatagggtttatcgctgacggcagcagaaaaatcgacttggctgcgcaacacttctagcgccgtttggttcgtctcattccaattcttgccaaaatcagcaaacggcagcatcattgccgtctgtagttctggataatctttttttaattcggtggcgacttctaggccccactgctcagttcctaattgtccaccgctgatcacccaagccaaatgttgctcaaaatgggcaattatttcagcccgtaacgcggctttaataatttttaactttggttcgttagcgctgaaaacgccgagttcataactacggtaacctgttacccataaccgcataagcatcccttcttaattttattccaaaaaaacttagtaattgctataataaaggcttaggagtgtgatcatatgccgttgcattatccaaatggcaacctctaccacaatgatgccaaagcgcagccaaaaaagcaaatggcacgcagccaaacacgctttgataaccggggcatgtcattagaagaggaaattaatgaaagtaaccaattttatcgtgctcacgatattgcagtcgtctataaaaagccgctgccattacagatcgttaaagttgattatcccaaacgtagcgccgcagtaatcaaagaggcttactttcgccaaccatcgactactgactataatggtgtgtaccgaggctattatcttgactttgaagctaaggaaactaaaaataaagccagcttcccgctgaaaaactttcatcagcaccagattgaacacatgcgccattgtttgcgccaagcggggatctgttttgttattatgcgttttgttagcttaaatcgtttattcgtttatccggcatcaccattgattgcacattgggatcaacaaaacactggtggccgcaaatctattctattaactgatatcgaaaccaatggctttgaagtgcattacgctttaaaaccacggatcccttatctgacggcaatcgatcaattcattgccacgttaactattgaaaaaggagatcatcatggccaataataatcaatcacgcgttgcccgacatcaaaatggagcaaagaaaccaaaaaagcgccatccgattcggcgcatttttctctggctattagccctatttgtagttatcttagttgccggaggtggtttattcacctactacgcaatgagcgcccctaaggtgacgcaagcacagctttctagtcaatcctcttcagtgatttacgatagctctggcaacaaaattcgcaccttagggctcgaaaatcggagttatgcttccggcaatgaaattccgcaaactttaaaggatgcaatcgtctcaatcgaagaccgccgtttctattctaactttgggatcgatcctgtccggatactgggggctgcctactctaattttactggtagttctggtttgcagggcgggagtactttgacacagcaattggtgaagctggctgtcttctccactaaaaagtcagatcagaccttaaagcgtaaggcacaagaagcttggttagcaatcaaagtcgatcgttcttactccaagaatcagatcttagagttttacgtcaataaagtgccattagctaacggtgtctatggtatgggtaccgccgctcattattactataacaagtcactaaaagaattggacttagctcaattagcgctgatcgccgggatgccgcaagcccctaatacttacgatccttacactaacccatcagcagctaaagcacggcgtgaccttgttttacaggcaatggtaaccaacaaaaaaatcactagtcaacaagcaaaacaagctgcagcagtaccgatcaccgagggcttagtcgatcaacaaaagcaaactaatacggatactgataacgtcactgacgcctatatcagtcaggttgtcgctgaagtcaaaaagaaaactgggttaaatccttatactgatggcttaaagatctatacaaacctaaacatgaaagttcaaaaacgactttacgatattgttaacacggataactatgttagtttcccagacgatctattacaaactggggttacgatgaccgacgttaaaaccggtaaagtcacggcgatgatcggtggccgtaaaacgggtaacgttcagtttgggcttaatcgcgcggttcaaactagtcgtagtagtggctcgacaatcaagccattacttgactacggtcccgcaattgagtacttgaattattcaacctaccaacaaatggaggataccaagtacacttatgccggtacttcaacgcaattatatgattgggactttgaatacatgggtcgaatctcactccgaactgctttagcgcaatcacgtaacgttcctgcagtccgtactttagataaagttggcttaactaaagccacgcaatttatcaacggtttgggcattacattcgcaaaaccgttagagttacaaaatgggatcggtgctgatgtctctagtttacaagaagctgccggttacgctgcttttgccaacggtggcacctactacaagccatatttgatcaataaggtggaaaagccagacggaacgagtgaaacctttgatccacaaggtaaacgcgctatgaagtcctccaccgcctacatgatcactgatgttttaaaagatgttatctctagtggtactgggacaagtgcacaaatcagcggattacatcaagcaggtaaaactgggactaccaattactccgatgatgaattaaataatagtacgagcatctctagcagtatggctaaggattcttggttcactggttactcaaaggattacgcgatctcagtttggactggctatgatcaaccgcaacaacatggattgacttcgactgagcaacaagttgccgccaatatttatcgtgagttaatgcagtacgcaaatacagaaacaaacgcaagtggtggtaattggactaagccaagtagcgtggttgcggccaatattcttaagggctcgaatccagcacagttggcggctagtggcgcttcaagtagtcaggtcactcgtgaactatttgttcggggaacacagccgactactgtagctagcagcactacttctagcagacgtaaaacgtcaaccagtagttcaagtatttctagcagtagttcaagcttagctagcagcagtttcagttcagcggtcagcagcgcttccagctcagcaattgaacaatcatcaagtcaagttagtcaaagtagtagctcagcagctagtcaaagtaccaataacggtcaatcaaacgctaatactgcaacaacagatactagcgcaaatcagaatacgaccaacagttcgaacacacaaacacctagtagtaatactggtagttaaatcaaataactaaaaaagcctgacgcggctacgattaatttcgtaatctacgtcagactttttttagttatttttttaatcctaaccgccgttgaccatcagcgcacatactcaataacggacactgttcacatttaggcgcccgagctaaacaatgataacggccaaagtagatcatccgatgatgggcagtgacccatagatcttccggtaataacttcatcatccgttgctcaatttccaacaccgttgctttttgtgggaccatccgtaatcgtttcgtcacccgtgtcacatgagtatcgaccgcaaacgctggaatcccaaaagcgtccgccagaacgacgtcagccgttttgcgcccgaccccaggtaattgcattagttccgctctagtcgatggcacaacgccgttaaaatcgtctaacagcgcttggctggctgccttcatatgttttgctttatttcgatacaagccaatactatgaatatctgcctgtaaagcagtttcgctagctgccgccatcgcttgtggatcaggaaaatctctgaataatttaggggtcactttattgaccgaaatatctgttgcctgtgcacttaacattaccgagatcatatattggaatggtgttcgtgcatctaatgatggctgggcgttaggaaacatcttacccataatttcaaccgcttgttgtgtttgcttttttgataacatccccagtgactcctttctacttcaccattcaggctattaatcagccaaaaccgctaattaatttggcggttttggacgatgctgagcttgccgttgttcggcttagtccaatcggcaacgggcaatccaacgctgcttaaaaatgaacacccaccacttatacttgctaaacagtgtgactatcaacgagcgccagtaaccatttttgtagccaaagcttaccgcaagaatgccatttagttactgcttatcatcatcgtcaggctccgcccaattatacatcgggatctgcggaatatcctcagtggatgattgcgccgccgcaccggaactaggttgacgttgttgccgcttttcctgttctcgttggatctgttgcttagtggtcaagtgtttacgttcccaacttaacaaaatacgatccatgtatttcaaactataagcttgattcaaaactgcttcgcgcaatgctaacccgatcacatctgcttgataatgatcttggtctagccaagccgcaatggtttcgtattcaatcggtgatagcggccgaccaaactcggtttcgatctgctcaaataatgcttgccgctgatcggatgatttttgttcgacaacttgccgattttgttgactcaaataagtcgctaatttgcgatacatcaacgcaaaatcgtattgatcctgactacgaccctgtttatcctgagtcgtatcgatcgtcaagatcttcttttggatcatgcggtgaatgatctgataaacctgagtactagaaagccgcagtcgctgagcaatcgtagccatatctggaaaatggttcccagcgtcatagaaactctttaattctaaataaaccaaaaactcatcattggtgatgcctaattcatgaaaatgcgccagcaacaaactggaaacagttgtctgtcccgcattaataaattgctgcataaaggtatcgtccatattgccatccttttcttaaatataaaaagagtgccgcaattgaacccagctagccgtccacttgcctgacactctttttatagcgcttatgggtaaatccggtttaacaaacgtgggaacggaattgtttcccgcacgtgatcaacaccacagatccaagtcaaagcccgttctagaccaagaccaaaaccagaatgcggcacactaccatatttacggagatctagataccaactatattcttttggatctaacccagcttttttgacctgctccaacaaataattatagtccgttgcccgttcactaccaccgatgatttcaccataaccttctggtgccaataaatcagcacagatcaccacgtcatcacgggttggatgtggtttcatgtaaaacggtttgatcttctttggataatttaaaacaaacacaggttgctcaaactggtcagccaagaaggtttcttctggtgaaccaaagtcaacgccccattcaacatcaaaattatttttttgtaacatcgcaactgcatcatcgtaactgatccgttggtaaggtaatttagtatagcgttttaagacttccttatcccgttccaacagatccagttcataatcacagtgatccaatacattttgaactaagtaagccacatattcttcttgaatctttagactttcttcttgatgcataaaggccatttctggttctagcatccagaattcgatcaaatggcgccgtgttttcgattcttcagctcggaaagttggcccaaaggtaaagaccttatcaaaagctaaggcaccggcttcggcgtataactggccactttgtgatagatatgcatcacgaccaaaatattcagtgtggaataattcagtcgtgccttctggcgcactgccagttaaaattggcgcatccattttaatgaaaccccgcgcattaaagaattcgtaactagctcggatcacttcgttacgaatcttcatgatggcaaaaggccgccgtgaacgtaaccataaatgacgatggtctaacagaaaatcgattccgtgttcctttggtgtgatcggataaccttcactttcaccaacaagctctagatttgagatctcaatttcataaccaaacttagaacgtgtatcttgatggatcgtaccgtacacccacatacttgcttcctgatgcatttgcttagccagttggaagatttcctcactgacagcacttttaactaaaacaccttggaaaaaggccgtcccatcacgtaattgtaaaaaggcaattttgccgctggaacgtttgtcggtcaaccaagcaccgattttgacttcttcatcgacatgatttttggcatcaatgatattaatttgttgaaccattaaaaaatttcccctatctcacttatttagctatttttactaaagtaaaaatcacttattgctgcttttaagcttccatattacctttagtttgaatgaaatcagcaatacgctgataagcttctgctagtgaatctaagtcattagcgtagctgatccgaatatgatcaggctgaccaaaggcgcgccctggcacaactgctacgtatgcttcttccaacaatgcattcacaaaatcttcggtagttgaatagccacatagctcaactgcacgcttaacattcgggaacaaataaaatgccccttgcggcttatccgctaattcaaatcctggtagactttgaatctttgggaataagtaatttaaacgcttttcaaaagcttgacgcatagtttcagcatccgtttgctcaccactcaaagccgcaatcgttgcgtattggctaaccgcagttggattaccagtagcatggctagcaaccgtcgtcatcgccttaatgatcgccgcatcgcctaaaacataacccatccgccaaccagtcatcgcataggttttcgacacaccagtcaccaataaagtatttttacggatagcatcacttaaactaacgacagaagtaaactgatttccattataaactagattactgtagatctcatctgagattagcaaaacatcatgtgaaaccgcccaattaccgattgcggtcaattctgccgctgtatagatcaaaccagaaggattttgtggtgagttcaaaacaactgcctgtgtttttggcgagtatgctttttccagatcctcgaccgttactttatgtcccgccccagtcgttttaacggctaacggacgaccaccggctaaattaacttgctcagcataactgacccaaaatggtgctggcaataaaacttcgtcaccaggattcaagataacttgaaaaatcagatataacgcaaactttgcccccgtcgttgcgataatctgtttgttatcataatgaacaccagtttcagcttcaatccgctgactgatcgccgtttttaattctggcaagccaccagctggtgtatagaaactagttttgccggaacgaattgctgcgattgctgcatcctgaatatacgttggtgtaacaaaatcaggttcaccaatcgataaattgatgacatcaacacccttagcaatcatttccttagtcttagccgacatcgccagtgttgcggatggttgcaccttcattacatttttcgataatgccatatgaccactctcctgaagctatatatttttgatcaacttaactgatttaccagtcttaaaagctaacgtttggtaaccaagcttgccattttcatcagcaaacgaaacttcccagactggcttattgtgataaagtcctaaggttgcattataaaccttttttggtgcttgtgtccgccaaacgcgtttcaaggctgtattgcgggaaatccctgcactttgatcaagcaccgttatcttgccacccttttgggcaatgatcacaaataccgctttatgctgcttggtttgtcccgccacggtcaaatagctatgtttgcgattaaaccaataaaaatcatccaccgtcgtgacgtgcgcatatttctcagctaaagaaacagcttcgcgccgggccgtcactgcaggcttattagcggcatgataaatgagtaacgcactgacaatgatcaataaaatcacgccaattaaactatatgatttccaatgttttcgcatgatttcccctctacttcacgatcaaggtaacttattagcaaaaagcactaataagtttcgatgttacggacgatgaccattctgttaacgaattggaccataaaacctacgcacaattattatagcagattttacaataacatttggctagaaaaatttaaactttccttgcaaaaaattcgtcagttgccgctgcaacttccactaagctagccgttgatttaggcagtgatgccggtaaggttttcagcatccgcttgccataggcggtggtgacgatgcgatcatccaatacgatcatcacaccgcgatcagcactggtacgaattaaacgaccaaaaccttgatgcaaacgcaaagtcgccttaggtaaagcttccttgaagaacggatttaacttagccgccgtcaattgacggtagcgtgccttggtcaaaataccatctggtgcttcaaacggcagccgcgcaacgatcaattgctccaaagcttccttcggtagatcgatgccttcccaaaaactaccagtacctaaaagaatgccgcggtgacttaaactaaatcgcttggtgatccgttccttactaccagtcatcccttgggcaaaaatctcccggtgtaacggtaaatcagtctgcatcaacgcccgataaacttcagcgatcatctgcaaggaattgaatagaaccaaagtttgccgttgattgtcttgggtgagttgataaatcgcccgcgccacataattggtataagcgtggtcagcagcaccacgaattgccggaccatcgttgaccacgaaaaaggcagcctgtcgtttataacgaaacggactggcaaaccgcttttcaattacagcaacatccgctaatcccatctgttgcttgaaatagtcaaatttatgggcaacagtcaacgtcgccccagtgaaaactggcgcagtaaagtgctgacacatagtttcgacaagcggtgtaatatccaactggcttagttgtaaagtcaaactagccggatcaccgtaatctttagacgtcaaccaaactaatcgtccaccatcaggttgtgctaactgtgtaaacacctcgcgtagcaacgtacgtacctgcaatagttcctggatctgttggttaaaatcaagccacaacttttgctcactaactaaccagctagcttgttcatttaataggcgctgacttaatttgtcagctagtaacaaacaatcgttgagtaagcgccgtaatttttgtccagcaccttgattagcttgaacccaatcagctaattcggcttcatctagtgaacgttcaatatagccattacgttgctccgccggaatctgttcaaagataaaatcagcatgtaattgattttgtaactgcaataataactgactaaactcatttaaaccataatccagtgagatcacattgtaacgggctactggatcgtccgctagcaaaccagctaatgacggctgaccttcaactcccatcaaggatttgtgtaggcgtttgatcaactgcatgatcgccccaccaataatctgtttactgctagcttttaaagccgcatcgggaaattgctgggcttcatcaactactaaatagcttcctgcagggaaaaagtgatcatccgcgacatgctgacttaaaaaggcgtgatttgtcaccagcacgtctgccttggcctgctgtttacgcgccgccaaccagaaatcatcagcggcaaagggatcatctttactgattacttcatgactatgatgactgatctccgcaaataacggtgaatgatacgttgtcaaatgcagttccgcaaaatcaccagttttagtcatggtcaaccaaactagcagttgcatttttaacagttgaatctgcttaactttatcggcaacggccaacgattggctaaacttagccagatcaatgtaatgttgtgggctttttacgattgccgcttgcaaatcaatatcgagtaattgattgagcaacggaacggtttgctggacaaattgggtctgtaaaaccgctgttgaggtgctgaccactaactgccgctgcccttgcaggcgaaaactaaacggcaataaatagcccaacgacttacctaagccggtggcggcttcaaggatcatcggctgcggatcggccgcataattagcgtagatcatgtccatcatttttccttgcgtcttgcgccacttcagtaatggctgcaaataatgctttttggcggcatcagtcgcggggtattctttctcggccgtcgtcaaacgcgttgttgaaactgactttttgcgcaaagctaacccatgactgacatataaatagtccggtaatggctgatcattgggctgcgcttgaacggcaaaatacgcgccggtttcccgggctgagcgcgtggcacatttagccaaagcttgtcgcgtgactaaaggcaaattcgccaaacgctgactcaacgcaataaataattgtgccgtcacggcagcatcgctatcagcctgatgaggattggtgtgttcgatcgccaataactgagtcagatcactaagacgataactgatcgccgtcggcaataaaatttgcgctagctcaaccgtatcaattgccgctaactgcagtgctggttgaccgacacgctgtaattcagcatctaaaaatggatagtcaaaattaacattatgggcaacaaaaactttatcctgtaacaactgactgattgtcgcggccacatcttcaaagtacggtgctgcttttaaccgtttattcgtcagatgagtcagctgcaaaatatttgccggcacctcacgctcaggattaatatctaacgcgatctgatcgatcattttaccatgttggactaaggcacagccaaactggatgatccgatccccgtctttaacgctggttccggtggtttctaaatcgacgatggcgtagatcgagtctttattcatgatcgtcatctggtctcttttctttaaatttactaaggaattaacgttggcgcacttttagcatttatcgctagacgcccactaaaacaactaataaaaatagtagcattttccggccgctacggcaatctacgactgtatgatcatttaaatttttatgtaagctatttcatctctgtacaactagtatttactttattcacgacaatgtataaactattgatgagcactaagctaaaaatcgcaatcagctagcacggaaacactaaagctatagtgatcgccgcaagcggcataatacttaaaaatatagaaaagagtggcgcaatgacattagaacaaggcatcggtgtgagcaacgccaaaattattttgattggggagcacgctgccgtttatggtaaaccggcgatcgtcgtgcccttgaccgcagtcaaattaactgccgttacgaccccaatcgcacaaggccaattaattgaaagtaaatattatacgggtccgttagcaaaagcaattaaaagctttgctggaatcaaaaagttgattcaaaccattttagaacggttcaatcagcagcaagctaactttaaactcaccatcaccagtcagatcccggctgaacgggggatggggtcttctgcagcgacagcagtggcggtcacccgaagtttatacgatttttttgacaaaaaattaaatcgcgctaccttattagaactagctaacgttgctgagacggtcacccatggtgcgcctagtggcatggacgctgccactaccagttcaacggcgcccatttggttcgtcaaaggccacgctagctacaatctgccgatcaatttaaagggcaacttagtgatcgccgatagcggcattcgcgggcaaactggccctgccgtaagaaccgtgcgtgagcgaatggctgattttccgcaagaaaccagcgtctttatggatcaattagctgaattagcgctatcgacccgtaaagcaatcgcgtcgcaacaactcgctcaagtgggccaaaacttcacgaccgcccaattgattttacaaacgttaggcgttagtaacgaaaccatcgatcatttggtttttgtcgcccaacgcaacggtagcttaggcactaaattaactggcggcggccgcggtggctgcatcatcgctttgaccgctgaccaagccaataccgaccgcctattagccgccttagctgctgaaggtgtcacccaaacttgggtccaacccttggcgcaccttaatcaaactattaatcaggagtatgatcatgactaaagcaatcaccgcccgcgcacataccaatatcgccttgatcaagtattggggcaaactcgatgccgatttgatcatcccacaaaatagcagcctatcgctgactttagcgccattttacacggatacgaccgtgcaattttcacctgaattgtcccacgaccaaatcaagatcgatggccaattactgagcacagctgccggccaacgggttcacaccttccttgacttagtccgccaacgtgctgtcctgaccgcctttgcccaggtcgattcaaccaatcatgtgcctacggctgcagggttggcttcgtcagcgtctggctttgctgccttagcggctgccgccagtaaagctgctggcttagaattaagcttgcctgaattgtcccgtttggcccgccgcggctctggctcagcgacgcgctccatttatgggggctttgttgaatggcaaaaaggccacgatgatctagattcacaggcggtcccttttcaagaaaaaattgatttcgatattcaaatgatcgccatcttattggatccacggccgaaaaaagtcgctagtcgtgccgggatggcgcaagtcgtggccacgtcaccttattatgcggcctggccaccgactgcggaacaagatctgatcgccatgaaagccgcaattcttaaaaaagatttaaatttaatcggacaattagctgaagctaacgcaatgaagatgcacgccaccacgcttagtgccaacccacctttcacttattttgaaccagaaactttgaccgctattgaattagtgcagaacttgcgcaataatggggtttcttgttattatactatggatgcgggtccgaacgtgaaagtcatctgttcggccaaggagacgcccgcgatcctcgcgcaactccagcagcactttcccgccgatcacttattggtggctaagcctggccctggggtcacgtacatttaaacaaaagtggtgccaatcaaggttggcaccactagggacgaatgcgtgtaccaacttgtgcacgccccttatctattgttgtggttgaaaggaaatgattgtttgataacggctcaggcccctggcaagctatatattgcgggtgaatacgcagttgtggaaactggtttacccgctgttattgtcgcattaaatcaatttgtgacagtcagtattgaaaaaagcgccgattatggtagtattatgtccaagcaatatcaggaaaactcattgtattggtcacgtcaaggtgatgaaatggtttttgataaccgggacaatccatttcattacattctttcggcaattcgcttaactgaaaaatatgcgttggaggctggtaagcgactttctctgtaccatttgcggatcaacagcgagcttgattcagctgatgggaaaaaatacgggttaggcagttccgcggcggtgaccgtggcaacgatcaaagccttactcgcttactatgagctacccttaagcaaagataaactttataaattagcggcgatcgcccatttggacgtccaaggtaatggctcattaggcgatatcgccgccagcgtttatggcggttggatcgcctatcaagcctttgaccacgattggctacaagccattcgccgtgaatcaagtttgacggaattgttagccttgaaatggccacagttgaatatcgaactactgacaccgccagctaatctacaattgatgatcggttggacgggctcgccggcttcgacctcacaattagttgatcggatcacgatcgccaaggccaaaaaacgcgctgactaccaaaacttcttggaacaaagcgccgcgtgccttcaaacgatgatcaatgggtttaaacaaaaaaacttagccgtgatccaagcacagatcaagcgcaatcgcgaactgttacagcaattaagcgactttagtcaggtgtcgatcgaaacacctttattacggaaaatgtgcgatctggctgaagaatttggcggcgccgctaaatcttctggtgctggtggtggtgactgtggtattgccattctggatgccgcccttcccacccatcagttagccgctgattgggagcaaaacggcattgaacgtttggctttagccgtccacaacgtcacattatagcgaaaaaccgccaggcactgacttggcggtttttctttggtaaacggcgctgctttctgatctaaattatcctgagttgtgaagtagaggaggcctttaaaatgacaaaactatccgcccacgcccaccgcaaagatgaacatgtctttttagctgaaaaattttatcattcggaccacaatgactttgaccaagtgcgatttatccaccaaagtttaccggagatcactttggctgaagttgacttaagtagtcagctagctgggcaagcgatcgcggtgccattttatatcaacgcgatgaccggcggcagcccgcggacccaagtcttgaatcagcaattagcaacgattgccgcggagctcaagattccgctagccaccggctcacaaagtgtggcgttaaaagaacctgctttagcaccgagctttgaaattgttcgccaaactgatccaactggtgtgatcctggctaatttaggcgccgatgcaaccttagcgcaagctgagcaagcaattgagatgttacaagctaatgccttacagctccatctaaataccccgcaagaaatcgtgatgcctgaaggtgaacaacgcttttattggttggataacttagccacgctggtcgccaagacaacggtgccggtaatcgtcaaggaagtcggcttcggtatgagtcaagccacgttggcccagttagcggcgatcggcgtgcagtacgttgatctcggtggccgtgatgggacgaattttgttgaaatcgaaaatgcccgccggccacaacgtgagctggactatttagctggctggggccaatccaccgtcgagtcactgctagaaagtcgcgcataccagcaacaactcacgatttatgcctctggcggcgtgcgacaaccgctggacatcatcacggccctcgccttaggggcgcaagccgtgggcgttgccgggactattctacatcacttgcaaaaagacggcatggcggccacaacgaacttattgcggggctggatcgaacaattgcgggcaatctgcgccctacttggctgccgcacgattagtgaattaccgcaaaaggccgaattgattttcagccccgaactgttaagctacatgcagcaacggcaaataaaatggtgacccaaatagcgagtgtggcataaggcgctcagttttttccgcttagctatattgttcggaagtagaaaataggcgtttgacatcaattacagatgtcaaacgcctatttaatttctgaacaatatcatcaaatcacctgatacacgctattccgtcacatccgcgacaaagcgcaggcctttggggaagaaattcttcattgtcgtaccagttagcttgccaaagccgactgatttatcttggtaacgcaataaataccagcccttgccggtagcgtctgtagtaaaggtttcgccgtgaacgtacttaacgtattgagccgtcgttaaatctaattgttgtggggccgacgctaacgtcaacgccaaggcgtaagccggctcaaagcgattgcgtttaaactcacctaatggcaagccggggcgaacgacttttaacccttttaactccacggccagtggttgggcaaataaatgatcacggtgcaccaataaatgaccaaaacttgttgttggtagcatagttttagcaaaatcttgccacaatggttgctgttccttattcagcgcgggtgcagcgtgtttacgctgctttttagtcttacttggtgctgcaactgggccatccgccaagcgtaatttagccatgaaatggccttcaccgttaaataaatgcgggaagagacgcaaggtccctgccaacgcaggattaccatccgcccattctggccggcctgcactcatcccagcttgtcgtgcgatcggcaccacgcttagtggatactgttccagtaaccaggcgatgatctgctcgtcttcttctgggctaaaagtacaagttgaatagatcaactcaccaccaggccgtagcattttcagtgtttcggttaggatctcacgttgccgctgagcacaggcagccggataatcgggcgtccagtattgcttagccccaggatctttacgaaacataccttcaccagaacaaggcgcatcaactaaaatacggtcaaaataacctacaaactttttagccagtcgtgcgggagtctcattagtgatcaccgcactttcgataccaaaacgttccacattttcggctaaaattttggcgcgtttaggcatgatctcattggcgactaagagaccttgttgttgcataaaaccagctaaatgcgtcgttttaccacctggtgccgcacatagatccaacacgcgttcaccaggtttaggcgctgccactgccccgactaacatcgcacttggctcctggctgtaaacataaccagcctgatgatcaacttgacgcccattaactgcgccataataaccccactgcgtcattggcaccggctgggtcaaatctaaattaactgcctgcggattgggctttaatggattgatacgaaaccctttatagccctgattctgaaaactagccaaaaatggtgcagcctctgcgcctaataattgttgatatttttcggtaaatccttctggtaacaaactttttccccttttcgtctaacgtactggtaatcgctttaaggtatgccgcaaacgtaacgcataatataaggcgcaaatcagataattaatcactaacaaaactgttaataggtcatactgcaaaatatataatcgccaagcaccgactaacccgccaagaatgatggcaactagtgaccataccgcaaaatgccgcaattcccgccagtagaaagcaaccgcatcatcagtgtaaaagctggcagtttttaacatccgccgcgccaaaactaaccataattcagctacaccaacaaacaaagccacgatcaggatcaaagctccaccaaaccaccaatattcctgcaaccaagcaagaccaacaaatggtgtactttgcggcactaagtgcttaactgaagtcgcgtgaaataaatgtttaaacgtggtcaaatgagccagttttggttttccatctaagcgaatatcaaaattacgcaaagctttggtactcaaactttgctgtgttgaagtcgaaataaagatcatatcgtctaattgactgtctttttttgtccctaccacaccaatcaccgacaaataacggtcaccatatttaagataactttgattggtcggagtatataacttctgcgcaacattttggcccaccaccgctactggcactggcgaagtaaagtcactgtcactgaaaaagcggcccgaaactaacggcaaagtcttaaaattaccggcaccgtacataaaaattgtatgtgaatgtggccgccggtattgaacttggtagtcagttaatttagttttggcagctaattgctggttagccgccacgatcgtttggttactttttgtctcgatcacttgcgcgttggtcgataaacctgcatgatccaacaaatcttgataaacgactcgattcatctgactaaaaaagaatacacctaaaaaagcgacaagcgctagcaatgcgaccaaaagcgatttacgttttaacaagtcatgttcacctatttcatgataattatttaattacaagcatatacggccagccaccgaatgtctagcgtatccaaaataactgttcctgcactaagtctaaggttggaaaatagctgttcaaagtagcgacttgctcattttgttgaaaataggcgtgttgccaaaacgcggcactattggtacagccgttacgttcaccaatacataacagtggaatctgtggcgtatcctgccgcattaattgcaataattgccaatcgatgggcacaccatcagggctccaaaccatcaaaacataatcgatctggtggcggtatttccggtaagccgctaaagcatctaactgttcgatcggcgtcaattgttgcttgccggtttcattttcggcgacccaacccagactatcagttgcataaacttgctgcttaaactggcgtaaaccataactcaaataaccgttacccgccattacttcaaggtaacggttacccggtaagcgcgcgattgcggctgctgcagcttgggtaatttgtccccaaaagccaaattcatcctgtaggaatccacgatagtcctgtagacagcgatccaagcgctgaaattctgccgctgattgtgtaaaatcctgttgcggttgcgcaagtgcccattcgactaaaactgcttccggtaaaattaaattaggcaatcgctggggtaacttcccctgggctaaccgcataatattacggtgaataccatctaaccgttgcgtggctgctggtaacgttgcaaaacgctgcctcagtatttcgacttcctgaacatacttgcttgaacttacatcctgcacacgtgcaccccttttctgtatagaatgtacttgccacttcttcacgaaaaaaaagagtcagacaattgcttgtcccactctccttaactatgtttaacgaatccctaatgcgatccgtgcgtaacgactcattttatcaactgaccaagctggataccaaactaattcaacctcaacgtccttaacttcagggacttcacttaacgcctgattgatctgttcattcaatagatcagatagtggacagcccattgttgttaaggtcatcttaatgtggcataacccttcttcgttcaaatcaacaccatagatcaaaccaaggttaacaatatcgatacctaattcaggatcaatgaccgattccaatgccgttaaaatattatcacgaacggcatcaacttcaacgtcttcctcagttggggcaacatctttttcaatttcactcacaggactcacctcttttgctttccctcattatacttaaaaaaaggcaattaagcaatcataaatgagaagggctttcatttacgtcaagatgggccatgtccgcataagtttcacgcttgatcaccagccgggcttgaccgttttcgacaaagaccaccgccggccgtggattgcgattgtagttgctggccatcgagtaaccgtaggcgccagtcacaaacatcgccagcacatcgccgggtttactttgcggtaacggtaggtcccaaaccaacatatcgcctgactcacaatacttaccggcgatcgaaacggtttctgctggttctgcttcgggcgcgttggctaagacggccgtgtattttgcttcataaagtgctggccgaatattatcgcccataccgccatcgacggctaaataatggcggataccaggaagatctttacgtgcgccgatcgtatataacgatgttcccgcttcagcgaccattgagcgtcctggttcgatccaaatttctggtaacggcaattgagccgcggccgcttggtccttaaccaccttaacgatatcacgcacatagtcctgcggtgctagcggctgatcttcagcggtgtagcgcacgccgaagccgccacctaggttcaacacttgcgcggtgaaaccttgttgctgccactgggccaataaagcgatcatcgcttccgccgccatttcaaaccctttagtctcaaaaatttgtgagccgatatgacagtggaccccgcggagattcagccgtggtaaggcttgaactttctcaaaagcggtcgttgctcggccactcttcaggtcaaagccaaatttagaatcttcttgacccgtcatgatgtattcatgcgtgtgagctgagatccctggtgagatccgcaacagcacatcgattgttttgtcttgggtcgttaaaatgtcgttcaacaagtcgatctcatggaaattatcgagtatgatcgtaccaacacctgcggtaacggcatattccagttccgccgctgacttattattgccgtggaaggacgcggtcgccagcgggaagccggcttgttgcgccgtgtagatctcgccgccagaaacgacatcacaaccaacaccttgttctgccaataattggtacatcgcgatcgcagtgaaagctttactagcgtaggtcactttgtaagccacgccggctgcttcaaacacttgtttaaattcagcgatccgttgtttgatcaaagccacatcataaaccactaatggtgtgccatattcatgagccagttcaagtgtatccaccccgccaatactcaagtgcccggcttgattggtcgtttgggtgccatattgatagtaacgcaaaacatcccctgctttcattttttatcgtgtacgcaagtcaaatgatctagtgctcagccgcgtaggtccctttaaccagtgcctacccagcctagcaaaaacggcgaccactaggtgtcaccgtttacttatctatactatttagcacctttttctttaccggcaacaaaataatgatcatgcggcatttcatttaagacgatatggatatcatcggcgggcacgttggcgtttttggcgatcgccgttgtgacgtcagccgccatttgtttcaattgttctggtgtccgaccagctaatagatcgatgtggactaatggcaaattgatcacttctcttcatttaaatttaatctctaaaacatatttagaaaataccgttaagttagtttggtataaacctggttgaaaaagcatatttttcaacacaccctaaattataccgaacttttaggcgtttctgcaagttgacttttacggtcttcatccaaaaattcacctaaaacttgggtggtgtttaaaatattgacaaaagccgcgggatcaacggttttaactgcttgttcaatatcgtatagctcgtagcgggtgatcacgatcatcagcacgttgctgtctttttgcgtgtaagcgccgcgggccggtaaaatcgtgatgccgcggatcaagcgttcgtgaatggctttgatcaaggcggtcgatcgttgagtcacgatcatcaccgttactttttgctggctagtattgatactatcgatcacccgcgacatgcagtaaatggaaatgatcgtgtacaaggcgctggaccaactgatggtaaagccggcgatcaccacgatcaagccgttgatcgccatcatcagcgtaccgatacttttaccagtcgtcttcgccaaagcaaaggcgacgatatccatcccgccggtggaaaagccgtatttcaaggcgtaaccgacgccaatcccggtcaagacgccgccgatgatcgcattcatcaagggattagctgataaggcgtggatcggcaagcctaccgacagcagcgacgttagtaccgccgttaaaatgctgaatagcgtaaagccacggccaattttgaaccaacctaaccagccgatcggtaaattaaagagtaagatccaccaacccgtttgaatctgtaaattcgtaaatcgggctaataaggatgacactaactgggccaagccattgacccctgagctaaatactgctgccgggatcaaaaaattattcaacgccactgccactaataaactggcgatcagggtaaagctgatcttcttacttaattcatttttagtcatccacgcctatctccgtttcacaattgatcttatatcgctaatatttcctgtcaattcattgtactcaatccggctagacagcggtcttttatgatgattttctttgttaattctcatttatcgaaacaaataatttggatttgctcatctaatcctcagaaagacaaccacagccatttaaaatggtataattatgctgttatttttcaaatttatgtataaaggaagcttaatatgcaaaaacaattgttaactaatttatctgcgtgcaccagtattttagtcggcaaaaaagcgagcgctgacggttcgatctttatcgggcgcaacgaagacagtaaagccgcgtggcccaaacattttgtcagccatccgcggcagacccacaccacggcgccggtttttaaatcaaacgacactggcttcaccgtgaccctgccccgggaacaagctaaatataacgcaacaccggaatggacggctgaatttggcctgttcgaagaagacggctttaacgaatacggcgtagcgatgagcgcgactgaaagtgcctacgccaacgagcgggtgctggcctacgatccgctagtcgaaaacggcatcgccgaagaagcgatggtcaccgtggtcctcccttacgtcaaaaccgcgcgcgccggcgtgctgcgtttaggtgaactggttgaacaatatggtaccgctgaaagcaacggtattttatttgccgacaacgatgaggcctggtacatggaaaccgccaccggccatcattgggtcgcgcaacggatccccgatgacgcctacgcagtcgttgccaaccagctggcgatccaagtgatcgactttgccgctccggccaattttttaagttccactggtattcaggaatttgcggcggcacaccacctctggcagccggacacgcccttcaatttccgggaaatttttggcacccacaccgccagcgattttgtttacaataccccgcgggtctggtacggccagaaaattttaacgcccacgcacaagcaaaagccgcaaagcgatgacttaccgttcattcaacgtgctgacaagccaatcacctttgaacagatcgcgcaaattctcggctcccacttccaagggactaaatacgacccggtgggcagtggcaaaaccaaaagcaagcgtaaattccggccgatcagcttggcgaagacgcaggaatcgcatattttgcaaattcggccggcgctacccgctgccctagccgatattcactggctggccatgggcgtgaccgctgaaagcatctacgtgcccttctatgccggcgccgatcaaactcccgccgactaccagattggggcgcaaacatacgatccaaaatctagttactggctgtataaacttgcgggtgtgcttgttgacagccattatcatgagttcaatcaattgttagccgcggtccaaaccgccacgcacacacaattgttgacccaactagcccagcacgatgtggccgccaaaaccgccactgatctaacggcctacttaaatcaggctaaccaaaaacacgctgacttagcgcgggctaacttcgaagccttgatcgccgacatggtgaccaaagccaccgatctttcgccattgaactacaacactgacgaaaacctgtaacaagagagtgtgccataaggcgtccagctactacgccacaagaatggcagcgcccgtaacatcaagaaatttattagcgattcaggctaataaactttaccttaattgtgaagtagaggaaattataaatggaaaaacaaaagaaaatcaccgtgatcggcttgatcttaatgatctttggctcgatcttcggtttcgctaacaccaccgttgcctattacctaatgggttacggtggcattatttggtacctttttgcggcaattttattctttttaccatcgtcattaatgttcgccgagtacggttctagtttcaaagaagtccacggcggcatttattcttggctggccgaatcgatcggtgagcggccagcctttattggcacgtttatctggctggcttcgtggatcgtctggatggtatcgacggcgtctaaagtgtggattcccttttccacctttgtttttggccatgatcaaacgcagacgtggtcgtttttcgggctgactccgacggcgacgatcggcttgctgggcattttattcttcctattgatcaccttgctggccacccacggcgtgcaaaggatctcgcggatcgcctcatttggtggttttttgatcgccttattgaacgtcgcttttattttgatcagcttgctcgtactgtttaaaaacggcctccaccttgcgcaaccggttcaagggctgcatagttttgtgtcttcgccaaatgctgattaccacagtttgatcgggatgctgtcctttgttgttttcgcagtctttgcttacggcgggatggaaacaatgggcggtgtcactgatagcatggaaaaaccggaaaagacgttcccaaaaggcttgatcatcgccaccgttttgatcgcgatcagttatgcgttgtcgatctttatttggggtatctccgctaactggcaacaagttttgaacaataaaacgactaacctcggtaatattacttatgttttgatggataatctcggttattactttggccaaagcttcggtttttcttcggccacggcgcatttgatcggcgtttggttcgcccgggtcactggttttgctatgttcttcagttatctcggtgcctttttcgtattgatctattcgccgctgaaatccttcgtcctcggaacgccaaaagaactctggcccaagggtttcgccagcaccaaccaagccggcatgccggtcaaagccatgtggacccaagctatttttgtttcaattctcattttcatcgtcgcttttggcggtcaggatgcgcaggttttctataacgttttgacgcaaatggccaacatttccacaactttaccgtatttgttcctggtcaccgcatttccttacttcaagcggcgccaagacctgcaacggccatttgagatctacaccaaccaaacgtggacttgggccattacgatcttagtcgacctggtgctggtgttcggcattttattcacgatcgttcagccgttgttggaaggtcaatatttagatgcttttgaaatggtcatcgggccgatcgtctttggcttgattgcttggctaatgtacaatcattatgatcacaaaatacatttgcggccagctgctaaataatcaaaaaacgactctcataattgagagtcgtttttttgttaatacaaggtttcaacgtaaggtttcatggctgtgaccacagcttcactaccagtaccttctaacattgccaccattaaataagaattattgtcagcatccgcagccatcaagaagccgttttgttcaccatcggtatcttgtttttgctttaattctgcggtacccgttttagcggcaatattatggccactgattgctaaatcatgtgcggttccttgtgcgtcagcgacgacctgaactaacgcctgcttaactgccgtcgcactcgcttttttcagcactgtttgctgtttagccgtttgattcagtagtaacgttggcaactgcatggcgcccgcattagtcaccgcactatacatcatggcttgttgaatcggtgataataacagttcgccctgaccgtaagcagtatcagctaaaagaatctgactggctagtttaccgttactggaaatctgagcattattcatggtcaaaggtaagtccgttttggccttaaaaaatggttgcagaccttttaaataagctgagctgcccatctgcaaaccaacttgagcaaaccaaatattgtccgaattaactaatgcttgagtcatgttttcactagcagtatcagtcacccgtgtcacttgataattgccccaactgctatctttttgccacttcaacccactgattgatttagttgtatcagtggtgatcgtcccgttatccaaggcgattcctgcagtcagcattttaaaagttgatcctggtgcatactgctgggtaaaacggctcaaaaatggctgatccgcatttttagcatatttattataatccgtctggctgataccagtggcaaataaattaggatcatagctaggtgagctaaccaaagtcaacaactgaccattccgtggatccatggtgactaccgcgccttttttatcagctaattgttggtacgctttgacctgttttgtccgatcaatcgttagtttgatcgttttaccatcgtgttttttagtttttaacaacgtccggctaacggtatccccgttgttgatggtgatcgagccgccatcttgtgcttgtaattgcttgtcgtagtaacgttctaagcccgttttaccgatcgtatcgccggtatgtaactcgggatgttttttcagatcagccgctgtgacttcaccggtataaccaatcaattgtgcactagctacacctgtaggataagtccgcgctgaaactgcgcgataagtgacccccgtcaaacttggcttggtcgtcactgttttgatcggcacaaaactatcgtcagtaacccactgttgttgcagtgattgcttcaaagtcgccacactgacatcaaattgttggctaattttacttaaattagtgttgcgcgtggcgccactacctaattggctcggcaccatgccagcttgggtcacttgaccatcgacagctaaagcttggccattacgatcaacgatttttccccgttcaccttgttgccactgcaattgaaccgtatcagtcccattcatgtgcggaaaaagcaacgctggcgtccacagtacgcgccatttccccttaactaactgaaccgttgcttgataatggttaaccttcaaggcaccaatcatcgtttgcatattcaaattaaaggtcatccgataacgtttagcgctttgccgtgtcacctttaactgcttaacttgcatgttattggccccaatctgaccaaaaacagccacattgcgggcaacgacttttttagcggtatattggtaatcgccaccgcttaattgatttttgtccacttgacccatcattttggtgaaattttgttggctaaacgcttttgtataagtagcggccaccttttttacagctgcagtagtttgttgccgttggtgccactgataataataaaagccacccccgccaagtaaaataacggcaattaagccgagcaataagtattttttgcgcatccctttacctcgattcttgatcattttagcataactttcactaggttaatttgcaagtcaggccaacgaaaaaggatgcgctaatacgcatcccaccagtaaattatttagctgcttgccgctgataacgatggaataaccaccaagccacgaccccgaataacgttggtcccgcaattgagtaaatcgttttcgcccaatcaccattgatcgccggttcaataatcgtaaaggcgttcgcaaagccaacggaaaacatgactgccgcaacgcctagataagtggcaaacttatttttatacatcgtaaacggctttttgattgctgtttggcgtttaaagccaagaaaagcgaaggcgatgaacatataaggcaaggtcatcgacacgttggtcatcgaaactaaaatgtcaaagaaggccttagcaccactgccaccaaatgatacggcaaaaatgatcacgatcacgatcgccgcctgaatccgcatagcgttgatcggtaccccgtttttgatcaccgttaatttacgcggccagatggctttcggcgtgccttcgatcagttgctttagtggtgaaaaaatcaaggtgaaaaacgctcctgataaagctaaaaacatcgacaagcccatataacggctcagccattgaccaacctgaatcgaagccgcttccgacaaatataaggcatgacctaactgataacccatattattcatcgcgatataggccacattacctagcgtcacctgggcatcgccaaactgggtaaaagcaaaatgccaattagtgaaagcccccataatgaagataccgatcgcataacctgccgcaatgatcacggctgaaattgtgattccccgtggaaaagtgactgcagcattctcggtttcatcaaccaatccaccgaccacttccaaaccaccataagcaaaaattgcgtagaccaaaaagctaaaaattgcgatcatcgtagtgaaatcctgatttggcgagacaaacaatgccttaactgacagcggttcagccattttaccatttaaaaataggatcaatagcccgccgaccaacaaaataatattgatcaaggccactgcggtcccaccgatcgacgtgatccgcttgatcgaatccagcccttttgaggaaacaaaagtgatcaaaatcacccataaaatagctaaaacacctaatgtttggacgccatttagaccaaataacgaccattgctgagttttgtccaccccaaaaatcgcgttagacaacggaatccaaataccagaacccacgttgaccatccagacgatataggaagcgtaccacataaaagtcccaataaaggcgaattgcggattcagtgaattggccatccatgaataaataccgcctttataatccttaaaggccgcgccatattctgctagcataaaagcaaacggaatgaagaacatcaccgctgcaataatgtaccagaaaatcgacgcgtaacccattaggtaaaacgcccgcggaatattggtaaagccaaaaacggatgtaaaaatcatcagaataagtgccgataacgtcagcttaacgtgtttttttgttgtttgcgccatgcttgatccctcccgagtaaataaattctagggctaagcatagcagtaaaacgactaaaaaagcgcttgctagagaaaactctcatcaagtttcaccacactaacagcaacatcacaggcgctcatcagtaaaatcacagaaaaacagccataatgggccgattattcaccttcccagctgtataccaaaacaaaatacaccactagtttcacaaacccaattgcgttaagccctaaagacaaaccggcggtgccaattgagaaatggcgctgcggctggcgtaaatgaaacccgcaaccgcggtcgtaatcccagccgttcgcgatccagtaaacctaattgcggtgcaatcaataaatggcccccgcgactgaatccaatcaagccttgtcgcagcaaagccgcatgacttggacagagcagcaaaccattgtcagcagttgttcgttccgctggcgcactatcctttagcggttttaagcgtgtcgcttcaagtagcgtagactgttcaagtccacaaattgcgcactgcggcacttgtcgttgcttaactgccaacgtaaaagtctgttgcgtttgggtcatttgccgtcgattgatcaaatcagcattgactaataaacggaccaacggatcggcatccgttgtcgtcaccgctgacattgctaaactcaattgttcattttgtttgaccacaaaataatcggcttcgatcaaatcgatcagttgcgctaacaatgctgaataacacggataaatataaccttgattaccactgccgtccgcctgaaatgcggcgtgtttttgcggtaataagggctgaatttgtggtaaatgatcactgatcgttagtggtgtgggcaacgtataatactgtagtcgtaccgcattaacttgcgcgccaacggcttgccccaataaaaacgctggccgcttaattgtatgcacactagactgtgcttggctgaccgccacaatttgtccggcaacatagtgaaacaaaatatcttgcggctgtatctcgttgatccgcgcccaagttggtggcaccacttgaccagtgccgcgtttgtgcgtccaaatcaaacctgccgttttttcttgctgatacgtgcgtccttgcatgacaataaatgcttgcatcctggcacctcccgtttactgaaataatttatcaaaataatgatcggtcaaaaaattttttaatcgaggaacatccaactcgttttgcaaattcaaaaaaacaaacgttggcgttgctggcgaatagacgcggtccatatcggttaggatcacatcataagtagccgttgtactatataattctaacgcaattttgatgcctattggcacataagcacgaatctgaccgatcatggcttgcgcggcagacgtctccatcgaaaaatcacaatcaacgtgtaaaagtactttgctttccattatttttgtatcgcttttccaagatatacactcagatccgcattttcaccaccccagtttcggtaaaggaatggtcaaacttttgccataaaagtgtcgatcatccaatcagttatttcttgttcattaacccgataaggccacgcaaaccataataaatgaaaatagaaataccgaatctgatttcaaagccaactaagcgcccatttttgatctgaatattatatcagccaacaaccgcttcacaaatagatagtagagttgttgcgccgctaactgccctgtttgttgcagtaaaattggattgccgctaagctgtaaactgatctgtccagttaccctctaatgcttaaacattgaatccgtttcagttatgcacgcttgatttccgttacaaattttggaacagtctgattaacaaaataaaacatcatgcacgtccttactaattcatttggcttaaatctaagtaatcggattctctacttttattataacaatagttctaattttctgtataaaatcatataaaaagaaatgcaaatctgtaattgacctttgaagtgcagaagtacaatagaaaagttagacaatttaaattttgaattaagtagccctgctttgttcctggaatttaactaagtcaagatatttttgtttctagaaatcctaacattattgggcttagtcaaacatacccattcactaaaagttgagttcatttcagcgagcattcagtagtatcaccttgcaataataatttaattaatcattgtacagcttgtatttttaaaactaaaaagcacgaccaatcatgatcgtgcgcgccagttagttattcatatttttcgtgacgactctcatcgccattgactattttgcggaaatcgagaaagccggcatttaagccgcggatcagtatttcggcagtgccaatgttagtggcgagtggaatgctataaacatcagctagacgaatcagagcgttgacatcaggttcatgaggttgcgccgtcagcggatcacgtaaaaagatgattagatccattttattttgggcgatcagggcgccgatttcttggtcgccacctagtggtcctgaattgaagcgagtgaccggcaactgggttgcgtccgcaacgacttggccggtatggccggtagcgaataattgatgaccgcgcaaaatttcgcgatacgccgacgcaaaacgggccatttcgggtttcttttcatcatgagcgatcagtgctattttcatttaagtgactccttatcagtagaatggctagctgattctatcttactcaataaagcggtttcgcgcaagctaaataaaaaaccagcaaccaaagcggcgctggtaagtagtgattctattcggctacgctgtatgaagtgtcagctaaagcggcgttgagttgagcgacgctagctgtgccgtcaaaagtagcagttttgctatcaaggtcaacgttcacgttattaaccacactgcctaatttttcagtcacagtatcggcacaaccttggcatttcattccattaatagttactttttgcattatgataacttcctttcggggagggttagttttttgattttaaaacggttcaagcgtaaagcgttgagtacgacggtaactgagctaaagcccattgcgccggcagcgatcattgggttcaataagggaccgccaaataagtatagcagacctaaagccactggaatacctaatacattgtagaaaaacgcccagaatagattttctttgatattgatcatggttttgcggcttaattcacgcgctgtgaccaacgaactcaaatcagaattcatcaggatcacttcagctgaatcaaccgccacgtcagtgccattaccaatggcaacgccgatctcagcctgaaccaacgccggtgcgtcattgataccatcgccgaccatcgccactttatgcccttgttgctgcaaagttttgatcgcatcggctttgccttctggtaatacgtcgctgatcacttgtttgatgcccgcttgagccgcgatcgcctctgcagtcggacgattgtcaccagtcaacatcactacgtctacacctaaatgttgtagtcgtttgattgctgctggactatctgctttgattggatcagtcaccccgagcacgccaactaatttttgtgcttgggccacgtagatcaaggttttaccggccgtacttaaggcagcggcctgatcaaacaacggactagcggcaacgttttgttgctgcattagcttagcgttacccagtgccactgttgttccagcgatttgacccgtaacacctaaaccaggtagcgtcgtaaaattagtaacgctttgacgttgggcagcggcagcgtcgatcaccgcactagccaaaggatgatccgaataatattccaaactagcagctaattgcaaaacttgattacgctcaccgtctgtaatcacatcagtgacttgtggttggccttgcgtaatggtccctgttttgtccaaaacgacagtgtccagttgtgccaattgttcaagcgcggcgccatttttaaacagtacgccgtgtttggcgcctaggccagtgccgaccatgattgcagtcggtgtcgccaaacctagagcacagggacaagcgatcactagtacggatacgaagattgtcagtgaaaaagccagtgactgcccgctaattaaccaagctaagccgccaactaacgcgatcgccatgatcacaggaacaaaaacaccagagattttatccgctaagcgggcgatcggcgctttggaaccttgggcgtcggaaactaatttgacgatatgagccaaagcagtatcgctgcccacatgcgtagcttggtaagtgatctgaccatttttattggtactgccaccgatgacgcggtcgccgctcattttggtgatcggcaaactttcaccagttagcatcgattcatccaccgtggtttggccagttaaaacttggccatccactgggatcgtttggcccgatttgaccaaaactgtatcaccaacttggagcttatttactggcaccgactgtaccgtttcatccgcattgacgcggtcggccattttcggtaccaaagtcaataatgaagtcatcgacgtggtcgtcttttgcttggacagtgcctcaaaatatttacccagcatgatcagcgccaagatcgtagcgctggcttcgaagtataacggctgctgcgtgcccgttgtccagatcaacatcgtattgaccaaactgtacaaaaaggcagttccagtgccgacaaacactaacgaatccatgttaggatgacctttaaataaggtggtcgcccctttaattaagtaatcacggcccagccacagtactggcaaagctaaaatcaattcagcgagcgacgctgttgccggcgccatcattggatttaaccacatcacggtcggtaaatgtagatccccggccatcgccacgtacattaatacggccgcgccaattagcgcaccgatcatagcgttacgctgttgtgttaacttgacggctttttcatcccgctctgccgccacgttttcctgggtcaactcttgggctaactcggcgccataaccggcgttgaccaccgcttggatgacctctgctggtgctaaagcctgatcggcgaattccactttcattcgttccgctgccaagttaacgttagccaccgtcacaccaggtaacttgctgaccgctttttcaatggtctgcgcacaactggcacaaaccatgccgttaattttaaattgttcagctgtcataaaatttcacctcccttcattgaattgatcgttaattttgctaaacccatgataaagcccccgttctgccgcttgttacgtgataacggtttatgtttacatctgtaatcgataagttaatcttagcacaccgattacatttgtcaacggttattggcttaaaactttaaatgtaggcaaaaccctgatagttacttggtaattagttgctgcaacgccgtgatttgggttatgctgatagggattatctaaggaggaccttatgccatctgaactcgacttaatgcgagctggccagttgtacaattccaccgccgctgagctagtgaaaattcgcgccaccgctaaacaaaaagtttatcgctataatcaaacggccccggaagccaatgcgttacgagcacaaatcctgcaggaattgatcgactgtccaagccgtgacgcttatatcgaagtgcctttccggatggactacggcagtaatgttcacatcggcgcgaatttctacgccaactatgatagtatttttctggatattgccccgatcacgattggtgacaacgtcatgttaggcccgcgcgtgtcgttgtacactgctggtcatccgttggtggccagtgtccgcaatgagtttttagagtacggtcatccgatcaccatcggcaataacgtttggattggtggcaatgcagtcatctgtcctggcgttacgattggcgataatacagtcatcggcgccggagcaatcgtcaccaaagacatgccggccaattcattaatcgttggtaacccggcgcacgttttacgctcactgaccgcagctgatgaacaatactggcaggccgaaaaacagcgctatctcgctgcacggaaccaatagaataaaaatacgatcacgccagttatcatgctgtacgtgatcgtattttttaatccttattccaaaaatcagtaaccgcgcccgttgctgagctagaaactaaatgcgcgtatttccctaacacaccacgggtatacaacggtgggatcgtggtttccgctttgcgcttcgctaattcagcatccgaaacgtccatcgtgatctccttggtgtcttgatcaataatgatcgtgtcgccatcatgaagataagcgatattcccgccatcttgcgcttccggcgcgatatgaccaacgacaaaaccgtgggtcccaccggagaaacggccgtccgtcaacagagccaccgattcgccttgacctttaccaactaagatacccgataaggacaacatttccggcatccccgggcccccttttggcccttggaagcgaatgacgatcacatcgcctggtaccacttcatcagacaataccgctttgaccgcatcttcttcgttgttgaaaactttggctggaccaacgtgacgccgtgatttgaccccagaaaccttggcaaccgcgccttcggtagctaagttaccgtgcaagatcaataatgggccgtcaggacgtttgggatgttccaacggtacgatcactttttgacctggcttcaaatcaggtgccgtagctaagttttcggcaacagttttaccggtacaagtcaggcattcgccgtgaatgtagccattttggtacaaatacttcatgaccgcttcaacgccaccagcttcataaagatcttggaaaacgtactggccactaggcttcaagtcagcgatatgcggtacctttttctggaaaacgttaaaatcatcgatcgttaagtcaacattagcggcatgggcgatcgccaataaatggagcacggagttagtcgagccccctaaagccatgatcacggtcaacgcattttcaaaggcttcacgggtcatgatatctctagggtagatgcccttttccagcaagttcattacggctttaccagctgcttcgacgtcttttttcttttcttcaaaggttgccggatgggaagacgaaccaggtaagctcatgcccattgcttcaattgctgacgccatcgtgttagccgtgtacataccgccgcagccaccaggaccagggcaggcgttacattcgattgcacgtacttcttctgccgtcatatctttatggttccaatgaccgactgcttcaaaaacggaaactaaatcgatgtctttgccgtctaatttacctggcgagatcgtgccaccataaacgaagatcgcgggtacttcagtgttggcgatagcgatcatgctcccgggcatgttcttatcacagccaccaatggcgacaaaagcgtcgcagttatgcccgctcatggccacttcgatcgaatcggcgatcacatcgcgggatggcaatgaaaagcgcatcccaggtgtgcccatggaaataccatcagaaacggtgatcgtgccaaattgtaccggccaaccgcccattgaccgaatcccatttttagcaagtttgcctaattcctctaaatgtaaattacagggcgtattttccgcccaagtactgatgaccccgatcagtggcttatcaaaatccttatccgtcatcccagttgcacgtaacattgcgcggttaggtgacttgaccatcccatcgtacacatgacttctgatccgtagatcctttttcgattgttcgttcgtcattgtgattctcccctttcaactgtaaaaataaaacgatcattcataaatgatcttaaaagctaccccttaagcagcgcgttaatcatagccaaaacaaaaccataagcagatctagctgctttagtatagattttacctctttactcatttcattccaatataaaaataagaaaataagggaaaatacttatttaaaattaataattagcttgaatttttttaattttaatgacaaaatacatttacaactattttttaaccgcaattaatctagcttcatttttttgcctgcagctattacgtttgcaaaaattaccattttaattacgggtaagttaattggctacataggctgagcaaaacgcctactaaccgaattttattgtatgaaaaggagcgaatataatgcgtgaagatattaaaataaatgaccgtgccgctgaattcagtgaggcgatcatcgagcgattacgaaaggtcaacgatccagaattggaattagatatttataatttaggtttgatttacgaattaaatttagatgagaacgaccaactgacagttgtcattactttcacagaaatggtttgtggttgtattgaatcgatgccggtggacattaaggcggcgctacaagatctgccaggaatcaaagcggtggatgtccaaatcgtttggtcaccgcgttggaatatgaaacgaatcagccgtttaggtcggatggcgctaggtatcagcgtacattaattcttaacaaaaaagtaccgtcagcacttcagataaagtgttgacggtactttttttgcttatacacgcgcatacgtattaacttgcgctggaactaaaataaaattggggtgctttttctggacgattttggcggctataaccgtgccaccgagcagcgcacatactagtgctgtgcgataattacgtttggtcattttatcacctactcaagttattaatacgcttagcttacgtcgccaaacttaaaataaccttgggcttactcggccaataatggtaattgcgcctggccaaaataatcaccctgtaaaaaattagtgaacgactgctgccgtaaccaggcaaataagcgctgatccgtgacgccatcaacggaaaagcctagctgacgacttgcggccaaagtaccccaaaacttgatctctttgctagctttcatttgatcgggctgcgcggccaccgtgaatttaatgccatcaaagtaatctaagctggcgttgattttagtaaaatggcgattggttccgatctgacttaacacaagtttgatgccgttagcatgataaaaattagccattgggaccaatacctgcagcgccgggatctgatttaattcaatgtaaagctgatttggcccatctggaccgttaatgaaagccacgatcttatcggcaatggcttgattaagaaaatcagccacgggcaaagctttgactaacacttgggtccgcgtattcagtaaggcggttcgcatcaactcgattcgggtgtcaatatccaaataatgttgctgcggtaaaacccactgctgcgctgtctgatcataacgccgcaattgcaactcctcagcaatgcgtcgcaccggcgtagtgtctgcataaacgccacgcacaaagtatgcatacttgacctgattggagtcatcctgcaactgttgggtcgcgccattgactgtgatcgtatcacgtccattttgcttactgatatacagcgaatgatcggcccgcttataaatatcattcggcgagcgatcccccgcgtacaattcggtcatcccgctagatatcgtaaccttgatcgtttgcttatcgtaatcaaactcgtgggtgcgaatcgcctgccaacaatgtgccatgatctgaaacgtttctttgactgtactattaggaaaaatcacggtaaactcttcaccaccggtccggtagacctcgtaatgttcaccatactgatggacaatctctttgagcgcctaggcgaccttagccaatacttgattacccgctaaatggccgtattgatcattgaccaacttaaaatgatcaatatctaaggtggcaaccgttaacggctgtttgccagtgcgagcgaccccaaaatgattaaaaatatccttttggtaagcggtgaagtttttcgtgctagccaattcatcataattagccaaatgttccgttgccaaattttgaaaaaagcgccgctgctgccttccggtggaaagtttcatcaagaaaaacatcaataccgcgcctgcggcaattcctggcgttacaaccatccccgcgggtcggctcggtaatgtaaaccaaaaatcagctgccaaaaaaacggcaatcggtaaccgataacgaaaattaggcccaatcttcgttcgataatgccgcactagaaccaacgtcactaacaaaaccaccattgaaactataaaaccccattggacaaaattattaacgtagtactggcaccgcatgttgatcaatagtccacaccgaaccaagtattcccaaatcgatgtatcttcatccagcaatgctaaaatcagaataaacaacccgatattgtgataaaagatcgcgttgacacttccagcgtaaccagccacatttaaaacactgctaaaaaaaaacggcttgaacaataagtaacacgcgatacattaactggcgtgaatgacttagtgtcttatcccgaaaggcatgtccccaattttccaaataaaagctaacaaacccagcgataaaaaagagcgccaccagtaattgtgcgttccataataacgttttaagtaaaagcgcctctagattcaaaaccaatcctccaatattagccaactaaacagctaactaatgaacaagttttattttttaataacttaagcatagcacaaaatttatcaatttgatcaataaattaaagtatagcaactccattaaccccacacttttaatgtatttacccagtgacgctttacaattttagcagaacatcagtttggatctttgtaccataaagtagtataattaagttactaaattgaaaagaggttgaactgatgaactcaaaatttcttgaagtcatgcaacatgaaggacccgttacgatcgtgacgatcaacgcccaaccagctagtgtcgtcaatacttggggctcctacgttaatataaatgaagccggtaattacttattgattccagcagctgggatgcgtagtatcgaacatgattttgctaccgataataccgtcgtcttaacgatgggcagcaaagcagttgaaggtacagttggccctggtgctggttttcacgttcacggtactggtgaatttattgaagccggtgctgagtttgatgccatgcaggcaaaattcccctggatccgtaaagtacttaaagtcaacattaaagaaattcaacaaaaaatctagccacacaaaaacgaccgccaataatgacggtcgtttttctattacctaattaatgtgcggcggtatgtgccgtcacttcagttaccttttcatcagtgcgtgctacctttttatgttcagggaaaattaaattagctaaaataccaacgatcgcatccgcatggccagcaaaaccaatgcctaaggcaaacgtgatgcccagtacagtgatattacgttcactgaagccggcttgtgccaataatttgatcccattcaaagtgatcatcgcaaaaacggagatcaaagcgcccccaagcactggcgccggaattgacgcaaaaatataacctaatttaggcaaaaagccacaaacgatcagtaccccggcacctaaagtaatacaccatttattaacgactttagtcatcgacacaatgcccacattttgaccaaaagccgtatttggcattgccccaaataatgacgccacggcacagcctaaagcatccgctaaaacggcgccggaagtctccttctccgtggcctggcgatcaaatgcagcgatggtgatcccagaagtattgccgatcgtttccattgaaactgtgatgtagataatcacaaaactgatgatcgtttgcgcgttaaaagttgggataaacggtaaaggccgcggaatcgtagcccaggatgaagcgccgatcgcactaaggtctactttaccaaacaagaacgcaataccataacccaaaatcaagccaaataacaaggccgcagttttgacaatgcctttaccaaagcgttgcaaaactaaaacgatcaaaaaggtggcaaaagcgatcgtcaaattttgccacgatccgtaatccttagccccagcgccaccggcaaaataatcccggccaacgcctaacaaattcaagccgatcacgatcagcgcactaccgataactagtggtgtaaacagacgctttaagtatttatagaagaccccgatcacgccctcagctaaactcccaaccaaggcgccccctaatacggcgggaatcccacccgctgcagcagcggctgaagcggtgggtacgaaggcaaaactagtccccatgacaaatggcaaccctgaaccaatttggaaacggccgatcttgatcggatataattgcaaaagtgttgccagaccagagatcaacatccccgcttgaatcatgatcaccgtttccgccggcgttgctttagcaatcgccgcaatgatcaacattggcgctaaattacccgcaaacatcgctaaaacgtgctgcaaccccattggaaaggcaatcgacaagcgtggtcggccctccaattgataaagcatttgttcatccgacagaccacttgtactgttatttttcacttttttcatgaaaaatcctccgtttccgtgcacttgaactagccgactagcaacaaaataacccgctcaccgttttactttaaataatattttcgttctaaaaaatattatttgcattaaatccaaaaaataatatgtgccaaatcgcacatatttgtaagcgctttatttattaataatttaagtttaacacgacctatctgtaaatgcaatacccatttctgtgctcaaactaacccataaaaacggactaacattagtggtgaatcatgattcgacggaatcgtggttcaccactttgcttttttctggtaaagtggtgtcgaagttgacatgtcgttgtggtctttggcgctttgacgtcgtaataaaaact

SEQ ID NO: 555 - DNA, 3077 bp, Unknown
  Metagenome-assembled genome
tcgtcctgagccaggatcaaactctcatataaaatgaaaattgattgctcaattgattttgttgctagcgagttataattcaaattgaattgacttcgcaaatgtttgctttatctcgaaccggtccgaaggccggtaaaaaataaagaccctacacatttgatttgtcgaaactttgttcagttttcaaaggtctacctagttgcttaacacaacttaatcagtttatcatgacgagcgaagcttgtcaagaactttttgaataaatattcaaaacgcttattgccgatttcgttatgccttgttaaatcagactttccctctgcatctttatgcaagtaggaatgaataactcaacaagtgacaactttattagtttatcaagttaagcaagatctgtcaacaaaaagttttaaaaacttttttcaacgacatgagctataactgacaacaacaaatactatatcaacatttcgcggtagcgtcaagaatgaatttatatgactcaaataacctatatccgaactttttaagctagttttgcataaaaaatcggaattaatcgtttgccagaacctgtaactctaattaatgactattcacgatataaaaaaaccgatagatcatcaagaatctatcggttaaaattttatttttttaattctggtgcatcagtttgatattcgctcatcgttgatttaccgccatttttgctaaccagactagttgattgctttttattcgcttttttaagctgttttaaggctgctgacttcttatagttataagcacccttaatgacctttttaaagccctctggttgataaaaacgtagtaaatcaccgttgatcactttgtctgaagcagatagcgtattagtgacgtagttttgcatatcatcaatcgactttttctgtgctgttgttaaatttttaagttgtttacccgtactatcataataatcgccattatattttgtataagttggcgaagcaaaatcaccattacggaaagctaccgtctgtttgcgattagtcgctaataagtcggtcccaaattgaatcgtatccgagttcttgacgcctaataaattaagcaacgttggtaaaacatcaatttcaccaccataagtgtggttgattccaccctttagccccggcatatggatcataaatggtactttctggaaattagctagatcatagttagtgaccttcttcttacccaataatttagcaattgcaggtttatggttatttgaaatcccataatggtcaccatacagaaccaccatactgtttttatccaaccccgttttttgcagccaagtcatcagttccccaaccgcctgatccagataccgtgctgtttgcacataagaatcaacagttgagtcgccggtattgaacggtttaatcgactcgttctgtgaatcgatcaggtatgggtaatggttggtaactgtgatcaatttagcatagaacggctgtggtagttgctggatatactgtgctgaatcccgcaagaagatcttatctttcatcccgtagcctaagttatagctagacttgtcggcattcgggaagaaagacttactgaagtaatagtcatagccccatgatttataggtgttatcccgattccaaaaactaggcacatcaccatgaaaagctgcagttgtataaccattttgacctaaaatagctggtgcggcctggaacgtattagttgtaccgtccataaccatcgctgagccttctggtaatccatataaactattttccaacatcatttccgcatcagccgtttttccttggccaacttgattatagaaattatcgaagcttagcgtatctgatgaatgatagagtttgtcaatattaggcatgacttcttggccatcccatttgtagtcgatcatgaattgctgcaggctttccaagtgaataatgaaaacattcttgcctttagctacaccagagtattccacgttcggtgatactcgatttttggatagaaaattctgtacactggttaaatcagaactatccgcattagccttggtagcattattctgcgtcgttttgacgccatcgtaaacggtgtacgcctctaacccaagatatttaacaatatagttattatcaaaagtgcgggtcaacaagcctgagcgatcagtttccgctaagcttagattagcgccaaacaataagattgccaaactagaaactaaagcagcgtagcgcaatttaaatgctctggtatccatccgaatcactttgaaagctaacaaaatgatcaagaagatcacatccgcaaaaactaaaaagtcagtcggatgaatgatcccagcaatactttgattcaggttattcgaaacggcgctagaacccttcatcaagttaaacgttaaaaagtcagagaattcacgataatagagaatattggcaaatagccaagtcgccataatggcgtcgatcagcagcataaaccaatatgatttacgcccgcgcatgtataacgctagtcctagtaataatacagcaaatggtagcgggttaaacgctagcagtaattcctgcatcccgccactgacccctaagctgaattttgttttgtatgcaaaatatgatttgatactaaacagtaagaccgcgaggataaagaagccaagtcgtgtattaagccccgaccgcactttctttaaagcttgccccataatgattacttacctccgtcacataaaatacgattcaaagtctcttaaatcatactggatttacttgcgaaaaacaattgctggtcacaagcttcacgaaatatttaatattgttaactgctgaatgttaaaaaagctcagcttatagaacctagcctagcaaaataataagcagcgtttggattgtgtagctatctggaataagctactctttgccatgtttacactaaatcgtaagcggtaaataatcacccgttttaaaaagacaaccaaacttctcgattttgagaaatctggttgtcttttgttaggcggcatttttagcttgatgcttgtccgttgtttttttattttgatg

SEQ ID NO: 556 - DNA, 6731 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccatttacttaccttttgacatattcacaaacagtgctatattggagtcgtaaataataatgcgattatagcaactagtaaccattggtaaacgtccagaaaattagcggtaatgtgagctaatcgcttaccagtggcgaatccactgcttagcttgacctgtgaacagatcacggcgagacgatatactcagagtattgttgcatatttgcagcataaaactacgggtggtaccacgctaattacgtcccataatcttcaaaagaagattatgggatttttttgtattaaaaataaaaaggagtccttatcatgttaaatccaaaattgatccgcaaacaacctgatttagtcaaagaacgtttagcaactcgcggcgttgatccagctgaaattgatgaatatcgcaatctcgaccaacaaaatcgtgcggcgatcacaaaggctgaaactatgaaaaaagaaaagaatcagctgacagctaaaattaaggcagctgatccaaaatcagcagctgggcaagatttgatcaaacaagttaaacaattaaaccaagctattcatgacattgaagcccaacaagaaaaaggcgcggaacgcttgcagcatatcgcagtgcgcctacctaatatccccgctgctgacttaccagtcggtcctgatgaagctagcgacaccgaagtgcgcaaatggggtacgattccagagttttctttcacaccgaaagcacactgggaaattggtgaacaacttggtctgcttgactttgatcgtgcggctaaagtttccggcgctcggttcgtctattacaaaaatgccggtgcgcagttagagcgtgcagtatacaattttatgcttgatctgcatacacgggaacagggctatcaggaagttattcctccttatttagttactggtaaaaccatgtttggcaccggtcaattccctaagtttaaagaagacgtttatactgtggaagcaactgggatgacattgattcccaccgctgaagtgccgttgaccaactattatgctaacgaaattttggatgaagctgatttaccgatctatttcactgctctcaccccctgcttccgttctgaagctggcagtgccggccgtgacactcgtggcttgatccgcatgcatcaattccacaaagttgaaatggttaaattcagtaaaccagaaaaatcttacgctgaactagaaaagttgacccaaaatgctgctgaggttttggaaagattaggtctggcctaccatgtaattacactgtctactggtgacatcggcttttctgccgctaaaacttatgatgtagaagtttggatgccacagcaacatatttatcgtgaaatcagttcttgctctaattgcttagatttccaggcacggcgcgcaatgattcgttatcgtaaagccgatggcagcgtagaatatgtgcacacgctaaatggctccggcttagctgtcggtcgtaccgttgccgcaattctagagaattatcaacaggctgacggtagtgtgaaggttcctgaagcattacagccttatatgcatggcttaaaagtaattactaaaccataaggttattaaaaaagtccgctaagcgcggacttttttcgtatcacgtaacataaatgccaacactaacccacacaactccactatcaagaaggttaagaagaccgcacgataaccgccaatttgtgcctgactgatatcgatgccacgattttgtaatgcgtgggtggcgttagctaaaatcaacgtcgctacagccacaccggctgagcctaaaatctgccgtaccgtggtaattaccgcggtgccatgcgcaattaactgatcaggcaaggcgttagcccccagcgtgaccgctggcatcataacgaaggcattgccaccttcgatcagcgctgctagtatcatcattaaccctaaattcatatgagcggcaaaaagcgttaggatcagccaaccaagacagatcaagaacatccccgttagcatcacccgtttaaagccgaaacgatcggctaatttaccagtcagcggattgagaatactcaagactaccgcaccgggaaccaaagcgaggccagaaataaagggtgagacgcccaaaactttttggtaataaagtggaaaaataatcgtgacgacgattaaggcaatatacgagatcgcagttagtaaaaccgctaagtcataattaaacgtttttaacacccgtagttctagcagcggttgtgtcagttggaattgccgccaaacgaaaaaggctagcgccactaaactcaaagcaagtagcgcaaagttaaaggcccagttaccagcctggccgatctgattgaccacatacagcacaccaataacgcctactgagcaaataatcgaaataaaatcaatactagacggtgccagtgtcatcacacttttgatcgtaaataggctggcgataaaaactaaggtaataatgactaagaatacaacgaataaaccttgccaagtcgtaaaacggagcacgatcccagaaataatcggccctaccgctaatgcagaacccatgactaaaccagcaacacccatggtactaccacgtttagtttctggtgtgatcgtcagcataaccgactgataagctggaaacagtaccccaaccgcgatggcctccaacactcgcccagtcatcatcatgacaaaatttggtgctaataaaataattaaagttcccacatcaaaaatcactaaaatgcctaaaaataagcgtttaaaggggatattctttaatagccaaggactcacgggcatcatgacgcacatcaccaacataaagccagtggtcaaccattggatcgttgctgccggtaaattgaaatattgcatcagcgttgggtacgctgttgacagcgaagattgactgatcgacatcgtgaaggtgccggctaataagactgcgataaaccaaaaacgttgcgtttgctttgtttgcacgagaaattcctccaataaattaaaaacagctgcgcgtggacgcagccgctcgttgccatactgagactacatccattgaccgatgtagtaatgaataaacattgtaatgatcccaactaatatattacgaataattgccgttttgactaaaccgtcacctaacttggcgctgagaaaaccagttagggcaactgacaatgtgactgcagcgatagtactaggccacgcccacgctgccggcgccaacgtcatcgcaaccaacgggaaaagtccccccgatgctgccgcgaccagcgatgaaaaagccgcttgccagggactcatgtagtggccgagctccaaatcgtacttaactcggatcacggtacccaacgcgtcttttcccatcaaggcctgtgcaatctcagttgccgtagctgctgtcaccccacgcgcctgatagtacgctgtaacgttggctaactcagccgcaaaatttgacttcaataatgctgcttctttggctactaccgccttttccgtatccttctgcgaactgactgaagcatattcgcctgaagccatggaaaacgcacaggccagcagatccgctaaaccagcaataaaaatcgtgaagtgattggttgttgcggccgcgacactgaatagtacgccaaccacggttaaaataccatcattggcccccagaacgccagctcgcaaggtatttgagcgttcggccatagtcattttgcgttttggtgctacagttggtttaatcactttcatcatgtttcaaggcctcctcgactaaactaatgggcgaacaaactaccaataacataggtgacgatcatcgttagtaacccagaaataacgttccgcagcacggcgcggccacgattggcgttgcctaaagctgccgccgtatacccagtgatgattaacgccacgatgactgcagcaaccgttgcgactactttgatcgctggcgggaaaaacgtgatcgagactaacggtaaaatcgaccccgtaggaaaagcgatcattgaagcaaaggccgctgcgtaagcacttgtctgctcccgaggattaaaaccataacgttcacggactgcagtgtataaaccatccttttgcagcatttcgtgagtcgctttttccgctaacttagctgggatcccagtttgcatatatttatgctggataaaatcaaactcatcttggtagtgatcatcgagcgccgccgactctttttcaatcgcccgccgctctgaatcacgctgcgtattaactgaaacatattcacccatcgccatggaaacagtcccagctaacatccccgcgatcccggctaggaaaatcgcattgctattgctagtagcaccggcgaccccgataacgatcccagcgattgataagataccgtcgttagcgcccataacactagcccgcatcacattgattttttcagccaatgaacgtttcttcttcgcacgctccatattataaccctctctactccacatatagtggttaatttttgtatcaaaaatttctaatgtttcggtcgatgaccattcttgtggcaaaaaacgtgccgcaagaaacatggctctactccacatatagtggttaatttttgtaccaaaaatttttgatgtttcggtcgatgaccattcttgtggcaaaaaacgtgccgcaagaaacatggctctactccacatatagtggttaatttttgtatcaaaaatttctaatgtttcggtcgatgaccattcttgtggcaaaaactatgccgcaagaaacatggctctactccaaatacagtggttaatttttaacattatgaccgagaatcatattagtggaccaaaattgcactataagtagcatgactctcatttatcttttaatttagaatcattcttatttgttatcaaataaattataattttaattcttttaaaagtaaagtaattttcacctttttctaataaagcttgataatacgctaattgaaaacttttttcagttcggatggtgttttagcttggaatcattctaaaaaagtggtttaatatagttgttaaaaaataaaacatttaaatacgtagtctcttttacaatttacttttaggaaggatgaccgcttgtgactactgatgttacagatcaaacgctgcaagtattgaaagatcacggtttacgggtcacaccgcaacgtcacattatactttcatacctggccagccatcacaatcatccatcagttgaaatgatccgggtggcgctaagcagaaagctgccaaacttaggcgcggcaacaatttataacacattaaacacgtttgttgatctaggaattgtcgttgagttacaaaatggtgatggtagcacgcattacgactacttcggcacaccacattatcatgcaatttgtaccaattgtggccgaatcactgatgtcacttaccccgatttcagtcaagttgagcgtaaattagaagccaaaacagctgaattcaccggctatttaatttccggtaaccatatggaagtttatggtttatgccccgattgccaaaaaaaattacgcgtcaacaaagaaaatattaaatagaaacgcggtacaaaaaagcttgtcagcaaaatattgttggcaagctttttgcgtggttgttgatcccttatttttaatcccatatagttaaaaaaattatccaacacgttcatcttcttatacgtaaagcccattagtaccagtattttaaccggttaaaaaaataaattaaaatagttgagttattacttgcaatcgcttacagataatgctatattatgagtgtggaaaggataagacctgaccagtagtaaaggctcctcggtctccggcagaccaccaagacatgaaatggcggtcgttggtaacattttaagtattatggatctaagtaccatttagaaacatttaagtcttcggcagaccaccaagacacacgatggcggtcgtaggcaacacttaattgttccaaagttctatcaaatcaacgttgtgaaacgtcgaatcaacaagtaacaaattctttctggaggtgtatgtcgcatagcaggcataaccacagttccaacgctcctggtgcttcgctgaaacctagtttgagggtcttgaatcctatcattagataggtacgaccatacagatgtagaaaattaataaacaggtaagctagaagttcaccgtatgcgtaaaacttaatatgaaggtgtctagatattcaaaaatctctgtacgaccaaagtagtttaggtcaggcattttccatgattcgttagacttcaagactgaggagacttgaagtctatttttgtggttaaaaaatacggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaa

SEQ ID NO: 557 - DNA, 13668 bp, Unknown
  Metagenome-assembled genome
caggctattgaataaccggcaaaattaaaaaaatctgtacaaccaagggacaagtgtatccaaaagttcaaagcaattctgagttagttgaaagatctcactagctagaactgataaacatcgtatttcagcaaaagataaagacatacccgtcagttttcgaaaaaatacgaaaactgacgggatttttatgaactatgaataattcaggttgttatttttagataaaatttggcttttttttgaaagtaggtcgctggatttaaaacaaaaaagtttatctgattatagcagctattaatgcctgtgttataaggaatcttattagtttgtgcagattgtaataaagttgtcatacgcgagtaattgcgctgtaatttcaatgttctatgatagagactggtgaaagtgataaaaaactattgaggggttacacatatgacaacaatcagtaaacggaatttagttaagggtgtcactgcaggggtcatcggtatcgctggtgcgactctccttagcgttgcaacaacttcagatgttcaagccgctactacgggaacagttacatatgaacccggcgcaacgactgtttggaataattcagatacaccatcaccaattcgttatctagttaaagatcaaacagttaatattgaaggtcagaaacaacatgctggcgaaacttggtacaatatcggcaatgacgaatgggtaccaggcaagtacttaaatgtcactgaagatggcaatacagcccaagcacaagcttcacaggcacaagcacaacaagctgctgcacagacacaaacagcggcaacaaccaccgctactgccgcagcaacaactgcaacaacgtctagcacaggtgcagtacaaactgcaatcaatgcggctaagtcacaaattggcgtgccgtatgtttggggtggcgccactccaggtgttgggttagattgttctggcttgacgcaatatgccttagcacaagctggtgttcaagtaggccataatacagttgcacaagaaagtgctggccaaaaagtagctgttagtcagttacaagctggcgaccttgtattctggggtagtgctggtgcaacttatcatgttgcgctatacattggtaacaaccaatatattgcagcaccacaaccaggtcaaagtgttgaagttgaaagtatcagtagctacttcatgccatcattcggtgtgcgtgcactctaagctattagttaagagcctaagtttcgacttaggctttttttgttgcgcttatatttcaaagtcaccgttattttgttatttttgtaatatttttgtaacgtaaacgtcatttttgtggcataatagagctgagccaagttaagcagctattttttatctatcgttagactctttgtattttatttttaatggtagatgataggctaccagaatagcctgattaatgagtttgttccgagcgtcgtttggtaatttagggcgtattggtaagaaaaattaattggtgactatattaatggcgtataccaatcatgaagtaaagcgggggaattttaatgcaggcgcaacggcgtgaattaaaaaataaacaacataaattattggtgtatctagcagatctttatacacaacaccgaaatagtggtgctgataaaatgcatcaagcggggactacagcagcaacctgccagatctgtcatgaaataaaagtgatccacgaaattattgacgaaattagtgcagagttaaaaaagactgcggcgccgacaccacgacgtagacggcgacgtaaagcaagcgtgacgaatgaacagctttcggttttttgtctgtcaacgcaaaatggtgcgaattattttattcgggctgctaatttgactgctgcaattgacttattaggacagcaaaacaaaaatgtggttgcttatacaactgttgcaccaagtctttatgcggcgattccattgactgatcatgccgcaataaaaaatattactcaattattaggagcagagcccgatttcacaggtattatcacagttcgatcattacgtgaaaccccggcaatgtcttattgaaacttgacaagttaaaaattataagtaaacttaagctaatattccaaaagatatgagaagatgagtaatccgttaaccaatcttttttagcgagtctcagatagtgtaaggagatagatttggccgggtgaagatggtctttttaagtaagcattatcgagtggttacacaaggtagtgatgggagcgcccattatagtgctaaggtattgagtgaattctgtacctgatgaggctactattgtgaagtagtagcaaaaataggtggtaacacgaatgcaatagcgtccgtcctagaactgataatagttcaggatgggcgtttttttattggctaatttttataatgaactaatgattagtggaatatgaaggagtggtgaaatattgaagaagaaatacatagttggtttactttgcctagcttgggtgacagctatattattaccagcgccagtcgaagcagccagttcaatcacggttggttccttaacttcagatgcagtgatttggcggcacattgctaaatcaccgcaagctaaaaaggccggcttgaaaatcaaggttcgtgaagtgagtgatccagttggtttaaatacggcgacggctcgtggtgagatcgatgttaatgcctttcaatcagttagttatttgaaagcctataaccatgaaaataaaggtaaagcacaactggcaatgctggggacaacttatttagaaccgatgggcatctattcaaagaaattaaaaagtttaaagcagttaaaagatggtgctacggtggcattggctaataacccagccaatacatcacgtggattggcactattacaaaaggcgggcttgatcaaattaaaggctaacttcaatgctaacagcgatgaaacggcgatcagtcaaaacccgcaccatttgaagtttaaagagatcgatgataatactggaccacgtgttttaggcgatgttgatattgctctaatctctaattcagtagctttggctggacatttgaatgttttaaaagactcacttttccatgaaaaagtgaatcaatcaactaaacaagacattaatgtgattgcgacgagcaccaagaataagcaccaagctgaatataaaaaattagtcaaactttatcacgatccaacgattcaaaaatggatcgatcataaatttgctggcaccaaagttgaagttcaaaaaccactaagttacttaactaaatgatttttgagtgagtcaaggtgagccatgccgttgcagtgaactgggccacaagaatggccagcgccatgaacagcataagctgcgactaagtaacatcctatttgagtgagatagaggaggaaattttatgagtgcagtgatcaaattagaacatattgatgtcacttttaaaagtaaagcacggacggtacaggcagttcacgatgtatcgttagaagttgaaaaaggggaaatctacggtattgttggttattccggtgctggtaaaagtaccttagttcgggtgatcaatttattacagcaaccaactaagggtcaggttgaagttaatcaacaagatctgctgtccttaaaagccaaaccattgcggcaagcgcgtaaaaagattgggatgatctttcagcatttcaatctgatgaatgcacggacaatcgctgataatgttgattatcctttgaaaagctctaacttaacaaaagcacaacgaagagctaaggtggctgatctattggacctcgttggtttggcggataagaagaatgcttatccagctcaactttctggtgggcaaaagcagcgggttgccattgcccgagcattagccaatgacccagaaattttaatttctgatgaagcaaccagtgcgcttgatcctaaaacgacgctttccattctagaattattacgcagtctgaatcagcgactaggcctgacaatcgtattgatcacccatgaaatgcaagcagtcaaagaaatctgtcaaaaagttgcggtaatggaaaatggtcaaatcattgaacgcggcgatttgttacaagttttcagtcaaccacaaaaacaattgaccaaagatttcattaatacggctacacaagtcgaacaagcgctagctaaagtgttacaacagccggctattcagcatttacgggccaatgaacgtttagttgaattatcctatattggcgatagcactgatcagccgttgatcactgaattatacaaacgttatttggtaacagccaatattctatttggtaacgtggagattttgcagggaacgccagtgggaaatttgattgtaaccctaagcggtgctgaaaagaatcttaacgcagctactgagtatttgcgtcaggcgcaagtaaacattcgggagatcaaggtaggtcgcgatgtgattcctctggttaaacaggaacatacctaaaaagttatagtataaaaattaaccattattgtagagaagcgggtttcaacgaggtagtttttaccttgattgaatagatattggcacaactatcagaagcttattggtagtttgggctaataaattaacctattttagtgagataaaggagtgctaaggatggcaactatttttgcgcattattttcctaatgttgtaggtatcagtgatcaatttatacagagtacatgggaaaccatttatatggtagtagcaacagctatcattgcgggtattctcggtttggttttgggggtagcgttaacggtgactgagccgggtcatattttagcgcaacggaccgtttatagtgttttggataaactagttaatttatttcgttcaattccgttcattattttgttagcagttatcgttcctttcacccgtctattagtagggacttcaattgggacaacagcagcaattgtgcccttagtgttaggttcagcaccattttatgcgcggcaaattcagaacgcactggtggaagttgaccctggcatcattgaggccgccgagtcagttggttccagcccattagaaattattttccgggtctacttaaaagagggcttgtcagaaatcattcgagtatctgtggttactttgatcagtgtgatcggtttaactgcgatggcgggcgctgttggtggtggcggtttaggtaacttggcgatcagtgtcggttacaatcgtttccaaaatgatgttaccttcgttgcgatgattattattttattaatggttttcttcgttcagatcattggcgatttctttgcgcgtaaaacggcgcattaaaagaagtgactcttgctaacattgagcacttaataagtatatttcaaaatgaactaagaatcgttaccgcttctttttattttgctaattttaagcgaacgtacgttcaaatgtgctgatgtgtggtaaaatataattactaattagcgatgggagcgtttcttttgagcctaaaatttatttttggacctgcaagcaccgagcgccgtggtgctttagttgatcaattagcacaacaaatgcaagctgatcctaatgggcagttcttttatattgtgcccaatcacattaaattcagttctgaagttgatatattgacggctttaaagcagcgccgccacagtgaagacaaggtctttgcggctagccgaattcaagttttttcgttttcacgtttggcttggtattttatgaaaaatacaccttattaccagattccacggattgggactgctggattaaatatggtcgtttatcaaatcatggctgatttagctgatcagctaacgatttatcgtggtgaattaacgcaacctggttttgttgcgcaattggtcaaacaattgctagctttaaaggtgggctgcgtcacggcggctgatctacaacagatcgctgatgaattggattctgataccgatttggccgctaaaacacatgatttggcgttgatctatactgcctttgagcagacaatgcaaggacgttatattgaaaataccgatctactaaatgcgttaagtgattatttattacagcaggatctaagtcatacttatttttatattgatggtttctcccaattatcagctcaagaaaatcgtttgctgttgactttgattcaaaaagcaacgcaggtgacactggggttgatgttggatcgaccttatcgacaacaactgccggaaaaacaggcgctattctttcatccgggccagttgtatcatcaactttatcaaacagcccgtagcttacatgtgccgattttagctgatttacaggtgaccgaacaacgggtgacacctgatttacaacgattagaggcttattggcaacattcgactagtggtagtcgtcaattacggccagaagctttgcaaaatgcaaaaagtatccaaattgttcaagcggatacccgccaaactgaaattcggcaggtagcgaccaaaattcggcagatggttgcgctacagggctatcgttatcaggattttttagtgttgacccgccatctggatgcgtacgaaactattttggaaccaacatttcgtgagtttggtatcccagcatttgatgatctacaacatcacatgacggatcatccgctggttgagttgatcaatgcgttgtttgccgtcaaacaacattattatcgctatcaggacatgatgcgtttattgaaaactgaattgctgttgccacaggtcgatggccagccgatgcctaatcaagcgtatcgccaggcagttgatttaaccgaaaatatggtactaaaatatgggtttagcggcaaacaatggctgcgtaaagatgattggcaattttatcgttttgatgatcaggactttggtacgcagtcaaccaaggatgatgatagttcagcgcaagtgaatttgattcggcactttgttcgcgataccttgccaccattttttaaaaaactggatcaggccaaaaatggacaagccgccgcgcaagtgctttataactttttagttgagcatggtgtggtgacacaattacaggcctggcgggatcaagcactagaccaaggtaatttggctcaagctgcagaaccggagcaaacttggcaaatcttttgtaccatgttggatgaatatgtaacgattttaggttcagtctcatttcaagcaacggacctactcgctttatttcaggttgggtttgaaggtgccagctactcacaaattccctcgacgttagatcaagttttgatttcagaaacggggatggtacaaaccgcgatgcgtaaagtggtgtttatgatcggtagtactgaccaggtcatgcccgaccgtattgtcaataatcagttgttatcggatgttgatcaagaacaattgaccccgcatttggcggagggcgcttatttgatggatgatgcgctgacgcagatggctagtgaaccttttttgaattacactgcttttttaactgcgcgtgaacagttgatttttacgtatccgttggctgatgatggtagttccttgaagttatcaccttatgttgaaagaatcatgaatcatttccaactggtgccacaagttgcgcaaactaggccggatattacggctaataaaattgcgccgtttgttggttcaaagcgcagtactttatcacatttgattcaagttagccgtgacgcaatggcccagaaaacacagttaccaccgatctggttgtacgtctatcgtttgttgcggcaagatggtggctacagtgcgctaactgagcgtttattggcaagtttgaactaccgcaatgtaccccaaaaattgcgaccggagattgttgaagccttgtacggtaaaacaatcaatacttcaatttcaaaattagaagaattttatcaaaatcagtatgcgtatttcttgaaatatggcttgaaattacgcgagcgtgatatttttgaactatcaccagctagtgccggtgaattttatcatatggctttagatcagttatttaagcgagtgcaggctgaaggacaacaattggctgaattatctaccaccgatgttgatcgcttgatcgatagtatcctgctgaaaatgtcgacgttaccgcaatttcagattttggccagttctaatcggatggcttatttagctcgccaattgaccgcgacgatcaagcaagttgcccatgcattgcagtatcaaggtcaacagactaaaatgacgcctttgcgcaccgaagttttattcgggcacgtcggtagtacagacggtttagcgccgttgcaatttaagttgcctcacggtcgccaagttaaagtccgtggtaaaatcgatcggatcgatcaaatggtactcggtaatacacgctatttaggaattgttgactataaatctggtgtccgtgattttgattttcgggatgcctattatggcttagccttgcagatgttaacctatctagatgcgatgatgcgcaatgcaactgatttaacagcggacacacaactacaaaccaagccggctggtgctttatacatgcatttacaaaatcctaagcttaagttaacggaagttttgaccaaaggattcgatgacgctttgttgaccaaaaataaatatcaaggtttcttattaaatgacgaaccactgctagagaatttagatcacgaattggccgaacgaactggcagttctaaggtttatccgttgactaaaactaattctggctactcccttaaacagagtcgattggtgaccgaatcagagttagcgttactgttaacccatgatgaggagttgatccaggcagcagctttagcgatttttgctggtgaacttaaactaaacccagttaaatggccaaataatcaaacggcattgcaatattcaccgtttaagtcaatcatgcagtttgatgcgatgttgccggaaaataactatcgacaattgactgcattagatcgtgcgaccgtgttagccatgctaaaagcagagcaacagcagaaggaggataaatagtgagcgcaaaaacaaactttactgcaagtcagcaacacgcagttacagatgctggacgtaatatcctagtttctgcttcagccggttcggggaagacaactgtgctggttgaacgcgtgattcaaaaaattttacatggcaccaatgttgatgagcttttagtcgtgacttttactgaagcggccgccagtgaaatgcgagaccgcatccaaacggctttgcaaaaggcattagctgctagtgaagagcctaagcaacggcagcatttaagtcagcagcttagtcggttagcggtggcacacatcagtacattgcacgctttttgtttgcaattgatcgaacgttactattatgtgatcgatctagacccggtttttcgtttattgactgatgacacggaagtcattttattgcgggaagatgtctggtcagatttgcgggagactttgtatggtgatagcccggcttttgcgcaattgaccgctaatttttccaacgatcgtagcgatgatgggctgactgatttagtgatgcgattatatgattttgctaacgccaatccggagccgacaaagtggttggcgcaactggctgccgcttatcacattacggtagcggaaccaacggctagtacgttctatcagcaacagttgttaccactgttgcaggaagagttgacgcaggcaagccaggatcttagtagtgcgcaagcaattgcagcagagcaacaattggataagttggttgcctgtttaatagcggatcagcaacaagtagccgctttgcaagcacaattgactagcgcaacctgggatgaattgcggcagcagtttttgacttttaaactaaaacgggcaccttcactgcgtaatttggacgatgaggctaaagtagctaaaacgacggcaacagattttcggaaacaagcaaagcaacgcgtgagtgccattggtgatgcttactttggcttatcggctgatcgattgatcgaggtgatggggcaaacagaacaattagtgactcagttggtggccgtagtggaacaatttggtcaagcctttcgtgccgaaaaacaacggcggcatttattggactttagtgatttagaacattttaccttggcaatcttaactgcggataacgccagtggggtgcaaacccgaactgcgttgcagcggcaatttagcgaagtcttagtcgatgagtatcaagatactaatcgcttgcaggagacgattttgactaccgtggcacaatctgatcctggcaatatgtttatggtcggggatgttaaacagtcgatctatgcctttcgcttggccgatcctagtttgttcttggataaataccatcagtttgcccaagctgatagtgccgatcaacggatcattttggcggaaaatttccgctcggtggcgaacattgatgattttaccaacttaattttcagtcagttaatggatcaaactgtgggtgaaatggcctatgatgacagtgccaagttagtggccggtgctaaatatccggctgacttgccggcgacaactgaattattggtgtacgaggccgataccgctaccgcagaggatggtatcccagagcaatttgcattggatgataaggctcagggacaggtagcactggtggcgcaacgaatcaagcagttggtggatcacggtcaagtttatgaccgtaaaaatgagcaactgcgaccaattcggtatcaagatattgttttgctaacaccaacgcgcaagaataatttgatcattgttgattggtttaagcggttaggtattccagttgtcgttaatggggcacaaagttattttcagaccactgaaattcaaattatgatggcgttattaagtgtcatcgataatccttatcaagatattcctttggttagtgtgttacgctcaccaatcgttgggcttaacgaaaacgaactagcattcttacgaattaatcgccgcactggtgattattatcaagcggtacttgatttccaacaaaattttgtgccaatgggtgcgccagaattccaacagcaattgtatgctaaaatcgaccgttttctaggccagcttgaccaattccgggaattagcacggcagaatcaattggttactttgatttggacgatttataatgaaaccggctttctagactatgtaggtgggatgccagctggtgcgcaacggcaggctaatttacatgcgctgtacgaacgtgcacatgcgtatgaagccagcagtttcaaaggcttgtttcaatttgtacggtttatcaagcaaatgcaggaaaaagataaagatctaggtgaagcaccagcacaaacagttgaagatgccgtttccgttatgacaatccatggtagtaaagggctggaatttccagtggtctttttgatggatgctacgcaccagttcaaccaagataatttacgtggtcagtatatcttggatgatcgttttggaattggcgttacttatttagatccagataaacggatcgagatcaacttaccgcaaaaacagattgcttatacgctagcacggcggcggcaagcggctgaagaaatgcgtttattatatgttgctttgactcgagcagagcagcaattatttatcgtcggtagttatccgaatcgagaaaaggcattggccaattggcagaaagcttttcagagtcagcatttagtgctaaatgctgggctacgcagcggtatcaacaattttatggattggttgggtatgtgtctagttcgccatccacaatttgatcaaagcttattaacccaagtaaattcatttagcggtttagcacaggaccaaactcaatttaaagttcatttctatacagctaatgacgttttaccagcagaaatgactactgaaattgatcaaactaattggccggataaatttgcggcagcagcgcgtacgactgattttaccagtttaaatgttgatcagttagatcaagtattgaatctgcgttatccatttcaagcggcgacgcaaacaacggcttatcaagcagtttcagaagtgaaacgtttatttgatgatccaacgaatagtgaaatgaatcccttgcttgttgacgctggtgaaaaagcaccgggcgttcatcgctatgtagcccaggactttgcagtaccacaatttatgcagacgaccacacaggtaccgccgactgcagtcgggacggcgacgcatcttgttttacaagaagttgatttgcatacagcgccaactgcggctagtatcgctcagttgatcaaggagcttgtggctcaaaatattattgcggcaccggtggccaagcaaattaaaccagctcatattctgcgtttctttgccagtgatctgggacggcagttgttggcacagccggataatgtggttcgcgaagcaccattttcgttgttattaccggcgactcaattgtttactgactttgctcccgacgatcccgcacagattctgattcatgggatcatggacggttatttagtgacctctgatcaggtgatcttatttgattacaaaacggattatgtcccacaaaccaacgctgcacctaaaattaatcagttgaagcagcgttatgcagggcaattgaacctatatgcggcagcattggcccgtattctacaacgtccggtaacgcacaaatacctttatctactggctagtggcgattcattggccgtttgatcaaaaagctatcttatggaacatgctttgactatcttgttcggaagtacaaagaaagagttgcggtataaatgatttatgccgcaactctttttaggttctatttattttgttgtagttgaatactgattgttccaatcgactctttgttggtggggttgctggcaacatattcaacagtacttgtatcattctttaacgctaaaccgacaacagcggtgacggtctggccagcagctacggctgttttagcttgattgctatttgtggcgtagctggtctcactttgctgatagctggtggctggaatgccttcatttaatttggtgccatcttgctggaattcaccatattgttgtaatatcgttgctggcgttaagtcagcgttgcttttatttttaaaggtgtaagtaaagaggatcactttaccgttattatcgtcgctgactatctgaatcttactgaatttgagctgaaaatttttagtgttaagtgtgttaccagaagcataggtattattttcagcttgatagcttaaaacgtttttcaacgaatccggttgctcgccattaaaatatttttttgcgatttgctgtgcttccgtgtttagagcaataaaattacgggagtaggcgctattattggcgtttttaagtgttgttagtaaactggtaattgtttggctgtagtgtagtaatgccttggtcaacttaacgtgggtccgattgtgttttaattcagtgctaaaccgtgaaagttcaaaacccagctaaacctgattgcactaagttattttagcccaagattaaacacaagcagctccttgaagtatacttgagtcgtctaaaccacgatacaaaggagtgcttg

SEQ ID NO: 558 - DNA, 18207 bp, Unknown
  Metagenome-assembled genome
ccatcattgatgaactcttcgatcaatttatccgaacactgcccaataatctggcccaattattgggcaatggcgtgtaataactgaattaactaatttttagtcttcaaactcaggactagcaggagtttgaagttatttgggtactttcaacctttaggaatattatcaagaatcggcggaatcgccgttaatggcattcgcaggcaggttcccaataaaataatgcctagtaacagccaccggtaacgtttttgcataagttgcacgctcactttctggaattgcaaccctgagacagggatatcaagcctaatataactgattcgcccagataagtaaacgcttactaagatatttatgctatattattgggcatgaaaatagtgttaggaataatccttggcgcattcaaaatttaaactaaaaatttttgttcattaaaaatataacgcttccatctttaattcagccgcgtttcatgctaaactttaggttcagacaaaacggcgctgtgattcaacttggttgttttaaccgagttgaatcaatagcaactgtttttagccgctggtgctaaaaacaattatttcttatgtgggagccatatttttgccaagtagggtcgcgaccaaccgaatggtcattggccgaaaccacaaaaattttggtctaaaaatttgccccttagggtggcgtagaggagactttattttatgaagattgttgtacttgctggcggacgtagccccgaacgcaacgtgtcgctttcatcgggcgccaaaatcaccaatgcattacgggaaaaaggccatgctgcagtgttgatcgacttgtttttaggtgacgatttaagtgacgttgagacgattgcggcggtgtttcagcgcccagctccaagtgctgattacgcgatcagtgaagagattttaaccaatgacgcgatcgatgctttacggagcacagatgataaaggtttattcgggcctaatgtactaaaaatctgtagtgcggctgacattgtttttttgggcttgcacggtgaagatggggaaaacggtaaggttcaagcaacgttagacttatttggtattccctatactggtagcggttttatcgcatcgggagttacgatgaataaacatttggccaaacagttgttgcagcataaccaaatcaatacagcccgttatcagacgatcaaggctggcgaaccagtaccacaactggcatttgattttccaatggtggttaaaccgactcatggtggttctagtattggcatggaaatcgtgccggatcggcctgcgttgatagcggctttaactgaagcggggcacttcgataatgaggtggtggttgaggaatatattgctggtcgcgaattttcggtgggtgttctcaatgggcaagccttaccggcgatcgagatcacggtggccgatggctggtatgattatgaacataaatatcaggataatggcgccacttaccaaacgccgccgcacattccggctacggtccaccaagaaatgcagcagatggccttggcaacgatgcaagtgttaggtttgaccaattatgggcgaatcgactttctttgggatggtcagacgatctatgtgatcgaaggtaactcgctgccggggatgacgccgcattcattattaccgcaagaggcggccgcggttggtatcagttatgcggatctatgtgagcagattattgccggccagcttgacgcgtaaaaagctacggtcatggtccgttagttatttttgaagtggtatactacggatgtagttactaaaaataagggggcttttttgatgagcaaagtttttctatccgctaagttgccaactgcaacaacgcaaattttgactgatcatcattttacggtgcaaacttatactggaactggattaatttctcatgcagaactgctacggcaggtcagcgatgttgattatttgatcacgccattatcgactcaggttgacgctgaagtgatcgatgcggcgccgcacttaaaattgatcgctaattttggtgccggttttaataatattgacgctgcttacgcgaaaactaagggaattcaggtaacgaatacgccggcggtttcgactaattcagtggccgaagtgacgatcgggttaatgttggcactcagtcatcgcatggttgaaggcgatcagcaaatgcgtactaccggctttcctggttgggcgcccctgtatttcttaggtcacgagatcgctgggaaaacgttgggaattgttggctttggcaatattggtcgggaagtagcacgtaaagcgcgggcattagccgtcaatgtacagtattggcagccccatcgtttatccgatccggaagaacgcagtcttggcgtgacctatgtgtcgtttgccgatttagttgaccagagtgactttatcagtatcaatgcaccgcagaccaaggaaaatcaccatcaattcgatggcgccgtttttcagcaaatgaaggcaaccgcttatttgatcaatgtgggccgcgggccaatcgttgacgagacagcgttactgactgcgttacagcaaaaggagatcgccggcgcagcgttagatgtttatgaacatgaacctaaggtgactgtaggtctggaaaaattgaccaacgtgattttgacaccgcatattgggaatgcgacggttgaagcccgggcggctatgggaacgatcgttgccaataacgttgtgttagttgagcagggacaagccgctaaatttatcgtcaacggctaaatgtttctcttttttcagtaacttacctaaaattcaaaaaatattcataattatttaatataattatcatggaattaatcttaggataaggatcgtttcatggtaatgagaagtaagcagcaatttaggcgattattaggtgttgcggcggttttgttggttacagttgggctggtcggttgcgggcaaaatcagcaaaaggcaacgccaaaaaccaatactaccaaattattgtcggtaaagcagatcaaagaaaatattggtagtaagttggtgacaacgcgggcggataagtaaaaaagtgccacccaaacttataaaacggcgttagcaaatacggactatacattagctaaaccgtacgtcaaggtgaacccataccaaacatcgccattaacggcgctagttatttttcaaacggatcaggcggctaaagtgaaatatacggtggttggtaagactgcgaatacatcgatcaccaatcaggtcaatggtggttatagtacccagcatcaggtaacttatcaagatggcaccacgactgagcaaacgttggcgatcaagacgactactgagttacctaagtatttacagcaaactaagatcaaagtcacaaaaaataataaacaacaaatggcgctcggtgataataagttgactttcatgatccgaacgacgaagcaatggtttgccatcgacgctgacggtgccattcggtggtactcgactttgtacgttcaacatatgttgcaaccgatccataatggtcatttattgttattaagtaagaaaacacagtcctcaatggtctataatgatttgctggaaaccgattatttaggtcgcgtatataaggaatacacgttccgcgccaaaactagtaataacgatggtggtaaggagactacagtactgcaccacgatatcattgagttaccgaaccatgacttagttgccaccgtcaatgatggctcggactatgttgaagatacgatggtcgtgatctcagcgcagactggtaaaattactaaagtgatcgatctgaaaaaattgttaccgcagacgatgtataccaaatataaggctgccagtgatggcgatattgattggttccatcagaactcggtttattatgatcgcaatgaccgcagcttactgatctccggacgtaatcaagatatgatcatgaaaatcgatttgcaaacaaataagatcaagtggctctattcgggtaaaaaggcgtcaacgtggccgcaaaagtatcgtagtttattgctaacgccaaccaagggaactacgatcaccggtggtcagcacggcttggatctcttaagcgacgataatagtgatcctagcagtgaaaacattttgctatacgataataatattgatgtgactaacggtgacgcgcagacgtcaggtaagtactcgcaaggtgtccaataccatatcgataccaagaaaatgacgatcaatcaaacttgggcgtatggcaaatcactgggacaggccaactttacgccagttatcggctatacccaaaagctgaatgatgccaactatttaattgattttggtttccagaataaagggagatctagtaacgttattgaagttaatgggcagcaacaagtcttcaatgtaaaattgaccaatccggcgtctaaagcgtatgtttaccgtgcttatcgattaccggtctatgccagcagttatcaattcgatcttgagcaataaacacttgcttttttaattatgtactaacataattaagctgaggtgagtgcaatgacagcaaaaaagcagccactacatcaacaaatcgagatcgatctacgccgaaaaattcaggatggcacttatccagagcagcaactgattcctaaagaggttgagctggcacagcattatcaagtgagtcgaccgacaattcgccaagcggtccaagctttagttgatcaaggttttctggaaaaacgaaaacggcgggggaccatggttaagcgcgctaaaattggccaggcgtttacccatgtgatcagtagttatgatcaggagatcgatgcgactgggatgaaaccgcgcactaaagtattagtttttaaagctgagccggcaacggtggaagtagcccaacaattgggtttgccggtggccgcacctgtgtataaattagtgcggttacgctatgcggatcaaacaccggtggtactagtgacgacttatattccgcaagcgcgctttcctgattttactgaattagattttagtcagacttcgttatacgcgacttttgcggtacaccaacaagcagttgtccgtgtacggcgtaaattggaagttttagtcgctgatgagaccagtgccgacttattggatgttgagatcggagcaccactattttattttcacacacaaggttacaccgcagcggcgctcccaatcgaatatttaattgcgaaatatcgtggtgatttaaattacttccgcttggaaatcgaacaaaaaataaattaataaaggatcgtgttcacgcttaaatgcaaacgaacacgatcctttttgttagacctgctttttcaaactttcaatgatttgtacgccagcactagtaccaattcgttctgcaccagcatcgatcatcgctaaaaagtcggtggcgctacgaatgccgccagcagcctttactttaactgcagcaccgacagtttgcttcatcagtcgcacgtcggcaattgttgcaccgccagtaccaaaaccagttgatgttttgataaagtcaggctgtacttctttggcgatcaaggctaattggcgaatttcgtcgttagtcaggtaacaattttcaaaaatcactttgcaaggaagttggtgctgatgacagcaggcgaccatttgcgtcatttccgacttaatgtacgcataatcaccgtttttaacttcggttaaattcaccacataatcgatttcggtggcgccatttttgatggcgtcttcggtttcaaaaactttggcggcaatcgtcgtctgtcctagcgggaagctgatcgccgcgccaacgtcaatatcggtaccggctagatattctgcgcaccgttgagtttgtgattgattgatcgccaccatcttaaaatggtattgtttcgcttcagcgcaaagctttttcatatcggctgcagaggcatcagcatgtaaattggtgtgatcaatcatccgtgcatagtggtcaagttgttgtggggtcataaataggcttctttccatatgtaattacatattataataaaccgttttctttgaagcgtcaaatttggttattgacatgactaatggatatttttaatattattagaaaataatgagaaaactggaatgcagtaggaggtattttaaatgtcattagaaaatgtgcaacattattttgctcagtatggattagatcagcgaatcattgaattaccggaatctagtgccactgttgcactggcagctacggccttacatacacagccagaacggatcgctaagtcgctaacttttgctgtagcggataagccggtgttggtggtgatggccggcgatgcgcgcattgctaacgccaagtttaaagctcaatttcaagttaaggcccatctattgccacgtgatcaagttgaacctttgatcggccaaccagtcggcggtgtttgcccgttcgcggttaaaagtgatgtggcaatttatttagatcagtcgttgcgccgttttcaaactgttttcccagcagctggtagcactaacagcgctatcgaattaaccttgccagaattggagcaatattcccacgctcgtggctggattgatattgctaaaacggcctaaaataagcgcgctcgagtaaaaattcaagcgcgcttattttagtggtgcaaaggatttttgcgtgtgttcttaccctgaactatttataatgagggtgaggtgagggcactggcagatttaaatgaccaactgcggcaacgacgtcaagcattgaagttaacacagcaggcagttgcacaacaattacatgtgtcacggcagacaatttctaattgggagcgtggttcgagtacaccgaattggcatgatttgcaggcattgagccaagtttattcgttacctttagcagaactgattcagcaagcgctactaactaatcaacggaaacaaatctggcttaaacggactgactatgcgctggtaattttatcacttggtttatttgttcccatcatttttttcgatgctggtcagctgatcgtagaaattattgtggcagtagatacgatactattaatgtttaatgttggttgctggtttacgttactatttattgcccgcttttcccagtaaagtcctttttatcccaaaaagttttggctggggttgggcaattaatccgcgtaatccgttagggttggttttgaatatcttagtatttataggagttattgtcatgttattggttgctattttttcaacataagaaaaagaccatattgctattcgttatagccatatggtcttttatattagtcagcgaatggtgctttgcctagataagcactaatcatccaaatatttttgtcggtttcatccttgaagccattgagcatatcttgagttggaaagtctttttcttcgtcagtaacttcgattcctttttgatattggtcacgtaggtacttgaattgatcaactagccgttgcatgaattcagccatcgttaattgatcaaaagcgactttatcgtctggtaaaccagtattttcaatgaattcgtgagttgttgccagtgggctgccgtttaaagcaatcaaacgttctgcaatttgatcaagctgttcgcttagttgatcgccatattcgtccatcagcggatggagacggaagaagttttcaccgcgcatataccagtgtgtttgttgaacgttgacctttaattggctgatgtcggcaatcagttgattgagttgtgcctttgattttggaaagtcataattgtaagttgtcataatgaacccctcttcataattattggttacactaataccttaacagttatgaaaacgtttttcaaatcaaatgcttgtggtccattggcggtataaatcttctataatcgctacggtgtggcaggtgagtgccggcgtcataactgggctagtcagttgatgttggtaccagagctgattaaagtgctgaatctcaaaaacaaattcactattttgagtgacctgtaacgaggtggcgtggccagtattatcatataaagtggcgctgctggccttccagtagttaggaatcacgattttaccatgactgccatagatgatcattctgctaggtagtggtgttttggcggtgatgaataggtggactaaaatattcttttcggtctgcaggatcacatcactttgttgatcagctgctggtgcctgccgctgatagaggccgtgatagctagtaaagcgttgtgctaataagtattgaatatagtctagcgggtaggcagcgctaccatgaaaagcaccaccaccggcggcaatatcttggaaccaagcaattttagtgccaccgggatgataactttgggcatcgatccaactaacttcaccgatcgcaccttgctgcaacagttgcttgattttctgagtcagtggcagaaaaactgccttttgagcggccattaaggttacttgatgctgttgagctagagcaaataaattttgggcttgatcaagggtcagcgtgaacggtttttccagtaatacacttttaccgtggctgatggctagtttggcaccagcataatgaccgccattataaaggggaatgtagatcacatccaaatcaggatcagcgactaattcggcataactgccatacgcccgcggaatttgattggcgtgggcaaatttttgcgcacgagatagattgcgcgtgccaattgctaaaacttgtgcagctccagcttcacgtaagcccgcgataaaacggggcgcgatttgtgcggcgcccatgatgccatagttaattagttgcacttagatcacctcgaataacgatttaattctaacgtagcagtttagaaaacgcttgtacagtgggataaacaaaaaacacgccgttatgcgtgtttttcggttaaaactggccattgggaatacccggacctgtattggttccagtgccagttgtattatcgtaagtgttggtagtgtcgctactgctataggtgctgccatcactataggtgccagtgccgtaatcgacagtactatcggaaccataaatcgtgtacgttgtatttgtaacaccgtcaaagtatggatttgccttatttagctcggtttctttattgctgacagtttcagcacttaagtttaattgtttacgtaatttcttcgagatgcgattgatttctttagttggagcaatctggtaggagctaccgttgatataggcatcttgaccttgtagttgatcagagaccatgttagtcgctgctgaacgataattagccgccaagcccttcatatcagaaaaactaagatctgtttgtaggttgttttgaacaacactgaggatcttttgataattagcgaccccgtttaatgacaatagtttcttggtgacagccttgattacttgttgttgccgcaattgccgaccatagtcacccttaggatcatcgtaacgcatccgggcaaaggagagggcttgcttaccgttcaagtggtgagtccctttcttgatcgtaatgttattaaaggtgaaggtcaggttacttgtgaccgtgacgccaccaacggcatcgacaattttagctaaaccacccatattcaaggttaaataataattaattggaatatttaatagtttgctgacggtttttttagcggttttggcgccaccaatttcgtaagcagagttgattttctgaatactagtttcaccgctggccgtcatttccgccatggtatcacgaggaatactgacaaaagtcgttttcttagtggttggattgatcgtcgccacgatcatagtgtcggagcgacctttatctgtccgcccatctgcgccagtatcgatccctaacaataggatcgacagcggctttttctgtttgaccactgctgaggcgttctcgtcacttgctttgtaaatcttattagcggtttgtttagtttggtagtaggcataggccgcaaatacgccaccgaccagcaacataactgcaatcacggcaagcaaaattttcggccatcgtctggatttctttttatgcaacataaattagtccctttcatgtacctcttattctttgcaattatagcagttgtggcttaaatcaagcttaaatattttgataagcttataagatgcggcgctatagaaccatgaaattaaagtttttagttataaaaaaagtaccgcttaatcagcggtacgtcaataaaaatcatttttctggtgtttcatcaggcgttaagtcaacttggcgtgtaaccttaaaccaactgatgtaggcattctcgactgcaccaacggtaaaagtaaaatcatcgatcttgaagacgtcatcaggcttaacggcgggatggtctttcataatatagccggttaatgtgactacgtcagaatcatcaaattcacggcttttaacgttgaagtaacgttcaaaatcataaagggtgatcttaccattaacccggtaactaccatcattttgtttttctacatattcatcagatggaatttcgttttcatccttgacggtgccaaataattcttcatagatatctttatcggtcacgataccactagtaccaccgtactcatcaactaccacaacgatcggggttcgtttctgaaccatttgtgcgaggacattttgtagtggggcggtttctggcacggtgataatattacgtaagagcttgctgactttgatttggtcgctgttttcggcttgtttgatcaaatcataattataaacgtagccgatgatcttatctttatcattattttcaacgacaggaaagcggctaaagccattagtgatgtacattttgatcgtttcagccaccgttgctgtaacgtccacaacgatcagtgaagtccgatcaaccataatatctttggcgattttatcattcatggcaaaggcgcgttccatgtagatataatcattccgttccagttggccaccgctaaccgcattacgggataaggacaaaatttctgcctgggagaagttctcattttcctcgtcagccggctttaagccaattaaacgaacgacaccgctggctgaaacatttagcaaccagacaaatggatagaaaatcaaatgaaaataacgtaaaggcgttgtaatgaacatcatcgttggtaatggcatatcaatactgatatttttagggacgatttcggtaaagacaacttctaagtaagttaacacgatgacaccgagaaccgcacctaccgcgtgtaatgccgcggggttcattaaatggcctagattgaacaaatcaactagaattgtctccaccgtggcttcgccgatccaacctaagataatgccggcgacactgaccccaacttgagtggtcgataaatattcatttaaattatgcaccatatgcagtgcggtgctaacttttttagagtggccaccacgtttttctaactcttcttcaagtgcgcttggtcgggtttgcaccaaagcaaactccgaagccacaaaaaacgccgcaaataaaaaggtgatcaacatgatgaccgaatttacagcgatttgactaccagtcacgatcattcctcatttcactcaatataactttattctaccatgtttaaatagtaaattaagtcctgataccaaaattagctatgtaattgatacttccattaactagtgggtattaattatcgcactaattataataatgtacagtctttttagcttagacgtcatctaaattaaacaaatattaaatcagtcgcaagtcggtggttagttggtaaaagtctggtaaagttaaaataggcaagtggtataaagccgcttagctttaataataatgaattaatggcatagctataaaaatcagcatggtattactctgctgattaagcacgtccaattttaaggagaacaaataatgatcgttacaattattattgcagtaatcttgatcatggctgtttatcgcgggatgcagcgtggcttgatcgtccaattactttatacactgggctacattggtgtttatattttcgcgcggctggcggcacctagtgttagtgcttggttggcaacttggtcaggcagtgccgcagccagtcttggtgtgactaatatgatcgcctttttaatgatgatcgcgttagggtggtttattgtccgcttgctggcacgctggtcacgattgatcacttggctaccagtcattaagcaagtcaatagtgttgccggcgcggtagtggcgttcgtgttaaattatattggtttgttcattgttttgacggtgctgaattttattcctaatacggcgattcaatatcaaatttcgcagtccagcgttgcgcaagttattatcgataaaacgccagtgttaactagccaactgctacaaaagtacttattcaataatgaagatactgataacacagattcgacgaccgatgacagtagctcgaccactgatcaaagtgatgaagtaactacaacagatgcgaattcaatttagagctaaaactcgacaccgataatggtggcgagtttttgtttgattagttaaaaattatccttcatcttgggtaatctcttattttacacttacgaaaacttaatttttctgctaaagtaatcttctgtgttcagaaatcagatttggtttacggcataactttttggaaggggggatttttcaatatgaaaaatctcgcagagactaaacgtttgccgatcatggctggtctactcatcggtggcttcatcggtatgttcagtgaaacagcgcttaatattgcattagcaccactgacaactaaattgggtgtatccactgggacgattcagtggctggttattggttatttattaatggtcggtattttattgccattatctggattattgacccgttggttcacaacacggcaattattgatttttgcgttatgtgattttattgttggggcactgatcgcagctttatcatcatcatttacgttcttattcatcgggcgtttgattcagggtgttgggacaggtattttactgccattgattttcttagttgccctggccatttatccgttggaaaaacggggtgcagcaatgggcttaattggcctagtgatcatgttcgcaccagcaattggcccgacggtggctgggttgatccttggcgctttatcgtggcagtatattttttgggcgatgattccattcttagtgatcgctttgatcaccacgattatcttcacaaaaaatgtgatgccgatcacacggccacatgttgatgccttatcaatttgtctatccacgatcgggttcggtggtgttgttctcggaatcagtttggccagtgataaaggttggacctcgccaattgttcttggtgcgttggttgtcggaattgtggcgttgttcttctttatccgccggcaattgaagttaccagaaccaattctcaatgttaaggcttttgcgcatgttggtttttctttaggtactgggttggtcatgatcgactttatgatcattatgacatcaatgtacttattgccgatctattggcaaaaagggttattggtgccagttgcattaactgggatgttaatgttacctggtggtattatcaacgcagtggtttcatcgatttctggtcgtttgtacgataactttggcgcgcggatgcctgccatgttaggcttcttggtttcgattattggtgcgctgatgctattctttggaaatgctgactccagttatctctatgttgtgtttgcccacgttattttaatgatcggggcaccactcgctatgtcgccatcacagacccatggtttaaatgcattaccgcagcaattatccgctgatgggagtagtattatgaataccttgcagcagatctgtggtgcaattgcgacggctttggcgacgagtttgctaggggttggtgaagccgttagttctgcagctggtgcggctaaagtcgccagtggcacgcggtttgggtttgctctaacagttggtttggcagtattaggttttctattgacgtttgctttaccatgtaaacaaaaagcttaagttgggtgttgatcaactataagtggctttgcttttaaactttaaatattatgaaaaataaaacctgctaggttggtaattggccaacttaacaggttttatttagtcataattacgatttcatgtgctcacgagctaaaatgtcctcagtaatattctgcagcgtaatttcgttcatccgctgaaaggctgttgcttcaatgtcagcataatacatatttaatgtttcttgaatattcccaccaatgatacattgaggattagttttaggatcgatatgcagcaggttgtgatccattgtgattgcttggtagacgtttaaaatggtgatttgatcgggcgccacactcagtgtagtggtggcactgccaggtttggtattgatcaaaccgcctttccttagatcagacattaaattacggacaacgctggcatttgcttcgatacttgcagcaatcgccttactagaaagatcaccgtctttacagatgattaaataggccagaatatgaattgcgtcacttaacttgtgtgagtacttcacgctttacacctaatttcgcttaataatttcattaattgcttccggcagactagttaattcatgccccagaaccgctggcagatcaattgttgtttcgtttaaggaaccatcattgattggttcttggaatgaagcaaaaagcgcagccgtattggcatctagtccagtggccactaagttattctgatattcagctgtcgtcatttgtttgaccgcaaaatgatgaccagtggcttgttgcagagctgcgcctagttcagcataggaccgtgctggaccggcgaattcgtaaacttcttttggcccatttaatgttaacactttagcggcggctgcggcaaattcacgttctagtgcccagccagctttaccacttgcccagtaagcagcggtttgatttgcggcgccactttgtaaaaagccgatttcgttttctaaataccaattattacgtaaaaatgcatgggcgacgccactgtttttaatagcagtttcagtgattctatgatcgctggctaaggcgctaattgaattttgggcattaggaaaactagtgtaagcaacaaattttacatgcgctgcgactaaagcgttaaccacattttgatgttggacagcacgagcgactgactcacctggtagtgaggaaatgaaaagtaagcggtcgacgccctgtaaggcgtttgccatagttgtttcatcggtataatcggcttgtcggatctcaataccttgtggtaataatttcttagccttagcgacgttgcgtgcgattgcgatgatattctgactggcggtaagttttaaaagttccttgagcgcaagttgtccaaagtgcccagttgcgccagtaattgcatatttcatgagtaaaaacttcctttcaaaatcagatattgttttattattaacaactatatgctaacacatgttgttttaaagtcaacagattgctacttcggtaattgtttagctccggtgactcttttgctaaaatttggtataaaataaagttattcatttaaccaaaaaattgggccataattattggcctagcaggttatttggcgaagtgaggttactttgtaaagattaaggatagcgttgttcaagaaaatattaagctgtgaattgaagcaaatattaacaatttttatttaatttacgtcattccagctgattttctgctatcattaaggataaaatcgggtgaaagaggttaccagttaatggacaagcgcaaagcattgattttattgcaagagctattaaaaattaaatcggtgaataatcatgaagcccaagtggctgactatattaaattgttattcgatcaatatccagcagcacaagtaacggaagttaattacgcgccaggccgttctaatttagtgatcacgatccatggtgatcaaccgggtaaaacactcggcctatccggccatttagatgtggtttcgccaggggacatcagtgcttggcatcatccaccatttgcgggggaaatggatacggataatgtgtacggacgtggtgccagtgatatgaagggtggactcgcggccttgatctacgtgctgctagatttattagctgagaaacgtagctttgccgggacgattcgtttgtttgctaccgttggcgaggaaactggtaattacggtgcagcacaattgactcggcaaggctttgccgacgagctggatgcattgatcgtcgctgaaccaagtaatctgcaagttgaatatacacatcgtggtgtgatcgattatgaagtatcggctacagggaaagcagcgcacagcgctaatccagcagccggcaacaatgccattgatcagctatttcgtttttatgaagcaatcacaacgttgatggcaccgaaaacgaaggtcgatccagtattgggaccacttttacataatgtgacgcaaatcgcaggcggtgagcagatcaattcaattcctgcgcgggcacgattatatggtaatattcgcacgacgccattgtatcccaatcaacctttgatgacggagatcgaagcattagtagccgaacttaatcagcaaccggaaaatgagctacaattaacgtatcattatccagaaagtccgttacccggtaatccgcaggccccatttgttcagttgttccgtaaggtagcgacgcatacattaggccataaagttgcggtggtgggtgatagtggcgccacggatgcctcggaattcattcgggcagcacaaaaatttcccgtagttatttttggtcccgggaatgatagtggccatcaagccgatgaatatgtagcgatcaaggattatatagcagccattacgatctatcaacaagttattttacaatttttacgataaacaaaaacgtctcgcaaatttttgcaaggcgttttttgatgaggtaattttattcggctacctctagggtcgtactctgatctaaaaagcgttgtagttcaactgcagtcggataaccgtcattgtcaccgggatgttgtacggccagggcaccgatcgcgttaccgcgttgtagggcggcctcgatcgataagccctctagtcgggcagtgataaaaccgaccgcaaagccatccccagcgccaacggtatccactacttgtttgacggcgaaaccaggtacaaaatagctacgagtttttgttttggcaaaagcaccttcagcgccaacttttacgatcactaatttagcacctttagctaaataaaaatcagcaatcgtattaggatcagtgctgcctaacaagatctgaccttcattgatccccggcattacaatgtcagcttgcccggcaaaatcattaatggtcgctatcatttccgcttccgatgcccacagcgctggccgtaaattagggtcaaaagtagtcgtaatgttctgttcacgggctttatcgatcagacgctgaaaagcggcccggctattgttggataaagcaggaaaaatgccggatagatgaatatgtttgagaccagtaaagtcgatattatcgatagctgccggagttaattgcgcggcagctgagtttttacggaaataaaaggtattcggatcaccactggaaactttttcttttagctgatagccagtccaagcatccggtgtggtggtaatattatccgttgcgatattattagcttgaatggcgttaataataaactcaccaaatggatcctgaccgacttgagaaacgtattggctggcatgccccagacgggaaacacctacggcaacatttaactccgcaccagccagaaacttttgaaaatgcgtggcgtcagctagtttagtatctacttcttgggcagcaaaaacgactaagggctcaccaatcgttaaaaattcactcattaaaagtgccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 559 - DNA, 46643 bp, Unknown
  Metagenome-assembled genome
aaactaatcaaactaactaaattaagtcaaacttggctagtcatgactagcccaagtcgtgaatatagagaaattacgtaaaactgataatttggccaatcaatttgatgcatatgcataattcaggattaatactaattgaaatataattaaatgcaaaaaaacgtgtacctagaatctaggtacacgcagaattaaaattatgccccgagtgggattcgaacccacggcctacggtttagaagaccgttgctctatccagctgagctatcgagacaacaacagtattgattataaagtaaacttaatactgctgtcaataacaaatatgatgcgtgtttttcgctatgttaccggataaattaataagatgtgataaatagtttgcaacttgtggcaattattggtatgatattagcgttgtaattgtggctgccacagctacaaccgctcggaacaagtttaagtcgggtaaccgcacttggtttcggcgagtctaagacgaggaggtgcagcatatgtacgcaattatcaaaactggtggtaaacaacttaaggttgaagcaggtcaaaagatctggatcgaaaagttggatgctaaagaaggcgacgaagttacatttgacgacgttgttttagttggtggtgaaggtgaaacaaaaatcggcacaccaacagtagcaggtgctaccgttactggtacggttgaaaaacaaggcaaggaaaagaaagttgttacttacaagtacaagcctaagaagcatagccacaacaaagttggccatcgtcaaccatacacacgtgtattgatcaacgcagttaacgcataattaaagaataggtggttatatgatccaagcgcagtttgaacgggatcaggcaggtgtgatccattattttcgcctaactgggcacgcggattcggggccttacggtagtgatatcgtttgtgctgcggtttcggcagttgctattggtgcggtgaacggaattgagcagatcgcggcagtcaagccaaaggtcaaggctgattcagttaatggggggcatttagaatgtcgtctacctcgtcaaatgaacacggagcaagctaagacagcgcaagttattttagccaacttattgttaagcatggaaagtatcgccgaaaattattctaattatgtcatgattaaaaaataagtaattcaaacgcataggaggtgcacggatatgttgaaaatggatctacaattcttctctcatcataaggggggcggctcgacttctaacggtcgtgactctgctggtcgtcgtttgggtagcaaacgcgctgacggtcaaactgttacaggcggttcaatcctttatcggcaacgtggcacaaagattcatcccggtgctaacgttggtatcggcggcgatgatactttgtacgctttaactgatggcgttgttaaatttgaacgcttcggtaaaaacaagaaaaaggtctctgtttaccctgcagaagcagctgctaaataagtcctttaaagaagttcggaacacacttgttgggttccgggctttttttgtgccgtgcatcatgacttgatcaggttttttaagcaagtaaagtgcggtgccattttgtttacggtggttttttgttataatagaaattaatttagtttgcgcctagtagttgaagcaacaagaaaagaggcaaacgatggcacaaagattggcagctttacgggacaaattagccgcaatcgaattagacggtatgatgattactaatatggctaatttgcgctacctaactggttttacgggaacaacaggtgcagctttgatcacgcgaactagcgcttttttcgtgaccgattcacgctatacacaacaagcctaccagcaagttgcaccgcagggctttgcaattgtagaaaataaaggtccgttgttcacggaaatcagccacttattagaaaaattacaattaaccactttaggttttgaagccgatcatatctcatttaatacttatgatgatttagcggatatttttgatgttggtttagtccctacatcaggaatcgtggaaaaattacgcgaagtgaaagatgcagatgaaattggcttgattcgcgaggccgcagctattgccgatcaagcttaccaacatattttaaatatggttcatcctggtatgactgaacggcaagttgctaatgaacttgatttttacatgcggaaattaggggctagtggggtttctttcgaaactattgtggctagtggtgcacggtcagcgatgccccatggggtcgcaacggataaagccattgcaccgcatgaactagtgacattagatttcggctgttactatcaaggctatgtttctgatctgacgcggacttttgcagttggtgagcccgatacggaattaaaacatatctaccaggtcgttctagcggctcaggagcaagtgattaagaatgcgcgagctggtttaacgggtcaccaatttgatcatgtggctcgccaagtgatcactgctgctggttatggtgactattttggtcacggcactggtcatggtatcggtttagaaattcatgaaggccctatggcgacacctaattcagaagatgtgaccttagtggatggtaatattatcaccgatgagccgggtatttatttgcttggtttaggtggtgtgcggatcgaagatgatttattgatcatgtcatccggcagtcaagtcctaaataatgcaccaaaaaaagaattgattatcgtgtaaaagcttgccaactagcgatatagcttgctatagttagttgatgctatttaagtgtggcgtggtactttttaatcgtcattgtatgatgatctgatttacggcggcttatgctgtaaaaatgaacttgatcgatgacgtagaggaggaaatataagtagtgatttcagtaaatgattttaaaaatggtttaacgatcgaagttgaaggtgaattgtggcgtgttgttgaatttcaacatgttaagccaggtaaaggcagcgcctttgttcgttcaaaattaaaaaatttgcggactggtgcggtacaagaaaaaacatttgcggccggtaaaaaagttggtaaggcccagatcgacaataaaaaaatgcaatatttgtatcaagatggcgacaattatgtattcatggataataatacctatgaacaattgtccttacctgctgaacaaatcaaagacgagctgaattatttaaaagaaaatatgacggtcagcgtgattatgtatggcagcgaaacgcttggcttagagttaccgaataccgttgaattgacggttgcggagacagaaccgggaattcgcggtgcaacgcagtcaagcagccctaaaccagcaacaatggaaactggcttagtcgtccaagtaccattctttattaataatggtgataaattgattatcaatactcaggatggctcgtatatttcacgggcttaagtattgtttgattaaagttaacctattagtcaactgatcgcgctggtttgtgcatttaacagcgctaatcagcggagtgtgttgagaattagacgttaattgtgaagtaggaggtttatgagatggctgaagatacaaatattgttttagacagtaaaacagaaacatcgcttggacaaattgaaattgcccctgaagtgatcgaaattattttaggcattgccgctagccaggttgacggtgtttataaaatgcgtggcactttgtcttcaagtatcagtcaattacttgggcgcgaagatcgcggtaagggcgttaagttgactgtagacgctggtcagatccaagcagatatttacgcttatttaaattatggtgtttcagtaccgcaagtcgctttaaaaatgcaagatacgatcaaggaacaattattatttatgactgatttagatttaactgaggtcaatattcacgtagtgggtgtgatcccagaaaaattagttaatgcagtagatccaaataatttatttgctgaagatggtgaagacgagtgattaaccgacatgagatccgtgagtttgcttttcaaactttgtttgcaatcaacgccaatccagaagtcgatactgaggctttaatggaatcgttagcggcgacaccgggtgaagaagttgaactaccggcttatttattgagtttagtggctggcgtgcgtgaacatacgccacaattagatgaagcaatcagtgcgcatttaagtgctaattggtcactgaatcggttagctaaaactgatctagttattttacgagtggcagtttatgaattactagaagtccctgatgtacccgcaaaagttgcggtcaacgaggcattagagttagctaagaaatatagtgatgagcgttcacgcaaattcattaatggggttttatcagcgattgtccgccagcatgagttggtttaggagaatcagtaaaaaatcaggctgggcaacatgacttaggttgtgggtccagcttttttagaaagtgagcgagttggggtgacaatattagatggaaaagtggcgtcgcaggcgttaagtgcggagttacaaacacaaatcgctgaattaaaagcggatggtgtaacgcccacattagcggcggtgttagtcggagatgatccggctagtcaggtttatttgcatagtaagcaaaagcgggcggcaaaatttggcttacgtatgttgaccaccacgttatcagccacaacgacaacggcagaattgatcgtggtgctacaacaattaaatcaagatccgcgggtacacgcaatcatgctagaaatgcctttacctgcgcagattgacagtcaacaagcaattttagcattggatccagcgaaagatgtggatggggttcacccactgaatttaggttatttatttggcggtcaaccacatgcaattccgaataccccattcggtatcctaaaattattagatcattatcaattgtccgttaagcataaaaatgtggtcgttgttggtcgtagcgtcgtcgttggtcgaccactagcggctttgcttttaaatcgagatgcgacgattacgattgcgcatagctatactgaaaatttagcggaactgacacgacaagccgatattttggtcgtggctgttggtcgagctaattttattgccgcggatgcggttaaacctggggcaatcgtgatcgatgttgggatgaatcgtttagcagacggcaaattggtcggtgatgttgattatgccagtgtggtaactaaagctggtacgatcacaccggtaccaggtggtgttggtccaatgacgagcctaatgttactgtaccaaacagtgcaatttgcaaggagtcagacaaaacatggctgaacaaagagattatttaacggtcacaacgttgaccaaatatttacgggccaagtttgaacgcgatccgtatttggagcgggtttatttaactggcgaaatttccaattttcgtttacgatctaatgcacaccaatattttagcttaaaagatgatcacgctaagatcaatgcgatcatgtttcgctcggcgttcaataaggtaaagttcactccagaagaaggaatgaaagttttagttgtcggtcgaatctcattatatgagcctagtggcagctatcagatttatgttgagcgcatggaaccagatggtgttggtgccttctatcaagcttatgaacagctgaaaaagaagttagcgcaagaagggttatttagtgcacctaaacggccactggttcgttttcctaagcgaattgcggtagtcactagtcctagtggggcggtgatccgtgatattattacgacaacccgccgccggttccccattgcgcagctggtcttgtttccaaccttagttcaaggtaatgaagccgctgcagatattgtgactaaaattgagcaggtgaaccagcagggcgattttgacacgttgatcgttggtcgtggtggtggttcgatcgaagatttatggccgtttaatgaagagattgtggcgcgtgcaatcgcggcaagtcaggtgccggtgatttcttcagttggccacgaaaccgatacaacgatcgctgatttagtagcagatgtgcgtgctgccacgccaacggccgctgctgaattagctgtgcccgtattaagtgatgaggttgttaaactgcagcaacaacaggtgcggctactgcaagcaatgcaaaatcggattagtttggctaaaaaacaagtggaacgcttgcggcaatcttacgtttttcggcaaccacagcgattatatgacggttacttacagaacgttgatcaattgaatcggcgtttacaaactagttttaagcaagtattgcaggtcaaacgtcagcaagctttgttggccgaaagtcacttgcagcaacaccaattacaaccgcgggttcagcaaggacagcgcgatttagctcgtttacagcagcagttaaccgtcgtgatgcaacactatatgacaaacaagcaacaaatagtgcagcaacgcattcaatcattggactatttgagcccactaaaaattatgggtcgtggctacagttatgtgacggatgaacaaggtaatgtattgaagcaagcaactgattttcagccaaatgcggaagttgcgttgcacgtcaccgatgcggtggtcacaacgaaagtcattgcggtcacaccgcaaaagcaagataaataagaacggaggccgttttaatggcagaaccaacttttgaacaaaatttggaagcattgaatacgatcgtcactaacttggagcaaggggatattcctttggaacaagcattaaccgaatttcaaaaaggtgtgacgctgagcaaaacattgcaagatacgttaacacatgcagaaaaaacattaactaaaatgatggcggaaaatggaaccgaagtgccgtttgaagaaaaaggaactgacgcggatgattaaattgacagattttcggactgaacttgtccccgcactggatagtctattgtcaatgaagttacaccaagatattaaggaaccagcgttgcaagcagcgatgacttattcagttatggctggtggtaagcgggtacggccgctgttactgttagcggtggtccaaacttttcaggctagtttgattccacaaagtttaccggcagcggctgcaatcgaattgatccatacgtactcgctgatccatgatgatctaccggcaatggataacgacgatctacggcgcggccaggcgactaaccataaaaaatttggtgaagcgctggcaattcttgctggtgatggtctacagcctttagcttttcaatggctaagtgatctacgctttgctgatgctgtcaaaattaaattgatccgcgaattagctttaggtgctggcccactgaatatggtcgccgggcaagtggctgatatgcaaggtgagcacaaagcattgagcttaactgaattaaaagcgttgcatcggcgtaaaactggggctttgttgaaagctagcctattgatgggtgcagtgatcagtgagcttgatagcaaacggacagctgctttaagtgactttgctgaccatttaggcctagcctttcagatcaaagacgatattcttgatgtgaccagcactgctgcagagttaggtaaacctgttcatcaagatcaggcggctaacaaaaatacttatcctggtttattaggcttagacggtgcccaaacagcgctgacgactgaacttacggcggcgcggcgtgcgcttgatccgttggttgcgtcaaccgatatcagtttattggcggcatttttaactgagttggcaaattaacggaggcaaattgaatgaaaaaagaacgaattgatgtcttattacaacaacaaggttattttgattcgcgggagcaagctaaacgtgcagtgatggccggtgaagtttatgacgaaaataaccagcgttatgataagccaggtagcaaaattcccaatgatactattttacatttaaaaggtaaacatatgccttacgtcagtcgtggtggcttgaagttagcgaaagcgttggcggtatttaagttggatgtcaccggtaaaacagtattagatatcggttcctcaacgggtggttttactgatgttatgctacaaaatggtgcggcacgtagctatgccttggatgttgggactaatcaattagtctggaaattacgtgaggacccgcgcgtcactgtaatggagcaaacgaattttcgttacagcaagttggctgattttacggaaggtcaacctagttttgcctcaattgatgtttcctttatttcgctgcggttgatcttgcctaacttggcgacaattttacaacctggtggtgatgtggttgctttgatcaagccccaatttgaggccggcccagaaaatgtgggcaaaggcggcatcgtacgtgatcccaaagtacacgaaatggttctgcaaacaattttagactttgctgttgcccatcattatgacgtactgaatctagatttctcaccgatcaaaggtggcgaaggtaatatcgagtttatcactcatttacgtttgaatttagatgcagatgggcaaatggctgctaatgtatcgattgccgccacattaaaagcggcctatcaatcgctgaatgcggctaaagagtaaccacctgtgattgcacacctatgcaacgtttatgcataatctaacagataacgctttaattttagtagcgaataagctattatgaagttagaatgtggaaagcaaggtgacggtatgcgaaaatctgaacgacaacgtttaatcaaaaaattgatgaatgagcatgatatccagaagcaagaagattttgttgcattgcttgagggtgcaggtgtcaatgtgacccaagcgacgatttcgcgagatattaaggatatgcaattgattaaggtaccgtcaccaagtggcggttatcgctatagtttgccggcacagcagactgttgatacggagaagaagttgaaacgggtgttatttgatgcctatgtttcaatggacgtccaagactattttattgttttaaaagctttacctggtaatggcactgcaatcgcaactttgatcgaccaaatggatttttcggatacttttggcacgatcggtggcgatgatacggtgttgatcattgccaaaacaccggcggcagcgcaggatttatatcaaacattaacgaacttgcttgagcgttaagcaggttctttgttttactgaatggaggatggttgtgttacaagagttggatattcgtgattttgcgatcattgaaaaattgaatattgcttttcaatctggaatgactgttctgactggggaaacaggtgccggtaagtcaattatcatcgatgcggtcggcgtgttagctggtggccgagggtcacaggagttcattcgtaaaggcgcgagcaaaatgcgcctgcagggcttatttcatttaccagataatgcagcaacctttgctgttttagatcattatggaatcgaacatgccgatgatgatattttattacagcgagatctgtaccggactggccgtaatgtctgtcgcgtcaatggccagttagtcaacacgacaactttaaaagagatcggtgaaacgatcgttgatattcatggtcaaaatgaacatcaggaattgatgcatccagaaaaacatttagctttattggatgaattctataaagctaaggtcaatccgcaacgtgccaagtatgcacaagcttatgatgagtatatgcgcttaaacaaagcttatcaggagcgtatggcccacgctaaggaatgggcccagcgtttggatatgctacggtttcaagtcgatgaaattgaagcggcacaattaaagcccaatgaagaaagcgaattagacagtgaacgggcacggctcagtaattttcagcggatcaccacggccttacaaaatagttatgaagctttggccggtgatgcagcggggacaatggatcatatcggtggtgctatgaatgaattacagcagatcacgccactggatcatgcttaccaagaattagcggataatgtgcagacggcgtattatacactgcaggatgcggcatcggagttattacgccaggctgatttaatggaatgggatgaaggtcggttagatgagatcgaaaagcgcttagaattgatacaacagttaaagcgtaaatatggtgatagcatcgcccaaattcttaattattacgccaaaatcaaagctgaattagaacaaatggtggctaccgaggataatgaagatcaactggcagaacaagttgatcaggctaaacaaactttgctagatcttgggcagcaattgtccaagactcgccaacaaggcgctaaaaagctaagccaagcgattcatcaacaattagcggctttgtacatggaaaaaaccgttttctcagtgcattttaaagcgacttcaacggtgcatttttatccaacagggttagatgacgtcgaattttatattcaaacgaatccaggcgaagcggctggaccattagctaaaattgcttctggtggtgagctttcacggatgatgttggctttaaaaacaatttttacccgtagtcagggcattactagtattattttcgatgaagttgacactggtgttagtggccgggtggcgcaagcaattgcggataagatctcggcaattgcgcggttctcacaggttttatgtattactcatttaccgcaagttgctgcaatgagtgatcagcatttctttattcgtaaacaaatcagcggccagcggactaaaacaaccttaacacggcttgaacctgcccagcgggtggatgagctagcccggatgctttctgggacagcggtaactaaactgacacgcgagcacgctagtgaattacttaaattagctgcggctgaaaagaagcgcttacgggaagcggtcaccccagcttaaaagactataaaaatacggtaatgatcaagttatgtaaattgatcattaccgtattttgttgtttgcttacgattgtttttggggtgtgatagcaatgtaacgaattgcattcgcagtcacaagatgaattagtttgtgatcatcagcagtgaagataatccgatcattgtggcgttgtttaaaatggcctttgatcgtcgtttgaccgccatgatcaaaatcgttaaattggacagtgacgtttaagtcttttgttagggcttgttcgagaaagtttttgatttgaaagtgaggcatttgcggtagcgcagcagttgagactgggtccgctgcaggaacctcgaaatcaaccattttttggtaagatgcctgtaaatgagtgccaaattgttttaacgttgcttggttaaattccataatgtttgcctccgaacatttgtttgtgtctccattatacgaacaaatgttctaaattgcaatgcttttttcatttagatggaaattcatcgagctcttagcggagttatgctaaaatagatagaatatgcaaaacgagcaattgctgcagcattctatgttactactttgtagcacttttgtctgaaataattgcttgttaattcttagattagtttatgatagcgggaggtaatagtaatggcagcaccgttggaatttacgattgaagagaccattggcgtgttaagcaccagtaaaagtggttggacgcgcgaattaaatttagttagttggaatggtcgaccagcgaagttcgatctgcgtgattggtcaccagaccatagtaagatgggaaaagggttaacgttgaccaatgaagaaatcgagcagttgcggcaactacttgatagcatggtcagtgattaaattatatttggcgattactatttgcggcactaatctagtctaagcaggttgaaaaattctagctaagcgtaatttcataatcagaaagttttccccaacgtacgctagacttgaaaaacactaagaaaaagtgcagaatagagattaaaattatcagagcagaaggagaattgaccgatggcgacacgcgggatgttaatcgttttatctggcccttccggtgtaggtaagggaacagttcgtaaggcaatgtttcaggatcaacaacgagatttcgtatactcgatttcaatgacaacaaggcaaccacgcccaggagaagttaatagggtggattactattttgtcagtaaagaagaatttaagcaggagatcgctaatgacgggatgttggagtacgcgcagtacgtcgacaatttttatggcacaccgcttaaatacgttaatcaaactttagattcgggtaaggatgttttcttagagatcgaagtcaatggtgcgatgcaagttcgtaaaaaatgtcctgatggggtcttcattttcctgacaccgccagacttatcttcattgaagcaacgaatcaagggtcgtggttcggaagatatgcagacaatcgataagcggatgcttaaggcggttgacgaaatcaaaatgatgcggcaatatgattatgcagtggttaacgatacggtggccaatgccgttcaacggattgaaaacattattgaaagtgaacatcttcgtgtcccacgggtgatctcgcagtatgaaaaaatgataggagttgtcgaaaaatgattttatatccatcgatcgataaattattagacaaagtagattcacgttactcattagcggttttatcagcaaaacgtgcacatgagatcgaagctggcagcattaagatgttaccagatggcgattatcattcaccacaaaccgtgggtcaagcattggaagaaattgccgatggtgatgttgttgttgatcctgcttcattgatgactgaacgtgaagctgaagtgcaagatcaagcagacaaacacgaaaaataaattgttgtcagattaagggttcggctggtgatgaccgcgaactctttttttatacttaacgtgataattattgtcagctaggacgctgatttagcctgtattttctgctacaatagctatattaagatcattgctgagggggaaactattttgttggctggaagacacgttgcgctgtacgtcagtggcggcattgcagcatataaggcggcttatttagtgcgtgaattgattcgccaaggtgctgaggtacgcgttgtggaaacagcaggggcacaagcatttgtgactccactgactttccaaactttgagtaagcatgcggtttatacggaccgtttcgcccaactcgcaccagacgaagtcgcgcatattgagttagctgattggaccgaaattgccttggttgcaccggctaccgctgacttaatcgctaaaatggcacagggtctagcggatgattttgctagtacggctttattggcgaccaccgcaccaaaatttgttgcaccggccatgaatgtgcatatgtgggaaaatcccgcgacgcaacgcaatgtggccactttaaaggccgatggcgtcgaaattattgagcccgcaactggctttttagcagaaggttatagtggtaaaggccgtttcccagaaccaactgcaattgttgccgcggttacggctaaattattggctcaggctaccgatctaccattacatggacaatcagttttggtcactgctggcggaacgcgtgaacgcttggatccggtgcgttatttgaccaatgattcatcagggaaaatgggttacgctttggctactgctgcgcgcgacttaggggcgcaagtgaccttgatcagtgcaccaacgatgctcactgtacctgctggtgttgcctatgttggtgttgattcagccgaagcaatgcggtctgcgttattagcgcgttatcagacggcccaaatggtgatcatggcagcagcagtggcggatttccggcctgtaacagtggcggataataaaatcaaaaagacaactgcagactatacgttgaccttaacgaaaaatccagatattttagcggaattaggtcaacaaaagcaacaacaatttttgatcggctttgcggcggaaacacagcatttattaacttatgcgcaaaagaagctggctagtaaacgggttgacatgatcgttgctaatgatgtttctagcgctcacgctgggtttaatcacgatactaatgaagtgacgattctacagccgaatgtagaaccacaaacattaccgttagccagtaagcaagtcatcgcacagcaaattttacaaattgctttggctacgcggcgggataaacagcaaaagtagtgatctgttgcttacaggcatatagatggctattgttgtgcgtgtttttgtaatgtagcccagtcaagcagctcatgtagtagaaaggtggttagtcatggtgcaatttgcgcaagtgatcgttgatgtgcccactttacaaacaaatcgaccctatgactacgttattccagcgatttggcaggaacaattacgtgctggtatgcgcgtcgttgtgccttttggtaagggacagcggcaaattcagggatttgtagtcggtatcactgatacagcaccggattatacgggtgaactgaaagcaatcacacaagtattggatctacagccagttttgaatccggagttgctggcgttagcaaagtggctggcgcaatggacttttgcttttcaaattagttgtatgcagacgatgttgcctagtgtgatgaaagctagctatagtaaaaaagttcgtttacttggtgcgcctacaccagcgaccactgcaatttttcatgaccaaactgaattggattttgctgatttagcaccagagacgatcaaacaattactaaaattacaacaagaacagcttgttgaggttgtttaccaggtgcatgatcgagcaaaagttaaaacaatcaaagcaatcaagccgttattggcggcagccgactatacgactattgcggcgcaagttccggctaatgcgaagcgtcaacatgagttattgacttatttagcggcccatacaactacaaaagaaccaatcacgatgcagcaagtgacggcagagacgcagttgacgttaacgcatgtacaaactggtgctgccaaagggtggctacgtttgatcgaactcgaaacttatcgtgatccttacgctgaattagctagtgcgccacgaactcaaccgctgactttgacgaaagagcaagctaatgcagtgcatcagatcacgactgctggtcagcagcaacgtgatcaagtttttctagttgaaggcgtaaccggcagcggtaaaacggaaatttacttgcaatcgatccaagccgcgctcaatagtggtcgaaccgcattaatgttggtgccagaaattggcttaacaccgcaaatggtggcccgggttcgtggacgttttggtgctcacgtagcggtattacacagtggcttatctaacggtgagcgctatgacgaatggcgccgcattgaacggggagaagcccaagttgttgtcggtgcccgttcagccatttttgcgccgttgacgaatatcggtttgatcattatggatgaggaacatgaaggtagttataaacaggatgaaatgccgcgttaccatgctcgtgatgtggcgctgtggcgggccaaatatcatcactgcccagtggttttaggtagtgccacgccatcgctggaatcacgggcccgtgctcaaaaaggggtctatcaattgattcggctcaaagaacgggccaatcatcagccattgccagaagtgacggtggttgatatgaaaaatgaattgaaaaaaactaaagaggacaatttttctggtttattgatgcaggaattgcggaaacgcgtgttgcataaagagcaaagtgtgctgatgcttaatcggcgtggtttttcatcgtttgtgatgtgtcgtgattgtggctttgtcttgaaatgtcccaattgcgatatttcattgaccttgcatatggacactcactcgatgaagtgtcattattgtggtcatgaagaagcgattccccaggtttgcccgaactgtcaaagtcgtaagatccgctattacggtactgggacgcaaaaggtggaaagtgagttgcaaggtttgctaccagaagcccgtatattacgaatggacgtagatacaactcggcgtaaaggcgctcacgcgaagattttacggcagtttggtcggcacgaggctgatattttgttaggcacacaaatgattgctaaagggttggattttcctgatgtgactttggttggggtgctcaatgcggacactgccttaggcctaccggattttcgagcgagtgaacgaaccttccaattactgacgcaggtcagcggtcgcgccggtcgtgctgaaaaaaaaggcgaagtgatcgtgcagacttacaatccagaacactatgcgattcgcttggcgcggcaccatgattatgaaggtttctatcagcgtgaaatgactttacgtcatcaaggcggctatccaccgtattactatacgattttggtgacggctagccatgaagaagaaaatgaagcggcgaagaagatttttcaattaatgaatcaagtgaagccggttttatcaccacaggcggtcttactggggccgacaccgcgcgccatcgctcgggttaataaacgctattattatcagatggtgatcaagtacaagcatgaaccgcagttacaaaaattactaacccagatcatgcaagaaaatcaagcgcgtaatggtattcagatttcgatcgaccgcgaaccgcttagctttatatagcttttttgaatcaaagttaattaacaatagaaagaggagaagtacgtgacttcaattgtatttatgggcacgccggcattttcggcaccaattttagaaagcttgatcactaatggctacgaagttttggcggcggtgacgcagccagatcggccagtcggacgcaaacacgtgttaacgccatcgccagttaaagaagtagcgttagcacatgatattccggtgttacaaccagaaaaattgagcggcagtcccgaagcagaaaaagtggtgacattagcgccagatctgatcgtaacggctgcttttggtcaatttttacccaagaaagttttggctgcagctaagatcgctgcaatcaatgtgcatgcttcattgttaccaaaatatcgtggtggtgcgccaattcagtatgccattttaaatggtgaggctgaaactggggtgacgatcatgaaaatggtcatgaaaatggatgccggagatattttacggcaacaggcaattccgattacagccgacgatgataatgggacgttgtttgctaaattaagtcaggttggcgaaaagttgctgttagcgacattaccggatttattagcgggtaaaattaccccacaaccgcaggacgaaagccaagttactttttcaccaacgatcaagccgggggaagaacaaatcactttagatatgtcagcggcagcaattgactacaaggtacgggcgttacggccacaacctggagcgtttgttaaaattggcggtcaacggacgaaattatggcaagttcggccaaccgctgaaacaacaatgttggcagctgggcaagttgctgtcattagtaagcaccaattgggtatcgccgcagctgatcataaagtgttttatattgaagagattcagcctgctggtaaagctaaaatgaacatcactgcgtatttaaacggccaaggacatggccttaaggaagggcaacaactcattgaagactaacataaagcattcaccgcgttatttagcggtcaaattactggatcgggtcgctgattcaggcagttacgccaatattacgttggaccaaaccattgaaaaagaacaattgcaaccggctgatgctagcttgctgactaacttggtttatggtgtgatccagcgccaattgacgttagatttttatttaaagccattcattaaaaaaccgcaacgcttagaacgttgggcgcggcaaaacttgcgggtcgctgtctatcaaatggtttatttggacaagatccctaatcgggcaattttttatgaagctacggagatcgccaaaaagatgggtaatcgcggggtcgccggtttaatgacggcaattttacgtcagatcgaacgtcaaggtgtgccgcaattgacaacaattagtgagccgctaaaacgattaagcatcagtgctagcgtgccggaatggctagttgccaaattgatcgatcagcttggtgaaaagaagacggaagcgattttacaaacaatcaaccagcctgctgcggcatcgatccgcgttaatacggctattgctacggttgacgaggtgcaagcagaattagctgaattaggattggaaacaacccctagtgaattatcaccagttgggttagttcgccagggtggctttttagcggggacgactgcctttgcttatggtcaatatacggtgcaggatgaaagttcaatgttagttgcagctagtatgcagattgaaccacaacatcaagtactggatgcctgtgctgcgcccggtggtaagaccacgcatattgctagttacttgtctgctgaggctggtggtcacgttgaggcttttgatttacatccacataaggtaaaattgatcaaagataatgctaagcgattgcacgttgctgatgtggtcaatgcacgtgcatttgatgcgcgtaaactgcgtgatgtggtggcaaataagtcatttgatcgtgtattagtcgatgcaccatgttctggcttaggtctaatgcggcgcaaaccagagatcaagtatacccgtcagccagaggatctattgaatttacagaaaattcaattagaaattttggatagtgtcgcaattaaggtaaaacctggtggcattttgacctacagtacgtgtacaattgttaatgaagaaaatcaggacgtgatcaagcagtttctcgcaaaacacgcagagttcgaaccgattcccgtgtacacagataaagcgctcaaagtggctacaacaccgtatttgcgcctttatccagatgattacgggacggacggcttcttcatttgtaatctgaaacggaaaacgaggtaaaaaggatgaaattcgcttaccggacggatgttggtcaacgccgggccaacaacgaggattatgtaagcgtctatcaaaatatagctggggttcaattcgcaatcgttgcggatggcatgggcggtcatttaggcggtgatgtggcttcggccatggccgttttacatattggctatgattttgagcagacagagtttgataaagtagaaccgatcatatcttggctggtggcggagctacaaaaggaaaatgaacatattttgaataagtcacagcagtatcctgacttgtcagggatgggcacgacttttgtggcggctatttattatcaaaatgagttcatcattgccaatattggcgatagtcgtgcttatttatttcgagaacagaaactaagtcaaatgaccgaggatcattcgttggtcaatgagttagttaagcatggccagttaagtgcggaagcggctaaacaccatccccaaaagaatattattacccgcacgctgggcgtatccgagcaagccgatgctgatgtggtcgtgcggcgtgcgcagcacggtgattatattttattatgttccgatggtttgactaatatggtgtctgacgatgagatcagtacgatcttagccagccctcggtcattagagttaaagtgtcaggccttgatcgacgcggcgaatgcagctggcgggctagataatattacggcgttactattatatgaggatcgtggggtgaccgcacaatgatggaagcaggatataagttaggcggtcgctatcgcgtgatccgtccggttggcgaaggtggcatggccaatgtttatttggctcaggatctaattttaaatcgtgaagtcgcaatcaaagtattacggctagacctacaaaatgatccagatacgattcgccgttttcagcgtgaagagttagctgcaactgaattggttcatcctaatatcgtttccgtttatgatgttggtgaagatagcgggttacaatacattgtaatggaatatgtttcgggcaatgatttgaagcaatatattgctgaccattacccaattccgtatgctgaagtggtgcggatgatgacggaaattttagcggcagtacagcaagcccatgcacacggtattattcatcgtgatttgaaaccacaaaatattttagtggcgccgtcgggtcatttaaaaatcaccgattttggtatcgccgtggctttatcggaaaattcgatcacccaaaccaattcaatgttaggttccgtgcattatttgtcaccagaacaagcacgaggcagtattgcgactaaacaatccgatatttactcgttggggatcattttatacgagatgttgaccggcaaggtaccgtttgaaggcgaaacagcggtgagtattgctttgaaacactttcaaagcgagattccttcagtacggaaaatcgacccgaatattccccaagcgttagaaaatgtgatcttacgcgcaacagctaaggaaccagctgaacgttatgagtctgttgccgctatgacggctgatttaaaaacgacgctgtcaccgttgcgtgtcggtgagcctaaatttgtgtcacaaatcaataatgaagaaactaagatcttaccgcggatcgacgctgaacagtttgcaactagttcggcaacgtctgaagcggcaccggcaagcgctaatactacgacggtaacaacgaaaaccgtatcggcggcagcgactaatgagccagcaccgacccccaagaaacggctcgctcggccttgggtcgtgatcacaacgttgcttgttttagtcgttttggtggttgtaggctttttcgttgctaatcaattgcagccggtagcggtacctaatgtggcgggaatgactcaaagtaaagcacagtcaactttgatggccgctcagtttaaggttggttcagctaccaaggtacatgatgaccacgttaaagcaggtcgcgtgatcagtacaacgccggtaaaaggagaaaaggctaagcgtcagtcagtggtcaaaatgcgcatcagtactgggaaaaaggaatatacattgaaggattatacggcacgatcctattccgcagtcgcggctgaattgcgtaaggccggctttaaggtgaaacgaacaaccattgtttcacgcagttatactaatggtcaaattgtccaacaaagtcgagatgctggcacacgcctagttcccaagggtaaaacaatcacgctaacagttagtgtaggtgctaatggtttcagcttattggatatgactaattggtcgcaagcaagtgtacgtcagtatgcaaatagtatgggttttacccttaatctaaaatatgattattcggctgcggtccaagctggttcggtgatgtcacaatcgcctaaagcaggaactgcagtaccgcacagcgcaaaaataacggtggttatctcgcgcggtagcgaagcaccagaataaaatgaccttaatggtgaagtagaaagtggaggcgacagtttggcacaaggacagattcggaaagcattaagtgggttttattacgtttattcagatcaacaaacgtttcaaacacgtgggcgaggtaatttccgcaaacgtcagttaacgccgttggtcggtgattatgttgaatttgagagtactaatcaaacagaaggctacgtgttgaagctactaccacgtaaaaatgctttagtccgtcctcaagtggtcaacgttgatcaagcggtggtcgttacgtcttgcgttaagccagacttttctagtaatttattggatcgttttttgatgaccctggaaaagaaaaagattcggcctttgatctactttactaagggtgatctcttggatgaggcagcacgggctaagctagcaccaatcgtggcgtactatcagcagttgggttatccgacattttttgatgcggaaccatttgcaccggcgcaagtcaagcaattgacgacgtactttgcggatcaattgacggtgtttatggggcaatcgggtgctggcaaatcaactttgctgaatcacattgaccctgaattacagttgaaaaccgccgcggtatcggaaagcttaagtcgaggtaaacacaccacgcgacatgtggagttgttgccattgtttggtggcttagtggcggatacgccaggtttttcttcattaaatttaagtgaatttgagttaactgaattgccattactttttcctgaatttgtcgctgcgtctgctgaatgccgttttcgggcgtgccaacatgatcaggaacctggttgtgccgttaagcaacaggtggaaacggggcagatactcgccagccgctacgcgaattatttacaatttcgaactgagaaaaaggcagaaaagccgaagtataatggaaagcgaggcaaaaaatgatgaaaattgcaccttcaattttaagtgctgattttgcaaatttggcacaagatgttcaaacggttgaattaggtggcgctgattacttgcacgtagacgtgatggatggccagtttgtccctaatattacttttggtccgagtatggtggcggcattgcggccagtgactaagttagtcttagactgtcatttgatgatcgaagcgccagaacgcttcgttgctgattttgctaaggctggggccgatattttgacgttacacgtcgaaagtacgccacatatctatcgggcactacaaatggttaaagatgcaggtgttaaagcgggggttgtattaaatcccggcacaccactggaacaaatcaaaaatgttttaccattagtcgatcaagtgttagtgatgacggtcaatcctggctttggtggtcaaaaatttattccggcgatgttaagcaaggttaaacggctagatcaattacggcaaaccaatgactatcattttgatattgaagtcgatggcggggtcagtgatcaaacggtcaaagcgtgcgctgatgctgggaccgacgtctttgttgctggttcgtacgtttatggtacggctgatccagcacaacagattcagactttgcgtaatattgctgcaaccaatgactgagtttaatttattagtgggggggcctccggcgatgtggccggccgaacttgcgcagcaaacggcggttccgtggattgccgctgatcgtggggccttgcgtttacttgagttagggatcacgccgcaggttgccgtcggtgattttgattcgttgagcacggctgaactgaaacgggtgcagacgcaggtggcggatattcgctatgcggtagcagataaggatgaaacggatactgaattggccttaaatattgcgttaacggaaggtcaagcgacacgagtcactatttatggtgctactggtgggcgtttagatcatttgttagataatttattcatgctattacagccgcgttttttaccttactgtcaacgcgtacggttattagatcgtcaaaatagtttgcgtctgtttttaccgggcgtgcatacgatcacgcgggaggcaaggcagcagtatttagcttttgcaccgttgacggcggtgacgggcttaacgttgtatgatactaaatataaattgactaacgcagattacgcacaaccaatcatgtttgccagcaatcaattcactaaaaaaagtgcgacctttagctttcgtactggggtggttgcggtgatccaaagtcatgattagatacaaaaagagcttgggttgccccaagctcttttttaatcgtctaatttaattaaacgcgagtaaccttaccggattttaatgtccgtgcagatacccatacacgttttggcttgccatcaactaggatgcgtactttttgcaagttagctttccagctgcgacggctatggtttaacgcgtgtgaacgcttgttaccgaaggttgtacccttgccggtaatgaaatctttagccatgtctagtcctcccttaagcatttttacatgctgctcgttaacacttacctgatttaatttatcataatagccccttgattgcaatacttttctttcaagtaaatttgcttgacagggtaaaattgaggtaggtgaacgccaaaaatttagcttaaaaagcagtatttaaatcgattcagcaaaagtagctaaacactgaatacttaagtttaatatttttgcgtgtgcagaacggccaaaatcgcgtggttgccaattgtttaagtcggtcattgtgtcagcggtgaacaataactgaccgaaagcaacttgcctgaattacgcgcaagctgctagtgcagcgcactccatttcaataacggtgtaaccagcttgcgtgcgctgctggaccaattgttgtgtctcacgaaaatagccgtcagtcgtccaagtcttaacaaattgtggcgtcaattgttgggcttgaatcacctgtgctaattggttgtacctgcccatgaaatttgaaaaattggcgttgtcgccgcaacggtttcaatcaccgcgatttgttgaccattgtgtgtggtcacaaatttatcgatcgtttctcgggttaaaaaagccaataaaactaattgcgggaagtttttaagtgcgggtagatcatgatcaggatttaaaagcgcttttggcgtgcgatcgtaatctaaaaaaggtaattggtccatcaaagtcgcctcactatatttgaattgcattgcgcgcatggtcgtaatcagtccacccaaaatatgaactaacttaatgactaaaacgaacgcttcaataacacttaggtatcatctagtttataacctaattagttatttgcctagtgcaatatcaaaaataggtgtgcatctataaccgaatttttggttgaatcaatttttgcatcgtgctggttgaggcaatgccggattgatcctgataatctaggctgcaccaaaagctatcttttttatgtggtgcggtaaataataaggtttctaattggggatgcgtaaactcagtggcgcaggaccaagtttttttacccagtaataataaggtgatcgtatcttctggatgctgggctaaaaagttgtggatttgttcgcggtcactagccagagcaaagtaaatattttggcgtttaaaatgccgtagtaattgacctgtggtgaaattacgttcaatatggcgtaacttagcttcgatttgcggacgaccaagtaagaaggccatcagtcggcgatatgattttgtttgtggagtcaggggtgtcggaataaaggcggctgtattaaatggatagtaagcaatttggtcgcttgcggtatattcagcagtaggtttgtattttttaccgccaacgattatggttatagtagtcatagcgggcacctccgtttacttctagtgtacggggataggttgattatgcgcaataaatacgcaaatctactgcttaattagcgttatctaatggaagataacttttcaatattttcaggctatgatagaatggcgtgtagaagtttttttaaaacgtaccaattttgatacgcagagtgaaaatgagccagatttttgctggctgtgtgcggccgtctaatggtccaaacagcaactgcaaaagtttttggaacaaaaattagctactattgtggaatagaggaggttcttttaatggctgtacacattaaaacccaatacggtacaatcgatattgctaacgcagtgatcgccacagttgtcggtggtgcggcgactgacgtttatggcatcatcggaatggcaagtaaaaatcaaattcgtgataacttaaatgatattttacgtaaagaaaattatgcgcgcggtgttgttgtgcgccaagaagaaaatggcgtggcaattgatgtttatattattgtcggctacggaacaaaaatttccgaagtttgccggaatgtacaatcaaaagtaaagtacaatttagaaacaatgcttggcgttaccgccaattcggttaatgttttcgtacaaggtgtacgagtattagctgactaattaaactaaaataaagtcgtataatgcggatacgaatgtgtcccgctggttttgttttgcgctaaaagcaggcaaaacagcaaggaggataattttggaagtaacagaaataacggcagcaaaatttcaagatatggtgcgcatcggcgcgcatcggctgaccaaaaatgctgaatttgtcaattcattaaatgttttccctgtccctgacggtgataccggaacgaatatggggctatcttttggtagtggtgctaaagcggtcaacgaatctaatgccactaatgttggtgaattagcacagtcactggctaaaggattattgatgggtgcccgcggtaattccggggtgatcacttcacaattattccgtggttttgctagtagtgtagctggtaaagaagcactgacggctcaagatctaactgcagcgttgatgagcggtgtagaaacagcctataaggcagtgatgaaacccgttgaaggtacgatcttaacggttgcccgtgaggcggcgcgtgctgctaataagcaaagtaaagaaacaactgacgccgtcgttattttacaagccgttgttgcggctgctaaaaaagcgttggcaaaaacgcctgatttgttacccgttttaaaagaagtgggtgtcgttgattctggtggtcaaggactagttttcatttatgaaggctttttagaaggtctttctggtgaagtggttgacgatgatacttatcagccagatggttctgaaatggacgagatggttaatgccatgcatcatcaaagtgtccaaagccaaattgccacggaagacattactttcggttattgtacagaaatgatggtcgggttaggccaagatggtgcaacggctaaatttgactatgaagaattccgtaatcatttagatggtttaggtgattcattactagtggtcaatgatgatgaagtggtcaaagtccatgtgcatacggaacatccgggcacggttttagcctatggccatgaatatggttcgatgttgaagatcaagatcgataatatgcggttacaacatgaaaccattctagaacaagatcaagctaacgaagctgaagctcaagaaccgattgattttggcattatcgcgattgcttctggtaaaggtgtcgggacattgttcaagagtttaggcgctacaacgatcttaaatggtgggcaaacaatgaatccaagtacacaagatattttggatgcgatcaagtcagctaatgccaagcaagccttaattttaccgaacaacggtaacattattttggccgcacaagaagcagcaaaagtggctgatatcccagtagcaatcgtgccaagtaaaacgatctcccaagggatgacgtcattactttcatttaatccagataactcattggctgataatgaggcgcagatgacggctggcttgaaggatgttattagcggtcaagtgacacaatcaatccgtgatacaaccattgatggtttagcaatcaagaaggacgattacatggggatcatcgatggtaagatcaaggtgacggcatctgagcggcaaacagcgacagtcgatatgatcaaagcgatgcttgatgatgatagtgagatcgtgacgattttgatcggcgaaggtggaactcgccaagaagcccaagcgattgccgatgcagtcatggcaattgatgatgaattagaagttgaattacacgatggcggtcagccagtttatccatatctggtttccgttgaatagtgtgaatagtgtgacccaggcaagctgaggtaggtgcctcagcttgtttagtatggtgaatttggtcagaataaaggtggtggtctgacatgaccagtaaaagtttacttgatccggtggcggtgttaccaggggttggtcctaaaaaagtccaagcgctacatgaattaaaaattaatacgatcaacgacttgctgcattattttccctttcgctatgaagatctaaaggttaagtcattggatgaagtgatcgatcaagaaaaagtaaccttgaagggggtcgttgtcgggccgccagttgtcagtcgctttggccgcggcaaaaatcggcttaatgttcggctcttgattgatcaagctgtgatcatggtgaccttttttaaccaaccatggttgaaagataagtttgaaaccggtgcagaagttgcagtttatggtaaatgggatgctaagcgtaaaagcatgaccggaatgaaagttcttgccatcaagaatgatactagcccagaatttgcatcaatttatagcgcatcgaaaagtattcgccaaacgacattggtcaagctgattcgaactgcttatgatgcctatgcggatctgatcgtcaatattttaccgcaagccttgatcgacaaataccgattggtgacggagcggcaagtaatccatggcatgcatttccctaagacgcaaactgaagctaatgcggctcgtcgtacagctatttttgaggaatttttcttatttcaaatggcgatccagttactgaaaaagcgtgaacaagcgccagaacaagggttagcgttacactacgataatcaaaaattacgcgcctttattcaaaccttgccgtttgagttgaccaaagcgcaaaaaagagttgtcaatgaaatttgtcgtgatttaaaaagcccgcggcacatgaatcgattgctgcaaggtgatgttggtagtggtaaaacgatcgttgcggccttagtcatgtatgctgcagttacagctggttatcaagcagcgctgatggcgccaaccgaaattctggcggaacagcactataagaacttacagcggctgtttgctgattttgatgtccaagtagctttattaacgggttcaatcaaaggcaaagcgcgacaagcaatcctcagcgatttggctgctggtaagatcgacttgatcatcggtacacacgcgttgatccaggatggcgttgactttgccaaattaggtttggcgattactgatgaacaacatcgttttggggtcaatcagcgccgtgttttgcgtgaaaaaggctatcggccggatattttagcaatgacggcaacaccaattccacggacgctagcaatcaccgcatttggcgaaatggatgtctcaaccatcgatgaattaccggctggccgaatcccaatcaaaacaagttggatccggggtaaccaagtggccaatgcgttaagctttattcaaaaagaattagctaaaggccgccaagcttacgtggtcacgccgttgattgaggaatcagagagtatggacttgaaaaatgctcaagccgtctttgcgaaaatgcaggcagcttttgcgccgacttatcaggttggcttgcttcatggtcagctgaaaaatgaagataaagatcaaattatgcaggcgtttaaagccaacgagtttcaagtcttggtggcaaccacagtgatcgaagtcggtgtggatgtacctaatgccaccgcaatgctgatttttgatgccgatcgttttggtttatcccagttgcaccagctgcgcggacggattggtcggggacaagaagcatccttttgtatcctagtggccgatcctaaaaatcaaaatggtattgagcgaatggaaacaatggtggcgactactgatggttttcaggtatcgcaaaaagatctggagttgcgtggcccaggggatgtgctcggtgaaaaacagtcagggatgcctgaattcaaagtcgctgatccagtagccgattaccgcgcattggaaacggcgcagatcgaagcacaagaattagtgacgactggtgcctggcaacaaccagaaaatcggcctttagccaattatttagctcagcaagagcaaaattatcagaatttagattgagtgaggaaagaggaatcagccatgaaaattgcagtagacgcaatgggcggcgataatggcccaacaacgatcattcctggtgttgagcgcgcccgtgatcagttccccgatattgaatttttactttatggagacgaagctaaaattcgcgctgagatcaaaaatgatcagcgcttaacgatcgttgccactagtgaagagattttagccgacgaagagccagttaaagcagttcgacgcaaaaaagatgcttcgatggtcgttgctgcccatgcggttaaagacggtgaagcggatgcaattttctctgctggtagtactggggcgttgttagctgcaggtttatttatcattggtcgaatcaaaggtattgatcgcccaggcttaatgccgacattacctgattttcggacaggtagccaatttaatattttagatattggtgccaatgccgatagcaaaccagaaaacttgtatcaatttgcggtcctaggaaattattatgccaaaaatatgcggggcattgaacggccgcggatcgccttgctaaataatgggactgaaccggataaaggtgacttgacgcataaagcggcttaccaactgattgcggcagaaaaagattttaattttattggtaatatcgaagcgcgtgaacttttaaatggtcgcgccgatgtagtcgttacggatggctttactggtaatgctgcattgaaatcaattgaaggtacggctatttccatcttacatttattgaaagatagcatcatgaatggtggcgttaaagccaagctcggtggcgctttgctaaagggtagtttagggacattacgtgataattttgactattcacgttacggtggcgctgttttacttggcttgaaggcaccagtagtcaaaacgcatggtacagctagtccagacgccgtttattatacgatcagtcaaattcacgacatggtttctaagcaagtagtcgcagatgtagtcgattattttagccgaaatgaactcgcacggcgcccagaaaaaaacgattaaattgggctagacaatggcggttaaaaccattacactactatttgaaccttgaaatcgactactagtgaagaaaagtgtgcggtcagattcattgaatgtgtatttgtgaatcgatacaacaggctaatttttaccagtgatctacatttgaagcgttgttagtaaaaataagcagcgacgaatttgatttgtccggcgcaaaattattggtcagcgtgttgaccaagcaaggggggattagatgtctgagcaagagatctacgataagatcgtacaattgattgaagaacggtttgaattatcagctgacaaagttagtcagtcacttgattttaagaaagatttaaacgctgattcgatcgacattgtcgaatttatcttggaattggaagatacattcggtgctgagatttcggatgaagatgcagaaaaattagcgacagtgggcgacgcagtcacttacatcaaaaaccatcaataaataagcgagtgagttggcgttattcagacgaataatgttaactcattttttgttgttggcgcctatttttgacacaatatatagtaactgactaagcgctagtcttttcctaggaaaacctgtataatacgctggtgtgattaaagcaagttttattagaagtgctgcctaatattgacgtgttgtgtggtgaattttaggcagtatcatttgtaagagacattaaaaattactagtgaatgctgctagtaatcgaccttaattgttttgtagtagaaaggggctcagttgtggagcaagtatttttaaatgagttacgtgaccgttttggcattgagtatcagaatgtcgatttattatctgaagcgttcacgcagtcctcatacgttaatgaacacccaaacttaaagttacaagattatcagcgcattgaatttcttggtgatgcggtgatggagttgaccgtatctgaatatttatatgccaagtacccaaattatcctgaaggtaaattgacccgattacgggcggcaattgtctgtgaggatagttttagtgcttttgcgcgtgaatgccattttgaccgatacattaagctcggtaaaggtgaagaaaaaaatggggcgcgtgatcgtaattcattactttgcgatatttttgaaagttttgtcggttccttgtacttagatcaaggtaaagaagcggtacaacgctttgtggcgcaggtcgtctttcctaaagttgaacaaggtgctttttcctacgtcatggatcacaaaaccaatttacaagaatttttgcaaaaagatggtgaagttgagatcagctatccattggttgctgaagctggcccggctaacgatgcgcaatttaccgtccaagtcgtcgctcgtggcgaagtcttaggtcaaggcactggccacacgaaaaaagccgctgaacaagcagcagctgaagtggcgttacgtaaattacaagattaaggctggtatagataaggctgatgcgaatgaaatagcatcattcagcaggataaaacaccttaattgtggaatagggccatgtttcaacttggcgatgtttgccttagttgaatggacactgtcgctcgtttttgccaacaccaaattggccagcatttggtattgagcatattcgtgaaacagagctgacttgtcgatgtcgattggactaaagccgtaactcggctaagtccaagtcgcactgtctgaaacatcaatatttatcagtgctttttgctgataaaacaccttaattgtggaataggagcttaccggtgtgcaacttaaaacgttagaaattaatggcttcaagtccttcgccgataaaaccgtgattcaatttgatcatggtatcacggggatcgttggtcctaatggtagtggtaaaagtaatattacagaagcgattcgctgggcactgggtgaacaatcagccaagagtcttcgcggtggtaaaatgcctgatattatttttgctggttccagtgaacgtaaaccattaaaccgtgctgaagtcacgttgactttcgataattctgatcatcaattaaagtcagattatgatgaggtcagcgtgactcggattctgtatcgggatggcacttctgccttttatttaaatcaaaaaagttgtcgcttaaaggatatcgttaatttattcatggattctggcctggggcgagaatccttttccattatttcacaggggaaaattgcggcaatttttaatagtaagccagaggaccgccgcggcattattgaagaagccgctggcgtagtcaaatataaacaacgtaaaaaagaagcggatagtcaactaagcgccacggccgataatttacatcgggtttccgatattatcgccgaattagctcagcaggtcgagccgttaaaagaacaaagtagcttggccaaagattatctgcagcaaaaaaagcaacttgatcagatcactaaaactttattagtccgtcagatcgaatcacgagctgctgccaagaaagaacagcagcaggcactaaaaactgctcaagaaaatgtgatcttggctcgacggaaccaaactgattttcagactaaagttactgcccaaaaagagcaacagcaaaaaaacacgcaacgactggatattttgcagcaggatcaactgcgaatcaccaaacaacaagcagaattatcgggtcaggccgagttagctggcgaacggcggcgggttgctcaagataaattagctgatttaacgactgaactgaaaacgcagcaacagcaattagctgaattgcagcaggttttaaccactgaaaaaacagcgttacaacaagctgacgctgacttaaaacaaaaacaacaattggtgcaaaactatacgcaggcgcagcaggtcgatgaagccacgatcaagcgtaaagtggaagcactacggcagcagtatatcgatcaactacagcaacaaacaacgttgcataatgaagctgcttatttggcgcgggaacagcagcagactaaagtgcgcgatgagaagcaacaagcagaacaagcggccttagcgcagcaaacagctgagttagcggcacaagtcaaaaaggctgaaaaaaccgcaactcagctgaaaaaacagcggacccaacagcagcaacagcaacagcagttaacgacacaggttcagcatgatcagcagcaatatgatcaacagcagcaacagtggtatcaggctttagctatcatgcaaaaggttgaagccaaacaagccagtttagctgaaatgaaagaggattatagtggcttttatgcaggcgtgcgcagtattttacagcacaagacacagctaaccggtgtgatcggtgcggtggctgaattattgacggtgccagcgaaatacaatcaagcgttggaagctattttaggtggccaactacaggcagtcgtggttagtgatgaggcagcgggtaagcgcagtatcaattatttgaaacaacagcacttaggtcgggccacctttttaccgttatcggtgatgcagccgcagcaattgaatagtactcaaatgcagcaaattgcgcagcagcctggctttattggtgtagcagctgatttggttaaattcgcgccagagcacgctaacgtaatgcgccatttattaggccgcatcgtgattgctactgatttaacggcggcaatcaagttagcggcgctactacagcatcgtgtgcgcatcgttacgctagaaggtgacattctcaaccctggtggtgccatgactggtggcggccgtaccaaacaaaatggcttattagcgcgcgaacaagagcaacgtgacttaacggcacaattagccaaaatgaaacaacaattggcaactaaagagcaagcactgcaagccttaaaggcgcagatcgaagcggctaatcaacaattgtccaccactgatgaacagttgcaacagctggcagggcaagagctggaaaatcaagccattttgaaggatctaacgcggcaacaagcccagttagtccggcaacagcaagcggtcgcttatacaagtcaacagcaaaatgatgccacggctgatcagcagcaaaaatatctggcaaatcagcaacaggctaaaaaagttgccgctacgattgagcaaattcaggctgatctagcggcgcaacaagcggccttagccagttggcaagaaaatcaggcggcaactgccagtcagcgacaacaggcgcaaaccgacttggctgtagcccaagaacaacaaaaacagcgacaacagactaaccgcgagcatgttgagcaacaaagtattttgcaagcagcaatggtcagaaaccagcagcaatgtgatcaattgacgcaacggcttaacacgcagactaaggatcatgtcagtaacgcagctgatttaaaacgtgcggccgaacagttggcacagatcgatgttcagatcaaaacggtcaaagaacaacgtgaagtgctagccgctacgctacaacaacaggaacagcagttggcacatgcacaagcggtttatcagcaacaaacggcagctcaacagcgaatcgaagcaaccttagccagtcttaatgatagtttgaatcacgctttgactcagttagaaagtgattataacctgagcttcgaagccgcaaaacaagctgctttaccaacggacgtagctgaattacagcagcaacaaaagttacttaaattaggtctagccgatctgggtgaggtcaatattggtgcgattgctgaatacgaacgggtcagtcaacgctatgaattcttattggcccagcgggaagatctattaagtgcccgcgaacaattgacaacgacaatgactgaaatggaccaggaagttagtcaacggttcaaggccacttttgaagcaactgccaaagcgtttgcaacgatttttccacaaatgtttggtggtggtcaggctagcttgagtttaactgacccagccaaccttttaaccaccggcattgaaattaccgcgcagccaccgggtaagaagctgcaacaactgagcttgttatctggcggtgaacgcgcattgacagccattacgctgttatttgccatcattcatgtacgtccagtaccattatgtattttggatgaggtcgaagcggcgttagacgaagctaacgttgagcgctttggtcgcttcctacagcgttatgatcagcaaacccagtttgttgtcatcacccaccgtaaaggtacaatgatggcgatggatgtattgttcggcgttgccatgcaggaatcaggcgtatcgcatatggtttcggttgcgctggaagatgtaaaaacggaggcacatgcatgagtattcaaatgattgcttttgatcttgatggcaccttgttgaatgatcagaaaacgttgacgccactgacggtggcaacattgcaacaattggcgcatcaagatattcaattagtcttatgtacagggcggccgatcaacgcgatctggccttatttagcccaactagaattgactggggcaaataattatgtggtgacctttaatggcgccttagtccaacaagtcgcgagccggcaaattttggcgcagcaaagcttgactaaagctgctttggcgccactagttgattttgcccacacggtcgcatggccactggatattttggactttgaacaagtgtatccactgacggaactgcccacttcactatatcagcaaatgaatcctaaattaaaatttgtgccgcagacttttgccgacttggcagttgatctacaatatagtaaggcggtcgttgccgctgatcatgaattattggttttaggccaacaacaattaccagctacgttcagtaccgcgtttaatatcgcttcatcacgggataatttattggaatttagtccgaaaacagtcacgaaagcgacagcgttggatgtattgttacaacgatttggttggcagcgggccaatttgatggcgtttggcgatcagctaaacgatctatcaatgttgcaagcggcgggggtcggcgtagcgatgcaaaacggcgtaccggcaatcaaggcagccgctgatcagattactagcgtcgataatgagcatgacggggtcgcacgctttttgcaggactattttaagttataaaacgagaggtgtacaaatgggattatttgataaaatcaagcaggcgttcaccggcggggctaagccggaagaaacggcagcggaagaaaaatacgataaaggcttagagaaaagtcgaaaaacatttggcgatcgcttaaatgcgttatttgctaattttcggaccgttgatgaagatttctttgatgatctggaggaaaccttgatcggcgccgatgtgggctatgaaatggcggtcaagcttagcgatgagttacgcgatgaagtgaagctacgtaacgccaaaagccagcaagaagtggcgcaaacgattgttgaaaagttagtcaatatttacgaagccgaaggtgctgacgaaaataatgagatcaattttgcgccggaaggaccaaccgtgatcttgtttgtcggggtcaacggtgttggtaaaacgaccaccgttggtaaattagcccatcagtataaagaagaaggtaaaaaagtggtcttggccgctgccgatactttccgtgctggagcgatcgaacagttgcaggtctggggcgaacgtgcgggtgtgccagtggttgctggtaaggcgcaaagtgatccggcggcagtggtttatgatgccgtgcagaaggctaaacgtgatcatgacgatgttttattggttgatactgccggccgcctgcaaaataaagtaaacttgatgaacgagttggaaaaaatcaagcgggtgattgctcgggaaattcctgatgcaccgcatgaagtgttgttggtgcttgactcaacgaccggccaaaatgcgctgattcaggctaaacaatttaaagaaacgactgcggttagcggtatcgtgttgactaaattggatggcaccgctaaaggcggcattgtgctggcgattcgcagtgaattaaaggtgccggttaaattagttggcttaggcgaacagatcaatgatctacaaccatttgatgccaacgcctttgtctacggtctgtttaaagatttgatccaagatacagataaaacagaataattagggtaacaaaaaagtcttagtaaagtggtctgtgccattttactgagactttcttgttagctatttatttagctgcttgtggggaacgaacgcggccaagaaagaattgtgccacgatcaaaacaacgttgatccaattgttgatcattaaccaaccagtctggggaactttgctggatgcggaacccaaagcccattgaataaagccgttgtcgccataagcccaaacgactaataagccagcaatcaatgcaaaaacattgagcaacataaatgcccataagttaccgcgttcgccgttggctaaatacttgagtgaaaaaccgacgttccagatcaaccaaacggctaaaactagaacggcgccccaataaataataacaggtaccatcatcattacctccctaaaggtggactgcatcacacagcctgattaattttattctagcagattttgactgaaaaagcagttaaaattgttaatgtttacacatgaacaaaaaacgcccgtaagataattgattttatagtgcggttaggttacgcttaacaagtatgcagaaaatgaaacggtggactttaacatggaaattgaaaaaaataatcgcgtcaattcgctgtttgaattttatgcgccgttattgactaaaaaacaatatcattacctgcagttgtattacgcggacgactattccttaggtgaaattgctgaagaattcagtgtcagtcggcaggcagtttatgataatataaaacggacagaaaaaatcctggaagactatgaacagaagttacaactgtatcggaattttcaggtacgtaacaacgccactgatcgcttgcaagcctatgtacagcagcattatgcccaggatcagcaattgatgcaattgatcagtgaattagagcaagacgaagcagattaattaaacaaaaaacaattagagccatgtttcttgcggtgaccgaaacggtttgagttgaggaaacgcagttgcggactgtgcaactacgccctttaacctttgccacaagaatggacgtcgtccgtaacattagaaacttttgatacaaaaattatccactattgtggagtagagggtgaaataaatggcatttgagggcttaactgagcgtttacaaaatgcaatgagtaaattacggcgtaaaggtaagatcacggaatctgatgtccgtgatgcaatgcgcgagatccggctagcattactagaagccgacgttaactttggcgtggtcaaggatttcgttaaaacggtgcgcgagcgggcaattgggtctgaagttttagaaagcttgactccagcgcaacagatcgtcaagatcgttgatgaagaattaacgagggtcatgggtgaagaggccgttccgttaaataaagcaccacacattccgacaatcatcatgatggtcgggctgcaaggggctggtaaaacgacgacagcgggtaaattagcttaccggttaaaggaaaatgaacacggccggccgttattcatcgccgccgacgtttatcgacctgccgcaatcgatcagttacaagtcgttgcgcaacaagtcggtgcccctgttttccaattaggaaccgatgttgatccgcgcgagatcgtgcgtcaagggttagctcaggccgccgaaaataaaaatgactatgtgatcattgataccgccggtcggttacagatcgatgaaaagttgatgcaagaacttgctgatatcaaggaactcgcgcagcctaacgaaattttgctgacggtcgatgccatgaccgggcaaaatgccgttaatgttgccgaaagttttaatcagcaattagatatcaccggggtcgtcttaactaaattagacggcgatacgcgtggtggggcggcattatcgattcgtgccgtcaccggtaagccaattaagttcaccggtcagggcgaaaagctaactgatttggatgttttccatccagatcgtatggctgatcggattctcggcatgggtgatatgctgaccttgatcgaaaaagcacaaactgattatgacgagaaaaaggccaacgagttggccgaaaaaatgcaggagaacacctttgattttaatgacttcatcgatcaacttgatcaagttcaaaaaatgggtggtatccaagacattttgaaaatgatgccagggatgaacaacgtacccggcctagataagatccaaatgggaccgaaagaaatggggcacatgaaggcagtcgtttattcaatgacgccaagtgaacgcaccaacccggatctattgaatccaagtcggcggcggcggatcgccgctggtgctggccggccgatccaagaagtcaaccgtatgatcaagcaatttaaagaatcacggaaaatgatgagcaaaatgtccaatgggaactttgcggggatggatcagatgtttggccaaggtatctcgggtcgtttaggcaagatggctatgggctccatggtccgtaaacaaaagaagcaaaaacaaaaacggttaaagcaagcacggaaacggcgtaaataaaaggcaagtgtaacataaggtgtccagctactacttcacagtagcagtcgattttccggacgctgactatttctgtggtaaaaatcataccgcaggagacatagcaaggcgaaaaccgctagcaagtgaaaaaggttgccttatggcatacgttttagctatattgttcagaagtaaaacgaaggagttggacataaattatgtcacaactccttcgtttcgtcttcatcgattgcatcacgctgaatttcttcacgcttttcttgggttttaccttcggcatggtgtttagcatcttccttagctttagcctgatcctgttcctgttggcctttggcttctaattcgtcattgtcgaccaatttgcccgttgcctctttgattttaccttttaacttatcgaatttactattcatggacaaacctcctttaccggtggttctgactgatcttttcctaatttaattatcgcaagaaagtggtaatagtgcgagaaatatgctagtgaaaaagcggctgatgaaagttttggggtaggtacggaatattttaaagtgagcaaattaatttgacgacaaatttaaaaagatttacttagtttgacacgaaatacagtggtttaactgttgattatgatcataaacgcgataagataggcattttatcgtgtaaagaaaaaacactttacaacgctgcaaataactggtatatttattagcgttgaataagttaaggaggtgcagaaatggcagttaaaattcgtttaaagcggatgggttctaagaagcgcccattctaccgtatcgttgtggcagattcacgttcacctcgtgatggccgtttcatcgaaaccgtcggcacatataacccattagttaatcccgccgaagttaaattagaagaagaaacaatccttgattggttacaaaaaggtgcgcaaccttctgatacagtacggaacattttatccaatcatggcattatgcaaaaattgcacgaagcaaaatttgctaagaaatagggattaaatgatgacagatgtgaaagaactgattattacgattgttcaaccactcgtcacctatcctgatgacattaaggttactgttcacgaaacagaacggtttcacgaatatgatctccatgtcaaccatgaagatattggtcgcatcattggtaaacaaggtcgtgtggcacaggcgattcgaacaatcgtttatagtgtgaaagtaccgggtaacaaacgggtgcgtctcaacattattgaataaaacagctaaacgcctcaataagacagtgatgttttatgaggtgtttttctttggaaagcgtgcattaaaaaagctttttcgagcacctttccgtttgaataatatgtaatgaggtcaccagcaacttgactaaaatgggttataaaacgcacaattgccttttataattgtcttagaaaggatcaagcatgagcgaaaaatattatacggtcggtaaaatcgtcaatacgcacggtatccgcggggaagtccgagtaatggcgacaactgattttccagaggaacgttttcagcctggagcgaagttatacgtcaaaccagcaggtaaaacgcaagctttaacggtgaaaacacatcggcggcataaaaatttcaatttgctatcatttaccgagctacctgatttgacggcggttgaacctttgaaggggcaaatgctttatgttgctggtgaagatcagcatcaattggccgctgacgaaggtttctactatcgtgatatcattggccttaaaatcgttgatcagaccactggcgctgatttagggacggttaaggagattctcagtcctggtgccaatgatgtttgggtcgtggcgcggccaggcaaaaaagattggctgctgccttacatcaaacaagttgttttagacgttaatttagcggctaaaaaggcgatagttgatttaccggaaggattgatcgatgatgcggattgatgtcctcagtttgtttcctagtatgtttaccggtgtgtttaaacaatcgatcatcggtaaggcgcaggaacggcatttattagatattgaagtgacggattttcgtgcttactctgatgatgttaagcaccataccgttgatgattatccctatggcggtggcgaggggatgttgctgaagcctcagccgatttttgcggccatggctgacttagagcagaaacagcctgggcccaagcgcgttattttactggatcccgctggcaaaaaatttgatcaaagtgtcgcggcagatttgtcagctagtgatcacttggtctttatttgcggtcattatgaaggttacgatgaacggatccgccatttagtgaccgacgaaatttcactcggtgattacgtgctgaccggcggtgagctgggggcgatggtggtgatcgataccacggttcgtttattgccaggcgtgctggggaatgaaagttctgccgacaacgactcgttttctgatgggttgctcgagcacccgcagtacacacggccagctgattttaacggtatgcaagtgccaccagtactgaccaatgggaaccaccagctcattgcccaatggcaggagaaagaatcactacggcggacttatttacgtcggcctgatctattgcaaaaagttactttaactgagcaacaacaaaaactattagccgaagttaaagccgaggaagacgctaagtaaaggatttcccctttacaggctgaattgagtgtgctaaaatttaactttgtgatgaagagtcactgatcacgatattccgctgctgcggttgcggcaagagtgtctgtagaaaaggagaaattttcatgaatccattaattgcagaaatcactaaagaacaattacgttctgatatcccagcatttcgtcctggtgataccgtacgtgttcacgctcgtgtcgttgaaggcactcgcgaacgtatccagttgttcgaaggcgttgttatcaaacgtcgcggcgaaggcatcagcgaaacttacacggttcgtaaagtaagtaacggtgtcggcgttgaacggacattcccaatccacacaccacgtgttgccaaaatcgaagttattcgctttggtaaggtacgtcgtgctaaattgtattacttacgtgcattgcacggtaaagcagctcggatcaaagaaatccgtcgctaggctttatttataaaagtcgtccagaaatgggcggctttttagtttatactggaattgtgcttagtcgcataaagtacgggaaggtgtggcgtgtatgaaaattgcagttagatattattcgcgcggcggtaacgctaaaaaagtggcgacggcgattgctaaagcggttggtgtagaggcaaaggattgttctgtcgccattgatgagccagttgatttattatttttaggtaggtcagtttattgggctggtattgataagcatttaaagcaattcatcgcccaactagatcctgataaagtgcagcgagtcgcaagttttggcacctcggccttaaagaaagatttagataaagaggtcgatcgacttgttcgtgctaaaaatattccggtttcaacgcaaaattttcgttgctggggcgagtttgctactgtacataaaggtcggccgaatacgcaagatctgcaacgtgcagcagactttgcgttagctgtggtggctgaaggaaaatgatgaccatagtgtttaactaaactgaataaaagctaccatttaaaaaaagcacaccttgccgttcaacaaggtgtgcttttgctatttaataaagggtaccagcttgtggtagagcggggaatttctttaaataataatctcttgcgcgcaataaaggggccagctctgattcgggcgaaccttgatggaaataaacgactggttgctgcttgtgtttcgtggccgcgagataaaatgcaattgaggacgtgaaaatcaaatcgtaatttgcggcgtctttctggtcatatggttcaatatcgatataggcaaagctgttatgataaaaatcggcgtaacgctgatagatagcactatcaccgggaaccatcaatgcgacacgcagatgatattcttttttgtatttggcgtaaaccggcaaaagtaactgatataatgcctgcgtaatttgggtatggtcgccaaaaagttgggtatatttttcgggtaaatgtgcaaaataggcgctgatttcatgatataggtcagcgtaatcatacccaccagtcaaaagcggctgttcggtgtcagcgataagtgttaatgatggcacgacaccgtcaaataagtaaccggttaaaataacattaatcacgttacccagtaaaattttatcagtaactaagcgctgtggtagtttaaagctgttttgctgcatatggttgagaaattcggtggcaaattgccagacgatattgtgccgcgtataaaagtagtccaatgttgcctttaaatacgcgtcctctttgcgaaaaatgggcacaatatttaataattgatagccgaactgaagaaccgcttgtttatgggcttctgtccatttggggtaattttggctttcaatcagcttagtgtttaataaatgagactcgtaattatcattatctaccagtaaaatatttccccgcgaattagcttcaacgtagttaccatggtgcatccgcaaattaatgatcgccaaaaatagcagcggaatagctgtattttcccaatcactaggaatctgtaggcgagtgatgaattgttggtgggcttccgtagcgatgacttggtcttgctcagtaaagggccaaaccacgcctctggtggctaagcggaaaatacaaaataaaaataaaatgactttgcgttcatcacccacaatgttcatctgactaaaagtgaaccgtaagccgaatttatgtagtagggcatttagcggcttgattttacgaaaaacggttgcttggcttgcctcatattgtttacaaaagtccgcaattgatggctcgtcgtcagtcagcagataatagagaatttggtaaggtacctgtgtggtcagtaaatgataacggaaagtatcaagatcgattgtcaactgagtggtatctagactaccgttgtcggcaattaaagcagccgcattaggatcgatcaaggcaagttcattagcgagcccttgggttaagttataggccttaggatatggcagatcaactcgctgtgcaatgtcgtgaattgaataagtatctgggtgtagcgcgcataacgtcctataaatgcggaaatattgataagttcgattattcaacattatttgttcaaagctcatgatgtcatttcctccgggaaagtgagagtataaaatagtttgtgtaaatgaataaaagtcctgttgaaaagggaatcccttccccgtatgattaaatcatccaaatcaaaccaaaacggatggattccccatggatcagtttaccaaaaatctaaccaaaactctattgtcaaatggcgatgttaaagaatggatgtaagctgattcctgagacaacttttaagagagggtataatgaataaatcatctctcaaagggaaggaatttttacatgccaactcgttacgacaaagaattcaaacaaaacattatcaacctatataagcaaggtataagcaaggcgaatcagctgcccaactggccagagaatatggcattggctattcaacagttcataagtggatccagggccaggccaaaactcaatccggtaaatcgccagacgaaatcaaagcg

SEQ ID NO: 560 - DNA, 23291 bp, Unknown
  Metagenome-assembled genome
ctaggtgaaaaactcgacatggcggttgaaacattaactattatttttgacgaatttataaaagcattaccgagtagcctggccaggctactcggtaatgctcaatgaagtggaaactagtaatatatcgtgccataaccgtttgacatcaatggttacggtctattttgatactttcaacctttagtaattatattgaatgagcaaattaatattattaactttttcttttcgcctgtaattttagcaaagattagaattgattacaatcattaatacctaaaatatagttattgcactcgaatcaaaaagccgctgatcgtatcttcaataactgtttgtaattgttgacttaagtattgtgggctggttggttgatcatcttgtagccagtcgacaattacgctgactacggctcgtgagaagtattcgcgtaaaaagctgatgtattcaccagttaaaggaatatttttagttttcaacaagtcacgaacgataatatcggttagttgcttggtgtgagcaagaaaatattgatcaaatgaattttgttcgctgatcgctaaggcgttacgataatacgcacgattagtttctagataatttaataggtctaatagtgatgaagtccaatgctcgtaattaacactttcttccagatcggtgccggcctcagcgttaaagatccacgctaacaaatcatatttatcttgaaaatattcatagaaggtttgtcgccgtagctgcgcttgctgcatgatcaaagtgacactgatctgcttaaagggcatagttaacattaaagttttaaatgcagcagcaatctgtcgttgtgtcgttgaggtcataagcaatcatcctttattcattattgcaacttatttgtcctagaactacgtaatcatatttaatcgtttccattcaaattttatcatctcagaaacttgatagctagcgttgtgtagatatattttgaatgggttaaaaatagcgtgatgcaaaatgcatcacgctaatgtttatgccttagttggtcgccgataaatcagacgtaagcagaggctgaatagggcaatcactaacagaattagaactaaacgaatcagcacgtcaatactgtgtaggcgtgagatccagtaaccaagtgctacggcgataacgagcagaactaaatttagagtccactgactgccagtaaaggcgttgccagcattttcgcgttgccgccgagcaataattggcatgatcaaaccgatagcacataggccgatcgttaccacgatattcatgatcaacgaatctgtccataaactagtaccaggctttgcgtccgttgggaaaaatgcggcgaaagcggagaaaaaggtgacaacgaacatccaaactccgacgctaaagcctaatcggtcatttttgatatatttataagctggcgttgggtaacggtcactatgcaagcggaccatcataaatgcccagaataggaagcaagtggcgaatggtgaaacaataccgtttaagtttaataaccagttgaaaatatcattgatctcaggtagtaagccgcctaagaacatgatgactgcacaaattgcagtagtcatccaataaccgttgatcggcaaaccatcagcgttaagcttagataattgtttcggcatatatttcttactgatatcgccaaggaagacgcgggtaccagcatccaataaaacagctagttgcgcgcacatgtagatcgcttgcgtaactgcaaaaatgtacatcaaaattttaccccagccgaaatgctggcctaaagcgaggaacgcatagtaggaaccgttcatttttaaatcgccgggtaggtgatgagcgttaaagaaaacacctaatgagaaggagccgaagacagtcaggaaggccgtcatcactgcaatcatgatcattgctttcgggaaatccttacgtgggtttttcatatcagtcacgtatggtgcgactaattccgaaccgttcatggcaaaaatcaacagccctaatgtagtaaagaagtggccgtcaattttagggataaacgctttgggtgtaaatggttgtgttgcaatgtgaccacctgttgtcagtgccacaacggtcatgatcacaaacaagaccgtcatgataaacatggcgctaccaccgataacactcatgatcgctaatgatttatttttaaataaatgctcaaagaagataaaaccaacgaagacgatcgtagtcaaaacaccgaacatggctttagacatataagcgtcaacgttaccattaccgtggatcaaccaaccaaaggcgataaccactgagttagcgacatccacgatgtacggtaagccaacgacccaatagaaccaagctgcgaaataaccaactttgtcgccgctagtcccgcggacccaagaagttaaaccgccaccttcagaactgaaaacagagccgagatgaccaaccatcaatgaataaggtaagacatagataaaaagcataacgacccaagatgtgacaacaccgagaccttgattctgaaaattataaataatatcgtcgaaaccaatgacggtgacaaaatccattaaagcaaccaccggccattttaaataattgcgattagcactttctaattctagtttttccatgataacctcctaaaatagagtgcctaaaaaagcgttcatgttttgagcattagcctagccaggcaataagcagcacacagtgatgcgtttgactggcgtagctaagcggaaaaacatgcttttttggcacgtttccactaaaacatcgccataaagcgacattctagtcaattgtctacttcagtattatcggcgggttattttggcaaaagccagctgcacacatggcaaccgtcctttcttattcataatcgtgatacttattaaaattcaaccttatctagtataatgaaaaagccgtgaaaatactagcctgattgcatttcttctccagcttacaattttgttaggtggttgttagttgattcgcaggcgttaccgctaatgatttgctaaaattaagccaataagttagctgaaagaaggatcattatgacaacacaatcaacaatcgttgcggtcaccgatgtacgcaaagtttacggtaaggctaacgaaaaacaatatgaagcactgcacgatgttagctttcaaattcaggctggagaatttgtcggcattatgggcgcctctggttcaggtaaaactacgttgctaaatattttatctaccttagatcaaccaactagtggctcggtaaaaattaatcaacaggaaattacacatttgcgcggcaatcaattggcggattttcgtgctaaggagatcggttttattttccaggattttaatttgttagaaaatatgactgcttatgaaaatatcgctttaccactctcattgcagaatgtttctgccaagaaggcacggccgttgatcgaaaagattgcggcaaccttaggtattagtgaaattttaaataattatccaacggaaatttctggtgggcaaaagcagcgagtcgcatcggcacgagctttggtccatcaacctagtattctgatgggcgatgaaccaactggagcgttggattctaaaagtgctaaaagcttgttggacacgatgacaaagttgaatcaacagcagcaagtctcaattttgttagtgacccatgatccgttttcggcaagctactgccagcgcattttatttatcaaagatggccagatcggtcaagaattaaaacgtggtgatcgcattaaagaagccttctaccaagatattctcggcgtacttggccttactgaacagtaggaggagtgatgggaatgctatttaaattatcactgaccgggatcaaaagccgcttcaaagactatttggttttattttccggtttagtcatggcggcggcaattttttatatgttcgaagctttggcgactaacaatagttttatcaaggccaatagcacgttttcgttagcaccttttgtttttcagtttggttcggttttgttggcgatcattacgttcgtttatattttgtacgctaattcatttttactcagtatgcgtaaacgcgattatgggttattcatgatgctaggcgcaaagtcaggtaaactaggtcaattgatttttctcgaaactgtagctatcggcgctttatccttagtgattgggttgttcgttgggattgggctgactgctttagttgggggactgctgattcagcgtttgaataccactgcggcccactttaatgcattctatttaccagccatgttggtcaccgtgatcttcttcttaattttgtttgttttagcggcgttgctaaatcagcgggttctgcgtaaaacaccggtgttagcgttgttaaaaagtgcggcgcaaccaatacacgttcaagttaaccccatcaaaacggttatccaaattattttcggcttagcttgcttagttgtaggttacattacgatgcatgtgatcgggactttgcagattctcggcattgctgttgcactagttacaatcgttttagggacctatttggtttttaattcattatttacatggttattaacccggcttaagcggcacgagaattttgctagtcgtgggttaaacaactttaccttggcacaactgaattttcggatttttgattataatcggatgttggcaatggtaaccttgttgtttgccttggcattaggtgcaatcacgacagggatgggcttccaaaagaatatccgtctctttactgagagtgcgccttatgatgttattttgcatgatcctactgctaaagttaatcaagctgcggctaaaataaaggtgaagcaacaggcccattacacttataaagtcactgggacgaccgtttattttgttcgtgatcaatttgatgcgcaaccaatttatgcgcaaaagccatggcagaagaagcaagtgactgctgaatatcagttgatcgctggcaagcaaatgactgcacaaagcccattacgttggcaatcgtcactacaagcgttgctgttaccacaagatagtgaaaaaacgatcacgttggttgatcaggcggcttttacacaaatcaatgcaacgacgctggtaacgcatgatttctttgcaaatttagcggcaatcaagcgggtcacgcagttggatcaacagcagaataaagcaccaatcaattatagtatgggcacaaccaagtacgatgcttatcaaatgatgaacgggctactatctggttttgaatttatgggcttcttcctcggagtggctttcttagccatgttagctagttgtctaatgtttaaaatcctatctggggctgctagtgatcgactacgttaccggatgttggataaaattggcacccgccagcgactattacgtggtgccatcgctaaagagataggcgttttattcttattgccgggtgttgtcggtgttgttcacgtcttattcggtctgcaaatgttcaccacaactagtttattaccgaatgcgtaccatgatttatggctaccatttttgatcttcttagtattatatggtttatattatttgttgacggttaagctgtatcaaaatattgtgctgaaaaaatagtacacaaaaaaccgattccagtgcggaatcggttttttatatgcttattctaaggggccttcatcgattcgattatagtactcaacgtgaacttcgctaccttctaaaagaagtttagtgacgctaccattgcgtgggcttttagtcagatcaaagcgttcctgaccaaatttaccgacgatactgcgcatcgtggtgccatgactcactagtaagatcttagcaccagctggattatcacgacgcaacatatcgaagcctaacaaaaggcggttccaatattcagtactattttcagcgtcatggaaagggtcggcttgcttcataaaatctttggaggcatcgattgaatagttactaataatttcggcataagttttactgtcatgaccagcgccagtgaggtaccaagcttctggcgaattcatgccttcaaagtagccataaaattcttcgcggaaaaacggcgtttctattggttcggtcaagccgctgacagcgttggccttgagaatcaaacgtgccgtactccgtgcacggccagtatcgctgcaataggcttgatcaaatttgatctgagctaaccgttgaccaaccttattcgcatccagaataccttgttcagttaacggtgaatccgcccagccttgcatacgattataccgattaaaataagtttgaccgtgacgcacgaaataaacggtcgtttttgtcataagtgaacctcctacgctaaaatgtgccgttttcaacgtcttgaatgaattgacttaaatgatcgaagtaaactggggcgttatcaatcatatggtgatgtccaccatcaggagtggtaaccaatcgtgagttagggatctgttccgccattcgtttggcagttgctagtggcatcgtttcgtgttcaccgaacgtcaataaagttggaaccttgatattcttgatttgatcacgaatatcccatgacttcaacttgccggtaacaacaaattcgttattgccttggaaatcattgtaaactggagttgccatcgtgctgaccaaatgagagatcgccggtggctgcttacgatcaacgtagccagcgtttaaaatatcaacgtaaccttggtaacgctcattatcaagatcgttgcgggcctcgcactccttcatataagctactgcgtcggctggtagggcttcttcacgaattttattgatgttgacgacatattcatcaatgttgtcgaccatactggaaatgatcgcaccctttaaatgttgaccatacttcaaagcataaagcatggttaatgcgccaccccatgattggccaatcaaatagaagttatctaaacctaatttttgccgaacttcttcgacttcatccaaataataatcgtaagttaaaaagcgatcgcggatcgcgggatcagaaaaatcaggttgatcggaataccaagaacctaattgatcatacattgaaacgcggaccccaagtggtgctaatttatcagcaaaattttcatagtactcatgattaccaccagggccaccatgcaaggtcaatagttgaatatcgccggtaccatcagtgtgggtccacaaatgataaccgttatctaaggtaatgatgttggttccgtttttcatacgctcacctttttctaataagatactttcattctagcattttcagcggctaacctaaagcaccagcaaagctaaatataagtttaaatttagtggaagaaatcgcttttgatgactaaattaggtaaaatgagtaagctagagttgattgtagaaattttttactagcaaagttatcggggatatagcatttaatcaaaaatgagccatggctaggtcgtaacatcagaaacttttggcacaaaaattatccactattgtggagtagaggggttttatataatgaaacaaacttggcaaaaaattagtcgccgtgcagcagttgtgctggtattagcgggtgtcttttttggtagtgggatagttgctgcccacgctgatacgtattctagtagtagcagtagcgagagtgtggtcaatgagcgttggggcaaaccaacatttatttatggtggcgggttgaaccaaagccaaattcaagaaacgatgaatatcatgaatattaatagtaacgacgtcaccactagcagcgtgactggacaggacctagttaaatatttaggttctggttccggcgatactagtgtaatgatctcgtctgttttagtgactcgtgagtctagtggtcatgggatcactgtcaaaattgacacgccatctaatattacacagatcacagctaatgaatataaaaatccactgatcactgctgggatcactgatgcaacgatcgaggtagcaagtgtaaaaccagtaacgggtgaaagtgccttaactggggtttataaagcgtttgaagctaacggcgaaacggttgatcctgatcgggcggcgttagggcaagaagaattggaaacgactaattcggtcgcacaggatgcggtcaaacaaaatgcagccgacaaccctgaccagagcagttctgaaagcaaagaagacgctaataagatcaaattacaattggctaatgcgctgactgatatcaaacaacaactagctgatctgaaagaacaaggtaagaccgcgaataccacgcagatcacaacaatcgtcaataactcgatcaaagataataatttatctgggaaaatcagtcaaaccaatattaaacagttagtcaatttagctggtaaatatcaaaccacatcaggtgtgttagataaatcaacgatgaatcagttagataaagctaaaagtagcattggttcagccttagataaggttggcggcgcgttaaagaatgcccaaaatagtagttggtggcagcaattcactaactgggtcaaaagcgtttggcaaagtatttttggttaaataatgtagggtgaattgaaaaggcaatgtcttcaatcacgtttatgccaaaccaatgataaaaattaacgttacgatttttccaaatacaagttaaattagtggggcaacggcgatggccaatgcgccactttcttcattggaagtaagattttgttatactaagggagtatttctaatcagtgataagcaaaaaaataaatttaaaacaaaggagctggcgcaatcgtgttttattttgtaaataccagtatgaatttaaaaaaatctggaattgagcacgcagaaatgaagcgcctcgctttattcaataaacatggcgttcccgctaagatcgtgacccgcttcttttctttaagtctccacgaaaccttagccgctgctggaatcgcggagaataatcaaatcaatttattcgattttattcagaattcaactgactttaaaccacgaaaattgacgatcgctgatctgaacctgccggcggactaccaagtgactgcagatgcgcataattataaggtagaacaagatgatcagttgcggatgcgggttaatacgatcagcgctactgactcacggttaaataatgttcagtattttgaccgcaatggtaaattgacgaagactgagtggtatgacacgcggggctttaaagggttagagcagttctatacctttgatggtcaagtcgctagtgaacaggtttttgatccgcaaggcaaagttgtttatcagacgttccatatgcaaaataagcagggcaaggtgaagaactcactttatcgctttattgactatcacggccatgattggtcgtttaacggtgaagaggcgatgatgcgcttcttcttggatgaattaaatcaagtcgataatggccggaatgtatttgtggttgatcggacttacgaattagcttggtcaacgctacgaatgcacacgcgaccgtttcgtgtgatgcacttacacagtaatcacgttaatgacccagctgacccacagcactccgctttaaattataattacgagttagccttgaataatttagctgattgggatggtgtgatcgctgcaacgcaacagcaagccgatgattttacggcccgttatggaacgaccacaccaatcttcacgatcccagtgggggtggtggccgatgaattaagtgcccagccaccggttaaatggtcaaaacggacaccaggtaaagtcgttatggttgctcgtttatcggaagaaaagcaacaggatcaattgatcaaagcaattaaaaaagttcatgctaaatttccccaagtctcattagatttctggggttatgccaacggtgataccgggaccaagttacatcaattagtggctgaactaggtgtcggtgactatgttaaatttaatgactacaccactgatgttggtcaagtgtatgatcatgctcagttggcggtgctgactagtcgtgctgaaggctttgccctagctttattagaaggtcaggcgcatgggttaccccaagtagcttatgacattaaatatgggccccaagcaattattcgtgatcagcaagatgggctgttggtacctttaaacgacattgatgcgttagccgaagctatctataagttattgagtgatccggctaaattacaagcttacagtaaacaggcttatcaagatagtcagcggtattcagaaaccgcagtttggcatgcctggcaacaattgattgctgcagccgagcaatattattcacagaaaggtggggcgaataaatgatctattttgttaaccaatatttaatggcgttgaattcaggtgttgaacatgctgaatttaaacggatcgcgttatttaaacaacatcaagaaccggctaagcttgtaacccgtgattttgatgttttactacatcaaaatatgactcattttggtttggcagcaacggatatggtcaacttatacgattttttccgtggtagcgaggaactgcctgaacgtgtgttaaagattcaggaccttaaattagcaccagcgtataatgttgatcctggcgctaatgttagtcatgtccgtgatggtgatcaggttattgccgatgtttatttcagcccaggaacagtaggccacctttattatgttaattatttcgatgcttttactaatgttgtgcagcgaacttactatgattcgcgtgggtttaaagccagtgatcaattcttttcaccagctggtgaagtgatcactgagatcatttataacgttgacggtagtcgtttgtttgagcgctattacgctcataatgacgcaaatagtaattatatctcgtcaattcgtttgctggcttatcagggtcgcgaatggcaatttaattctgaggatgagttaatgcgtttctttcttgacgaattaaatcagcgtactcctgggacatttattgctgaccgaccattagctgctgattggcccgtgatcaatatgcaaaccgcggcgcggaaatttgcttggttgccaacaactcatgctaacgatccacaggaccaagttttcagtaatatgaatggtgcttatgtctatgcgttgcacgatcacttagcgcaattagatggcgtgattacagcaacaaagcaacagcaagccgatttgactcgttggttagggggcaagccagctcgaccgatcacagcgatccccgcagcagttgtcagtgaaacaagattaaaggctaaacaagttgcggctagtcaacggacaccaggtaaaattatttttgtgggtcgcgttgatcaaactaagcggctcaatcaattgatcgaagcttttagccaagttcatcagcgcttgacggatacaaccttggcgatccatggttatggtagtgagatcaataatttacaacggcaagttgcacagcttaatttgaaaaatgtggtcacctttgtaccgtatcatcaagacttaaaggcgacgtacgaccaggcacaattatttgtttatccggcagaaagtgatggtcaatcgttagctttggttgaggcgttatcgcatggggtacccgttgttagttatgacattaattatgggccaaaagagatcattactgatggcaataatggctatttagtgccatcaggggatgttaaagcattggcgagtgcgatgattaaagcattagtgaatcaaaaacgttggcgccaattgagtcaaaacgcttatcgcagtgcacgtcaatatggcgagaacaaagtttggccattatggcagcgacttttaaaattatagccgtgcaggagagtccaataatggactcttttttatttagaatggaaattcaggttgtcaactgatttagattgttccctgtgaaaaaatgtgatattctctatatgtaaccgtttacaaaaaagcttagtgattacgctaaggctgaggcttatttttttaacagaaaggaagtagcgacatggcacaagatatccagtatgagactttcgcgaacttgcagaaatttatggcgcttggttttgaagccgttggtgtgcccaccgccgatgcacagacttgtgcacaagtactgattgaatccgacaaacgtggtatcgattctcacggtgttggccgctttaaaccaatctatattgatcggatcgaagctggtatccagaatgtgatcaccaaggtggaagttgtgcgtgaaaccaaaacaacagctgtacttgatggtgggaacggtatgggccatgttatcggtacacaagcaatgcaaatggcaatcgataaggctaaagagtacggcatgggtatggttgcagttcgtaattcaactcattatggaatcgcaggttattatccgatcatggcagctaagaatggaatgatcgggatgactggtaccaatgctcgaccatcgatcgcaccaacttttggggtggagaatatgcttgggaccaacccattgacgatcggttttccaactgatgaagcctttccgtttatgatcgatgcagcaacttcaattactcaacgggggaaaattgaacattatgcacgcattcataaaaccatgccttatggttgggtgatcgatgaaaatggggaaggcgtcactgatccagatattgcacttaaaggactagttgatggtacttgtgcattggcgccactgggcggtattggcgaagagttagctggttataagggatacgattacgcaactgtagttgaagtcttatccgctgcattacaagggggtagtttcttacatcaattaagtggctttgatgcgcatggtaaaaaacagccatatcatttagggcatttcttcattgccattgacgtcaacgcatttactgaactttcggcttttgaaaaaaccgctggtgatattttgcgggctttgcgtgcttcgaagaaggcaaaaggtcagccacgaatctatacaggtggtgaaaaggaatatctagctttcttagagcgttcagaaacgggcgtcccgttaaatccagctgtgcgtgattcactaacagcagtacgggataaatatgccattgatttcaaatttgcttgggaataggttaggtcacttaatttagattctatataaaaagcatatctaacgataaattttgtcgttagatatgctttttgcatgctttaatatttacgggtcagtaactgttgcgttaattgttctaaatcatcccgtgccgcgccagccggtaacttgtggatcgcagttagtgcttgttgcgtatagtcagcagctaatttttgtgcggctgtgaccccaccagccgccacaaccaattggcgaatctgttcacattccgctggtgttaaagcggtccgtttttttagtaattcgactaattcggggttcgcgttttgcagggcgaaaactagtggcgcggaatagacaccttgacgaacgtcctctaaaactggttttcccaaagtaacactactttgttggtaatcaaggatatcatcaacaatttgaaaagcagttccgatcgccataccgatctgttcactttgacgtgcaaaactttgagtattaccactttcataagcgccaataaagcaagcagtactgaaaagctgagcagttttacctttgatttgcaataaataatcatctaagctcatcgatagctgatagcgcatcttcatttggtggatctcaccgttaagaattctttccatgctattcgaattaacttggatactgcggaggtcactggtatagtgcgccagtagtttaaaacacacgacaaagagataatcacccgcgtatacagcggtgtctttaccgaagcgtgcttggattgttggttgattacggcgtagattggattcatcaacaatgtcgtcatgaatcaatgttgctgtgtgtaatgtttcgactgcagcagctaacgcaatcatctttttacgatcagtttcgtgaaattgggcgaataacaggcagtaagccgggcgcagcaatttaccaccagcatggatcatatcgataatagccgcagtgacttctggatcatgggctttaatatttttttcaatcaaagtcagtgtggcagttaactctggcgctaggcgcgggtattgttgccacattgcattaatttttgtcataatgcgactcctttaagtgtctcacgtgtcgttgacgtttcttttgcgtttgcatatgcgcataattggcctttaaataatttagggtacgaacgtgctcgaataaataattagcagagataccaattgcaattcccgcaagaataccaatgaaggataagattggtaagtagagcattaccgtccaactctgagcaattaggctagcaactaataattgaccgacgttgtgcaggacgccaccagcactggaaataccaataatgctaacgcgcttgggtcccagctgtttgatcaataacatccccaaataactaagtactgcaccacctgctgaatatagaaaagttgatagtgtaccgcccagcaaggtagttaggatcaaacgcatccatagtagcaaaaagctatcgcgaaaaggcattgtaaatagggcaacgatcgtaatcagatttgctaagcctagtttagcgccgggggcaaatgcgaagggaaagggaatcatccgttctagtaggccaataatgacaccttgtgcaactaataaggcaatgaatacatatttttgaattttaggttgggtcattaatttttcctcactcattcggtgaccatcccaccttgggtttgtgagccgtggttgaccttgatctcgatcaagagtttatgtggcaaacagacgatcgtttgtccaggttttgagatccacccacggcgcacacagacttgatcacggcaattggcaccaacgatggcgattcgatcacctttgatctcgacatcattgtagtcaccatcggcggcctgataacggtatttagtcgaacctttgtgaccggttagtttgatcgaatacacttttttgccattatggctgataacagcagtgcgtacctgcgtcgttggtgcctgtttatcagttgcaacctgattcttttcatgcaacgcaaaaatgacaagcggagtgaacgagccgatcactagcaaaaccacaataatgatgtcccacggacgaatcattttcaaatacttattcttagccacagacttgactccattctattgccgatttgctttgaaaaaaagaaatggccctgggtaagtcaccccagaaccatccccgttattgactgtaattgttaatgtttaccataaattgatttcaagtcgccgtaccaccagtgaccaagatgtttttgtaaccacggcacaacccagaagtcgagaccaaatgcacgaccggagccgttcatcaaggcgagggccataaatggcatccacatgttgacccagtagaacataccggataagcagaagaccactactaaaccaatcgtgattgcattggctaaccaagtgaacaaaccaaacaaaatacacagtgctaaaccaatttcaacgatcgtcatgaattcttgcatgaaaagggctgtttgcttgttaggaatgaagaacttagttacgctttcataccattttggtaagtgcttaaagatcatcattggttgtttaccgtaatcatatgatagactgaaaaattcattagttggcgctgctgcagctgattcaactgcttttttggctgtgccagctgcttcagaagcaccactggtagttaccttggggtagagccaagtgaacggtagccggagcttgccgttgaaccatgagccactaccttgaatcttgtaccagcaatcgactaaccacatagaagcatagaagatccgcgcgggaacactccacaaaacgttaccgtagcgagaaatatgaccccagaagggattgcggccattgcggttacggaagaattcatgcatgctgtattggaaaatatagtagccagcaaaagttgtaaagaagtacaacaagttgatcatgtgcttcatcatggtgcccagccaaccgctaaggtgaatactaccaaaaacgttagcaacactgtaatgggagccaatcgaaacgacaaagccagaataactactcttcaaaggcttaggtgtagtgccgttaaccgtagcgacgatatgttctgcagcagtattcccagtttgttcagctgcttcaacaatttgtggtgtcccacgatcgccttcattggtatttaaggacaggtccccagcaacataagtattaggatattgcttggattgcatgtattcgttagttactaaacgacctgcgcgaccttgttccatatcaaactcagcagtatcggtgttagcctttaagccagccgtccaaatgaccgtatgcgtaggcacatgcgtaccatccttcaacgtcatgtagtcggcaccgacttcagtgattggcgcactagtacgaacatccacgccttttttcttcatgaaacgtagggccagatccgcatcaggacggtccaacatgttaaggatcgttgggactgcttcgtctaagatcaaagtgatctcgcttggattaatcttgttttccttagctaagattggccgccaatcgatcatttcaccaatggtctcgaccccagtaaagccgccaccaacaacgacaaacgttaacattgctttgcgcttggcttcgtcatgttctaatgctgccgcagcaacggtagctttaatgtgttctttgattttaaccgcatcttcaaaggaccaaaggctaaagccatgttctttaaccccaggtgtgccaaagtcattagattcagcacccattgctaaaatcaaataatcatagtcgtaacgaccatgttcagttttgaccacatttttatcgtgatcgacttttgtaacgttgtcagtgaccactgaaacattctttttatgtgcaaataagcgacctaagtcgtattgaacagattccagtggtacacgatcagttgcaatttcgtgcagttcagtcatataagtcatgtaagaatgacgatcaatgagtgtaatatgcacgtcatgattctttttgaatcgttttgccaagcgtcttgtagcagaaacaccggcaaagccagccccaaccactacaatatttttctcagccatagatgaacaccccttaataattgcagtagaataaaaatttcacaaaaaagataaaattaaaaaaaatgcaaagcttatatcaggtaaattatacagaatcgcaaccgctttgtccatcggtatatacaaatgtggtcagaacaaatttaaagcgcaagcacaaaaaaacaaatttttgaaataaaacaaaaattatgccaagggcaaattaatttttgttatcttgattcagaacaaattggtatagtaagcgactttatgattcattttggcattggctaaattaattagttgactacagcttctgtaaatataaaagttattgtttgtaaaatagatacggctaaattaaaaaagactcatgataattaaaacgttttctaatgcagtctatctttagcttgattatgattaaaaatgtaatatactaagttatgtgaagttaaacacaaatatttatgggtggggaaacatattatgaaattaaataaatttgtcacaagcttatcggttgttgcgatgtcagttttaacattggcttcagcaatgccagttcaggctgctgattcgtctagttcatcggcagaatccagttcagtaactgagaagaaagtgactgctggtaagacgatgaaagcaggtacttataaactggaagaaaagaatttcagtcatggttacaaggtaaaaatgtcaatgacggttggtaatgacggtaagatcactaataccagttacgactatgtggataaaaatggtaattcaaagaccaaagacgctgactacgaaaagtctatgaaggctaaaagcggggttggtccggctgaatatattccacagttgaatgattcgtttaagaagaatggctctgatactggtgccattgccgttgtatctggagcaactgaatcttctaacgacttcaagaattatgcacaacaattagttcaagcagcacaagctggagacactaagacgattgttgttaacaacggtaaaaagatgaagaacgggacgtataagttagctgaacaaaattattcgcatggctaccggatgaagatggcgattaccgttaagaatggtaagatcactaagtctaatatggactatgttaataaaaatggtaaatccaagaccaaggatgctgcttacgaaaaatcaatgaagtccaaggttaaagttggtcctaaggaatacatccctgatttaaacaaagctctaaagggcaaaactgcaacaacttatcaaaatgtgaaggtcgtttctggggcaactgaatcttcaaatacgtttaagttgtatagtgctcagttagttaatgcggcacaaaatggcgataaaggtacgatcaaggtcagcaactacgtttatgctgaataattagttgtacttttcatgttgacttaatagaataggaatgtggcgatattgccgcgttcctattcttattttttagcgcaaaggggcataagcaaataaatgaataacgaaaccaccgttaaaccgatgacctttaaattgtttttagagttcattcggttgaacgcaaaaactgcgagtgcaataccatttatattaggcttattgtattcgatttattattttcaaagtgttgactggctgaattcactgatttactttattgcgcagatggcgattgctttttttgtgaccggctttaataatgtgcaggactataaattggcggttgatcaacattatcgcgatacttataacattattggtcgtgaacatctatcgccacggcgggctttaaacttaatgctgacttttttagtagttgcgtgtggcttaggcctaattttggtttggcgaactaatttactattactatttatgggcggcgctggtatttttgtaaccattttttatacttttgggccgattccattttctcgttttcccttaggtgaattgctttctggtgtagctgaagggtttggtgtttttttcatcacgatctacgtcaatgttgcgccggaacgattgctagggttattttttgattggccgcgtttcatgatcaatggcaatttattaacgttgattattttacttttggtcgggttaccgaatattttcacggtggcaaatgtcatgtttgccgataatatgtcggatttgccgcaggatattcgtaatcaacgttatacattgccgtactacttgggtataaaacgggcgctgtggctgtatgatgcgttgttatatttatgctttgctagtgtcacggttagcgcaatcttacgtcttttaccgccggaaagtttattggtttggttagttctaccacaaattcgcaaaaacagtcgtatttttcatcgagagcagatcaaggaaaccacatttgaaacggcgattcagaatttaatgctttttcaaggggttcaaattttggcactagtggtggctattctgcgaactcaagtatttggctagaaaagttagtaaaaccgagttacagctgtgttaaagcagctataactcggttttttgtttgtcaatggcataaaaagcttgctaaataagaacgtatgttcctataataggattatgtgatggtgaggtgggtcgaatggattatgccgatgaaccgcgtggtgtcttttttatgatcgataataagtccttttatgccagtgttgaaagtgttgaacgcgggttgaatccgttgcgttcagtactagttgtcatgtcagaagcagataataccggcagcggcttggtattggctgcttcaccacaggccaagcaacgctttggtatcagtaatgtttcgcgtcaatatgaagtaccgatgacgccagaattattagtggtgccaccacgaatgaatctttatattgagaaaaacttggcgatcaaccaaatttttcgttcctttgttgcggatgaagattgctatccttactcgatcgatgaatcgattctagacatgactcattcttggcgtttatttggggagacgccattgcaggttgcacgaaaaattcaacgtacagtgcggcagcagcttggtctttatacgactgtgggtatcggcgaaaatccgctgcaagctaagctggcgcttgacctatttgctaaacacgatcatgaattgttaggaacattaacttatgcaactatggcggctaaagtttggccaatcactgatttaaccaaagtttggagcattgggcaccgcaccgcagcacatttacaacagttaggtattcacagtattcgggacctggcacagattgatccctatgagctaaaacaggaaatggggatcattggggcacaattatatgcattggcgtggggaatcgatcgtagtcagctccatgacttagttgtaccgaaggataaaagttggggcaattcacaagttttaccgcgtgattatttaaaacaggcggagatcgaattggtactacgcgaaattgcgctgcaagtaggtacacggatgcgtcatcatcagcaaaaagctggctgtgttagtttaggggtcggctttgcccatgctgtagcacaggaggatagccgtgctggatttagtcattctctacgtattgagccaacggatagtcagcatgagataattggccacctattggcgttatttcgtgacgcttggtcaggccaagccgtgcggcacattgcagtttcgctttcacagttggttcctaatactggattacagcttgatttgtttcaagatccgcaacgacaattaaaggatgatcgttttgagcgcgtactcgatcaagtccgggcacggtttggtactacggcgctatttcctgctagcagcttactgaaaggcggtaccctgttagcgcgagccacgctcgttggcggacataatggaggtaatagttttgactgagacaccacagcaagcggcaaaattaattcagcaacgattagcactttattttaaaccgcgtacccagcaccgttatcgcttggatattgtgaataatatttacggtgctagttataattttttcctcaatattcaagcaccgtatcaacgtgaacgttcgctaccgttacatcggttgcgcgtttaccagttggcctatttagaaacggtcgtttacttgttgcggcaaaccacacaattgacctttaattttgttgattttacaacgcaacgctggccgcaaaaacaaacgttgatcaagcgaggcgattaaaatgattttacataaagccaaaaatgagcaggtggcagctgatttttttaaatatcattatcacgattggggcatgatgaagtggggtggcttttatttgtcagatcacaccagtgctttacagaaaatgcgtgcggctgaagttgctgaagcaccattgccgatacaaccacaggcgctgatcagtcagcggttatttagtgcctggcagcgtcaacaattagttcatctgcagttaaatcaattggaagctggtgaacgagttgttgtggtgacggggatagtggttggaatggcagataacgagattggtattcaaacagccgagcaaaagatcatctggttagttttagcagcgatcaaacatgtagaatttatttaaaagagctttctaatgcggacagcacatgctatgatttgcttatctaaatataacaatgtggcattatattatgaaaaaaggctttggggtataacggttttgttgatgcctaggggggtagcggcgatcagttcagttgtgtatgcgcattatttgacgatcacaggaaatattttattggcaattttatatacctacttgttacggcccaagtataaagacgctgcggattatcaaggaataaggtcaacggcggggcatttatttcggcaggcacgggctattttggcacaaatgccagagaaactatatctgagtttagtcgctatttttattgggttaccgctgctcagtagtttaccaactttactcagtttattgaccggtgatcgaaattggtggcaattgttggtgttgatcagcgccttggttttacttaatttaggatttttaataatcggtgctatggtcagtgcagtgatccttaaaaattgtttaccattaccgcaaaaagtgcggtggcgtatcgatcgtcaagtaattatcgatttactcgtcttaaaaacgcaattgaccagtgataatttagaagcgttgcttgaggcggtagagattcctgagttaattgcgggggatgagcggttattaactttatggcacggcctagcacaagccaaattaccagaattgacgatggccgagttgcaacaattgttggtacggcaagcaagtgacgaggtggaactctatgtgatcacccgcgattttgctggtttttgcgaattaacgatggcggtgaatgagccggaatcactgcaagaagcttatcagaactattgtcgcagcaatcaaaaacaactgtattttgtttacggtttacttgtgctggctactatattggcgattttttaattcagttaaaaatccgctgcaactgatttaatcagcgcacaacggattttatttatttcagggctaaattttgggaccaaggttgtgaatgtaatattcatcttatgccgttatctatcaggaaagtggtcattttaccaccccagaattgttgcgcaaaactctcactttgatttgaagccgcaatctgtgggttaggggagataagcgtgactgcataggttgatccacacttataactggttaataacgcgttaattataactaaattagtgtgctgtctattaaaaaaagccaataaaaaataccgcatgaattagcggtatttcttaaattattgttcatgatctaaaggttgaaagtatcaaatagaccgtaaccattgatgtcaaacggttatggcacggtatattactagtttccacttcattgagcattaccgagtagcctggccaggctactcggtaatgcttttataaattcgtcaaaaataatagttaatgtttcaaccgccatgtcgagtttttcacctag

SEQ ID NO: 561 - DNA, 1343 bp, Unknown
  Metagenome-assembled genome
attgccagtattaaagccactgcggtcataaggatcataaccaagtaaggcagttagttcagcttgcaagatgtgattaatagccgtttcgagttgttgacgaaaaagttctttaacatcgccatttgacaatagagttttggtaaactgatccatggggaatccctccgttttggtttgatttggatgatttaatcatacggggaagggattcccttttcaacaggacttttattcatttacacaaactattttatactctcgttttttagctaagctcgctaataaacttttgatgttcgcggcgatggccattcttctggcacaaaacgtgccgcaagaaacatggctaattatcttgaggtgcagtcgccccatcgtcgttgtcattgatttgattgcgttcaatcgttccgtcgatcatctgctgacctttgccgtaagaaaatagttgctgggcctcttgaatttcttcacgaatggcggacatttcttgatccaacataaaagcagcttcggcggcccgctttaaccgttcattgatttcatcaggaaattcaccttgatatttataattcaatgaatgctcgatggttgcccagaaattcatcgacaaagtacgaatctgaatttccgccagtaattttttctcaccatgaactgtttgtaccggatacataatcaccatatggtaagaacggtacccactaggcttaacattggtaatatagtcgcgctcctcaaccacttccatatcggtccgttgatgaagcagatcaacgacttggtaaatatcctcgacaaattggcacatgatccgcaaaccagcaatatcctgtagatcttgttccatcaagtcttcactgatctggcgacgatgcattttttcaataatactatccacgggcttgacccgaccagttacaaattcgatcggcgtatgcgcattttcttgttgaaattgtttgcgcatcccacgtaatttgattttcaattcgtccacagcttgcttatatggcattaaaaataattcccagtccttcggcatcgcaactgtccccatccttctcgttatttgcacaatgttaaacgcaaaattgcgtaaattactacatgatacgtgtggtgctagtttgtaacatttagaaatttaacaaaaaagtccaacccagttagactcataagtgacaaaacttaaaaggagtaataactgtgctgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 562 - DNA, 1264 bp, Unknown
  Metagenome-assembled genome
aagtatcctttgattcggtcccactgagcatcttccagttcgtatcgtttaggtgttgtcatcggaatgcctcgattcgtttttcctcagattatacctgaatttttagttttcagacagtccctagataatatcacacaaaaaatatttcatgaaaaagttagagggtaacatatgaaagccaaattagatgatgttgcattagaagcaggtgtatcaaaaacgactgtttctcgagttcttaataatcggggatacttaagcgataaaactaagcaaaaagtatatgctgcagttaaaaagttaaattaccatcccaatgaagttgcacgtcaattgtttgaaaataggacaaagctgattggcttagtatttccaacaactgcaaatccattttttggagaaattattgaaaaaattgaagcaaatttatttttagaaggatataaagcgttaatttgtaacagtatgaataatcctcaaaaagagcgtgaatatcttcaaatgttgatttcgaatcaagttgatggaattattgttggtgctcacaatactggtatagctgaatatgaaactgttggactacctattgtttcgatagatcgttttttaagtaatcaaattccgattattagcagtgataactatgaaggcggccgattagcaactgagtatctatttaacaagggagcacgacatattatccatacaaatggaccaattgagaaaaatgcaccaacaatgttacgtaaaaaagcctatgaagatgtaatgaacgagcatggttttactccaaaaacttattcgcttgatttaaatttacctgatgaggaaaagaataaaacaataacacggatttttgaagagaatccggaggttgatggtattttttccagtaatgatgtggatgccatgagtgtgattaatattgctaagcaatatcagcgctttgtacccaataatctgcaggttattgggtatgatggtactcacatgttaagaaatatatatcctgaattaccgacgattgttcaacctatacaggagatggcacaattaagtgtgtcaatgttattaaagctaataaatggtgatgaagtggataaaaatgtgatttttccaataagtttatataaacctgaattatgcatatgcatcaaattgattggccaaattatcagttttacgtaatttctctatattcacgacttgggctagtcatgactagccaagtttgacttaatttagttagtttgattagttt

SEQ ID NO: 563 - DNA, 7523 bp, Unknown
  Metagenome-assembled genome
atccagtgagaagcaacacctgaattaagttcgattcatccgtgaacggtgattccatatattaatcgtcatccccccttgaacatccggttttgaacttgggtttcatggaactttagacgttaccaattggattatgtaactgtttacaaactccagtataaaaaaaaagaatgcgacattcttgccgaattctgatagttgtccaaaaattactaacgttaaaatgacaatatcttgcaccacaaaaaaatgcttacattttggctaagcgcttgcaagtagggtttactaactttaaatttccgcttatactgaaaagtatatttatgaattcttgttaattgtaaatctgaattttacaaataccatggaggtaattagatgcttgatccggaaaattactttggtaacaatcagaaagttctcgataaaattctacgtgaatttgctgaggcaacaggcttacccactattctagttgatacccgcggggacgaactaacttacggctatggctttactcccttttgtcagttaatgcgtaataatgagaaaacgcgccagctctgtcaaaactgtgatatgtttggtggccgccgcgccgttcaagcaaaacaatcgcagccatatatctgtcatgccgggttgatcgatttttcctatccaatcaagttaggtgaacaagtagtcggctatattctttgcggtcaagccaaggtctcagatgacgctgaatttgaacctattttaaatgaaaaaaccgattggcataaagatccgatcctcagcgaggcctacgcaaatttaccaacagttaaaccgagtaaaatcaaatctggggccgaattattgaagatcatcatcaataattacctatctaatattgttaatggtacctttgatgtcgatgcaccgggaccagtacctgcacagatcaaagctaaaatgggcccagatccggcagataaccaacaacaggccgctaaaatcaatttttcgatcacgaaaccgcaccatcccgtccagccgcaaaagcctgagatcaaaaaagcattggattacatcaataaacatttgaacgaagtgatcagtctcgatgaagtcgccgaacatgtctttttatctagctactacttaagtaaactgtttaagaaggaaatgcagatcaactttgtcgactacgttaacaataaaaaaatcgaacgggctaagatcctgctacaagattcaacttggtcagttgacagtattgcccacagtttaggcttttcgcagaccagctacttcagtaaaacgttcaaaaaatcggttggcgcgtcacctagccaataccgtaagcaaatccagacccactagcatgtattgaaaaggcactcaggttatggcacagctagtcgacaatggaccaccctttttcaaccaggttcaggccgaaccgcaacctctcaatgctttcccaaattagacgctaaaaagacgcaacggcttttcccgctgcgcctttttttgttagctaaataaagcaccgcgcttctctactcccgaaaaagcctgtataccattcaccaaaatatcctgacttgatctcaatcgccgcatatccttccaaactaacgtggttatatgcattgtccatctcacagttgcgggtacagcactagatttacactagtttcctttggatcacttgaatggtcattatttaattaaagtggctacttactcgtcaaacttaggttcgggtaatcaccggtacagagaaatcgaggatcgtttgtaacttggtgattacttggttcagcgctgactccacatcagaaacgtcgccgcagatcacaactgagccactaaaccgatcaatgaaaccaagcttaacattacccgctttaatcgcaatatcactggcaatgatcgacgcttcactaggggtgatcgttaatatccccaatgcattatggtcatcatctaagcctaatttcgtataaatatcttcatccggactcgcaataatatgcgctaaagtaacttgcttacccggaacatattcttgaatcatgcgctcaggttttttagttgatccatttactaccatcaacgacacctctctacttcataatataattattttttgctgttacggacacttgcaatcagtccttaaacttggcggaaataaatcaaacgtaacgcattattaagcgtcattgtgaaacgcgccaattgatcagcgtcactcatatcattaggataatcaaacaacacaacttcattatccgtgggttcgaccttaattgtatcagctaaaacgatcacgcgcttgttgtattgcgctaaaagtgtccgataactcaaactatgtgcggccacaaaataataaggcgtctgctgcactaacgcagacatttctgtatccttaacaaaagccgttgccatatccgttaccgtgacctggccaaaaaaggtttggaaacaataacctaggccagttgctaattcggccttagcatcagcccgacagtcagtaaagttgactgcaactacttgagcactaaatttttgtaattgcgtttctaagaccttagcaatttctggactagcaccggtcagaccaatattccggtaagtcacaccatcagcacctaataatgggccccgtacctgcttattggtataaaaatgataatgtaaggattgccacgtcgccaatgcagtaacatcaacctgctgcaaacgccctaatttgcccccaccatgaatttgctgtcctgcactatctgtgaatttagctcctaatgcttccagcgcaccaacacctaaatcattggtaatattaaccagattaacaaaaataaaatcagtagtttgtgttgtccgcgttttacgcatcaactcacccagcccaaaacttgttgccgtcagcggactgcgggcaatttctggaatcaattggggccctagcaaactgcgaatatcaatgaccacaattttaccagcagctaaaacgccataacgtgccgtaaccggcatttccaatggtccagtgaccgtcatcgtttgaactttttgctgataaaatgccatgatcgcagttaaataatcatcatctaaatacggtaatcgttgtaaagtcgcggcaggcgcctgctgatgtaacgcttgttcgagcaattgtgctaactgatcattgacgacttggtcagtagatatctgtgcaaaagcataacgatcattattagtcacaatctgccctcctctacgccacttcttttaaggtagctaaagtcattaaagtgtttccgcttccaactattattctatcaaactcagaatatgctttcttgactaaatttagtactatttagtcctgttgactttttaacttagcggtagccgcagtaattgccgcttgcacttcagtttcgttttccgaaacttgctgattttgaaggaattctaataattccgcttcattatgttgcgccaactcggcgactgcccaaatcgcggttgctcgaataacaggtcgcggatcattatcgatcacttccagtaataaaggtaccgcactacggtccttaacgttggccaaagcaataatcgcattacgctgtaacggctttttcccgcgccaagaacctgccagacggccaaagcgttgtttaaattctttattcgaaattgtcagcattgactgcaatacaggagttacttcctccacttctggctccatccgtgaatggcgatgaaagtccttgccccgattaaacggacaaactaactggcaaatatcacaaccatagatcacactacgaatttgtggtcgaaattctgcggccatcatccccttggtttgtgtttgataggacaagcagcgctgggcgttcaaacgaccgtcacccattaaggcgctaggtggacaataatcaatacaacgagtacaagtgccacactgattttctaccggcggatcaggcgtaaatggaatattcgtaataatttcaccaatgtaaacaaatgaaccaaactcttcagtgatcaataagccgttgcgaccaataaaacctaaacctgcccgctgtgagactgcaacatcacttaactcgccagtatcgaccatcggtttgaagcgtacttccgccgtagcattggcctcaataaattcaaccaattgctgcattttatcgcgtaaaataaaatgataatcttcaccccaagaagcacgcgcaaaactaccacgtcgctgctggcgatcacgtggcgctttttggcgcatcttactcggataggctaaggcaattgcaataattgattgtggttgctcaaaaatctgctccggatacaagcgttccgccaaaacttgatgttcaaaaccgctggtgtgccctgctgctttttgtgccttcaaactggccgccatttctgcaaatggcgctgctgtagtgaaaccaattttatcaatgcctaagtccgcgctagcggcaataatcttttgttttaagtcgtcatacattagcaaattcctcacttgaatggattcatcttaattttagcgattttgcagacaaaataatagcagggttttcccgcgaattaaacgactagcgcttgacgccagcgattaaagcagccatgatagatttattacgaataaatggaggtaaaaaatgagtgactttcgtcttgaacatgattccttgggacccgtaaaagttccacaaagtgtactatggggtgcccaaacggaacgcagccggcaaaattttcaaaccggtggtcccatgccctatccagtgatcaaagcgctattacaaatcaaaaaagcagctgcaaaagtcaattcttccttgagtgaaatcgatcctgctaaagcaactttgatcgaagaaacggttgatcaattattaaaacaggatcaccgtaaagactttccactggttgtctatcaaactggtagtggcacccaaacgaatatgaatgttaacgaagttatcgttcattatgcggcacaaattgcccctgatttaccattatcgccgaatgatgatgttaatcatgcgcaaagttcaaatgatacttttccagcggcaatgatgatcgccgcttatcaagcctgtgtggacctattgccagtattgactcaactgatcactgcatttcagcaaaaacaaaccgagttcgcaacgatcgttaaaatcggccgtacgcatttacaagacgcaacgcccctaactgttggtcaggaaatcagcggctggatcagcgctttggaacacgatcaacaatatctcaaacaaaatatggccacattattagaattacctttaggtggaactgctgttggcaccggcttgaacacaccggctaactttgatcaaaaaattgttgctgacttagccgcaacctaccagattccattcattgtcgcgcctaataaattccaaggcttagctaatcacagcggcctcaatatgatccatggctgtttacgtacattagccagtgatcttttgaaaattggtaatgacattcgcttcttagcgagtggcccgcgtgctggctatggcgaattgatcatcccggctaacgaaccaggttcatcaatcatgcccggcaaggtcaatccaacacaagttgaagcactgacaatggttgttgcgcgtattatgggtaatgacaccactttgaattttgccgctagtcaaggcaactttgaaatgaacgtctataaaccgatcattattgccacttttctagaatcaactgagttattaacttcaagtatccattcattgaccgaaaagttggtcaagggcttgcaagttaacgcaccacgaatgcaggcattagttgagaattccttgatgttagttactgcactgacaccacacattggttatgaaaaaagtgcacagatcgcacaaagcgcgcaaaagcaaggtacgactttacgtgaagcagccttggcctctggtgcagtcaccgcaactgaatttgatcaatgggttaaaccagcagcaatgacacatccagccccctagcgtattatttgacggttacgctttctgctcgctatactaacactaaccacaaattatatttttatttgtggtgtattgttaaccacacaattattcatagaattaaaagaaaggaagcgttggtaaaatgcaaaaaactgacttacaaaaacacttgcaagcaattcaagaccgtaccttcaatcctattatcctcaagcacaattctttccgcgcttgccttcaccgcagcgcacaaaaccttggcttgatcaaaaatggtgaattaactgctaagggccgccaacacttaaccttacaattctaagaataataccgcaagaccgcgaactactgctgttcgcggtctatttttgtacatgctgataagctaagggtagttgacaaagcattttactataggttaacgcaaagtttttgactacttgccactcagtgatctgctgtggtgttggtgcaacactagtcgtgtggcgaataccgtatttgcgcgcataaaaactcgccttgcgcatatgccacgcactggtgaccacaattgcacgcgttagttgcaaatttgctaacagcggttgcgccaaggcaaaattttcaccagtatgccgggctcgccgctcacgaataattgctgctcgtgggattccgcgtttgatcaagccctgtgccattacgtcagcctcgaccgcaggtgtatggatcgcaccaccagaaactaaaatatatgatgccaaaccacgacggtataacttaactgcctgatccaggacggcttttaataacggcgtttctttgccagcagcagttgctggatgtcccggaataatgatcacatcggcacgcttacgcttttgccgcgcagcttgcggataagtcactaccggtgctgctaataaaatacctgccgctaacgccagcaacgtaaatttttgcttagcttgcatttgatcacctcacctagattttctttatttcagaatacctgcttagcagttgaaaggcaaaaatttaccccacttgctgaccaattgatgctaaaataggactaaagatgcttgttgggggaattttttcatgcgtaaattaattatttcaattactactttactaagcgtcacaatgctattaacagcttgccattcacagagttcagctagtgacagtgctgcacgatcatctagtgttgatcgtaatcagtcaacctatgaattacagcaaaaatacgttgcattaactgatgccgccatgaagcccgttacactggtcaatcaacagtcaaaaagtgccaacaatcaattaagcgattcactaaatacggcaacgcaaagtattgatcagttaaacactgaactaagtcgtgaaagttccaattcgagtaatcccttagtccaccaagctttacagcctaaaaattaaccttcaactattgctcatgctcagcgtgatcagcgccgaagtttgaatcgataagccatttaaaaattg

SEQ ID NO: 564 - DNA, 47951 bp, Unknown
  Metagenome-assembled genome
tcctactgggtgcattgagcgattagctcattagtaacacataaaaagtttcgggaaatagctcagcttggtagagcacctggtttgggaccagggggtcgcaggttcgaatcctgttttcccgattcacatatttttcttgcggaagtagttcagtggtagaacatcaccttgccatggtgggggtcgcgggttcgaatcccgtcttccgcttgtttttttgtttaaaaattgaattctcgggaagtagctcagcttggtagagcactacgttcgggacgtaggggtcgcaggttcaaatcctgttttcccgatttattcaacagtctagtttatgggctgcttttttttcgcccaaaaataaaaacaacgtatttctttgcaattttggtaaattcatctataataatagtcaatattagtcaaagttaagggtgaagacgatgcaagggcgaaatatttctgatattattgaagcctacttgaaagagattctggcagagtcggcgcgtgttgagattaagcgatccgaaattgcggagttatttaattgtgtcccatcccagattaattatgtgattaagacacgctttactattcagcgtggttatttggttcaaagtaaacgtggcggcggtggctacatccggatcgaaaaagtaaaattacttgatgatcgtgatatgctggatacaatgattcaactgatcggtgaacaaattaatcagcgtgatgcattgtcattggtccagaagctttatgatgatcaggtgatcgagcgtaaggaagctaatttaattttagcggcgaccagtcgtgagacactcgctgttgctgaccgtcaattggaggagcggcttcgggcgcgtattctgatcggtattttgaatcatttacgatacgaacgtgagtaagcgaaagtgagggacgcttaatggataatttatttacgccaagcgcaaaaaacgtattagtgttagcacaagagcaagccaaatacttccgtcatcatgcggtaggcactgagcatttgttgttggccttagttattgaaactgatgggattgctggcaaaactttgcggcagttatcaatcactgatgacgatattcgtgaagaaatcgaacgttttacaggttatgggacttcggctgaaacacaaagcgatacctatcttccttatgctcctaaagctaaacagatcttatcgtatgctggtgatgaagctaagcggatgggtgccatgaaaattggtacggaacatattttgcttggattattgcgtgaagacgatattctggcagcacgaatcttaaccaatctaggtttgagcttaagtaaaactcgacaaatgattttgaaaaaattaggtgtgacggatactgcagctaaacggcgtaatgcgccacgtggccgccaagcacaaggaaatagcagcgaaggaacgccaactttggattcattggcacgtgacctaactcagctagcacgcgagaatcaaatggatccagtggttggtcgtagtaaagaagtacgtcgattgatccaagtattatcacggcggactaagaataacccagtattgatcggcgaacctggtgttggtaaaactgccatcgctgaaggattagcgcagaagatcattgctggtgatgttcctgatgatatggccaagaagcggttaatgatgctggatatgggatctttagttgctgggaccaagtatcgtggtgaatttgaagatcggttgaaaaaagttattgatgaaatctataaagacgggcatgttatcctatttattgatgaattgcatactttgatcggtgccggtggtgctgaaggtgcaatcgatgcttctaacatcttaaagcctgcattagcgcgtggtgagatacaggtgatcggtgcaactactttggatgaataccaaaagtacatcgaaaaggacgctgcgttagaacggcgttttgcaacgatccaagttaacgaaccgacacaggcagaagcagaagaaattttgctaggcttgcgtagtcgctatgaagaacatcatggtgtaaccattactgatgaggccgtgcatgaagccgttgtactttcgtcacgttatatcagtgatcgtttcttgccggataaagcaattgatttgattgatgaatcagctgcatccgtgcgcctagatgcagccagcaagaagacaccagaatctaaactggaaactgaattaaatcagttagttaaagataaagaggctgcaattgaggcccaagattttgaaaaagcagccagcattcgtgaaaacgaaatggttttgaaagataagttagcaactgagcaagcagctgcaccaactaatggtgtgcgtaaagacgttaaagtcacacctgatgatattgctacagttgttgcacaatggactggtgtgccattgacccaattgcaaaagagcgaaacagaacgtttgatcaacttagaaaaggttctgcacaagcgtgttattgggcaggaagaagcagtttcggctgtttcacgagcaattcggcgtgcacgtagcggtttgaaagatccacagcggccaatcggttcgtttatgttcctggggccaactggtgttggtaaaacagaattggccaaggctttggccgaggcaatgtttggctcggaggataatatgattcgggtcgatatgtccgagtatatggagaagtattcaacctcgcggctagtcggagcacctcctggctatgttggctacgaagaaggcggccagctgactgaaaaggtacggcagaagccttattccgtagtcttacttgatgaagttgaaaaagcccatcccgatgtcttcaacattttgttacaagtcttggatgatggctatttaactgattctaaaggtcggcgggttgattttcggaatacgattttgatcatgacttccaatttaggggccaccgcattgcgggacgaaaaatcagttggttttggtgcccaaaaggttcagcaagattacaaagcaatgcgtagtcgtattttagaagaattaaagaagtcattccggcctgaatttatcaatcggatcgatgaagtggttgtcttccattccttaactaagccagaattacatcagatcgtgaagatcatggctaagaatgtgttgaaacggctgcacgatcaaaatattgatgttaagatcacgccagcggcgatcgatgtgatcgctaaagctgggtttgaccctgagtacggggcacggccaattcgacgtgcaatccagcaacaggttgaagatcgattaagtgaagaattgctttccggtcatatcaaagttggcgagtcggtgacgattggcgcacgtaaaggtgagatcacggtcaatatccgcgattcagaatcagatacgacgccgactgttaaagcttaaattgtaataatgaaagttgtcgtgtagtttgcgacaactttttttgtggcttcagatcatgaaatagtggtaacgcctaattcttttttcatttcggctgtggtatgctgaaaccatatattgatgagagaaagaagcgaattttttgattaatctgattgcaactgcagcttcgcgtgagcaagcaagccaactgctagctgcaggtatcgatacattatacgtaggcgaggattattttggcttacgtttaccacatagttttgaacgtgcggaactaacagagctcgttgatctagtacatcaagcgggtaagaaagtgacagtagcggtcaatgcgttgatgcataacgaccggatcgataaagttggtgattacctccactttttagctgagttaaaagtggatcagatcacagttggcgatcctggtgttgtttatttgttacagcaagaaaaattaccgttgcaatttatttacgatagtgaagtgctgatgactagttcgcgacaaattaatttttgggcgcgccatggtgctattggtgcagttttggcccgtgaagtaccttatggtgaattggtcaaattagcgccagaactaaagattccggcagaggtccaagtttatggggcaacttgtatccatcaatcgggccgtccgttagttcataactattttagttttgttcaggaacatcaagatcgggctgatcgtcaacgtggcttgtttgtttctgcaccacacaaaccggaaacacattattcaatttatgaagatattaatgggacacatttgtttgccaacaatgatcttaatctgatggggaagttacctcaactgcaaacattagggttaactaattggaagcttgatggtttgtttgccggtgaagctgaatttgtaacgattgcaaggcagttcgttcaggctaagcaggcgttatctgctggtgaatggacgctagacctagccgcgacactaagtgcagccgttgttgcgcaacaaccagccgaacgtggtttagatactggtttttatgatatagatccaagtgaggtgcaataatatgcgagtaattacagataaaccagaagttttagcaccagcgggaacgttggaaaaattaaaagtggccatcgattatggagccgatgcggtttatattggcggtgatgcttatggactacgatcacgtgcaggtaatttttcatttgatcagatgcgtgaaggggtagcatatgcacaggcacacaatgctaaagtttacgtggcggctaatatcgtcgtccatgaaggtgatactgctggagcaggccaatttttccggacattgcgcgatattggcattagcgcagtgatcgtatctgatccttcattgatcgagatcgcaatcactgaagcacctggcttaccagtgcatttgtccacacaggcttcagcgactaactatgaaaccttgaacttttggcaagcagaaggcttagagcgtgttgtcttagcacgtgaagtgggtattgaggagatcaaagaaatgcggcgccatactgacgttcagatcgaggcctttattcacggtgctatgtgtatcggctattcggggcgttgtgtgttgtcgaatcatatgtcgatgcgcgatgctaatcgtggtggttgcgcacagaactgtcgctggaagtatgatttatttgaaatgtctggtggcgagaaacagtcacaattggaaaatggcgaggctttttcaatgagtgccgttgatatggcgatgatcgaacatattccagatttggttgaagccggagttaatagttttaagatcgaaggccggatgaagtcgatccattacgtctccacggtggcaaatgtttatcggcaagcagtggacagttattgtgctgaccctgatcattatgttttgaagcgtgaatgggtcgatgaattatggaaggttgcacaacgagaaatgtcaactggcttctattatggtacgccaacggctgatgatgaattatttggtaagcggcgtaaacggccacagtatgggttcgtcggtgaagttttagattatgatgctgaacgtaaagtggccatcgtgcaacaacggaataattttggtgttggcgacaaaattgaattctatggtccgcactttacccatacagagcaagtggttgaacgtttgtgggatcaagacaatgatattttatatcgcgctccggatgctatgatgatctgtcaactgccagttaaacaaccggttaaggcaggcgatatgattcggaaacagcggtagtgtataatcaatcagttcgtgcaatatgctgatatctgagattttcgttccaaaattagcagtagtaggctgcattttatgatctgagcgcttttgaaaacactttttgttgacaatctttaaataggcgtgtaagataagaagttgctaaaaactgtagaatagtctagcctgcgatctattgtccgtaggcggcatatatagaaaaaaacaaaagtagtcgacaaatatcgaatgatagcgtcctatttttggtttttttttgccgaaaaacgactcagattagcaaatgtaatttttatttaatatttgtaacagtaatatcatattacgctagacgctacagaaaccatagaaggagtgaacaatttggcaggccatttagttaaatacggtaaacaccgcactcgtcgtagttattcacgaattaaagaagtgttggatctccctaacttgatcgagatccaaagtaattcgtataactggttcttggacgaaggcttgaaagaaatgttcaacgatatcatgccaattgatgatttcgctggcaatttgtccttagaatttgttgattatgaattattagaacctaagtatacggtggaagaagctcggcaacatgatgccaactactctgcaccattacacgttacgttgcgtttaactaaccatgaaactggcgaaattaaatcacagaacgttttctttggtgattttccgttaatgaccgaccaaggtacctttattatcaatggtgctgaacgggttatcgtttcccagttagttcgttcaccaggggtttattacaacagtgaagtggataaaaatggtcgtacaatttatggtacaactgttatccctaaccgtggtgcttggttagaattagaaactgatgctaaagatatttcatatgttcgaatcgaccggacacgtaagattccgatgtctgaattaattcgtgctttaggctttggttccgatgacgatattatcggcatgttaggtaataacgaaagcttaatgttaacgatggaaaaagacgtccataagaatgcggacgattcgcgtgttgaagaagccttaaaagatatctacgaacgactacgcccaggtgaaccaaaaactgccgatagctcacgtagtttattgaatgcgcgcttcttcgatccgaaacgttatgatttagcagcggttggtcgttacaagatcaacaaaaagttatccttaaaaacacgcttgttgaaccaaactttggcggaaacattagctgatccagatactggtgaagttattgcccaaaagggtgatgtagttgatcgtcaagtaatggaaaaattaagcccatacttggaccgtgaagactttatgaccaccacttacacaccatctgatgaaggtgcagttacagatccaatgacgctacaaacaatcaaggttgaatcaaaacgcaatcctgaaacagttgtaccgatcattggtaatggtcatattgaattaagctggaaacacattcgtcctgccgatattattgcttcaatgaactacttcttgaacttacaagaaggtattggttcaactgatgatatcgaccatttaggtaaccgtcgtattcgctcagttggtgaattattacaaaatcaattccgaatcggtttatcacggatggaacgtgtggttcgtgaacggatgtcaattcaagacactagcacagttacaccacaacagttgatcaatattcggccagttgtcgcttcaatcaaagaattctttggttcttcacaattgtcccagtttatggatcaaacgaatccattaggtgaattaacgcataagcgtcgtctatcagccttaggccctggtggtttaactcgtgaccgtgccagttatgaagtccgggatgtgcactacacccattatggtcgtatgtgtccaatcgaaacacctgaaggtcctaacattggtttgatcaatagtttggctagttacgccgttgttaataagtatggttttattgaaacaccatatcgccgtgttgactggaatacacataaagttactgataagatcgactatttaactgccgatgaagaagataactatgttgttgcccaggcaaactcgttgttaaacgaagatggctcatttattgatgacaccgtattggctcgtcgtgaagaagataacttggaaatttccgttgatcgtgtcgattacatggacgtttcacctaaacaggttgtcgctgttgctactgcctgcattcctttcttggaaaacgatgattctaaccgtgccttgatgggtgctaacatgcaacgtcaggccgttcctttgatcaatccacacgcaccattagttgggactggtatggaatataaagccgcccatgactctgggactgctgttgttgctaagaacgctggtacagttgaatatgttgatgctaaacaagttcgtgttcggcgtgaagatggttcattagataaatatgatttaatgaaatatcgtcgttcaaactcaggtaagagttataaccaacgtccaatcgttaaacttggcgatcatattgacgttagcgaaatcttagctgatggtccagccatggaaaatggggaacttgccttaggtcagaacccaattattgccttcatgacttggaatatgtacaactatgaggatgcaatcgtcttatccgaaaaattagttcgcgaagatgcttatacgtcgatccatattgaagaatatgaatcagaagcacgtgatactaaattaggacctgaagaaattacccgtgaaattcctaacgtcggtgaagatgcgttgaaagacctcgatgaattcgggatcgtccgcattggtgctgaagttaaggatggcgatttgttagtcggtaaggtgacacctaaaggggttacggaactttctgcagaagaacggttattgcatgcaatcttcggtgaaaaagcgcgtgaagtccgtgatacgtcactccgtgtacctcatggtggcggtgggattatccaagacgttaagatctttacccgtgaagctggtgatgaattatcacctggtgttaatatgatggttcgtgtttatatcgcccagaaacgtaagatccaagtcggcgataaaatggccggccgtcatggtaacaaagggacggtttcaatcgttgtccctgaagaggatatgccattcttaccagatggtacgccagttgatatctgcttgagcccaatgggtgtgccttctcgtatgaacatcggtcaggtgatcgaattgcatttagggatggccgcacgtaatttaggtattcatgtagcaacacctgtctttgatggtgcacaggatcaagatatctgggcagccgttaaggaagccggcatggatgacgatgcgaagtcagttctttatgatggccgcaccggtgaaccatttgctaaccgtgtttctgtcggggttatgtactacatgaagttagcccacatggttgatgataagatgcatgctcgttcgatcggaccttactcattagttacgcaacaaccattaggtggtaaagcccaatttggtggtcagcgtttcggtgaaatggaagtttgggcccttgaagcttacggtgcagcttataccttacaagaaatcttgacttacaagtctgatgacgtggttggtcgtgtcaagacctacgaagccattgtcaaaggtgaaccaattccaaaaccaggtgttccggaatcattccgtgtcttggtcaaagaattacaatcacttggtctagatatgaaagtcttagatgctgacaagcaagaaattgaattacgcgacatggacgatgaagacgatgaagtcgttagcgtcgatgctttgagcaagtttgccaaagagcaagaagcacaaaagtcaaagaaggctgcagaagaagcagctaatgctagcggcgacagcgacaacaaataggaggtcagctaagtgatagacgtcaataaatttgagagtatgcagattggtttggcatctcccgataaaattcgtagttggtcttatggcgaagtaaaaaagcctgaaacgatcaactaccggacactcaaaccagagcgtgatggtttgttcgacgaacgtatcttcggaccaaccaaagactgggaatgtgcctgcggtaagtacaaacggatccgttacaaggggatcgtctgtgaccgttgtggtgtcgaggttacccgctctaaagtacgtcgtgaacggatgggtcatattgaattagctgcccccgtttcacatatctggtacttcaaaggtatccctagccggatgggcttagttttagacatgagcccacgtgccttagaagaaatcatttatttcgcatcatatgtcgttatcgatcctggcgacacagtattagaaaagaaacaattactgactgaacgtgaatatcgtgaaaaatatgaccaatatggcaaaggcttcaaagcagcaatgggcgctgaagccatcaaggaattattaaacgatgttgaccttgaaaaagaagtcggtgaattgaaggaagatttgaagactgcccaaggccaaaagcggacacgtgccgttcgtcgcttggacattttggaagctttccgtcaatctggtaatgaaccaagttggatggttatggatgcaattcctgtcattccacctgatttacggccaatggttcagttggaaggtggtcgttttgcgacttccgatctgaacgacttataccggcgggttattaaccggaataaccgtttgaagcgtttattggacttaaatgcaccaaatattatcgtacaaaacgaaaagcggatgttacaagaagccgttgatgcgttgatcgataatggtcgccgtggccgtcccgtaacgggtcctggtaaccgtccattgaagtcactttcccatatgttaaagggtaagcaaggacgtttccgccagaacttgttaggtaagcgtgtcgattattctggtcgttcggttattgatgtcggccctaccttgaagttctatcaatgtggtttaccacgtgaaatggcgttggaattattcaagccatttgttatgcgcgaattggttaaacgcgaattagcttctaacattaagaacgctaagcgtaagatcgatcgccgtgatgatgatatctgggatgttgtagaagacgtgatcaaggaacatccagttctattgaaccgcgcacctacattgcatcgtttgggtattcaagcgttcgaacctgtcttggttgatggtaagtcaattcgtttacacccattggcttgtgaagcttataatgccgattttgatggtgatcagatggcgatccacgtgcctttatctgatgaagcacaagcagaagctcgtttgctgatgttagctgcccaccatatcttggcacctaaagatggtaagccaatcgcaacaccttcacaggacgttgtgctaggtaactacttcttaacttctgaagaagcaggggttatcggtgaaggtatgatcttcaaagatagcaatgaagttttgatggccttacaaaatggttatgtgcaattgcatactcggatcggtttggcaaccaactcattacctgacaaaccatttacgccagaacaacggcaaaaagtgatgttgacatcagttggtaaagtcatgttcaacgagatcttgccaaaggatttagtttacttgaacgaaccaactaatggtaacttgatggaaggtatcgacgacaaattctttgttgaacctggtactgacgttaaagctttgttagctgatcgtgatttgatcgcaccatttggtaaaggcttcttagctgatatcattgcccaagtctttaatgtttatcgggtaacggaaacttctgaattacttgatcggatgaagactttaggttacacgcaggcaaccaattctgggatcacagtcggtgtcgccgatgtcaaagatttaccagaaaaacctgctttggtggctgatgcacataaacaagttgcaacgatcactaagcagttccgtcgtggtttgatcaccgatgaagaacgttaccaacgtgttatcggcgtttggaacggtgtcaaagatcagatccagaaacgactaatggacaacatgccagctaataacccaatcttcatgatgagtgattctggtgcccgtggtaacgtgtctaactttacacagttagccggtatgcgtggcttgatggccgcacctaatggtcagatcatggaattgcctgtcatttctaacttccgtgaaggcttatccgtcatggaaatgtttatctcgacccatggtgcccgtaaagggatgaccgatacggcgttgaagaccgctaactccggttacttaactcgtcgtttggtcgatgtagctcaggatgtcatcattcgtgatgaagactgtggtactgatcgtggtttagatgtttctgccattacagaaggtaacgaagtgatcgaaccgttatacgatcgtctcttaggtcgttatacgatgaagtcagtctttaatcctgaaactggggcagaaatcgttggtaagaacgttatgatcgacgaagtcattgcacaacaaattattgatgctggcgttaaaactgtcacaattcgttcggtcttcacatgtaacactgaacatggtgtctgcaagtattgttatggtcgtaacttggcaactggggaaacggttgaagttggtgaagcagtaggtactgtcgctgcgcaatcaatcggtgaacctggtactcagttaaccatgcgtacattccatactggtggtgttgccgggggcgatattacccaagggttgccgcgtgtgcaagaaattatggaagcacgtaatcctaaaggtttggcgactattactgaagttactggtgaaattacggcaatcgatgaaaatcctgctgatcacacgaaagaaatcacggtccaaggtgaaacggatacgcggacttatagcgtaccatttaccgcacgtgtacgagttcaagaaggcgactatatccatcgcggtgaagctttaactggtggttcaattgatcctaaacagttattgcaagttcgcgatcggctttcaacggaaatctacatgttacgtgaaatccaacgtgtttaccggtcacagggtgttgaagtgtctgataagcatatggaagttatggttcggcagatgttacgtaaagttcggatcatggatccaggcgataccgacatcttacctggtactttaatggatattgccgacttcaaacgtcaaaactataagactttgatctccggtagtattcctgcgacttcacggccagtcttgttagggattactaaggcagccttggaaacaaatagtttcttatctgcggcttccttccaggaaacaacgcgtgtcttaactgatgcggcaattcgtggtaaaaatgatccattacttggtttgaaggaaaatgttattatcggtaagattattcctgctggtactggtatggcgaagtatcgtcatatggaaccaaaaggcgtcggtgccgtatcacaaaatgtctactcaatcagtgatttagaagagaagatgaagtgataacaaggaccaatccaaataaagtaaattaagagagcgacttttgaactgcagtaatgcagcgcaaaagtcgctcttttgtatagctaaaatattaaaggactggaaacgtcttcggtaagcacccaataacagaccgactataaatagcgtatcggccgcggtatgatagcctcatcataagaaatggtgaggtgcttttatgctcaataaaccggaaagcgttcaagttaagctggacgacggtcaacgacagccaagtccaatatcaaaggcctttcaaatcaaacgtcatgaacacgaaacaatcattgtttacaatcatatcaatggatatattttagacgccctagtcaaggcggtgttcactgatgctcattgatttacaccaactcaagggtatttatttgatttgtggcaaaactgacctgcggcgtggaatcgatggtttagccgctacgatcactgatcagtatgaacttgacccctacagccgggcgttatttcttttttgcggtacccgtaaagatcgttttaaggccctatattgggccggtgatggctttctcttactttataaacgaatcgaaaatggccgcctgcaatggccaaccaatcaaaatgaggtgaagcgactacacgccaaacaattacaacgtttattatctggctgggggcttgaagcaaccgtgcatcagaccaaccgaccaaaaaaagctaggcttagctgactaatcatggtacactcaggacaatcctagtgaatgaaggcgattccatggcaacgaccgtcgaacaacttaagcaagcccaagcgcagaatcgtgagttactcaaagaaataaaggccttgaccgcaactgtccaaactttgacggaagaagtcgccttttttcagcgccaactttttggcaagcattcggaaaaaataactgatcctaaccagttatccctattggcagatgacaatggggtttttaccgacccagagcaaactgggaaccaaagcgaaacgacagtaacaacagtcgtccataagccaaagcgtaagcgttgcgaatcagttgatcccaatctaccgatcgagaccaccgtgatccgccgcgagaacttgagttgcgatcatggtcatcaactgataccagtgggcaagcactttgtgcgtgaagtcgtgcatcaaattcctggtcgcctctatcgcgaacaaatctttgaacaaacgtataaatgtgccgcttgtgaaacgaatgatggtgtttcccacttatatcaggggactgcgccgcaggcgctgatcccccatagtttagcgacctcatcgttagtcgctgagttgttgtaccaaaaatatgccttagggacaccactttatcgtcaaatgaaagcctggcggcgggctggtttgattttaagtgaaacgaccatgacgaattgggtgatcaaagcagcgacgatcgttcaaccgctgtatacgttactgcacgaacaattattaacgcaaccttacctgcaaggcgatgaaacaccgtttcaagtcttgcatgaggtgggtaaaaccgcgcaaagcaagtcttatatctggattgctcggagtattcgcttagctgcgcatcaagttgtctattatacgtatagcgacaatcgtgccggcaaaactgcccaacaactttatggtgattttatgggtgtcctacaatatgacggttattctggctataatctactgggcgcaacggtgacgcgggtcggttgttgggcgcatgtgcggcgaaaattcttcgatgatgcctgcaagatcaaggggcaaccgacgataacgccacccttaaaattgcttgatcaaatgttttacctagaacggggctggcgtgatctaacaccaaccaagcgcaaagaactacgccaggaacaattaaagccagtgatcaagcaattttggcagtggtgtgatcaagcggtggccaccccgaaatcacgtttaggtcgtgctttgacctatgcccaaaaccaacggtctatgcttaatcgtgtgctggactatggcgagattgatttaagcaataacgccactgaacgaaatgtgaagtctttcgtgattgggcgcaagaattggcttttcgccaccagtcccgcaggggcacaggctaatgcgatttggctgaccttgattgaaactgcgaaggctaatggattggatccacggcaatatctcgaatatctgcttaatcaattagggcaactacccgtttttccaactgaggaagaattggcggtctatttgccatggcaacaagtgccagacaaaaaggtttggcgtgatcaagaagcgtagacccttggctaatttaaaatcaaacagcgctactgattcgaaccaaaaagtttcggatcagtggcgctgcttttgattacggtcgtttattgggtgcttaccgccttcggacttagattagaataataaagatatcggttatacaaagttataatataaaatgagttggatacgggggtataagaatgatctctttagttggtactgatctagatggcaccttgtttaatgagcatagtcaggtatcggtggctaatcgtcaggcgattcagcaaatgagcgcacagggggcaaaaattgctatttgttctgggcgaaccctgccaacggtggatgcattattgcgcgatacgttacaagtgccaggatatcgtgtttgtttaaatggtgctgttgtgtatgatcccaacaatcaaccgttagcggcaacaccagtagctaacgagttgttgatcgcagcctttaaaattgcacagcattggcaggttcggttatgcatttgtagtttagaccagatgttagtatatgagccaaaggaactaaaaacgttggccacgcgtgatcaacctgatggccagaatcggcaaataacgagtttaactgagctggaacaggcattaacgcaacccaatgctaagttctacaaatttacgatcaatatgacgcaccataacgtcttaggtgtcaggcaagcggccaaggcaatccaacaattaccgctacactttgttcgttcgggccgctttttttatgaagcgaccgcacccggtgtggataagtcagctgggttagcaattgttgctgctcacgctaaccttgaaatggccgactttatgtgttttggtgattatgaaaatgatctagaaatgattcgcgatgttggttacggggttgccatggccaacgcaattcctagtgttaagcaagttgcttggcgtgaaactgctgatcatgatcgggatggggttgcacaagttctgcagcaggtagttgcacagcatttggcaatttagggcctattcccagtatatagctgctaaatcagagactagagtgggatattggttcttagcggctagctcattataatctgcggcaatcatttctaaaagtttctggtaagtaggtgcggcttgtaggcgttgctctaatccaaagggatcttcataagtaacctgattattcgtcgcccatttgatcacggcaggaacgacgcgaatatcttggttgacgcaataaaaatcatgattagtggtactgaataataggaaaagccagaaattcatattggtaagtggattgccgatcccgggactgtagctacgtaagacgcctagctggataccatttatgtagccagggaaaatactgccgaattgctcggcttgatcggtgtataagtcgatttgggtaggttgaaaatcaagtgttacgttgtgatttttaccgttactgatcatccaaagtcacgcaaaaaaaccaccaaatttccctaatttacgtggatataattgaccatcgatttggatattggtacgggtcagcatacggtgaatgttttctggatcatgagtacgattgacttgtgcattttgcttgattgctgttggtactttaggttttagcatatagcccatctccttttacccatagtttagcattaaaaattatttataccagtattaatttcaccaaaaaggcgttgcgacagtttagctgttcaacgcctttttggttgaggaaaatagccttaattactagttaaattggctgaatggaagtagaaattcagtcccggataaacataaattgttgttgagaagttaaagatgatgttattcccataaaaatttagctgattcattgttaaagcaggtgtccccgttggtaattcaagtagggcagcatcttcttccgtcagcttttctaaggaaatgtaatcttcactattattagcgctaataccataattttcgcgtaggaaagtaaaaatagattgattgacgctttcaactgacaaaaatggtacttcagcacgtacatagtaagcttgctccaaacagtaaagctcgttattcaaataccgcagtcggatcacacgataaagctcgctgccgtttttgatgctcatacgattggccaaggctacgtcagcattgatcttatcaaaggtgatcacctttgatactaatttaccgtcggctaagtgtaagggttgtcccgcaccaaccgataaattgatcacagttttttccgataaactgatgtcgttaataaaataaccgctaccctgtactcggcgtagtaatcccttttgatagactaagtcgatcgctttacgaattgtgttgcgactaacattgtaacgcgccatcagctgaacttcagtgggtaattttttgtcgaataaaccttcattaattgatttcgtaatatcgtccgcaatatcgtggtacacagtcatcactcctgtaaaaaaaattaatggtacttgtaaaattggtacctacgagttatactttcgttgtaatgaaagcgatttatatgtcaactcttttcgctcgctaaaaccttgaacaagtcgaatacagtcggcgcaagcgcacaaaacgttgcaacccctttgtttgatgctaacacaaaatgactaatggcgcactctaatatttttcgtttaccggtgttgatctgtgtttggccctagaaaatagtctgaaatacgtaatcgttatttaaatgaaaatgaggtagggatggcaaatgatcgaaaccgaaactgagaacagtaacttacaggcagtaatggggttgattctaaatggcggtaacgcaaaaagttcagcctttgaggcaattaatgccgctaaaacgggtgactttacaacggctgacgcaaaattagctgaggcagataaatttcttgtggatgcccacaatgcccagactggtatgctgacagcggaagctaatggtgaacacgcgaatgtatcactgctgatggtccattcgcaagatcacatcatgacggcgatcactttccgcgacctagccggtgagatcgttgatttatacaagcgtttggcgcaagtaggtaaataaaaatctagtattctaaataaagattacggaggcttatatatgagtgacggaatggcaatgcctaaaggttttttatggggtggtgcagttgctgcccatcagttagaaggcggctggcaagaaggtggtaagggcgttagcatcgctgatgtaatgacagcaggtgctaatggtgtgccaagacgggtaaccgatggggttaaaaaaggtgagatctatcctaatcattgggggatcgatttttatcatcgttatccggcagatctaaagttatttgctgaaatgggcatgacttgttttcggacatcaattgcttggacccggatttttcctaatggggacgaaactgagccaaatgaagccggattgaagttctatgatgatttatttgcggagtgcttaaaaaatggcattcaaccggtagtgacgttatcacattttgaaatgccgtatcacttagttaaggcttatggtggttggggtaatcgtaaattgatcgatttcttccttaattttgcggaagtttgctttaagcgctacaagggccaagttaaatactggatgactttcaacgagatcaataatcagactgattggcgtgatccacatccattattgcaaaattcaggtcttcaattggatgaaaatgacaattgggaagaagcaatgtaccaagcagcccattacgaaatggtagccagtgctttggcggttaagttaggtcacgaaatcgatccagattttcaaattggcgcaatggtggcaatgtgcccaatctatccactgaccgcgaagccagctgatattatgatggctgagcgtgcgatgcaaacacgctattattacggcgatgttcaggctttaggtacttatccagcctggttgacaaaatattggcaacgccataactatcagatcgatataactgctgctgataaagctgctttgcaggcaggaactgttgattatgttggtttcagctactacatgtcttttgtcactgaagcaacaaaggataatcctgattttatttacgatgaagccaatgacctagtcagcaatccctatgttcaaaaatcagactggggctggcaaattgatccaattggtttgcgttatgggatgaactggatgactgatcggtggcacaaaccattatttatcgtcgaaaatggctttggtgcgcatgacaaagttgaagctgacggcagtattcatgatgattatcggataaagtacttccacgatcacattttacaaatggaaaaagccgtcgttgacgatggtgtcgatttaattggttataccccgtggggacatattgatctaatttcagctagtacaggtgagatggcaaagcgctatggttttatttacgtcgatcaggatgatttaggtaagggcaccctaaaccgctcgcgcaaggattctttttattggttcaagcaagtggttgccagtaatgggactgatctaagcatgaagcaccagcattaaaagctataaatgtcgcattttagtcgtttagtgtttaagcacaataacgacacgttaattgttttaaaaagataaggcggcagctgctgccttattttaatttcagtttggtaattagcaccaatatatggaatttgttcctatcaatagttaaacgtggtaaacttactttagtccataccaattatttttaatctaaaaaagtagaaggtgacagcatgttctcataccagcagatccgttcactcaatcagctagaaatgacggtttataaatttattatcggccatccgaatgatgttgaacgtttgacgattcgacagatggctgaacaaagccatgtttccgccactacgattcttcgttttctaaagaaagtcggctacagtggcttctctgagtttaagttcgcactgaagcaacagcggcaacaagaagcagtccaaccaaaattacaggatctggcgccaatcaagcaattctttgatcaacttagcgatcatcatttcaatgatcagattgctcacgctgcaagtatggtggcggccgctaaaactacgatttttttcggcttaggtacaagtggtagtttagcgcaatatggcggccgtttattcgctaattatggtatttatacgctgatgatctcagatccgtttcgtacgccgccagtagttgaacatgatttttatgatagtttgttgatcttgttgtcagtttcgggggagactgaagaagttttgcggcaagcacgtttttataaagaaaatggtacaaacatattggcaatcacagccgatgcgtattcgacgttagcacaattagccgatttcaatatcgcatataatattccgcagacacaggatgtgcaggggcatttatctacccaattaccggttgtctttttattagaacaaattgcacagcatgcctatcaagaagtcgcagaccatttggtgttatagttttggaatatgttccaagtgtggaacgtatttttttgtacagtacattttctaattatgggtagaagggtatacaagctttataccaggtggtacatttattatgctgaaagcgcgttcaaccttgctatttcaataattaatgttagccgtagtcgatttttattctatttgtaaattgccatttataagattgcgggtaataaaaaaatggggtttttgtatgagcgagaagaagtccagtttcgtacaggatcgattgataccattaactggtaaaatcgcttcttcacgtcatctagttgcattgcgtgatggctttgcgctagttatgccgctgatcatcatcggctcagttttcatgatcatcagtaactttccaattccagcttatctggcttggatgacttctgtattcgttcctaattgggcgacagtagttggttgggcaactaacacaacgttctcgatcattgggatggttgcagttattgggatctcttatcaattggcacaatcgtataaggatgttgatcctttggcggctagtatgattgccttaggtgcatttatgttaacgattccgttgcatattgataaagccggtgctgcatttgttccgttagcacaacttggttctgttggtttatttgaagccttattgattggcttgttcatcactgatttctacgtgtggatgatgcataagaattggcagttccacatgccagatacagttccaccggccgttggtaatgccttttcttcattaattccaggttttgtggtcattattgtaatgtggttgattcgcttaggtatcagctttactttctttaaaacgattcctaatgtgatcaccgttattttaacgcaaccattaactgctgttggtggctccatctggggtgcgctagttgctgaattcttcgtttccttcttatggttattcggtattcatggggccaacgttgtcggcgggatcatggcaccaatttggttaggccaaatggcacaaaatgccgatgccgttaaagcacacaaagcaattccgaatattgttaaccaacaatttgttgataactttgttcatgccggtggttctggtgaaacgatctccttagctttgatgatgttattcttagctaaatccgctaacttaaaagccattggtcagttagctggtgcgcctgcactattcaatatcaacgagccaatcatgtttgggatgccgatcgttttgaacccagttatggctattccatttatcgttgtaccgttggtatcggttattacaacctattactcaatgaaatttgggtgggttgctagaaccattggggttgccgttccttggacgacaccgccaattatttctggttggttagcaaccggtcatttatccggtgccgttttgcaattagttaactttgttatcggtggggcaatttactatccattctttaagtttgctgattgtcaagctttgaaagctgaagcaaaaatggctgctgaagaagctgctgctgcacaagaagcaactaactaagcattccataaaaatctgtcggcgtttgcggcagatttttttagtcaatggtcaagtaggcctgaatacgctaagataagtgtattcaggctaaacaataactatcattcaaagtaaagaagtctgtgaagggaagacaaatcatgagtaaacataaacgaattgccagtgttcaggctgaagcggctgcacaaaaaaatgtggatacgattctgcagaatatgcataaggggcaaaaaacaattgcatcattacctaaatggtcacaagaattagctcatcatcgctttggttggtcagaacttatttcatttttaccattgatcattattacgctgacatcaccgttgttgtctagtcaggtatcaatggggcaaggcttggtggttaacaagaatgccttgtttatcattccttttgccagcttattgatctcagccggatgttatttgaatgttaaaatccggcgtaagggtgaacgtattaccgatatcgatcattttgcgatgaatgagatttttaccttgttatcaaatgttgttgtggttgcgctttgttcaggtgttttaatttatcaattgattcgagcatttaccgcttaataaaatggttaaaccgcgttagcttaacgcggttttttaatgcaggaaagacaaaagctgttgcagccagataccaagactgaggtaggggatgaacggaatcgttttgtgttgataaaatgcatgtccaccgatagccagtaagcaagcaaacaacagtatttggatcgtactgttaaatccataaagtagtcctattccagccagcagttgaacatcaccgctaccaaggccacgggagaaatgagcaaataaaccgagtccacttacgagcaacaacatagccgtcaaatgaagcggttcgtgtggcagcaatagtagcgttattagccagggccaaaataaaacgggcaataagatacgctgtttaatgtcgatccaactaaataaaaataagccagcaaacaataagccagtaaaacttggtgcagcggccgtaagccaaataaagagaccaagaaaaccgccgataatttcgctgacccaagcggccaatggaattggtgttgcgcagtaataacaatgcccccgtaataaagggtaactgatcaacggtaatagctgccaccaacaaaggggatgttggcaaaccgtacaatgagacttgggtttgatgagcgactggccagccgttaagcgttctgcacataaaaagagacctgaagctaaactagctccaaaataaatgatcagtgtatataatagaagtaacatgataatcctccagataaattgtcagcggggtgtaaaaataggtcactatatttaaactacgcaattttttcgtaatttgtttttgatcgtaagttgacactgcgaaaatagcatggtattctaacaaaggtgctttttgtcgaacagttttccatttaattatgggcgtgctgactgtgagcgactgcacattgatttctagatgtgttttcactcttttttattgcgcgtaattcactacatttaaaaaagagacacctggaagtgtggacttatatttttgatttgattaggaagggagaattctatagatgcctacgattaaccaattagtacgtaaaggtcgtaaatctagaactactaaatctgatgcacctgctttaaacttcgggtacaacagtatgaaaaagatccaaactaacaatcctgcaccacaaaaacgtggggtagcaactcgtgtcggtacaatgacacctaaaaagcctaactccgcattacgtaagtatgcgcgtgttcgcttgtctaacttgatcgaagttactgcttatatccctggtattggccataacttgcaagaacatagtgttgttttgatccgtggcggccgtgttaaggatttacctggtgtacgttaccatatcgtccgtggtgctttagatactgccggtgttactgaccgtatgcaaagccgttccaagtacggtacaaaacgtcctaagaaataagacacttaattaacgctaaaaacataattatgttagcaagtaatgacttgctgattcaggaggttacgtaatatgccaagaaaaggcgctgcagcaaaacgcgatgtattaccagatccaatttataattctaaattggttacgcgcttgatcaaccgtttgatggttgacggtaagcgtggtactgcgtccacaattctttacaaatcatttgacaacatcaaagaatcaactggtaacgatccattggaagttttcgaacaagcaatgaagaacatcatgccagttcttgaagttaaagctcgccgtgttggtggctctaactaccaagtaccgatcgaagtacgtccagatcgtcgtacaacattaggtttacgttggttggttcaatattcacgtcaacgtggcgaacatacaatggatgaacgcttagcacgtgaaattatggatgccgctaacaataccggcgcagcagttaagaagcgtgaagatacgcataaaatggctgacgctaaccgtgcatttgcacattatcgttggtaatctaaagttattagttaaaagtcgggctattatatgtgtttccatatagtagccccttttgctgaaacggcttaattataatgactattgaggtcgcatagacgactttttaatgagaggagaaacatttctacaatggcaaacactcgtgaatttccgttagaaagaacccgtaatattgggatcgttgcccatattgatgccggtaaaacaacggcaactgagcgtatcttgtattacactggtaaaatccataaaattggtgaaacccatgaaggtgcttcacaaatggactggatggaacaagaacaagaacgtggtattacgatcacttctgcagcaacaactgcacaatggaagaaccatcggatcaacatcatcgatactccaggacacgttgacttcacaatcgaagttgaacgttccctacgtgtcttagatggtgccgttgttattcttgatgctcaggcaggggttgaaccacaaactgaaaatgtttggcgtcaatcaactacttacggtgttcctcgtatcgtattcgctaataagatggataagcttggtgcagactttgattattccgtttctactattagagatcgtttacaagctaacgcattgccaatccaaatgccaatcggtgctgaagatgacttcgaaggtgtcattgacttggttgaaatgaaagctgatctttatgacgaagatgaattagggactaaatgggataccgttgacgtacctgatgaatataaagaagaagcagcaaaacgccggacacaattgattgaacaattggccgacattgatgatggcatcatggaaaaatatcttgatggtcaagatattcctaaggatgaaatcaaagcagctatccgtaaagcaactttgaatttggaagcttacccagtattagctggttcagccttcaagaacaaaggtgtgcagatgatgttggatgccgttaacgattacttgccatcaccacttgatgttaaaccatatccagcaactgatcctgctacaggtgaagaagttgaactggttgccggtgacgataaaaacttcgctgccttagcatttaagatcgcaacggatccattcgttggtcgtttaacctttatccgtgtgtactccggtactttggaatcaggttcatacgtcttgaacgcaactaaggatactcgtgaacgtgttggtcgtttgctacaaatgcattctaaccaccgtactgaaattcctgaagttttctctggtgatattgctgctgctatcggtttgaagaacactacaactggtgattccttaactgatgttaagcatccattgattcttgaatcaatggaatttcctgatccagttatccaggtttcaatcgaacctaagactaaagcagatcaagataagatggatattgctttacaaaagcttgctgaagaagatccaagtttcaaggctgaaacaaaccctgaaactggcgaaactttaattgccggtatgggcgaattgcatttggatatcatcgttgaccgtatgcgtcgtgaattcaacgttgaagcaactgttggtgcaccacaagttgcttaccgtgaaacattcacaaaacaagcttccgctcaaggtaagtttgttcgccagtctggtggtaaaggtcaatatggtgacgtttgggtcgaatttacacctaacgaagagggtggcggcttcgaattcgaagacaacatcgtcggtggtgtcgttcctcgtgaatttatcccagccgttgaacaaggtttgaaagaagctatggctaacggtgtcttggctggttacccattggtcgacgttaaggctcgtctatatgatggttcttatcatgatgtcgattctagtgaagccgcatttaaagttgccgcttcaatgtcacttcgtgctgctgctaaaaaggctggcgcagtgattctagaaccaatcatgaaggtcgaaatcgttgctcctgaagataatttaggggacgttatgggccacgtaacagctcgtcgcggccgtgttgaaggtatggaagcacgtggtaacacgcaaatggttaacgccatggttccattatccgaaatgttcggttatgcaacaaccttacgttcagctacccaaggccgtggtactttcacaatgacatttgatcattacgaagctgtacctaagtcagttcaagctgaaattattaagaaaaatggcggcacaccagctgcagactaatttagcttaataaattgtactaaaaaatccgttatgagaataattctcataacggattttttgttttaatcaacaattttggcaccaaggacgttggcaaaatgatctagggcccattcttgaccttgcggattaaaagtggctacggcaccacgatgaatgactaagtggtagccgaggttatatgcgctaatagcggtgtgcaaaacgcaaatgtcagtgcagacgccagttagatgcaaggtgtcgatctgccgttcccgtaagcgtaagtccaaatcagtgccagcgaaggcactataacgtgttttggcgaactgaataactttggtcaacttttgattagtcgtgtaccaggaagctaactgaccatataattcacggccccagctgtcagcaacattgtgcggtggaaataatttggtttcaggatggtaggggtcgtggggcttatgcacatcggtggggagaaatacccagtcattgcgagtgataaattgatctgctaatgctacgatagctgactcgattacttgcgctggtttaccagcagttaaggcgccgttatcagctacgaagtcgttggtataatcaatgatcagtaacgcggtattgtttgccaaaagtaatcacctctatataatagtagattaagcctaaatccacttagcggccttgtcaacataaacgaaataaattgcttcttggtccaagaatattgtatgatagtcaccgttgaattacaggatatttgccttagattgaaaaaatgcagctttttacaaaaagagcttgcagtaccgggcgtcttctcgtataatagacaaggtgctgatttccaaggagagacagcccctagggaaacctagaattagcagtgatgtggaaggttgcgacacacccggccgctttgccatggcagagtgtattgggaattttcacggagctagtttatttttaaaatgaacgaaggagggaaaaacatggcaaaacaaaagattcgcattcgcctaaaggcttacgaacatcgtatcttagatcaatctgctgaaaagattgtcgagacagcaaaacggacaggggctacgatctctggtccaattccgttgccaacggaacgtacattatatacagttatccgggcaacacataagtttaaagactcacgtgaacaatttgaaatgcgcacacacaaacgtctaatcgacatcatcaacccaacacctaaaactgttgacgctttgatgaagttagacttaccaagtggtgtggatatcgaaattaaattatagttcaaatacaattaaattggaggtgtactcatgaccagaaaaggaatcttaggaacaaaagtaggtatgacgcaagtctttactgacgccggtgaattaatcccagttactgttatccaagcaacacctaacgtggtattgcaagtgaaaacaccagaaactgacggttacgaagctatccaagtcggttttcaagacaaacgtgaagttttatcaaacaaacctgctaagggtcatgttgcaaaagcaaatacgactcctaagcgcttcattcgagaatttcgcgatgtagacttaggagatatcaaggttggcgatgaaatcaaagttgatacattcgaggctggcgaaatcgtcgacgtcacgggtacaactaagggtcatggtttccaaggcgttatcaagaagaacaaccaacgtcgtggacctatggcgcacggttctcgttaccatcgtcgtcctggttcattaggtgcgatcattaaccgggtattcccaggtaaagcactaccaggccgtatgggtaacaacaccgttactatccaaaacttagaagtcgttcgtgttgatacagaccgtaatgtgatcttgatcaagggtaatgtccctggtgctaagaaatcattaattacgattaaagacgctgttaaggcagctaaataatcaggaagggaggattacaaatgccaaatgtagcattatacaaacaagatggcagccaaaacggcgacgttcaattgaacgatgacatttttggtattgcccctaacgataacgttgtgtttgatgcaatcatcatgcaacgtgcatcattacgccaaggtacacatgccgttaaaaaccgtagtgccgttcgcggtggtggccgcaagccatggcgtcaaaaaggtactggtcgtgcccgtcaaggttcgatccgttcacctcaatggcgtggcggtggtgttgtctttggtcctacaccacgttcatatagctataaattaccgaagaaggtacgtcgcttagcaattaagtctgttctttcccaaaaagtgattgatggtaacatcatcgttgttgatgcatttagcttcgaacaacctaaaacaaaactttttgcagaaagccttaagagcttagatgtacaaactaaagcattagtagttcttgaagatggtaacgatcaagctgcacttgctgcacgtaacttgccaaacgtttctgtggtttccgcagatggtattaacgtgctagatgtcgtagctaacgataaattgatcctgactcaagctgctctttctcaagtagaggaggctcttgcataatggaagcacgcgaagttgttttacgtccatggatcactgaacaatcaatgagcttgatggacgataaaaaatacacattcgaagttgacgttcgcgctaacaagacacaagtcaagtacgcgatcgaagaaattttcgacgttaaagttaaaaatgtcaacattgcaaacgtacgtggtaagttaaaacgccaaggtcgttatgctggtatgactaagaaacgtcgtaaagcagttgttgctttgactgacgattcaaaagaaattacaattttcgaaaaataaatcaattttaaattgattctaggaggggaaacgcgtggcgattagaaaatacaaaccgactacaaacggtcggcggaatatgactggctctgattttgctgaaatcacaaaaacaaagcctgaaaagtcattaaccgaatatatgacaaaaactgcgggccgtaatgctcatggccatatcacagttcgtcatcgcgccggcggtcacaagcgtcaataccgtgtgatcgacttcaagcgccaaaaagataatgtacctgcaatcgttaaagctattgaatacgatccaaatcgttcagctaacattgcgttactacaatacacagatggtattaaaacttatatcattgcaccaaaaggtttagaagttggcatgcaggttcaatctggcccagatgctgatatcaaagttggtaatgctttaccacttgctaatatccccgttggtacagttatccataatattgaattgaaaccaggccatggcgcacaattagttcgctcagctggtgcttcagctcagatcttgggtaaagaaggtaagtatgctttggttcgtttaggttcaggcgaagttcgcatgatcttgatcgttaaccgggctacgatcggtgctgttggtaatgaacaacacgaattgatcaacatcggtaaagctggtcgtaaacgctggatgggtatccgtcctacagttcgtggttctgtaatgaaccctaacgaccatccacacggtggtggtgaaggtaaggctcctatcggtcgcccatcaccattgtcaccatggggtaaaaagacccttggtaagaagactcgtaacaagcgcaaacaatcatctaaattcattgttcgtgatcgtaaacggggcaaacattaattataaaataaatcagttacgccagagcccttctgtttacgacagaaggacatctgcatttgcaagtcagactgtgtcacttttagaagttgacctgacttatgaaaaggaggtttcataatgagccgaagcttaaaaaaaggaccattcgctgatgaccatttattgaaaaagatcgctgcacaagccgatcaagacaagaagaccgttattaaaacttggtctcgtcgttcgacgattttcccaagttttattggttacactattgccgtatatgatggacggaaacatgtcccagtttatattcaagatgacatggtcggccataaattaggcgaattcgtcccaacacggacattccatggtcacgcaagcgatgaccgtaagaccaaagcaaaataagcgagaggaggatcattaaatgtcagaacaaattacatcagctcgtgccgttgctaaaacagtacggatcgctcctcggaaagctcgcttagtaatggacttaatccgtggaaagagtgttgctgaagcaattgcaattcttaaattcaccccaagaggcgcttcaccaattattgctaaggtattaaactcagcaattgcgaacgctgaaaacaacttcgacttagatgctgaaagcttggtagttagcgaagcttttgttaacgaaggaccaactctgaaacgtttccgtcctcgtgccaaaggctctgcttcaccgatcaacaaacggacaagccacatcacagtcgttgtatctgaaaaataaggagggataacgcgtgggtcaaaaaattaatccaatcggtttacgagttggtatttcccgtgattgggaagccaaatggtacgctgaaaaagatttcggtacacttttaaacgaagatttaaaagtacgtagttttatcgaaaaacgtttagcagatgcttctgtatcaaaagtagagatcgaacgtgctgctaaccgtgtcaatgtttcaattcatactgcaaaaccaggtatggttatcggtaaaggcggttctgaagttgaaaacttgcgtaagcagttaaacaacctaactggcaaacgtgtccacatcaatatcgttgaaatcaaacaaccagatcttgatgcaaaattagttggcgaaagtatcgctcaacaacttgaagcgcgtgttgctttccgtcgtgccatgaaacaagccatccagcgtacaatgcgtgctggtgctcatggtatcaagacaatggtttctggccgtttaaacggtgcagatattgcgcgtaaagaaatgtattcagatggtactgtgccattgcatacattacgtgctgatattgactattcttgggacgaagcagttaccacttatggtaaattaggcgttaaaacttggatctaccgcggcgacatcttaccaggtgaaacacacggtgattcaatcaaagataacattccagctcaaaataaccgcaatagtcgcggtcgtggcggcaaccgtggtggtaacaaccgcggcggcaaccgcaataaccgtaacaatggagcgaaaggaggaaactaaacatgttagtaccaaaacgtgtaaagcatcgtcgcgaatttcgtggcaagatgcgtggtgaagctaaaggcggcaaaaacgtcgattttggtgaatatggtttgaaggctttagattcttcttggatctctaaccgccagatcgaagcagctcgtgttgcgatcacgcgttatatgaaacgtggtgggaaagtatggattcggatcttcccgcataaatcatatactgaaaaaggtatcggtactcgtatgggttctggtaaaggtgcaccagcaggctgggtagccgttgttaaacgtcaaaaagtgatgtttgaagtagccggtgttccagaagaagttgcacgtgaagctttacgcttagctgcgaacaaattaccagttcggactaagatcgtagcacgtgaggaagtaggtggcgaatcaaatgaaggctaaagaaattaaagacttaaccactgctgaaatgcttgaccgcgaaaaagaatataaagaagaactttttaatcttcgtttccaattggctactggtcaattagaaaacactgcgcgtttaaaacaagtacgtaaaaatattgctcgcatcaagacagtattacgtcaacaagaattaaaccaaggctaatagcagatcatagattaaaggaggtcaaacattttgagcgaaaaagaaacacgtaacgcacgtaaagtcatccaaggccgtgtcgtatccgataaaatggaaaaaacgattactgttgcggtagaaacgacaaagcaacaccgtacttacggcaagcggattcgttatacaaagaaatactacgctcacgacgaaaacaatgaagcaaaaactggcgatattgtccaaatcatggaaactcgtccgttgtctgctaagaaacgtttccgtctgctcaaggtcgtagaaaaggcagttattctataaactgaattattaacgagaggagggcttttccgtgattcaacaagaaagtcgtttaaaagtcgctgataattctggtgctcgtgagatcttaaccatcaaaattttaggcggttcacgtgtcaaaacagcaaatatcggtgatattattgttgcaacggttaaacaagcaacaccaggtggcgttgtcaaaaaaggtgacgttgtcaaagcggttatcgttcgtactaagtcaggtgcacatcgcccagatggttcttacatcaagtttgatgagaacgcagctgtaatcatcaacgctgataagagcccaagaggaacacgtatctttggacctgttgcccgtgaattacgtgacaacaacttcatgaagattgtttctttggcaccagaagtattgtaaacaaacaatctgcaaaggaggttcacccatgttcgtaaaaactggcgataaagttcgtgtcatcagcggtaaagacaaaggtaaagaaggtactgttactaaagcattacctaaaactgatcaagtcatcgttgaaggcgtacatgcgatcaagaagcatcaaaaagcaactaatactaacccacaaggtggtattattgacgctaatgctccaatccatgtatctaacgttatgttgatcgatccatccactaacgaaccaactcgtgtcggttataaagttgtcgatggtaaaaaagtacgtgtctccaaaaaatctggagaagttatcgataaataattaattgaaaggaggaaaatcgctcaatggctaatcgtttaaaagaaagatacgtaaaagaaattacaccagcaatgatggaaaaattcaattacacatccgtaatgcaaacaccaaaggttgaaaagatcgtgttaaatatgggtgttggtgatgcagttgcaaatgctaaaaacttagataatgcagttgctgaattaaaactgatttctggtcaacaaccaatcatcactaaagctaagaagtcaattgccggcttccgcttacgtgaaggtatggcaatcgggactaaagttacgctacgtggtgaacgtatgtatgactttttagataaattaatcaatgtttccttaccacgtgtccgtgatttccacggtgttagcacaaagtcatttgatggccgtggtaactatacattaggtgttcgtgaacaattgattttcccagaaatcgattatgatcaggttgataaagtccgcggtatggatatcgtcattgttacaactgctaacactgatgaagaatcacgcgaattactgacacaaatcggaatgccattcacaaaataatagggaggtaatatatcttggctaagaaatcaatggtcgctaagcagcaacgtcctgctaaattttcatcacaagcttatactcgttgtgagcgttgtggtcgtccacattcagtttatcgtaaattccatttatgccggatctgccttcgtgaattagcgcatgctggtcaaattccaggcttaaagaaagctagctggtaaatctaacttaaagggaggttaaactaaatggtcatgactgatccaatcgcagattacttgactcgtattcgtaacgccaatatggtgcgtcacgagtccttagaagtacctgcatctaatatgctccgcagcatttcagaaatcttgaagcgtgaaggttttatccgcgacttcgaatccgttgaagatgacaaacaaggcatcatccgcgtattcttgaagtacggtaaagataacgaacgcgttatttccggcctcaaacgtatttcaaaaccaggtttacgtgcatacgtcaaagctgatgctgtaccgaaggttttaaacggcttaggtattgcaatcttatccacttctgaaggtgttctcactgataaagaagctcgggctaagaacatcggtggcgaagttctcgcctacatctggtaattattctaaacaatagggaggtgtaacacgtgagtcgtatcggttacaaagtaatcaatgtacctgaaaaggtaacagtaactaaaactggtgacagcgtcacagttaaaggtcctaaaggtgaattgacccgtgaattcaatccgttgatcacaatcacacagaaagataatgtgattagttttgaacgtgctgatcatggtaaaaagagccgtgaattgcatggtacagcccgggctaacttggctaacatggtcgaaggtgtctccaatggcttcactaagaagttacaattggttggtgtcggatatcgtgcccaattacaaggtaagaaattgattttaaacgttggttattccaacccagttgaaatggaaactccagaaggcttaagccttgaagttccttcaaatactgaaatcaatgtttctggtatcagcaaacaagctgttggtgaatttgccgcagttatccgtagtgtccgtgccccagaaccttataaaggtaaaggtattcgctacgttgacgaatatgttcgtcgtaaggaaggtaagactggtaaatagttttacccagtcattcaaagttttacaatacaattcgcggttaagtgccgcataatctaactatcagaggtgaacattgtgatttctaaaccagataagaataagacacgccaaaagcgccatttacgtgtccgtggtaagatctctggtactgctgagcgcccacgcttgaacgttttccgttctaataagaacatctacgcgcaattaattgatgacgtagcgggtgtgacgctagcaagtgcctctacattggacaaagaagttgaagcaagttcaaagactgaagctgcaaaagctgttggcgaattgatcgctaaacgtgccgttgctgctggtcatgaaaatgttgtcttcgatcgtggcggctatttatatcatggccgtgtccaagctttagctgaagctgcacgcgaaaacggattagatttttaggaaaaggaggaaaacccatttatggctaaagcgtttattgatccaaacaagttagacttggaagacaatgttgtatccatcaaccgtgttactaaggttgtcaaaggtggccgtcgtttgcgttttgctgcgatcgttatcgttggtgaccataatggacacgttggctttggtaccggtaaagctcaagaagttcctgaagctatccgtaaagccgttgaagacgcaaagaagaacttgatcgaagtaccgatcgtcggcacaactgtaccgcatgaaatcatcggtcgtttcggtggtgcgcgtatcttgatcaaacctgctattgctggttctggtgttgcagctggtggtgctgtacgttcgatcatggaacttgctggtgtccaagatgtcactagtcaattcttaggttcacatacaccgatcaatgtggttcgtgcgactatggaaggtcttaagggcttacgtcgtgctgaaaaagtggctgaacttcgcggcattccagtcgatcaattagaaaactaggagggcgaaattcatggcacaattaaaaatcacgttaaagcgtagtgcagcacatcggattccaaatcatcgtgcaattgttaaatcaatgggcctgtctaaagttaatagttcagtaacattgcctgacaatgaagccgttcgtggccaattattcaagattggttacttggttaacgttgaagaagttaagtaacaattatttagtttaaggaggtgctccaactcaatgaaattacacgaattacaagcaagcgaaggctcgcgtcacgttcgtaaccgagttggccgtgggacttcatccggtaatggtaaaacagccggtcgtggtcaaaagggtcaaaaagctcgtggtaaagtacgtttgggcttcgaaggtggccaaatgccattattccgtcgtatgccaaaacgtggtttctcgaacattaaccgcaaagaatatgctattgtaagtttgaatgacttgaatcgtttcgacgaaggtactgatatcacaccagcattgttggttgaatctggtatcgttaaaaacgaaaaagccggtatcaaattattagcaaacggcgaaatcactaagaaagttacagttacggttagcaaggcttcggctgcagctaaacaagctgttgaagctgctggcggtaaaattgaggtgatttaatgctgtcgaccatcaaaaatgcttggcatgtgaaggacattcgaaatcggatgttctttacgttaggtattttgttaattttccgtttagggacatttattactgttcccggtgttgatgcaaaggcattaacatcgattgcttcttccggattagttagcatgctgaatatgttcggtggtggtggattaaccaattattccatttttgcgatgggggtttctccttacatcactgcacaaattgtcatccaacttttgcagatggatattgtgcccaaatttgttgagtggagcaaacaaggggaagttggtcgacgtaagttaaatcaaattacacgttatctgacgattgttcttgcatttttgcaatcaatcggtattactgctggctttaacgctttaagcgggctaggtttggtcaagaatccaaattggcaaacctttgttatgatcggtattatcctaactggtggcactatgttggttacttggatgggtgaacagatcacggataaaggcttaggtaatgggatctcaatgatcatctttgccgggattattgcgcgcttaccaagtgggatttatcaagtttacaagcaatggttcgagacaaatccgagtaccacacaattctggttgtacattttgtacgctgtcttgttggtgattgcaattttccttgtcgttgtctttgttacttacgtccaacaagcggaacggcgtatcccgattcgttatacacggcgggtaacagatgctggcgataatagctacctaccattaaaagtcaacgttgcgggggttattcccgttatctttgcaagttcatttattgcaacaccgggtacgattttgcagtattttagtagcacacactctgaagatcagtggttcaagatcatgaccgatatatttagtatgacaaccattcctggttcaatcttatatacagttttgatcattgtcttcactttcttctatgcgtttgttcaggtcaatccggaaaaggttgccgaaaatttgcagaaacaaggtagttatattccaagtgtttggccaggaaaaacgactcaaaaatatatttccggcacgttgatgcgtttatcaactgttggttctgtcttcttgggtttggtagctttgctgccgatcttggcgcagaatatttggagtttacctgaatcaatcggactaggtggtactagtttattgatcgtggtcggggttgctttagaagcagctcgtcagattgaaggattgatgatgaaacgacattacgttggttttatccgctagaaacgtgttgaagcgctagctttagcacgtttcttatcaatatggtgaaaaggagtgcgtctttgatgaatttgattttaatgggtttacctggtgctggtaaagggacccaagctgaacagattgtagatacttacaaaattccccatatttctactggggatatgttccgggcagcaatgaaagatgaaactgaattaggtctaaaagctaaatcctttatggataacggtgatttggttcctgatgaagtgacaaacggaattgttaaggatcgtttggcagaagctgatactaaagttggctatttgttagatggttttccacgtaacctaagccaggcagaagccttagaacaaatcacagcagatttaaataagccccttgatggtgtgatcaacattcaggttgatcctgcatcattgatggaacgacttactggtcgttttatctgtaaatcttgtggcgcaacttaccataaactttacaatccaacaaaagttgctggcacttgtgatcgttgcggcgggcatgatttcttccaacgtgatgatgataagccagaaactgtcaagaatcgtttggcagtaaacgaaaagatgaatacaccgttacttgatttttacggcaaaaagaatttgttattcaatgttgatggtaatcaagatatcaatgatgtctttgctgacattaaaaagatcttagatccattagcaagcaagtaaaccgcaaggatgcttgcgtgacttatgacattttgctataattagcaaggttatcttttcaagccggttagattatggtataatctgctggttaaaaatcgaaaaggtgagtgcaacgtgctctcaccatttttatatggaattgagcacttgtcttaatcgtttacgatttgcgtggtttcggctgtgtaaatagcgctcgattcaagtaagtattggtagtcagttcaattttggttgttgaagcatagcggttcgttagcgaatcagctgtaatcagttaaggaggtacttctgcgtggcgaaagatgatgtcattgaggtcgaaggaaaagtcactgatacattgccaaatgcaatgttcaaggtagaacttgaaaatggggcaacaattctagcgactgtttctggtaagatcagaatgcactatattcggatcctgccgggtgatcgagttactgttgagttgtcaccatatgacttaacacgtggccgcattacctatcgctttaaatagcattttgtataggaccggaagtttagccttttatcttaggaggtattagtcatgaaagtaagaccatcagtaaaacggatgtgtgaacattgccgcgttatcaaacgtaagggccgtgtcatggtcatttgttctgctaatccaaagcataaacaacgccaaggatagtaactaattcaatttaatggaggtgtcatttaaatggctcgttttgaaggtattgatttaccccgtggcaagcagattgtcattgcgttaacttacatttacggtattggtaataccactgctaaaaaagttttagcagctgctggtgtcgctgagaatattcgtcaagatgatctcacaccagaacaagaagacaagatccgtgttgaacttgataaggtcaaagtcgaaggtgacttacgccgtgaagttaacatgaacatcaaacgtcttcaagaaatcggttcttatcgcggtatgcgtcatcgtcgtggcttgccagttcgtggtcaaaataccaagaacaacgctcgtacacgtaaaggcaaaaaagcatcaatcgccggtaagaaaaaataatcagtaaaaggaggtaagtaattaatggcaaatagaaaaacaacacgtcgtcgtcgggtaaagaagaatatcgaatctggcgtggcacatattcattctacttttaacaacaccttgatcatgatcactgatccccaagggaatgcaattgcatggtcttcagcaggtgctttaggttttaagggtagtcgtaaatctacaccgtttgctgcacaaatggcagctgaaacagctgctaaagcatcaatggaatatggtatgaaatccgttgaagttgcagttaaaggtcctggttcaggtcgtgaagcagcaattcgttcattgcaagcaactggtttggaaattaccgcaattcgcgatgtaacgccagttcctcataatgggtctcgtcctccgaagcgccgtcgtgtttagtgagtacgtttttcattttgagttataaactgaaacgtacaacatcaaagacacttctcgttttgaaaggggtaagaaactaaatgatcgaatttgaaaaaccaaatattgccaaggttgatgaaagcacaaactatggtaagtttgtcattgagccgttagaacgtggctatgggacaactttaggtaattcattgcggcgtatcctcttggcttcattgccaggtgcagccgtaacgagtgttcaaatcgatggtgttttacatgaattttcgaccattgatggtgtaaccgaagatgtcacacaaatcatcttaaacatcaaaaaactcgctttgaagttggattctgacgatgataagacactagaaatcgacgtcaaaggtccggcaacagtcactgctggtgacattgaagctgatggggacgttgagatcttaaatcctgatctgtatatttgtacagtcgctgaaggtggtcgtttccacattcggatgactgcacacaaaggtcgtggctacgttgccgctgatggtaataaggttgatgacatgccgatcggtgttttgccaatcgattcgatttataccccaatcagtcgtgttaattatcaagttgaaagcacccgtgttggtcgccgtaacgactttgataaattaaccttggatgtttggacgaatggttctattagtccacgagaagcaattagtttggcagctaagatcttgactgagcatttggatatcttcattaacttaactgatgaagctaaaaacgctgaaattatggtagaaaaagaagaaacccataaagaaaaaatgcttgaaatgacaatcgaagaacttgatttatctgttcgttcatacaactgtttgaaacgtgctggtattaacaccgttcaagaattgactaacaagactgaagctgacatgatgaaagtccgtaaccttggacgtaagtctttggaagaagttaaggctaaattaactgacttaggtctttcattacgtaaagaagattaatcacttaaatccatcaagggagggaacacattaatgagttaccgcaaattaggtcgcacaagttcacaacgtaaagctttgctacgcgatttgacgactgatttaatcatgaacgaatcgatcacaacaactgaagctcgtgctaaagaagtacgttcaacaactgaaaaaatgatcactttaggtaaaaaaggcactttagctgctcgtcgccaagctgctgcttttatccgtgatgaaattgctgatgtacgtgaagaagacgaaaaagttgtcgtacaaacagttttacaaaaattatttagtgatgttgcaccacgttatgcagaacgtaacggtggttacacacaaatctacaaaaccatgcctcgtcgcggcgatggcgcaccaatggttgttttaaaatttgttgactaattgtcaatgatcaaccaggattaaaaacgatcacttctaaaatgtttgactagagtgttatgatgttggttagttgtttttccaagtctagctcgatggttggcgaatcgtgtattcgatcacattttagaatgtgatttttttttacgcaaaatttttgtcttagtggaaaaagacacacgaaaagcgcttaatatgctatcatggaaacattgagaaaaagtaaattgaacggtaaaggtgactgttgtggcaaaaattattgaagtcgaacatttaaatttccgttacccgcaaacggaaggacgaccagcgctaagtgatgttaatttaacgattgagcaaggcgagtgggttgctatcatcggccataacggtagtggtaagtcgactttggcgaagtcactagatgggttgctaccattgaatccagaaagtggtaaaattcgcgttgctggaattgaattaactgaagatagtgtgtgggatattcgacgccaaattggcatggtttttcagaatcctgataatcaatttgttggggctactgttgaagatgatgtcgcctttggcttggaaaatattggcttgccacgtgatgagatggttacgcgtgtgcatgacgctttggcacgcgtacggatgaccgagtttgctgatcgtgaaccggctcgtttatcgggtgggcaaaagcaacgggtagcgattgctggtgtaatcgcgttgcagccgcagatcattattttggatgaatcgacgagtatgcttgatcccaacgggcggatcgaggttttagatacggttcgtgagctaaaggaacaagaaaatttgacagtgatctcgatcacccatgatatcgatgaagcagctaacgctaaccgcattgttattttggacgatggtgagatcaaggaatcaggtacgccagcggaaatctttcagtatggcgagcgtttgatcgaattaggtcttgatgttccttatgccgagcggttaaagacggccttgcatcgccaaggcttagttgtaccgcaacaatacttaactgaggaagggttggtggattggctatggacattacattccaagatgtagcttatacttaccaggccggaacgccctttgaaagccaggcgctacatgatattaatttaacgatcgcagatcagagcttcacggcgatcgttggccataccggtagtggcaaatcaaccctagtccaacaccttaatgcattgttgaaacctactagcggtacagtaacgattggtgatcggcaaattacgccggagactaacaataaaaatttaaaacccttgcggcaaaaagttggaatggtgttccaatttccagagaaccagttatttgaggaaaccgttgctaaagatattgcatttggtccgatgaattttggcatgagtgcaactgatgcagcgaagaaggctgctgagatgcttgatttagtaggtttaccggctgaattactggaacgctcaccatttgatctatctggcggtcaaatgcggcgtgtggctattgctggcgttttagcgatggctcctgaagttttgatcctggatgaaccaacagcgggcttagatccagccggtcgtcgtgagattatggggatggtcacacgattacatgagcaacaaaaattaaccgttgttttgatcacgcatcatatggaagatgtggctaattatgctgatcacgtgatcgtgatggaacatgggacagtagctaaggtaggccaaccaagcgagatatttcaggatgtagagtggctgcagaaacggcaactgggtgtgccggaaaccactgaatttgcggcgcggctgcaaaagcgaggctttaagtttacccggttaccactaactgaagttgaattggcagcggcgttgttgcctcaattacctcgagaggcggtgagtcagccacatgatgaataaattgctgtttggccgttttattcctggtaactcggtgatccatcatttggatccgcggaataaattattgcttagtttctattatattggaatcatttttttagccaataactggttgacctatctggtcttgtttttgtttaccattttagctgtacgtttatcgaatattaagatgagtttctttattcgcggtgttcgaccgttgatctggctgattctattcaccgtactactacaagtattctttacgcgtgggggaactacctattggtcttggggaccgattgttttatcccaatttgggatcgttaacggggtttatatcttcatgcgctttgtactgattattttcatgtcgactttattgacgctgacaacagcccccttatcattggctgatgcaatcgaggcaattttgaaaccgttgcggattatacattttccagtgtatgaagttgcgttaatgctttcaattgcgctacggtttgtgccaacattgatggatgaaactgaaaaaatcatgaacgcgcaacgagcgcgcggagttgattttggcgaaggtaatattttccaacagatgcgtgcagttgttcctttactgattccgttattcgttagttcgtttaatcgtgctgaagatttagcgacagcgatggaagctcgtggctatcaaggcggtgaaggtcgcagtaaataccggattctaacttggcgcgctgctgacaattgggcagtgattgcttttgtgttactgacaggtattttaatttggttacgtgcataaataataactggtgggtttgaggtgagtagtgcctttaacccaccgtttttattggtgttacaacaggtgatattaccgtaagatcaactaccttaaaagtgaagtagagccatatttcttgcggtacgatttttaccacaagaatggccatcgtccgtaacatcaaggttgattagcttttttgctaatcacctaccttaaaagtgaagtagaaaggagagcttggtttgttacgttataaagttacgattgcctatgatggcactcaattcgcgggctttcagctccaagtgaagcaacggactgtacagggggtcatggagaaggctgtacgaaccattgctaaatcaccaacccggatcgtggtcaacggttctggccgtactgatgcgggtgttcatgcgttagggcaggtcgtacattttgattttccatttgctttaccggccgctgcgatgttaaaagccttaaatagtttgctaccattggatgtagtggtcaaggattgccaagttgcggacccggaattccatgcgcgctatgacacaacaggtaaacggtatgtttatcgcgttagccgtggttattatacggatccttttcggcgtttttacactggtcattggaagtacgctttagatgtggataaaattcaactagcgctgactgattttattggcacgcatgattttagtagttttgctgcatctggtggcagtattaaaaataaggtacgcacaatttttgctgccactgtaactgaggatccagcgagtgatgaattaatttttgaattctatggtaatggcttcttatataatatggtacgtattatggttggggttgctttagaaattggtaatggtcgtcggccagtgcacgatattttacgtttatacgaagttaaagaccgtacacaagcacgttacacggcaccggctagtggactttacttgaaaaaagtctattatggtgatggtccagctgataaaggtgatttggttacgctttaataataaataattacgaaattgattgacagtttgtagtaaaatagttaagattatagctggtactgtttaccccacgataagccccggaaacttactggtgtttaaacagacacagaaaaatggaggaatacacgtgcgctcaacatatttagcaaaaccaggcgaagtagaacacaaatggtacgttgtcgatgcaactgatattgcattaggccgtttatccacagttgtggcttctatcttacgcggtaaaaacaaaccaacatttacaccaaacgttgatactggtgaccacgtcatcatcatcaatgcagaaaaagtactcttaactggccgtaaagcgactgataagatttactatcatcatacccttcatccaggcggtttgaagcagatttctgcaggcgaattgcgtgaaaagaacccagttcgtttattggaattatccatcaaagggatgcttccaaagaacacattgggtcatgctcaatttatgaaattgcatgtttacgcaggtcctgaacataagaatgctgcacaacaaccagaaactttggatatcacaaacctaatttaaggagggaaatgaattggcagaaaaagttcaatatattggtacaggccgtcgtaaaaactcagttgcccgtgtacgtttagtaccaggtactggtaaaattacgatcaacggtaaagaccaaacagattatattccatttgcaaatattcgcgaagatatggttcaaccatttggtatcactgatacaaatgatagttacgatgttttcgttaacgttaacggcggtggcttctctggccaagccggcgcaattcgtcatggtatttcacgggcactattaaacgtagaccctgatttccgtggacctttaaaacgcgcaggtctcttaactcgtgacccacgtatgaaagaacgtaagaagccaggtttgaaaaaagcccgcaaagcttcacagttctcaaagcgttaatccggcacgttataacaagcctgattacggttttaacttttaccccaattggcaaaattcgctcagaaaatttaactttggggtaaggtttggggtaaatattatctcaatgagaatgttgaacgtcagattagataatctggcgtttttttgtactttcttttttggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaa

SEQ ID NO: 565 - DNA, 33750 bp, Unknown
  Metagenome-assembled genome
aagaaccaccaataaaccagcgatgaacaaataaagccgccttcctcttgattatatcaagagcgaagacggtttcatatcatggatacgagggcgaagcaaagcgcgccctctgagagttttttgtagtttaaagatagtgaactaaatatctgtttagaatgatctgttaaattcatctatactaagtggcaaattttgaaaaaattatagtgtaatattgatttgaagccaaatgcgatgtagcttataatgtaagtggatacaacttacgctcaatgggcattttacagaaaggtggttaggacaatgtttgtactcggggtcagtctactgtcgttggcgcggttccaatttgccatgacaacgatctttcatttcttcttcgttcctttttcaattggaatggcgttacttactgctattatggaaacaatttatgtgttcaagcgcgacgaagattacaaaaagatggcgaaattttggggtaagatttttctgctaagttttgcggtcggggtcgttactggtatcattcaagaatttcaatttgggatgaattggtcagattactcgcggttcatgggcgatatttttggtgcaccactggcaatcgaagcgttattggcctttttcatggaatcagtttttatcggtatgtggatgtttacgtgggatcggttcaagccagcaattcatgcgttgttcatctggttagttatgttaggttctagtatctcggcattatggattttaacggcgaatagttttatgcaaaatcctgtagcttaccggatcgctaatggccgggcggaaatggctagttttactggcttattaaagaatccacagttgtgggtcgaatttccccacgttattttcggtgcatttactacggcggcgtttgctttggctggcatgtcggcttggcgtctacttaaaaaagaaaataaagtcttctatcgcaaatcattgcgtgtcgggctatgggtcggtttagtagcagccattttaacggttgctgttggcgatctgcagactcagcaagtggtcaaggatcaaccaatgaaatttgccgcaacagaagggatttataaggacactggtaacccggcatcatggtcggtagtccaaggctttgacaccaagaataaaaaagttacttggagtattgaggtgccgaagatgctgagtttattgacatatcacaaggcatccgggtcggttaaagggatgaacaccatcaataaagaactacacgctaagtatgatggcaaatttggttcagatatcagctactatgttccgccgaaaactttattctggagtttccgaatcatggctggtagcgggatgttcttcatcctgattgcagttttaggcttatggtttagtcgggctaagcggaatactttacaaaataaacgttggctgttgtacgtgctcggcattagtctctggttgccatttattgctaatacttgtgggtggttgatcactgaactaggacggttcccgtggatcgtttatggtttgtacacgatcgctgatgcggtatcaccaagcgtgacggcaggagatctttggttctccaatacaatgtacttcctgatcttcacgttgctcggtggaacaatgatctacttctctcaccggacattggtcgccgggccagatgcattagacgatggcgctggttatgatacgaatgtcgatccaatggcaaagggggccttcagtcatgagtagcttacagttattgtggttcttcttgatcgggttattgttttccgtgttctttttcttagaaggattcgattacggtgtaggtatgtcactacgggtgattgcgcgtaatgaacgtgaacgtggtgaactgatgcaagccatcggcccacattgggatggcaatgaagtgtggttgattaccgctggtggggcgatgtttgcctcatttccttattggtatgctagcctattttccggattttacattatcttgttcttaacgttatttgcgttgatcttgcggggtgtttcttttgagtttcgtgcccatgccctttcagctgccggtaaaaagctgtggggttggacgctgacgatcggtagtttatgtgcaccattcttattagggatgatgttcaccgatttagtcaaagggatgccactagatgctgcaggaaatattcgtggcggctttggtgattatgttaatttgttctcgatcgttggtggcgtggcggtgacgttactttgcctcttacacgggttaaattttattcgcttaaaactaaccggtgatctacgtcagcgcgctcaagcagttactaaagtattgtatccagttctgtttgtcggtttagttgtttttgctggtttgttgatgtggcagactgatttcttcaccgcacggccggtgtccagctggattcttttagtgttgatcgtgttactgagcgtgattgcaacctttggagcgtaccgagataaagaagtgttgtcgtttatcgccagcggggcgactttgatcggtgtggtcgcattgctatttaatgggttgttcccccgggtcatggtcggcaataatccattgcacagtattttgatcgaaaatgcggcatcaacggaatatactttaggcgtgatgacgattgttgcagcaattttagtgccaatcgtcctagcctacacgatttggagttattttgtatttaatcaacgtgttcgtacaaaaaaagtggtgagtgataaatgattgcgagcatggaataaggcgttcagcttctgagcactagcctagtaaggcaataagcagcgcgtagtgatgcgtttgacttacgtagctaggcgcaagaagctaccttatagaatgcgttttaactatattgttcgaagagcaaaaaaatattacacatgtggatattctctaaaaagtggtgagtgataaatgatcgataagcgtttattacgcttatctggaactaaaaaagtcttattaatgcttgcgggactaactgttctgcaagcatttatgatattgttccaaggtaagtttttggcccaggcaatcgtcaattcatggcgattaaaagcattggcttggctttatcagccgatgcttttcttttttctggcgttactggggcgccatttattgaattggcttaaaagtcatgtactcgatcgttatgctagtcaggctagtgctgatctgcaacagcgtttgttaactaaactatttcatttaggaccaagtttagtggcaaaacaaggtactgggaatatggtgaccatggcattagaaggcattgatcaagtcgaaaattacatgactttgattttgaataaaatgctgaacatgatgctgattccatggatcttattaatttatattttcactttggatgcgcgttctggctggattttattagttgtcgtgccgatcgtgattttatttatgatcattcttggatttgccgctcgtgataaagccgataagcaatatgcggggtatcaacagttggccaaccattttgtggatgctttgcgcggattggcaacgttaaaactgttaggtattagtgaacaatatgccgataatgtctatcaagtcagcgaatcgtatcgcaaaaggacaatgaatgtgttacggattgcagtactttcaacgtttgcattagattttttcactacattatcgattgcaatcgtagcggttttccttggcttagcactgttgaatgggcaaattccactgtttccagcattagcgaccctgattttggcaccagagttctttctgcctttacgtgatttttccagcgattaccacgccactttagacggtaaaaatgcaatgcaggccgtttttgcgatcttggaattaccccagccgcaacaacggcaattattaacggctgcaccaacttggactgctgatagtactttgactttcaacaaggttgatgtcagttatccagggagcaacgaagcagacttagctgcggtttcctttagcgtgcacggctatcataaaattggtgtgatcggcgaatctggttccggaaaatcaactttgatcaacacactggggggctttttgcagccggaaaagggtgaaatcaaagttaatggccaagtagtgccacacttaagccaagaacagtggcaacaaaactttgtttatttaccacagaagccgtatctctttcacgctacgattggtgaaaacattgctttttatcaaccaactgcgtcggcagcagcaatcgaacgggcggcggctcaagctggattaagtgattggttggccacgctgcctgctggtttggcgacggtgattggtgaaggcgcgcgtggtgtcagtggtggtcaagggcaacggattgctttagcccgtgcctttcttgattcacagcggcggattttattgttggatgaaccgactgcacatttggacattgaaaccgaggcggctctgaaagaaacgatgatgccattatttgctgatcatttagtcttttttgccacacatcgcttacattggatgcaacaaatggactacgtttttgtgatccagcaaggtcgtttagttgaacaaggaacgccagcacaattacaagcccaaaatggcgcctatgtcagtttaatggcgcagatgcgaggtgaagcactatgaaacaattgaagcatgatacttgggtcaaaccctacatgactaaatacaagggcttgctgacgctgattttagtgcttggtttagcaacgtttatttgcggcggggcgttaatgtttacttcaggatatttaatcagtaaagcagcaacgaagccagaaaatattttactgatctatgtccccgttgttttggtacgtgcgtttggtattggccgaccagcttttcgctatcttgagcgtttgactagccataattgggtatttaaggtcacttcagatctgcgtaagcgactgtatcagacgttagctaaggacgctgccttttttcagcaacattttaaaactggcgatattttaggtatcttagctgatgatctcgggcacttacaaaatctttatttacggacaatttttccaacgttaatcagttggctgttatatgtcctgatcgtgattgcgctaggcttttttaattggttctttgccttggcgattgcactactactggcagtgatcatttttctgctgccgctagtttctgttgcggttctaggtgcgcgggttgaacgccacaagcagctgcagcatgaactttatactgacatgaccgacgatgtacttggcttatcagattgggtgatttctggacgccaaaatgattttctaaaacgtccgcaaccaactttgaaagccgcacggcaaaatacactgcagacgcgccgatttgaatggcggcgcgattttctgatccaattaatttttggcgtagtgatcgtagtactgatggtatggacaaatcagcaatttaccgctaatcaaagtctcgccaactggatcgcggcctttgtgctgtgtttattcccattagtagatgcgttcgcaccagtgagtcagggggtcgaagaatggccactgtatatgtcgtcagtagcgcgattgaatcatttacagccaactgtgcgtgaattaccgcagcaacaaaccttgactgcacctatcaaaacaattgcttttcagcaaatcgattttaaatacacagcggcacaaacgccgattttacagcaatttaatttgcagattgcagctggtgaaaaaattgcaattcttggtcctagtggtaccggcaaaaccacattattgaatttattgctcggtgaattaaccccgcaagttggacaagtgacgttgaaccaagtacctgtagcggcactacaaacgcaacgagcgcaattgattgggatgttagatcagaaaccatttttatttaacacaacggtgctgaataatattcgtttaggtaatttacaagccagtgatgaggcgattatggcggcgctacaagcagttgagttaggaccgctgatgcagcgactaccagcaggcgctgatactgttgtggaagaggctggtgcacgtttttctggcggcgagcagcaacgcttggccttggcgcgagtattgattcaagatgcacccattattttactggatgaacctacagtgggactagatccaatcaccgaaaaggcactgctgaacacgatttttaaagtgctagcagataaaacggtgatctgggtgactcatcatttgcaaggtatcgagcacgctgatcgcgttattttcttggagcacgggcagattgcgatgcaaggaacgccgcatgagttgtatcaaaacaatcaacgcttccgcaacctttatcagttagatcagggtacagagtagtatagctggtttcagcgttggtctagctgtggtaacatagaagtgatttagagagtataaatgcactaaaagtgatgattttactagcctaatttgctttacctgatagaattgggatgggccgtgtttggaaaatattgctaagttagtttttatcactaatttagcttaagggtggttgaaaaagcagattaattgcgtataacctggacacttttcccaaccacgctagattgaaatacttttagtgcgcttttataagggtaggtgcaatggtgtgtctttgtcagtctttttagaattagtggagatcaaagccaaaacggctagtgtttttccgtttttattaggtactttttttgcttggtatcactatcatcagttacatccagtttatttacttttattctttgtggcgatgttgatgtttaacatggcggtggatgctaatgataattatcaggattatcatcgtgcaacacataatcaggcgctggcttttcgtgagaaaaccaatattatcggtgtgcacaaattaaatcctagtcatattggctggttgattttctggctgatcgctgtttcagcagctttaggtttgtttatcgttagtcggactggttggccattactttggttaggtctattcagttacgcggtgggttatttctatgctgggggaccgcggccaatttccagtacaccgtttggtgaatttttctcgggaattaccatgggcttcgtgatttttctgatcagtgtgtacattaatacgtatgatgtgatcacgtttaattgggcttttgtctggccagtgctgctgtcatctggtctggccgtatgcagtattgccaatttgttgttggcgaataatatcgccgatgaacaagaagaccgtgaacttggccgcactacgatcgtttactatctgggtaaaccagcagcacttaaaatgtttgttatattatatgttgtcggttttgtttgtttattagcgtcagtttggttgggttatttaccgaaattaaccctgctgacctttttgacagtgccaatcgtttggcgtaacacccgcggcttcttggctaagcaaatcaaaaaggaaactttcccgttagcaattaaaaatttatttttgatcacgttggcccaagttattttctttggactagggttattaattcaatggtaacaaaaaattgacgtcaaaattggcgtcaatttttttattgacctattttttcatgactgaacatgctacaatgagaattacattattttattaagatcaaatgagaaactgttctctacttcaatttggcggtctttctcctagttgaatagccgtcactacgaatagcagaagtttctcagtggattttattaagaaacaatcattagaagtaagatagaggaggaaccataaacatgcagcaagtgtataattttgcggctgggccagcagtattgccacagccggtattgaaacaagttcaggccgagtttttgtcctatcacggtagtggaatgagcgttactgagatcagtcatcgttcctccttgtttcaagacatttatcacgatgctgagcagaccttgcgccaattaatggggttaccagacaattaccggatcttatttttgcaaggtggagctagtttacagttctatatgctgccattaaatattgcgacgaaacgccgtgcagcatacgttgacactggccattggtcacaaaaagcagttactgaagcagaaaaaattagtggcatgcaagtcgatgtcgtggcgagctcaaaggctagcagttacaccacgattcctgttatgccgactttgactaaagattatgattatgtgcacatcacgacgaataatacgattgaaggtaccgcgtttacgcagctgccagaggttactgcacctttggtcgctgatatgtcgtctaatattttagcgcagaattatccattcgaaaaatttggtgttatttacgctggtgcccaaaagaatattgcccctgctggcttgacggtagtgatcgttcgtgatgatctacttggtcaagtgactggtttaccaacgatgttggattatacgttgcaggcacaaaaagaatcagcttataatacccctcctgtttttgatatttacaccgctggtttagttttccattggttacaggatcgtggtggcattgccggcattgagaaaatcaatcgtgctaaagctggtattttatacgactatttagcgcagtctaaattattcagttcaccggtcgcagtggatgcgcgttcactgactaacgtaccatttgtgacgggtgatcctgaattagatgctgaatttgtggccgctgctgatgccgctggctttaaaaacttaaaaggtcatcgcttagtcggtgggatgcgggcaagtttgtataacgccttaccaatcgatgcagtagcagcgctagttgactttatggaaaaatttgaaaaaggagcgggtaaataatgtttcagatcacagcttcgactacggtagcgccagctggggtggcgttatttgatcaagaaaattacaaagtggattatggcgaaagtccaacaactgatgcggctggcttactgatccgcagtgtggacttacatcaaactacgctaccggaacgacttttaactattggtcgtgccggtgttggtgtcaataatattccgttggataaggctgtacagcaggggatagttgtttttaatgcgcctggtgctaatgcaaatggggtcaaagagttagttcttgctgctttggctatcggtgcgcgcccgatgttgcccgcttctgattgggtacatggcttgaaaggcaacgatattgatgttcaagttgaaaagggtaaaaaagcttacgttggaactgaattgctaggcaaacagcttggtgtgatcggtttaggtcatgtcggtggcttggttgccaacagcgcgtcgtccactgcgtttggaatgcatgttgttggctatgatccctatattcaagtcgacaccgcttggaatttatcacatcatattcatcacgccaaaaacgtgagtcaagtgttgcacgacagcgattatgttacgattcacgtaccactgaccgacgaaacggcagaaatgttgaacgcagaggcaattgctcagatgaagcctggtagcgtgctcctgaactttgcacgtgacgatgtggtggatgaggcagcaatcattgctgccttagaccgcggtcatttacggcaatatattaccgactttgcgacaccaaaattgatccatcatccgaaggtattgtgcttcccacatatcggtggttcgactgatgctgcagaaacgaatagtgctaaaatggttgtacaaacaatgaagaactatttggaaactgggaatattcggaattcggttacttttccggatacggtaatggattttcaagcaccactacggttgacgctgattcatcggaatgtacctaatatggttggccgtatgactgaggtgctggctaattatgatttgaatattgtcaacatggttaaccgtagcaacggtgactatgcttatacgatgattgatttggatgctctggaagctaagcggctacagcgaattgccaataaaatggcgcaaatcgaaaacgtagttcgtgtccgcgtgatcgaacaaccaaagtagttgcgcgtgcacaaaaattatctagtagaacaggtttaatcaattataatttagcgggacggaagcgcaccagttgcctttcgtcccgtttttcagttatgatttggccagtggggtgagataagatgaaaatcggtttacgaaccgttaaaactgccttaggggcggtgatcgcaatggtgctagcgtatgaattacgacttgattattggtcgactgcaggcattattacgatcttaagtgtacaaaatacgactcgttattcatttaatgttgctggtttacggatcggtgccacaattttagcgtttatgctggctatttttagtttttggctactaggttttaatccgtgggcatttggcttgtttttattgttatttattccgttagcaatgcaattgcgcctacaagaaggcattgtggtcagtgccgtgttggtcagccattttttgattgagaaaagctatagctggtattggttaggcaatgaatttgcgctgatgttgatcggggtgggtgtcgccttgctgtttaacctatttatgccgtcactgatggcccagatcaaaggcttccagcaagaagtcgaagatcaattgcggcaaattttactacaaatggcgcaacaattgagtggcaccgaaaaagtacctacgtggcagcatttaggtgcacttttaaccgtgatccgcaaaggacgtgagtgggccagccgccagcaagataatcaattgttggttgaaaatgatttttatcgctcctattttgagatgcgccgcaatcaatatgagatgttgcgccaaatgcaagctaacttagatcagatcacgttgtctttaaaggaaagtacggcgattcgtgaattactagctgaaacggcggctagtttggcgcaaccgcagaaagttcaacatttacagcgtcgcgtagcccggctgcaagataaattcgatcaagcgccgctacctactaatcgcgctgagtttgaaagccgtgcacacctatacttattcttactcgactttgagaccttgctcacgttggctggtgatttctacgataaagtgattttaaatgaaaaataacagtcagtacgggtaaatttgtgtacaatggaaccaaaacaagtagtaggaaaacttccgttgatgcaaaaagcagccacaaaaaaggtaggtgtttgcgtggtcaaaaaacgtaaaaaaggtaatttatttaaacagctaggtctgccgcaattaattttagctgggatcatcattgcgtttgtcgggttattactagtacggctcttgggcgagcagccgcgagtcgccgttgatgatagtgcggcggtgacgcaagagagtattcagcgcgaacatcgcgcatttatcactaagttagcgccagttgcacaacgactgcagttaacgtaccatgttttgcctagtgttacgatcgcccaggcaattctagagtcgaattggggaactagtcaattggcaacgcgctaccataatttgttcggtgttaaggggacagacccgaatacatcgcaaattttaacgaccaaggaataccaaaacggtaagtggatcgagatccatgcgcgttttcaagtttatagcagtgacacggcagccttagaagcacacgccaagttattagcacagggaaccacgtggaatccgcagcaatatcagcatgtggttgcggcaactaactataaaactgctgctaccgcactacagcaagacggttacgcaactgatccaacgtacgcgcaaaaactgatcaatgtgatcgaaacctataaattaaaccaatatgaccagtgaacgttcgtattttgtgtcactcacaccttaatgactcggcatgatcaatccagttgatctaagttgattattgatagtttaccgctggtttttcaatttaagctacaattagcgtactggcttaaaaccaaatgaaatcttcctaacttgtattgtcattcggaattaactgtgctaaagttataataatttcatgtgtattgaactgatgtttagtggcattgtgccaactgaatgagtttaaacgtggttgaaaaagcagattactgctttttctaccactctgcttatataatgccataatctggttggcgagtttctaccctgaaccgtaaattcgggactataagcaaaaaagtggtcgtaccgcttcttttgccgaaccgtgtaaaagaagtttttttgtaggcagcgtgtcttcagcgcaataatattttaattttggaggttatatttatgaagttgctcgaggagcgaattcgacgtgatggtcaagtattagatggtaatgtgttgaaggtggataacttcctgaaccatcaggtggatccggacttgatgttcgcaatgggtgaagaatttgcgcagttattccgtggtgaagggatcaccaaagtcttaacggtggagtcctctggcatcgcgcctgctttattaactgggttacagttacatgtaccagtcatttttgcccgcaaacataaaagtttaacgttggtcaatgatttgtacacggcaacggtctattcttatacgaaaaaagtcagcaatgaaatttcaatctccaaaaagtttctcggcgcggacgataaagtattgatcatcgatgatttcttggctaacggtcaagccgttgctggcctgatcgaggtgtgtgaacaagctcacgctgagatcaaaggggtcggcatcgcaatcgaaaaaactttccaacgtggtcacgaattgatcaaggaaaagaacattcgcctagaatcattggcacaaattgctgcctttgaaaatggtcatgttgtttttgttggtgataaggagtcagaacatgcagaataagcaagtcgtcagcgtttcacatccaaaagcggctgcgctgggcttgcaacacctcttggcaatgtattccggttctgttttagtaccgctattaattggcggagcactgcatttttcggccagtcaaatgacatatctagtttccattgacatcttcatgtgtggcttggcaacgttgctgcagatctggacgaatcgtttcgtcggcattggtttgcccgttgtacttggttgtgcggtacaagcggttgaaccattgaagatgattggtgagcgttttacaattggaacaatgtatggggcaattattgctgccggggcctttgttttcctgatcgccggtgcattttctaaaatcaaacggttatttccgccgttggttacagggacgttgatcactgtcattggtttgacgttgattccagttgcctttaccaacttaggtggtggtgatgcctcagccaaaaactttggctcaccagattccttggccgttggttttttgactgtgttagtgattttagcggttaacgtatggggcgttggcttcattcggcaaatcgctgtcttgatcggcttattagttggaacgattgtggcggcctttatgggcatggtctctttgcagccggtagcagaagctagctggctacattttccccaaccattttattttggcgcaccacattttgagtggtcgtcgatcttaacgatgattttagtttccttggtttcaatggtagaatctaccggcgttttctttgcgctaggtgatattaccaaccgtaaaattgaaagcagcgatctgaaaaagggttaccgcgctgaggctttagccgtaatgcttggcggtatttttaatactttcccctacacgacattttcgcaaaatgttggtttagtgcaattatctggtatcaaaacgcggaaaccgattttctattctgctggttttctgattttgctcggtttattgcctaaagttggtgcggtggcaacgaccattccaacgcctgttttaggtggcgccatgcttgtgatgtttggcatggtggcgatccaaggaattcggatgttacggcatgttgattttcataatgataaaaacgttttgatcgccgccttgtcgattggacttggacttggggtcagtgttgaaccaactatttttcagtccctaccaacgactttacaactattgctaggcaatgggatcgtgatggctagtttatcagccgttctgctgaatttaattttacggccacggcaaccagaagctgaattagaagaagacgatggtttgaacgaggaagaataaccggtttttagaaatgtgctaaaaggcagattatgacgatagctacgcaatgatctggccatttttcaacacacgttacagattttgacgggtaaagactgctatgctacgattaaagcaactttaaacgttagcaaatgaaggttgtgagaaatgtgactgcagttatttatccagacagtatgatcggtatcattggtggtgatgcaaacagtaaattactggccttagcggctaaacgtttaggctttcgcgtcggtattttaaccgatactttagatagccctgcggctggtgtagccgatgtgactgaaatgggcgctttgaattcagtaactaatttacagaaattagcacagttttgcgatgcaatgacttatcagtatgaaaatatcgataccagcgtgctggaccaattaaacgcggtcaatttgcctcaaggaaccgatattttggcgatcactcaagatcggcaattggagaaagttttctttgaaagccacaatttgaatattgcaccttacgcaacgatcgttgatatcaatgatgtatatgatgcggtggcgtcgattggttacccttgtgttttaaagccgatccaaaagggctacggcaagcaatttcaacacattatttacggtgaggcagatattgcgggtagcgagaaatacttaacttcaggcacttatattttggaatcgtgggttccctatgaaagtgagctcacgatcatggttgcgaaagatgctgataagaacttagcttatatgccagtggtggagaatgtttttgttgatcaagaattatttgagaccatcgtaccggcgcggatcaaaccagctgtgatggctgaggtacaacgcattgctgaattagttggtaacgcgttggattatgtcggtgtgtttggaattgagtttttcttaaccgcttctgatacactttacgtgaagcggctagtaccagggccgcatacttcgggcaacatttttaatgaagcaacgaatgtttcgcaatatgaattacacttgcggacactttgtcactggccactaccaaaaatcaaattgatcagccctgcagtatcggtgacgattcctaagcgcttgatcaccgacacctttactcaggtgttgatcaaaccagattggcatttttattactatttagataatgcacaagatgataatgaccgcgctggccacgttacgatcttgaccacggacacgcagcatactttggaacaaatttacgacacagagatttggaatcaaccacctgaaaagggttaaacttgatttgtgaaaatataccaagaaaatatcaatgatgttttcttgctattctaaattctatggaaaagcgaggcttactatgttagaacgctatacgcgcccagagatgggacagatttggactgatcggaatcgctatcaggcatggttagaagttgaaactttagcggatgaagcttgggctgaaattggcgaagtacctaaggaagatgcggttaaaattcgccagaaagcgacttttgacgttgcgcggatcgctgaattagagaagcaaacgaaacacgacgttgtggcgtttactcgtgatgtttcagaaagcctcggccctgagaaaaaatgggtccattacgggctgacgtcaaccgatgtggttgatactgcctttggctacttgatgaagcaagccaatgatttgatccgccaagatattcaaaacttgatcgacgttcttgcaaagcaagctaaaacttataagtacactgttatgatgggccgtacccatggtgttcatgctgaaccaacgacttttggtttgcggatggcacaatggtacgcggaaatgaaacgcaatcaagaacgtttcgaacatgcagctaagggtgttgaagccggtaaaattagtggtgctgtaggaacatttgctaatatcccgccatttgttgagcagtacgtgactgagcatttaggtattcgtgcccaagatatttcaacgcagattttaccacgtgatcttcacgctgagtacgtggcaacgatggcattgattgccacttcgatcgaacgttttgcgacggaagtacgttcgttacaacggactgaaattcatgaagttgaagaatttttcgctgcgggccaaaagggttcctcggcaatgccacataaacgcaatccgatcggttcggaaaatgttaccggcttggcccgtgtgatccgcggtcatatgatcacggcttacgaagatgtgccattgtggcatgatcgcgatatttcacatagttcagcagaacggatcattattcctgataccactgggttattggattatatcttgcatcgtttcacgaagattctagatacgctgacaattttcccagaaaagatgcgtagcaacatggacgtcacttacggcttgatctatagccaacgggtgatgttgaaattaattgaaagcggcatgagtcgtgaggatgcttatgatttagtgcaaccgaaaacggcagtggcttgggatgaaaagaagcctttccgaccattattggaagctgatcctaaggtgaccaatgcacttagcagtaaagatttagacgatgcattcgattatcactggcatttacggcacgtggatgaaatttttgaacgtgttggtttagctgaataaaaatatttaaagaagctggggcataattattgtcgcagcttttttgtaagtagtgtgcgaacttatattcgtatttttagaattctttagagaagtttaagtgaatttttgttataatgttgagttgaacgatgtgacgccgagttagattaacttggcgttttccagttaggatgcgttacaaaattatttttgccgctggctaaccaatttagtgcgaataataaagatagcaattacaagtacgcaccagtaaataattaaaaacgggggactgactaagttatggccacaacggatttgttaacaggcatgaacgacaagcagcaagaggcggtaaagcagacagaggggccattattgatcatggccggtgccggttccgggaaaacacgggtcgtgacgcaccgcatcgcctacttgattgaagaattagacgttgcgccatggcggatcttggcaatcacatttactaacaaagccgcgcgcgaaatgcgtgaacgtgtggctagtttattgaatgaacgagctgaatccgtttgggtctcaactttccatgcgttgtgcgtgcgtatcttgcgtcgcgatattgataaaatgaccggttacagtcggtcatttacaattgctgatccgggtgagcaaaatactttaatgcgtcggatcctgacccaacagaatattgatcctaaaaaatataccccgcgttcgattttaggcgagatctctaacgctaaaaaccaattacaaacgccaaaagattatgcggctgcggcaagtacgccatttgaagaaatcgtcgctaaatgctatgaaccttatcaaaatgaattagaagccaatcaagctcttgattttgatgatttgatcatgctgacgatcgagctcttccgtaaatcaccggaaacactagattactatcaagaaaagtttcgctatattcatgtcgatgaatatcaggataccaaccaagcgcagtatactttagttaatatgttggcacagcgttatcataatttgtgtgtcgtgggtgatgccgatcagagtatttatggttggcggggtgctgatatgagtaatatcatgaacttcgagaaggattatccagaagctaaaaccgttatgttggagcaaaactatcgctcaacgcagacgattttacaggcggctaatgatgtgatcaacaacaacgtttaccgtaagccgaagaagttatggacggaaaatgatgctggtgctaagatttcttactatcgtggtcaaaatgaacatgatgaagcccgttttgtcgttgctaaaattcaagaagagatggctgataatgatttccgttatggcgactttgccgtcttgtaccgaaccaacgcacaatcacggacgattgaagaaaatttagtcaaggctaatattccttacaaaatggttggtgggcataagttctatgatcgtaaagaaattaaggacgtactggcctatttgcgggtgatcgttaaccctgatgattcgatcgactttgaacgaatcgtcaacagtccaaagcgcggtattggtaacgggacgatcgataaattacgtgactttgctaactacaataattggtccttgctagaagctgcccgcaatgtggatctagctaacggtattgccactcgagcacgccatacattaggcagttttgcaacgactatgacggctttgcgtgacaagcgaactgagtgggacgttacggaattgacgacccaaatgctagaacagactggttacttagacgctttaaaacaggaaaaaacgctagaagcgcagacgcgaatcgaaaatattcaagaatttttgtcggtaactaaagaatttgatgatggttacgacgatgaagcagacgctgatagtgatcgtttcgtcgactttttaactgatttggctttggtttctgaccaagatgatatcgaggaagaaagcagtgaagtgactttaatgacactacatgctgcgaaagggttagagttcccagttgttttcatgatggggatggaagaaggaatcttcccattatcacgggcaatgatggaaaacgatgaactagaagaagagcgacgcttagcttacgtcggtattacgcgggcaaaaaagaagctgtacctgactaacgcctactcgcgaatgttatacggccgaacacagagtaatcccgcttcacgctttgtcggtgaaattgatgaagatttgattttatttgaaaataaaacggccgctagtttatcggaacggaatattccattcagtgactcccggcagcaaaatgcttatacacgagcaacggcgacgacttaccacacacggcgcggaacggcggctaagtcggtttccaatacacctagcaccggtgccgaaagcaagtcatggcaggccggtgataaggtgcagcataaaaagtggggcgaaggcaccgtggtcaaggtcagcggtagtggcaccgacgctgaattggatattgcgtttaaatcacaaggtatcaagcgcttattagcggcctttgcgccaatcactaaggtaacagaatagacgaaaagcgtttttgacacttaatcatagaaagaaggtggcacctgctggaagtttccggtaggcaatcaatggctttagaaaaaccaatcgaacagtattcggaacaggaagctagtgcggctgcattagcattacgcaatcttttagaccagtggagtcaggcttattacacagcagaccaaccgttagtcgaagataatgtttatgacgaaaattatcgtgatctggaaacgttggaaaaggcttttccggccatcgttaccagtgattcaccgacacaacaagttggtggtcaggtgctgcctggttttaccaaggttacgcatgagcagccgatgctctccatgggggatgtattctcattagctgagttggctaattttgatcaacgcctgcgtaaaaatgtcacgactgattttgattatagtgttgaattgaaaattgatggtttagcgatctcgttagtttacgaagatggtgtatttgtgcgtggtgccactcgtggtaatgggacgattggtgaagatattacgcaaaatttaaaaacgatcaaatcaattccccacaagctgactgaaccgctgtcgatcgaagttcgcggtgagtgttatatgccgcgggtgtcatttgctaaattaaatgaacgccgtgaagcggacggtttagcgacttttgctaatccgcgtaatgcagcagctggtagtttgcgccaacttgattcacgagtaacggcggcacgtaatttgtcaacgtggatctatacattgactgattatgctgcattgaatgtgaccacacaagccgaagcacttgctcgtttaagtgaattaggctttgccgttaatccgaccacaaaaacttgccaaacgttgaccgaaattgaggcttttattgctgaatatcaggcacaacgcaatcaactcgactatgatatcgatggtgtggttttaaaagttaattccttagcactacaggctgaactaggtaatacggtcaaggtaccacgttgggaaattgcttataaatttccaccagaagaagcacaaaccgtgatcaatgagattgagtggacagttggtcgtacgggtgtagttacaccaactgcggtaatggatcccgttcaattagcgggtacgaccgtagcacgagcaacgctgcataatggcgatatgatccaagaaaaggatattcgactacatgatacggttttgattcacaaagccggcgatattattcccgaagtttctaccgttttaactgacaaacggggggccgatagtcagccctatgtgattccgactcattgtccttcctgtgattcgccgttggttcatttagaagatgaagtcgcgttacgctgtatcaatccgaagtgtccggctcagatcaaggaacagttgacccattttgcgtcacgtaatgcgatgaatatcgatgggcttggtccgcagatcgtgcaacaattatttgagcgtgaactggttgctgatgttgctgatctgtatcaactgaccctggagcagctgctaacgttagataaatttaaagaaaaatcagccaataatttattacaggcaattgaacgtagtaaagctaattctttagagcgtttgttaaccggcttaggcattcgccatgtcggcgctaaaatggctcgttcattggctgaacactttggtgacatggctagtttacaagctagcagtgctgaagaaattgaagcaatcgcgacttctgggacgatcattgctaatagtgtgcggacttattttgatgcaccggaagttcctaagttgatcgaacaattagcggctgccggtgtgaatatgcgctatttgggaccagcaccagctagtgtaagtgagacgccatttaccggtaaaacgatggtgttaactgggacactagaacggcacaagcgggcagatctcgccaatacactgactgatctgggcgctaaggtgactggcagcgtatcgaagaaaaccgatattgtggtcgctggtgctgatccgggtagtaaatatactaaagcacaaaaattaggtattacgatctgggacgaagccactttggagcaaaacttgcaagatctggctgactagcggtattatggtttctatgataggcgccatgcttcttgcggtatgcacttagccacaagaatggtcatcgccacgaacatcaagaatttattggcggtttgtgctaataaattatcattaatagtgagatagagccatgtttcttgcggtatgcacttagccacaagaatggtcatcgccacgaacatcaagaatttattggcggattgtgctaataaattatcattaatagtgagatagagccatgtttcttgcggtatgcacttagccacaagaatggtcatcgccacgaacatcaagaatttattggcggattgtgctaataaattatcattaatagtgagatagaggagaaaaatcgtgaaacgaattagcgcaatattagctttagcagttagtgtcgtactgttgaccgcgtgtggccgcttaggttcgtccggtgtcggcacgactagtagtaccaaaactaaaacctcgattcagacaaccggccaaaattctgacgatgagtatcaaggcgtgatccagaatggtcgttataaaaccagtaaggcacggggactcacgaaagatcagaatactaatggggctaatctgaaaagctttgaaaatggattacagacgatttcacagaaacagtttgccactgatgattatatcttccaagaaggccaatacttaaagaaagcaacggcacagaattggttggatcgtaagtctaaaagtaatgccagtggattgaatccagaagacaatggtcaaacggatgctgataagcggaatccagattatttgcaggcaattgaagaacaagattatatgacccaagatggtaataatctcaagcttggtggtatgacgatcggtttggcaatgaatcaagtcgattactatcaaaaagaagaatatggcgcaactttcgagactaaaatttctcacgataaaatggtcagtgaaggtaagtcgatggctaataaagtcgtttcacggatgcgtaaaaccgaaggcgttggtaatgtgccaatcgtgattgcgttgtacgaacaggccactaatgatagcttagttggcgggactttctttgcttatggaatcagtaaagacggcggtaaaacaattagtgagtggcatgatgttaacgaagctaattacgttttaccagtagttggtagtgctaagtcaggtaattccagcgatgccgattcgtttactaacttcaaaaataatgtgcagtcgttcttccctaatttgtctggcgtcacagcgcaaactcattacaaagatggtaatttatctgggatgaacattacgatcaacacgcagttttatagtgaaactgaaatcaagagtttcacgcaatacttggtgactgcagctaataaatatctaccaagtgaagccgcaattgagatcactgtgcagtcaactgacggtacacaagcttttgttgcgcgcaaagcaggtgaaaagagtttctacagccatgtctttggtagttactaataatcgcattaaacgtcctcaattatgaggacgtttttttatgattatattagagaatttattaatattcacattatttgctcatggaaaggtaaatgaaaactcgttatcaacggctaattgtgctaaactgaaaattggttgatttttaaacctgagaatatgagatttaattaagaaaaattttggagggatataacgtgcaacagaaacgctttttacgcctgagtttaggctggcgcattgtgcttggcctgatcttggggttagttgttggtgcgcttttttatcaaaataaaatggcgatcgccatcctgaatccaatcgggacgatcttcattaatttaattaaaatgatcgttttaccgatcgtggtttcctgtctagtcgttggtattgccaaaatgggcgatatcaaaaagttagggcgtgtcggtggcaaaacgttgatctactttgaactgatgacaacgattgcgattgcgttggggttgctggtcgggaatctgactaaaccgggtgattcgatcaatattcaaacgctgagcaaagtttcaattagtcaatacacggcaaccgctaaaactgccggtaataacgggttaggcgatatcatcatgaatatcgtaccgactaacttttttgaatcgttaggtaaaggcgatatgattccaattattttctttaccgtcatgtttggtctaggaattgcggccattggtaaacgtggtcatgttttgatcgacttctttgatgcgacctctgaagtgatgttcaaaatgactaactggatcatgcagctagcgccaattggggtgtttgctttgattggtgtgactattgcacagtttggcttaagtgcgctgaaaccgttggcgttgttcctgttgatcgcctatatgacgatgatcatttttgtggttgttgtgatggggttagttgcgcgtttattccacctgaatatttttgatctattgttggtgatcaaggatgagctagtgttggctttttctacggccagttccgaagcagccttgccacgaattatggagaaaatgccgcgttatggcgttagtcagggaattgcctcttttgttattcctactggctacacgttcaacctggatggttcggcgatttatcagtcgttggccgcgttgtttttagcgcaggcttaccatattcatttaagcttaggtcagcagatcacgttattggttgtgttgatgatcacgtctaaagggatggcaggtgtgcctggtgcgtccttcgtcgtgttgttagcgacgatcaccacgattggtgtgccggcatctggtttagcttttattgccggtatcgatcgtttagttgatatgggccgcacggctgtcaatgtggtcggtaattcgttggccgctttgatcattgccaaaaccgagcatgaatttgatgaagagaagcagcaaaattacttagcggacgttaaaaaagttaccgcagagaaagttaattaattttttcagaaatttgcagcctgtgtgctgcttttttcatatcacaaatcgctatctatcacggtacgtgctataataatgtcattgtggccgcgtgcgcggtcaaacttagacttttcacactaagtcgttaacgttaaaataataatgtaataaaaaatgaaagagaggccagagaattggcaattagtaaagagcaagtcaaccatgttgcaaacctcgcccggttatcttttaatgatgaagaattaagccaatttactgatcaaatgagcaaaatcaccgacatgtttaaccagttacaggaagttgataccactggtgttgaaccaatgacacacgtggttgatctggttaacgttgtgcgcgatgatgtaccagcagccgctgatccagaagaacggacggcgttattaaataatgcacctgatactgaagacggctatatcaaagttccagcaatttttaaccgtggggaggattcggctgaatgaacttctttgacaatgatttgaccacgatccataaccagttagtgaacaaaaaattaaccagttatgaattaactaaacaaacaattgatgctttaaaagcaaccgatcaaaaaatcgatgcttttttggcgttagatgaagaaaatgccttagcaacagctaaagcaatcgatgaaaaaggtattgatgccgctaacctgttagccggtattccaattgctatcaaggataacatcatgacgaaaggcttgcggacaactgctgccagcaagattcttgaaaactttacgccgatttatgacgcaacagtcatggaaaaaatccacgctaatgacatggtcgtgatcgggaaaactaaccttgacgaattcgccatgggtggctcaactgaaaattctgcctttaagatcactaaaaacccatgggacaccactaaagtgcctggtggctcatctggtggctctgcagctgctgtttccgctggtatggtaccctttgccttaggttctgatacgggtggttcaattcgtcaaccagcttcatttactggggtcgtggggatgaaaccaacttatggtcgtatttcccgctggggcttgattgcttttggttctagcttggatcaaattggcccattctctcgtggcgttaaagataatgctgccttgctgaatattttggttggtgaagacaaacgggatgccacttccgttagcggccacgaagctgatttcacggctaaaatcgatgctggcgtcaaaggcttgcgtattggcttaccaaaggaatatttaggtgaaggcgttcaggcggaagttaaggaagcaattttggctgcagctgataagtaccgtgaattgggtgctacggtggacgaagtttctttgccacattctaaatatggcgtagctgcttactacattatttctagttctgaagcttcatctaatttacaacgttttgacggtatccgctatggtgtccgtgcgcaagacgctaaggatttgaatgaggtttacgtgaactcacggacgcaaggtttcggtcctgaagttaagcggcggatcatgttaggcatgtactcactatctgctggttattacgatgcttacttcaaaaaagctgcccaagtacggacattgatgcggcaagatttcgctgatattttcaaggatcatgatttgatcttagggccagttgcaccaacgactgcttatggtatcggcgaagatgtcactgatccattgaccatgtatgctggcgacgttttgagtgtgccagtgaaccttgctggtcttccaggcttatcactgcctgctggttttgctaacggtttaccgatcggcatgcagttgatcggcccatcatttgctgaagctaccttgtatcaagctggatatgcatttgaacaggcaactgatttccacaaacaagttccaacgttagggggtaacgactagtgaactttgaaacgactatcgggcttgaagtccatgttgaattaaaaacaaaatcaaaaatgtttagtccatcggccaacgaatttggtgatacccctaacatgaacactaatgtgatcgactggggttatccaggtgtattgcctagcgtcaataaaggtgctttggaatatggtatgcgtgcggctttggcattaaatgcgacgattgctaaagaaaatcactttgatcggaaaaactatttctatcctgataatccaaaagcttatcagatcacacagtttgaacaaccaatcggccatgatggctgggttgaagttgaattagacaatggcgataccaagaaaattgggatcgaagaattacatttggaagaagatgctggtaaaaatacccatcgtggccaaaattcttacgtcgatctaaaccgacaggggacgccattgattgaaattgtctcaaagccagatatggcttcacctgaagaagcttacaagtatttggaaactttgcgccaagtgatccagtttagcggtgtatctgacgttaaaatggaagaaggttctttgcgggttgacgccaatatttcaattcggccagttggtcaaaaggaatacggcgttaaaactgaattgaagaacatcaactcatttaactacttacgcaaaggtcttgaatacgaagaaaaacgccaagcacagattctattgtctggtggcacaattcgtcaggaaacacgtggttacaatgaaaatacaggcgaaaccgttttgcagcgggtcaaggaaggctccgatgattatcgttacttcccagaaccagatattccaccgattcatatcagcgatgattggatcgcagaagtacggcgttcgatcccagaaatgccagcagcacggcgccaacgttatatcaatgacttaggtttgagtgcagctgatgctactgttttgacgcaaagcttggaaatggctgatttctttgaagcaacggttgcggccggtgctgacgctaagttagccgctaactggttacaaggtgaagttagtgcttatttgaacgcagagaagcttgaattaacggcgactaaattaactgccgtcaatttagcgacgatgatcaacttgatcactgatggcacaatctcctcgaagatcgccaaaaaagtcttcaaagaaattatcactaacggcactgaacctaaacaatgggtcgaagcgaaagggttagttcaattatctgatccagctaaattattgccgatcatcactgagattttggacaataaccaacaatcgatcgatgacttcaaaaatggtaaggaccgtgcaattggtttcttggttggacagatcatgaagcaaacccgcggccaagctaatccaaaagtcgttaaccaattattgatccaagaattgaagcaacggtaaaggagggttcccatgcagcaacgggcacgtatcatttataatcctaaggctggtcatgagggcctgaaacaaagtctcgttgatattttagcgatttttgaacaggctggttatgagaccagcgcctatgccaccacgccagaaccactttcagcacaaaatgaagccatgcgggcagcgcaggctggctttaatttagtcgttgccgctggtggtgatggcacgatcaaccaggtcgtcaacggtttggctggtttaaaacatcggccgaaaatggcgatcattcctgctggtaccactaacgactatgcacgcgcactgaaaattccccgtgaagatccagttgaagcggctaaaattgttttgaaacggaaaacgattaagatggatattggccgtgccgacaaagaatacttcatgaatatcgccggtggtggctttttgaccgaactcacttacggtgtaccgtcagaaacgaagtcgatttttggctaccttgcttatttacttgaaggggctaaaatgttgccacaaatcaagccagtgccaatgcacctggtttatgatgacggtgaattccgcggcgatgcctccatgttcttactcggtttgaccaattcgatcggtggctttgaaaaagttgcgcccgatattacactcggtgatggccgtttctcgttgatcattgtcaaaacagctaacttagctgaattagttcggctgattgcgttggctatcaacggcaaacatttaaacgatccgcgagttatttatgttaaaacgcacaagctagtggctaaaaccaccaacggcgcagaaatgaaaattaatttagatggcgagtttggtggcacggcgccaatgacgttcaccaacctcaagcaacatttagaaatttttgctgatgttgacgcgatgccgcaaacggcattagcggcagaaggtgatgctggtttgccggaaacaccggtgaagccaaaaactgaggcggagcattaaatgcgtagacttgctaaaaatactgttctccgttagaatagagagcagtatttttttatgttcggtaactgtgttccaaagatacagttggaacactaaagcacctaattgaggagaccaaaatgaaatttatcgcaccagtaacaaaaaatgaagagatcactgcaacaattattgacctgacttatgagggcatgggtgttgctaaagtatctgattacccattgtttatcgaagatgccttacctggtgaagaagtagaactagttgtcactaaagtcggcaaaaattatggctacgcgcgcgtattgaaacggcacaatgacagtcctgatcgtgtggaattacctaacaagacttatatgcagtccggtatcgcaccgttaggccatttaagttatgctgcacaattgaagtttaaacaacaacaattacgcaatgtttatcaaaaaaatcatcttgatatcgaagttttgccaaccattggcatggctgatccgaaaggttaccgtaataaggcacagatcccagtgcgccaagtcaacggtcaattagaaactggattttaccgtaaacgcagccaccaattgattccgctggaagatttctatatccaagatcctgaaatcgatcgtgcaatcgtgattattcgcgatcttttgcggcaatatcacgtacctgcttatgatgaagcgcgcaatcgtggtatcatgcggaatatcatggtacgccgtggtcattttactcatgaaatgatgatcgttttgatcacacggactaaagatattccccaattacagaatattattagcggtattgttactaaattacctaaggttgtcagtatcatgcaaagtgtggtgcctaagccaactaacgtcgtgctgggccgtactgttaaaaagttgtatggtaaaacgtatattcatgaccaaattttaggtcacacttttgacgtttcggcgttatctttttatcaagttaaccccttgcagacggaaaaactttaccaaacagccattgatgccgcccatttaaccggtaaagaaactgtgatcgacgcttattctggtattggtacgatttcgttgtcgttagctaaacacgctaagtacgtctatggcgttgaggttaccgaagctgccgtcgctgatgctaagcgtaatgctaagcacaatggcattcataacgtaaaattccaattaggcttagccgaaaaagtgatgcaagaatggcgtgaagaaggtctcgaagccgatgtattggtggttgatccaccacgtaaaggcttggccagtacctttgttgaagctgttggcgttatgaaacctaaacggatcgtctacgttagctgcaatccagcaacgttgggccgcgatatcgccttgttgcaagaatttggttaccatgctgaaaaaacgcagccagttgatatgtttccattgacgcagcacatcgaatccgtgacggcgttgacattggactaatttaggtggataaaatagctaactctgttgcgatttgaatagctcggtaaaagttatggctaaatcagtgtcataaagaatatgacttagctttgctatgcgtttatttactctaattgataagtatgttttgtaataaaaaattttttaaaaacgagtgcaataggttaattctatttcattaatatagcaccagtaaaatagcgaaagctaattttactggtgctatttgttttggcaatcataaaggtgaattgtaaagcatgtaactaaaccgacgtggttccaatacaagtcggccaagacacagattatgttgttattagtataaaaaagaatattttgctatttatataattacagatgtgatcaagttaataatattattaatctaataatggtgttcattcaatcgagcaattaatttcaatttactaaattaaaggggaaataaacgattaaatagctattttttaaatgcatagataaatatttaaataatatatatctattaatgactattagaataaccgctgattaataaaactaattaattttttgtgcgataaatgtatggacttttgctgttaattattctcttgaaaatgctgtcagcaagtaattgctaacttactaatcgatcgtgctagtcagcagatatgcttaatctttatttatctgcgctataatagcgattttagaaataaaaatgatggacgaaattaaacctattatttattgattgcaatagtgtaagcaattgaaactaattgcttagtttatattataatctataataataaaaaatataactaatgacgataacaaaaaaatataattatattaattagtaaaaaatagtttacttttatgataaaaggtttattattgtatttgaatattgtgaaagcgttatttgatataaaagattattaattttgctattgggagcactggcgttgaaccaatatttaaatttataatgttgaattactcacttttggtcaaaaaaattaggagatgttcatatgcagtggggaagtaaaaatatttctaagcgtaataagaacttacaattacgtagagaaacaagcaaaatccattatcggatgtataaggctggcaaattttggctattcgctggattaactacgtttaccttagcttttggccctggagtagttgtccatgcagatacggtaaatacaactaatgccgcaacaaccacacaatctactacgacaaattctgatagttcctctgatggcttagctactagcgataaagcatccgttagtgagtctgcagtgaccgctgctttggcaagtacgaattctactgctgccagtacaacaaatgcagacacgacatcagttagtgctgagtctaataatcaaagtactgtggcaacagaaaacacaaatactagcgtgacaagtaccgctacaactagcgaagcagcagttagcgctacttcagcgagttccactacaagtacggcgtctgttgctaatagtgtagcgacttcaaacgcaacagcgacaagtaacaacgctaatgatcagagtactgcggcaacagaaggtactaatacaaacacaacgagcgttgcagctacaagtgaagcagcgactagtgcaacttcagctagcacagacgtaaacaacaatacaaattctgcgacggatgcgacctcggctgcaggctcaacagcaatcagtgctgaatctgatgcgcaaaatattgctacaccagaaagcaccaatactgctgagactagtacagcaacaactactacagcaagccaagcaactgatacgacagcacaacaagctgccgatgatactgctactacggcaacacctgcagcttctacagccagcgtgatcaataacgcaatggtttctgatgtagcaacaccaacaacgactgcgaaagtagataacgtgacttcggcaagtgccatcgccaccgcggctaattctctagctacttctgctgcagtaacaacgttggttgatccatcatccgcagaactagcagcagctttatcttccgcacaagcagtttatgagcaaactggtgtagtacagacagttattgtagctgcggctgctgcaacagttaatggagtaggaccagtatctgctgatccaagttcaattattggaatctatttgactactggtattacatcacaaccaaccagttcaacggttgtagttgaaactagtgcagctgtcaatgcacatttagaatatgggatcgttgataatttaggttcacttgcagttgcgggtagcacattaggcatcatccaatttgtaccatcatatacgttatattcaagcacagatggtacaaactggaaaaaagttacaaccagtagtactggtaagtttagtgtgacaccaacaactgttggaacagtatattatcaagtcgaggctacagggacacttaaaatagcaggaggattatttaatgtgcctctatcaaattactactcagatgtcgtcagcgtcacggctgtagctgcaccggtaccggcaacatcagtttcggttacaaccgatgctaactatttaattgttggtgcaactgttactacaagcaagggtagcttaacttataatgggactactcaagctacagcaacgctgacaccaagtggttctaccagtaaagtgacttcatggacttcaagcgataattctgtagcaacagttgatcccaatggcgtggttacagcgtttggtaaaggaacggcaatgatcacagcaactgttacaaacagtgatggctcaaccgtttcgggtacgagtgagctgattacagtcggcactggggttgatgacgagactgttcatgcaggtgaaacagcaacatttacagttaatggtattccagcttctgcaagtggaactacaatcacttatcagtggtataaggcagatggtactaaggatggtactaaggatggtactaaggatggtactaagatttctggtgccacgggcacaagctatactactgctgcaacgacaaatgcaaatgatggtgatcaatattatgttgttgcgaccatttctgctaaaggacaaacagaaacaatcccaaattgcaagaacaaattagccacacgataaatcctattaaatcagtattttcattaatattcatattttatggacttaacttaaccggcggaagcagcggagaaaagcgctttgggtgtttg

SEQ ID NO: 566 - DNA, 1137 bp, Unknown
  Metagenome-assembled genome
gcactcctttgtatcgtggtttagacgactcaagtatacttcaaggagctgcttgtgtttaatcttgggctaaaataacttagtgcaatcaggtttagctgggttttgaactttcacggtttagttaaaacaagtaaaaatacagcagttgacgttaacgtaggccattttaattacactgatggtgtgatcaatacgttacctaaacgtttgaataggctgtatcagcgcattaaattctatcagaagcggctggcacgcaaacgggtcgtgaacagcaaactagcaactaagagcaataattaccggataacgagagccaagttacaaagggattattgccgagttaccaatatccagcacgacatcatgcaaaagttcacgacccagttagtcaccgattacgacaaaatcgttatcgaaaatcttgcagtcaaggacatgcagatgactcatgtggcttcaaaaggtctgcaacgctcaatgtttggttattttcggcaagtattgagctataaatgcgactggtatggtaaggtattgattctcgctgataaatattatccgtcaacgcaacgttgctctgaatgtggccatatcaagtcaggtattgataaaattacgttgcaaggcaacaccgcacataagaccaagcaccatgagtacatttgttataattgtggggtaacccttgaacgtgataaaaacgccgtgaccaatttattgatgctaatttaaaacaatttatattttgaaggggcaggctttgccctgatactgtcatagttgatcaatgtgattacgcccttgtggaatatcggaatatcagcgcgataacgacagtaagcaaaataaggaaagaaaataggcaatcttttttctaaagtagtaaccaaataatttactatattttgcatagcagagtacaggatttgaacctacacattgatgtcagtcgcttcagtttctcaaaataaattcataaagtccctaaagctagcgactatatgtgcgataatccctttatggttgtcagatgaaatacaataattcatctaacaactatggagggatttttgtatgcccagatctaaacatacggtactcgaaaaattagcaatcttaaaggaacttacc

SEQ ID NO: 567 - DNA, 3118 bp, Unknown
  Metagenome-assembled genome
gggcagtaacgaacagcttaatgggctactaagagaatttatccctaaaggtcaatcaattaccagtttcagtgatgatcatattaagcaagcgaccgcggcacttaaccaacggccacgtaaactacttggttataaatcagccaatgaattcatggctgagcagctactcgcatgaccaccacctagaccacttataagtgaagtttagcaagtgttgcacttgatttgacaattcgggcatcactaattattccagtactaatgtctgtaagcacgcttgccattcactgataaaatccgttccaaatttccattcgtagtgacgtttggtgccatagcccactggccggcaaaaataagtggtcccagcaatttgccgcggtggatatttaaaatgcgtatgcccaaataacgcataagcaacatgataacgacttaacaaagcccctaaacgtggtgaacccatcaaggcattagccatctcccagtgcggttggcgcgggacatgactgatatatgcgtcttgcggcacaaaatgcgtcatatacagtacttgcttgtgttgcgcggcggcttgtgccaatttagccgctgtatcgcttaaaaccagctccatacgttgccgatcactcagcggttgttcgatcgcaccatcgatccagtaagcccgcttccactgggcaaaatcagccgctgttttatctggtacttgagcaaattggtaatcataccagccattatttccaatcaaaacatagttggtaccaggaaaatcgatcattttttgatgtacatagtgcccgttgaccccactttgtaaggtagcaaaatcagcaccacgcaccatatcgtgattaccggcaataaaaaacacacgacattgtggtgccaagcgcttggccaatgcttcaacgtaagcgacacttgcggtaaaatcattgaacagatcgccagcaatcaaataatcggtgtaatgctgcgctaacaaataagcagcctgctggatcaacaattcgtttgcatcaagctggttcacatcaaaatgattatcactggtcatcgcaattttacgcatcgcgctcaccccataattatagaaaataaaaaatgtgtcaggcttagcctaacacatttttatgattttgttctctagagtgtcttagaattgattttgcggaaacgtgttaattaataccttccatcaatcccttgatcttcggtaccatgaagcccagtaaaataccaaaggccacggtgatgatcccaatgactgcgaaatacatcatttggttagctggtgtatacaagcgcacgatttgggcgttgattgcttgggcagcagcgtcacctaagaaccacatactcatcatctgcgactggaacgcttttggcgctaacttagtcgttgctgacaagccaactggtgagatcaacatttcaccaatttcgacgattgcccagctgagaaccagccataaagcgctgacccgttgctggccgaacaaggaaacggggataagcataaccaagaaggaagcaccagcaaacagtaaaccataagcaaacttagctggtgttgatggttgatgtttacctaatttgccccagaaccaagcaaagattggaccatataagataatgaataatggatttaatgactggaaccaagatggtaacaagttgataaagccaagattcaagatcgtttgatttttagcaaataaggctaatacaacagagccttgttcttcaattgaccagaacaaaacactggcaatgaacaatggtacataagcccaaacccgtgagcgttcaactttagtcgttttacgactagaaagcatcatgacgaagtaaccaattggcaacaatacccctaggatactgaagaccaagatcacattagtaacattaagtttgccggcaaaagccatcaaaccaaagaccacgatcgcagcgaccacgatcgcgacaattttacggatcaagcctgctttttcatcttcagaaacaggatcgctgggacgattactagattcattcaggtttttaccgccacgccagtattggatcaaaccgaagaacatcccgatagcggctaaggagaagccgagatgatagttgacttgctgaccgatcgaaccaacgacgtatggtgctaaaagcgaaccagcgttgatccccataacgaagatcgtaaagccagaatcacggcgtacatcgtcttcggtgtacaacgtaccaaccatttcagaaacgtttggcttcagtaagcctgtccctaaaacgatcaatgcaatggagccgtacaacgcaccttgaccaaatggtaacgataagacaatatgtccaatcatgatcagtacgccaccccagaaaacagtccgccgactgcccagcaaacgatcggcaataaagccaccgatcacactagacatataaactagcgaaccgtagatcgacatgatcgaagcaccagttgcttcatcaaagcctaagccaccgcgcttaacagtgtcgatcaagtagaagaccaacaatgcccgcatgccgtagtaactgaaacgttcccagaactcggtaaagaacagcgtcattaacccacgcggttggcccaagaaggttttttcctctttgttattcaattttaacttcctttcaccatttacttattctcactaatttctaacagcaaatacataaaactatagtcacccaactaaattgctatatgtaacctgttgtcacattaaaaccgctgataattaagtgcgaacttcacatcccttttagagcatagaattttcacataatgaatattataatgcaaagtgactagcagcgtcaattagtaaccgcttttcttagtatatccacagcaatttattgtacgtgtggtgctagtttgtaacatttagaaatttaacaaaaaagtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 568 - DNA, 1028 bp, Unknown
  Metagenome-assembled genome
ttcactccagtattcatctggggtgaggccgtttctttgtgctgagcgattgtggtgattgaaatattcgattccttcctcaaccagtctcacaagctcttcgcaagtctttgctagtggatggcgagccatccaccgtaacttgaattcgttccaccagcgctccattggtgcattgtcgtatggtgttcctggtcgagacatgctacgtgtgacgttgtaacgaccaagaaagttgttgaaggcaccagaggtgtaggctgatcctcgatcagtgtgaaccaatgggtggacgtcaccagaagcctcaaaggctcgttggaaaacctcgatttctgctgctgatgtttcagtagcgctcaaattgtaggacaacaaacgtcggccgtagagatcaaggacgccactcaagcgcaccttatacttattatttacgccgtaagtcagttccgtcgaatcggataaccagacctgattaggactgtcgacgtcgaagttctgattgagcacattgtcttgaatgtgctgttcgttctccttatgtcgactgtgcttcttgacccgaatttgacatgtcaagccaagctcccgcatcacacgacgtaccatcttgaaagtaacggggaagtcaattagttcatcatgttgaagattcactaaaagattcccagcaccgataccttgatgatgaaaatcaaaccagtattgtgtccgttccttgagctgacgattacgggtttcccaagcagtttcttctcgatttaaccctttgtagtaagcctgccggcttacaccgacaacggccaacagcgtagatactgcaccgcgcttgccttgactgacctcattaattgcgaagtaagacagtcgatgttttttactcaccccctgcgctggagttccagcaatttttttgcgaatgcctccacaagctctttgtctgcgagctgtgctttgagctgcctgatttcaagattggctttatcgagttcagtcagttcagcttgttctttgtgatggccacggtt

SEQ ID NO: 569 - DNA, 1208 bp, Unknown
  Metagenome-assembled genome
gtgatgacggcattcccatttacccccttcggcataaaattttaccccattaagcgaagaaattgaccaagttctgcaaaagagattgaccagccctaaggtacctcttgtataatgtgatagcgcatacattgcgtaattatattatacaggaggttttttatgtccattcagtatcgtaagattcttgagctccatgctcaaaaggtcgtacaacggaatatcgctgcagctacaggtaattctcgccccaaaattgcagagatcatcaaacgggcaaaagaagaagtgttagtaccaccgttcactgatgaaatggatgacgaatggttcgaagcgctacttttcccgcataaaaagcgtgagtctaaaggcagacaattgccagattttgaacatatccatacggaactagctaagtctaatgtgacgttgtcactactacactatgaatatgaggcaatgtgccgtcaaaataatgttattccctacgcttaccgcacattttgtcagtattatcacgaatatgcacaaaagtataaagcgactatgcgcataaagcgtaagccgggagaaactatggaagtagattgggcaggtacaacattgtctctaactgattcagatacaggagaaattgttaaagcttatttatttgtcgccacactaccgtgtagccaatatggctactgtgaggctcgcttgtcaatgaaacaagaagattggttagttagtcatattcacgcttataagtactttggtggggttacggaaatccttgtcccagataatttaaaaactggtgttaccaggcaccgatccggagaagctgtgcttaattcgacttaccgcgaattggcaagtcactataacacgattatattgccggcacgtgtccgaacacctaaagataaagccaacgtcgagggtagtgtaaagatcctttcaacttggattatcgctgcgctacgtaacgaaaagtttttcacattaatagaattaaatcaggctgttagggaaaaattagatgagtttaatttgcgaccattcaccaagaaatataaaaaaggtaaccgtaaagacgcttttattagcgaagagcagttcgcattacagcctctaccacgggtaccttataaaatggcaacctggaaaactgccactgtacaattagattaccacactaatgtggagaatatgttttattc

SEQ ID NO: 570 - DNA, 6368 bp, Unknown
  Metagenome-assembled genome
acatgaaagcagtgtttcaaacgttcaaaaagaacttagtggttgtactcaacgccagtgaatcggactatacgaatggcccagtcgaaggcatgaatcgaatgattaaacaaattcaacgcacagcatttggattccgtaattaccatcatatgatttcacgtattaagttacggcaaatgcgaacaaaaccaatgaaaaaaacagagttgaaagtcgcatgactttcaactctgtaaaagctattcatcaacaggatttgacaaagagcccttttttattacccttgggtcgggttatgcgtatggctcggtgctgtatcaggcatagcgttcaatacgtccatatcagcagcgctgatttcaaagtctaattgagtattagcctgaatatgcgcttcactgaccgctttaggcagcgggagcacatcgttttgtaagcagaagcgcaaagccagttgcgcaacgctaacgttgtatttagcagcgagggccttcatttggtcgttttgtagcataccaccggtggctaaaggagaataagcttctattaaaatatcattatttttagcaaattcagtaatttttggttcggtaaaaccgacataatattgaatttggtcgaccatcggcttgattttagcggtgggcaagatgttttctaagtcatgaacgttaaaattagaaacgccgattgctttaactttgccggtggcgtagatatcttccatggcccgccaaacttcgatattttcttggtcgcaattcttgccgatctcggtccatggccaaggtgcatgaactaaataaagatctagatagtcgatatctagttgcgccatagtgctattaaaatcagcgatggcaccatcataagttttagtggcgccaggtaattttgaggttacaaaaatatctgctcgtgggatgccagattcgcggatcgcccggccaacatcagcttcattgcgataggctttagcggtgtcaatatgtcggtaaccagcctttaatgcggttgtggccgcattaaaagcggtatcgccgacaggaacttgccacataccgaagccgacttttggaatctcaacgccgtttgctaacttaaatgtttccgttaaaattgccacgattttccacctgcttttttagtttacttgaacactcttattatacgcatttcgttaaagaaaaggctttattatgatcaactaaattaaagcaaaagattaattacaggcggattatatggtaatatagtgacatcagtgagcagatgattggtcaactttaatcgtgaaataggagcttgagatgcaaaaaaataaagcttatcgtattagtattctcgcaatgtttgttgctattatcatcattcaaaattttgtaccgttgttcggctatatccctttaggtttattggatctaactacgatccacattaccgtgatcatagcggcaatcattctgggaccaaaggacggtgcattagtcggcggtgcgtggggcttgatcacgtttattcgtgcgtttacatcacccactagtccattggcaccattagttttcaccaatccggtggtatcgatcgtgccgcgaattttaatcggcttagttgctgggtggttattcatttggttacagcgtaaaattaagcgcacgccagcaatgatgttggcggcgttagttggcgcactggtcaacacaattttagttttaggcttgatctacctattctaccggacgccggctgtcgcacaagcttacggaacggctgatgtgagtcggttaggtggtttattattagtggtcgttgcgaccaatgggattcctgaggcaattttagccgcagtggtggcaccactgatctgtacaccactattgcggttccgcaaacagcgctaaataaaagacgtaacattggatgtaatttccagtgttgcgtctttttagttaggctagaacctggacacccagtccgatcaacccggggccagtgtgcacaccaagtgccggtgaaacattaccggtaaaaatatgttcagcttgcggataaagctcgtgtaattccgcggtcagttgtgcggcaatctcgtgattagcaccatcggcgactgccaaattaaagcgttgcgcgttgccgatagtttcggctagtagcttcttcattttcaacaatgtttttttctcaccacgaactttggcaacggggtagtaaatgccgtcatcgtcgcaagaaataattggtttgatgtttaacagcgtgccggccatgccagcaacacgaccgatacggccacctttttgtaaataggttagcgttggcacgtagaagaaaactttggtgtgtttggcaactgtccggattcgtgcctcaatctcgaccttgtgcaggccttcttcgctgagttgggctgcgaggatcgcagttaagccgctagcgataccgatgttttttgtatcgatcacactgacgtctaggccggaaacacgtgcagcaatttcaacttgctgaaatgtaccagataagccgctagaaatacaaacagcgataacttccttaaagccgtccgctttgatgtcggcaaaggctttagcaatcaggtcaccagttggtgaagcagttttcggcacttctttatctagattagcgtaaaccgtgtccggatcgatggtgactttatccaaaaaaatttcatcgtgataagcaatcgtcattgggaccatgtaaagatgatgttcagcaataaagtctgctggaacgtcagaacaagaatcaacaagaatagcaacgtgcgggttaattttagtcatgggtaatagctcctttttcaatttgtggtgcgtgcagcatcagccgtttgctgatcaattggtaaatgatcgtggtggcggcagtctgttgaatggcttcatcccattcaaaatttttggtaaaaggtaatggcgtactttgcgccagatcaagggtctgtaattgggtcgtaaaattagcagcaaagcgatcgtaggctgcttgtgccgataagacgtttaattcaccattaaagccgctacggatcatatctaatggaaatacggttttgagcagggtcagcgtaatgaccgcagcgagatgttcgcgctgatagcgtttcttaacgggtttaaacatgaccttgtgtttaacgtaattattgatcatcgctggtgtaactggatccagctccagtggcgctaggtactggttgaccaaattgatcagttgttccatataaatatcaaaatcaggaaaatcggcccattgcggtaattttagggcctggatttttgtgagccatgcttgaaagtcattttcttgggtggacataaattgactcctttcaccaagtaggttattgatagtataaacttgtaatctagttttgtaaactagattacaaagttgattcgatcattatatgtgagagcagagtcaatattgaacaatgaatgccgaaacttgtatctatctagtcaagcttttaaaataaagttaagatttgaaatgagccatgtttcaacattgtggaagcggaggaaataacatgacagaaaaattaacgatggcggtgattggctttggtaaaagtgccacacgctatcatttgccgtatttgatgttacgcgacaatattcaagtaaaatgggtttatgcgcgccatttaaataaacggccagcggaacaagaattttacaagcagcatcacgttcagttcactgataacgtgactgaagtattagctgacccagcggttaaattagtgacgatctgcttgccgccagcgttgcattttgcctttgccaagcgctgtttagaagctggcaaaaatgtgctggtcgagaaaccatttactagcacggttgcggaagctaaagccttatttgatctagccgctgagcataacttattagtgatgccgtatcaaaatcgtcgctttgatggtgagtttttagctttacaacaggttctgcaagttgggtacttaggtgagccgctggaactagaatcacattttgatcattttcggcctgatccggaagttaaacaaggagcaccggaagatggcgccttttatggcttaggtagccatttagttgatcaagtagtggcattatttggtcggccccaacaggtcagttacgatattcgagcgcaacagaatccggctagtacggttgacgattattatgatgtcagtttgttttatcctaatttcaaagctacggtcaaaagtagctcgctagtggcgcaaccctatccgcgctttattttgcatggcactcaaggtagtttcattaaatatggtattgaccaacaggagaatgacttaaaagctggattaacaccggctgcggcggggttcggggaagatagtccgaaattctttggtgagctaaattatcaaaacgctaatggtgattggatcaataaacagcttccaacgccgcgcggggactacggtcgggtttacgatggtctgtatgaaagtattatccacggtgccgcaccactggtcagtgctgatgaagcaattactgatttggcaattttagctgctggctttagtcaattgagcccaagcatttatcaactataaaaaagattaattacttttccgcgaccaattttggtggcggttttttatcatacttttttatataaaatattgattattgttataggaatatatatagataaatatatatttatctacttgaagtgattgaatacggtaacaaaatatgctttaattaactttgttaagaaaagattaataatatgtgactgttcgttttacataaagcataaatagttgggagaatagattatgaagaaacacttgcttacttatttatcagttagtgtgttacttttaggggcggttgcaccgagcgtgagcgctttagcggtcactcctgtgtctgctgcggaacagaccagcacgactgcaccagatccaaacaatctggctgatgggacgtatacaatcgacgcgccggtaatgaagacaggaaccaagacaccttctacggcgcagcagtttattgataagtcggctaaattgtctgtgaaaaatcatcagctacaattaacattacatatcaagcaaggcgcaggcatgattgctgatgttaaaacatcgagcaataatcaaccagtgacggtcagcaatgatactagagaggctaaggatttaacgttcaatattgctagtttaacggcggttactaatttatcattgacgcttaaagtaggcgcgggaacgccggaaaaaatggacgttcagccggcccttgctactttaaaagttgttcaattagatcagccggcagttagctcgtcatcggctgctagtagcagtagtactgccgatgaaagcagtcaggtcgttcagccaagtgcggctagcagtagtagtgccacaacgagtcaaccaattactgaatcaagctcaacgcagtcggtcgcggcagcaggttcatcggcctctaaagctgattcagccgcaacgcagccaaacgtaactgagtcaaaagagtcaacaaccaagcaagaatcaacggctaaacaggaatcaacaccggctggtcatgattcagctagtgtagtaaaaccggagacaacaccggaaaaaacggcaacgacttttgatccaacccatttagcggatggtacttaccaagtgccggtggcaattttcaaaaagaattcgactactgcatcaatggctacaagttattttgccccaactgcaacagttgtagtgagcggggatgcagttaaagtaacgttgcatgtaattaaaaatgcatcattgatcaatacatttaatttaggtgggcaaacggcgacaattagccacgcaactaatgcgacagcagatttaacttataccgttaacagtcagtttaagcgtacaacggttcctgctgcaatgatgatcactattccttggcttaataaaatcatgaaccaggaagctgatgttaagtttggtgaggctttgtatgtcgcaccggacacaactggtaacgtaacggacgaatcgaaaaccgaatcagaatcaaaaactgaatcagaatcaaaaaccgaatcagaatcgaaaactggatcagaatcaaaaactggatcagaatcaaaaacggaatcggagtcaaaaactgaatcagaatcaaaaacggaatcggagtcaaagaccgaatctgaatcaaaaactgactctgcatcaaaagcagagtcggaatcaaaaacagaatctagcgcccaatctgaatctacaactagacacaccgctacctttgatcctactaacttaaaagacggtacctacgagatcccggtttcgt

SEQ ID NO: 571 - DNA, 36805 bp, Unknown
  Metagenome-assembled genome
aaaagccgaatcggaatcaaaagccgaatcggaatcaaaagccgaatcggaatcaaaagccgaatcggaatcaaaagccgaatcggaatcaaaagccgaatccgcatcaaaggccgaatctgaatcaaaggcggagtctgaatcaaaagccgaatcggaatcaaaagccgaatccgaatcaaaaactgaatcggaatcaaaagccgaatcggaatcaaaggccgaatccgcatcaaaggcggagtctgtatccaaggctagtgaatcaaaaaatagcagtaaagtgactagcagttcaagtagcaatagtgctaaggagtcaagttcagcggcatccagttccagcaagccagacacgaccgttaatttaccggtattcgatcccaataaattgacggacggtgtttatcaaacagatgtaacgatcttaaaagatgacggcgtaactgcctcacattcagctagcttctttgctaaacaagcaatcgtcacggtgacagataaaaaagctaaagtaacgttgcacgttacgcaaaatgcggcgatgattgcggcgtttgcgttaaacgagcaaaatgcgacgatcagtaacccaacgcaaaatagcgttgacctgacttttgatatcaacgctaagttcgctgtagcagtggtaccagcaacgatgacgatcaatgtgcccggtatgcctgcaccaatgacggaaacggctaaagtgaagtttggtcaggcattgtacgtggcgccaactaatgacgaagcgcagaccgagtccgaaccgaaagctgaatcagagtcaaaaactgaatcagaatcaaaaacggaatcggagtcaaaaactgaatcagaatcaaaaacggaatcggagtcaaagaccgaatcggagtcaaagaccgaatctgaaccaaaaactgaatctgcatcaaaagcagagtcggaatcaaaaacagaatctagcgcccaatctgaatctacaactagacacaccgctacctttgatcctactaacttaaaagacggtacctacgagatcccggtttcgtttttgaaggaaactggtaatgcagcttccatggcaaatgggttctttaagcataccgcaaccgtcaaagtagtcggtcaaaaagtaacggtaacattgcatttgacgcaaggtgctggctatatttccgaatttaaattaggtggtcaaaagtttgcggctacaaatggcgataaaactaaagttgatttgacttttaatgtcgataagaattttgccacggcgatcgtaccagcaacgatgacgatcagtgtgcccggtatgcctgcaccaatgatgcaaaaggcgcgggttaaatttggtcaagccttgtacgcaggtaatgttaaaaatagcaatactcaggaacatagtagtaagcctaagccaagagcaccaagaaccgagctgaacttaactaatttgccggatggcacttataacttaaatgtgccgatcatgcaaactggcttaaccacagcttcggcggcgcagcaatttatcagcaaaacggctcagttagtcgtgagcaacaacggccgcacgcttaagatcgttttccacgtgaccagtggcttgcagtatatcaaagggatgaccttagctgggcagtcggcgcagatcgttaaacatagtgccacttcagctgattttattttcccaattactaaagcaatcttagctggcgttgccaaggtacatttcagcctacacaatctgccaggaataataaaaaacgataatttagaagaagatgcggtggcggtctttaatttgaaccaccagccattggctagcttagttaagaaagcgactaccccgttaggcaacgtggctagtggcaccaatttgttggatcctgatcagcaagtgcagtacgtgccatataaagtcatgaacgaaagcagaacacagttatccacggctaataattactacacacacacggctaaagttgtgaaagacgctagcggctataaggtttatttaaccgtacaggcaccaacgggttacgttaaattccaaccgttgtcagtcaactacggtggttataccgacttgcgtcacagtaacgctggcggtaatgacgtttggacctacgctttccatattgacagcgcgactggtttggatcagccgatccccgcaacgatcagcatgacagtgccgatcgctggcatcagcaaccagcaatttgaagtgtggttatccttcggcaaggcgcaaggtggcggcactaattatttagctgcagccaacgcagcaacgacgcaggggttaccggcgacgacgatcagcttggttcaagcagcgaatggcaacacgatcttaccggccgccggcaccagtttaacggcaattagtgccacacaaccaactaaagcagttaaagcgactaaaccagctaaaacagcggcgaataaaactaaaaaagttgcggcggcaaccaccattacagcggcagagcaacaaaagtcagctaaattaaaggattatccatttatggcagaaattgctggctttggcgcagtggcgttagtgatcattgggtttgccgtctataaacggctgcatgtgggagagtagaaaatgaaacgaaaaataggacgattaattttaggggcggtactgctgctcgtgagttttacagttagcgcaaaagttggcgcggaggcgatcaattatcaagccttgaaatatggcacacagcaaacgtcgatggcgtctaattattacgttaagccggcaaatgtggtagcgaacggtaatcaatatttggtcacaatgacgatccataccagcacccaattaggtgaatggccggtgacggtgctcagcatcaacgggcaaggaccagcgaacgtcagcaaaacgcaaagtgctagcggttatgactattcttacgcctttcaaacacctaatttaaatcaagtggtcaatagctcgattgccatcaacgtaccgaatgtgtacacggccaaccacgatattagctttaaatttgataccagtcatttacctgcactcaatagcgctgcagctagtagcagtgcaccagcggcggttgccagttcagcagcgagtgccagtagcagtgaaaacagtgccactagttcaaatagtaccagcagtgagagcagtgcgatcagttctagcagcgccagtagtcgtgccgctagcgctagcagtcagaaaaaaatcgttgcaaaaacgaccacaactagtgtcactcgtaagcaaaacgcacagattgctgctctgaataagaaaaataaacaaacgcagacggcaatcttgactggcggttcggtagcggtggcaattttagcggtggccacgtacttctttatcaaacggaaataattaggtgagttgaaaatgaagtcagcacgtaaattagtttttattttattagctgtggtattggtcgcagtactgggcgttgtcgcttggttacagttgcggccaacgcctcaagccacccagcacaagcaaccgcggatcgtagcgacaactgtagcggtcacggaaatggcggccaagctggatctgccactggtcggtgtgccaacgactgccaaccagttgccagcgcgctatcaaaaagtgaccaaagtcggcagtccaatgtcaccaaatattgaaaaaattgctgccttaaagccgaccgccgtttattcagtgacggtactaaaagagcagtatgaggcgacttttaaatcccataaatttcacgcgcagtacttaaatttagatacagttaccagcttgaaacaaacgttgacaacgttgggtcagcgttatcaacgtcagcagcaggcacaccagcaagtgaaattgatcgatcaagcggttaaaaaggtgcacgcacgacaacagggtgccaagccacaagttttggttttaatgggcttacctggtgctggctacatgatcgccaccgatacctcctatatcggtgatctcgtacgcttggcgggcggagaaaatctttatccagataaaacacaaccctatttaacaccggataacgaaaaactagcgcaacaacgacctgacgttattttacgtttagaacacgccatgccagaagtggtcaagccgcaattcgagcaggaatttaagcaaaacgcaatgtgggcgcaaatgccagcggtccagcaacggcgcgtttatgatctacagcaacctgaatttgacgcgacagccaatatgcatgtggttactggcttacagcagatcagtcgctggttatatccggctaaggaggcgacaaagtgaagcaacgttcaatctgggcttatatcgtgctattggttgctttgatcgcactattggctgttgccttgctgcaaggggcaaccacgatcaacgtaacgcatttaaatgcacagcagtttaacacgctgttcaatattcgcttaccacgaatcatcgcggctttagttagcggggcgatgttggcgatcgctggtgctttttttcaggcagctttgcgtaatgcgatcgctgaccccagtattttaggcatctccgctggtgccagtttatttcaactactcggcagcttattgttaccagcattactgttcaataaatttatttttgcattactaggcggcttagtcgcctttttattgttacttcaatttcaaaagcaaatggatccctaccgcttgattctgattggggtggccttaaacgctatgtttgtggggattcaacaaattttcacgccagcaaccagtctcggcgggacaacgtttgcgactagtacatggacgaccacactctttttagtgatcctcggtattattggcttgatgttggcattatggctggcaccgtgggctaattatttgaagatcggcgacgcgcaattgcaaactttaggcgtagcagtggtttgggtgcggctagctttgttgctattagcggtttatctcaccagtacggtaacagccagtgtcggtgtgctgccatttatcggtattatcatcccccatgtcagccgctattttgtcggtcatgattatcgacaagtggttccattttctgtgttagcaggagcttttttactgttactatcggatacggtgggtcggttggtggtcattccaaatgaactgactgccgccacgattttagcggtgatcggtggcccatttttgatttttattttagcgcggcaagggggacagcgccatgcaagttaaacaattgagctatacctatccgcaacaaaaacgggggattgatcgtttggattttacgatcgaaccggggacgatgacggcggtgattgggccaaatggttctggcaagtcaaccttgtttaaactattggcgcgtgagctcacgccgacaagcggcacgattgaattggatcagcagacaatcactgacttttcagctaaagcttatgcacgtaaagtggcggtcgttcatcagcataatttattatatgacgatatttctgttcttgatctggttcgttttggccaattaccataccattcgctgctggcggaacctgatgatgtcgcaatcaaaccaattttggattatttagaattgacgccattgcaacagcaaagtatggccgaattatctggcggacagcagcaacgggtctggttggcgttggctttagcacagcaaccggagtacttgctgttagatgagccaacgacttatttagatcttcacttccaagctagcttcatggaattattggctaagttaaatcgagaaatgcatttaacgatcgtgatgattttacatgatttaaatcaggcgcgccattttagtcagcaggtactgatgttagcggatggcgcaatcgttgctgctggtacgccacaagctgtgatcacaccggcacggctgcgcgaagtttttcaaattaatactgaattgatcgcgacgactcaaggtgagtttatcgctcaattgcctaatcaatcgacagcaaattagttttgctgccgttttttttgtgtagtagtgacgcaaaattgatttgacaaaaaatttagtttgcgcgatactcataaagttaatggtatatactatatagtgcattaattaaaaatggaggcgatcatttcatgcagacgatgaaaaagcattcacgctttttattattactaggcttaattgtcattattccattgctattattattcatcgcaatgaattttgttgcatatgagcaacaaactagcactagccggattaatgtggcggtggtcaatcaggatcaacccgctaagtttcaaggtaagacggtagcgttggggacgggtgtaaaaaaacaattattacataatcatcaagttacctggcattttgtttcggctaaagtcgctaacgcgcggcttaaagatggcacttatttgatgaaagtgacgttgccgcataatttttctaagaatgcgaccacggcactgaacacgaaaccaaaaaccagtcaaatcaaggtggccatgtcagatcataacaattttgcttctcatttgatcacacaacaggttgctgaaaaattacgcgccgaagtggttgctaacgtacaggcagcttacgatcaaaatgtgtttactgcattgaagcaattgggtagcggcgtcagtcaagcacatactggtacccagaaattaaaaacaggtacagagaaattaagttctggtagtcaacaattaagcagtgggctgaatgaactaaatagcaagacagggacgctgtcatcaggggtctatcagctgtattcaggtagtgcaacgttacatacaggtgttggtgcctacacagcaggcgtcagtcaattagctggcggtatcagtaccttacaaagtagtgttggtccattagctagttgcgtgcaaaagttagcaactggtggcaaccaattaaataccggggttgacacctacacaaatggggtgcaacaactcgctactggtatcagtaccttacaaagtggtgttggtccacttgctagtggcgtgcaaaagttagcaactggtggcaaccaattaacggcccaatcaagtcggctaactaatggggctaagcaagttgctactggtattaatacgctgcaaagtaaggttggtccgttagctactggggtaacacaattggctgatggttcaactagcttgcagaatgggatttccgcctatacaagtgggacaaaatcagcgcaaaccggaagtcgtcaattggcgtctggattaggccaagtcaacagttccgtacaggctttaccagcaaacgttactaaattaaatacggccttacaacaattagagaccggcagccaagctgttgctgatggcattctaaaagttaatcaaggtgtaactagccaagatacacaattaacggcattaagtactggcttagagcaaatgaaaactgggttgacctcattgcatgatcaggtcaatagtacggatgtcgccacaacgattacacgattacaaagtcaggtgagcggcttacaaagtgccgttacaacaacaaccgacagtttgacaacgattggcgcgaatactgctagctcagctaaagctgttgcagcaatcgatgccagtgcggttcaagctagtaatttaagcgcggcacaaaaagctgcgatcaccggggcaatacaaactgttggtagcgcccaacaaagcaatcaaactgaattacaaaaaattcaaactgcgttaacacctttaaaatcgatcgacgtgacccagctaaaaacattagctgctagcgttcaatcattacaaggggcaatcaatcaactatatgctggttatgtaactggggcaaacgggcaaacttcattatatgctggtagcttaagtgcaattaaaggcttacgtgatgttgctgccaatactggtaccagcagcgaactatatcaaggagcaactcaagtgactggtggattaacgcaaagtgttactggcgtcaatgcattgtcagcacaattaccaagtttaacaacggcattagcgcaacttgaaactggtgccaatagtttaaacaatggtttaactgacataacggctaattcagctaaattaaattctggggcaacgcaattaaccggtgggatcaacacgatgaatagccagttaccaactttaacgagtggggtcaatcaattggcttcaggctcgaatcaagttgctagtggggttactcagtacactgagggcactggaaaagttgcggctggtttgaacacgatgaatagccaagtaccaacgctaacttccggcgtgtcccaacttgataccggcgcgcaaacgttaaatgctaattccccgacactaaaatctggtgctggacaattagccgctggcctgaatacactgaacggtcaggtaccaacgctgacttccggtgtgacccagctttatacaggttcacaaacgttaaacgctaattccgatgctttaaatacgggtactaagcggttagccggcgggttggccacattaaataatcaggtaccaacactaacttctggtgttaaacaattagatgatggtgcaagccaattagatactggtttagcacaggaaaatgctggcatgttgacgctgaataataagttagctgctggtagccaacaagtcagcaagctgaactttacttccgctaatgttgatcattttgtgactccagttgcgaaccaaacacaggcggataatttagctaaaccgttattatctgtgttagcaccattagtgatcttcatggtgctatttatcggcgcagtcttgaccgaactaggtttcaatcgttatagtcaacgtttccaagcacaaccacgtttgcagaaattcggtttattagccgctgcaatcgtgctccaagctgctggtattttggtcgttactcggtggatgggcgtcacagtggcgcatccaatgacgttattgctgttattgttactgggtagcggactatttacattgatcgtctttaactttgatcgttggtggggaactttaggcgttttagcaacgctagcgattctctttattcaactaattgtttctggcggcttattgcctaatgcaatgttatcggcagtttatcaaggcattagtactattttaccgggcacttatttactaaatggactaaattacgcgttaaacgatttggcgactaaaccagtgatcaatacagttattttatttgtatttattgttatttttagcctaccatttgcctttaaacgacaattaaacgcgctaaaacatgaataatatggtacgctcaatataaacgaataagaaagcgagtcattcatgatgagtcaggcacatgatgctttgttagaagcttatattgatgtttatatgtcggggtttaagtacattagtgatctggtttctgaaccgaccaaagaatttaatttatcatttgaacaatatttgatcatgcgcgatattgcggcaggacagcaggtagcgatgtcggatattgcgactaaacgtggtgtgactaaagcggcgatctcgcggcaaatacgggtgatgctagagcatcattacattgagcaagaacgcgatgccgcagatcggcggcgtttgtatctgcggttaaccccagaaggtcaaaaagtagcgctgtcgatcaatcaagcaatccaccaacgttttcacggttgggtcgccttgtttggcgaagaagaagcacaagaattgttgcgcctgatgcgcaaggttagcacgaaaatcatccgtaaagataataaagaatagcaaataggactgcgcttagctggcgtggtcctatttttgtatattcggctgcaaaggcaaaaaattaatgaattaaaatggtattgacttataaaatttgtacctacgagttatacttttaacgtaaatgaaaacgttttaaaaagtaaggggcgatttaaatggctgaaaaaaccattatgttagtttgtacagcaggtatgtcaacaagtttattagtttctaagatgcagaaatctgcggaagccaaaggggtcgatgcagaaatttttgcaaccgcttcttctgatgccaataataaaattgctgaaaagcatcctgatattctaatgctcggaccgcaagttcgctatatgctgaaaaacttccaggctagcgttgatattccagttgaagtcattaatatgcaagactacggtatgatgaacggtgaaaaagtcttaaatgaagcattaacctcaatcgacgcagctaaataagtcaatgcgggtcggtaaaatgtttagctaagtggaagctgctttgccagcacgtttacgttattcagaagaccaatacaatagtgatttttaaacatcccaatgaaagtggcggcgctgttggctgccacttttcgtatgattatgtactatataaaggagctagttgatttatggcagaagaaaaagaacaagatctacaatcgatcatgggtctgatcgttaatggtggtaacgctaaaagttctgcgtttgaagcaatcaatgcagctaagacaggtgattttgacaccgccactgctaaattgaaagaggcggatcattttttggttgaggcccataatgcgcagaccgatatgttgaccgctgaagctaatggtgaacacgctaaggtcaccttgttgacggtacattcacaagatcacattatgaatgccatcacttttcgcaatctagctggtgaaattgtcgatttatataagcgtctggctgagtaggttattagagtggcccataatgccactctttttttgagtacaaggagggtaatctttatgtccaaaagtggtttagcagcagattttctttggggcggcgcggttgctgcccatcaattggaaggtgggtggcaagccggcggtaaggggctgagcatcgcggatgtgatgacggctggtgctaacaaagtaccacgcaagatcactgacggcgtccaagccggtgaaaactaccctaatcatagcgccatcgatttttatcatcattataaggaagatatcaagttgttcgccgaaatgggctttaactgttttcggacttctatcgcttggacgcggatctttcccaatggcgatgaggccgaacctaatgaagcaggcttgaaattttatgatgatgttttcgcggaatgtcataaatacggcatcgaaccggtgatcactttatcgcattttgaaatgccttatcatttggtcagcgaatatggtggctggcgcgatcggcgagtgatcgatttcttcgtccatttcgctgaagtttgcttcaagcgctatcgtaattcggttaaatattggatgacatttaatgagatcaataaccaaatggattatatgaatgattttctagtggcgacagattctggtttagttttccgcaataatgaagacgctgcaacccgtgaagccttgatgtatcaagcatcacactatgaagtcgttgctagtgccttagcggttaaaatgggtcaccagatcaatcctgattttaagatcggcagtatgatcaatttcacgccgctgtatccggcatcagccaaaccagctgatattttagttgctgaaaaaatgatgcaacggcgttattggtggtccgatgtccaggcatggggccgttaccccgtggggatggaggcttacttcaagcaacatggtctgcggccggatatcacggctgaagatcgcatcgtgttgcaagaagggaccgtcgattacattggctttagttattataattcgatgacgattgctgctgatggcgctagcttcaagatcgtagctaatcctactttagaaaccagcgaatgggattggccaattgatccactaggtttgcgctatgcactgaattggctgcaggaccgctatcacttaccaatgatgatcgtggaaaatgggttaggtgcacgcgataaagttgaagccgatggtagtatccatgatccgtaccgcatcgactacttgcgtgctcacattgagcaaatgatcaaagccgtgaatgaggacggcgttgaactatggggctacaccccgtggggctgcatcgatctcgtttccgctggtacaggtcaaatgtcgaagcgttacggctttatctatgtcgataaggatgatgaaggcaacggcaccttagctcgttcacgcaaggattcattttactggtaccaaaaagtcattcagactaatggcgctgatctagcgtaaacaaaaagccgcagaaaaatctgcgacttttttattttttagcttttttcccaaagcgggttttcacaaagtaagccacgccggcgaggatcaagacgattagtacgatcaacgtgatgtgggcgaaggtatcgacgtagccagcgacttgggtccacgctttgccggcatgttgccctagtgtgactagcaccacgttccaaatcaatgtgccagccgcggtcagaaatagaaattgaatgaacggcatttttgtggtgccggcaggaatcgagatcaggctgcgaacgatcggaataaaccgacagaaaaataaggtgcttttaccgcgtttgacgaaccagcgctcggctttttctagatcactacgtttaaaatgcagtagccgaccaactttgccatcaatcaagcgttccaagcgctctaccgatagcagacggccaaccgcgtataggatgatcgcgccggcaacagaaccagcggtggcgacaatgatcaccccagtcaaagtcattgaagaatgtagcgtcataaagccgctaaatgtgagtacgatctctgagggaattggcggaaagacattttctaaagtaattagtagaaaaacgcctaggtagccgaattggtcgataaaatcgacgatcatagtttgcataagttacctccatcaggcttgtcctcataatataccgtgaaaatactgtgagcgtcaatcaataaccggtgttaattgcttggtcaggaggatgcaaggcacgccgtcttcggaaaatggttcgccgctgggctgataacctaacttagcataaaagccttgagcggttaattcgctgtggatcacggactgtgtgcagccgtgttggcggccgacttgttccaaggcgataatgattttagcgccgagaccattaccgcgttggctagccaacgtcgcaatccgcccaggtcgcatggtggtggcgtctaactgcttaaaacggccagtggccacgggttcatcattgtgatagatgaccgcatagatcgtaccatcattgtcttgatcatcaaattcatcttgtagcgctaaaccacgttcacggacgaagacctgcatccgtacggcaaacgctgccgagcgctgccaattggttgcattaacttttaattgcattagggttcctcgctttttttaatttttagtatagcactaaaaaagcgtcgcatcagggtaatcgagtgttaaaatgggaaccattaagaatagggaaagtaggtgggcggatgcggcctagaattgcaattacgaatactaaaaaaataatggataaacggcgattaaccgcgacaccagaaacttatgtccacgcggtgacggccagtggtggattaccactaatggtaccagccttggcggtcgaattagtgccagaacttttagcaacggtggatgcagtacttttaagtggtggtcatgatgtttcacctgatttatatggagcaaagttagatccagcaactggtgaactcgatcgtgcgcgcgatttatttgagattgcattggttaagcaagcgttggcggcgcacaaaccgatttttggtatttgccgtggtcagcaaattattaacgtggctttaggtgggacgttggtacaaaatattaccggcacgccgatcaaacatcagcaacgaccaatttctgggacgaagacgacgcatcaagttcaagtgattagtggaacgcggttagctagtctgttacaaggcgcttacgcggtgaattcctttcatcatcaagcagttgcgcaagtagcaccaggtttaaaagtcagtgcgcggagtgctgatggcgtgatcgaggcgctggaggcaccgcagcagcaattgttttcggtgcagtggcatccggagatcatgtaccccgatcacccggcagcgcaacgtttgttccaggcgtttatacagcaggccagtggaattgggcagagcgcctcttaattgcgtcttgctaagtagtatgaatcgtgaaataatagaaccgatcaaaataaacggccgtcagtgagcagccattttggaggaattgaatatggaagcaccaatcaagcatcaagtggatacaagtctcagtccgtaccagaaaaaagtcatcacgtcgtcagcggctggctttggtttagagaatatggatgttatgtttctctcctttgccttgtcgtcgatcattacgacattgcacgtttcggggacgcaggcgggcttgatcgcctcagtgactaacttaggaatgttggttggtggtgtgctttttggcttactagcagatcgttacggacgcgtaaaagtgttctcgcagacgatctttatttttgccatcgccaccgctgccatgtattttgccaacaatatttggaccgtctacttatgtcgtttcatcgctggaatcggtgctggtggcgaatacggctgtggtatcgccttgatcgcggaaagtttcccacaaaagcaagtcgggaaaatgacttcagtggcggcaatcggtggtcaaatcggtgcaatcttagcagctattttggcggccttgatcctgccacatttcggttggcacggcttatttctctgcggcgttttaccggtgatcttaattttcttcgtgcgtcggcacttaaaggaaagtcccgcgtttactgccttgcagcaagataaaagccaacaccaaaaggccacgatcagtgctttatttaaaacgccacagctggcttggcagacgattgcactgacgatcatggtcatggtgcagattgctggttactttggcctgatgaactggttgccatcgatcatgcagcaacgtttgggtattagcgctgctagctcgtccttgtggatgattgcgacaatcattggtatgagtctaggtatgttcacctttggcacgatcatggataaatttggtgcacggcgcgcctttgccatttttctgatcatttcagcagtggcggtgtttgcaatcacgttggcgacaaatcaatggacgttattgctggcagaagtgctgatcggctttttctcgaatggaatgtacgggggctatggtgcggtgatcagccgcttgtatccagtggaaattcgcgcaacggctaacaatacgatcatgaatgttggccgggcagtcggcggcttttcatcgatggtgattggctttttgatggatcgttatgatctgattgtggtgatggcgttcctgtccttgctctatgtgcttagctcagggaccttgatgacgattcgtaatttacgtgaagggtagaatatgttgaaaaggcatctagatttctgaggtttacatgtaaatagagttgattggttccgtccgtacacaccgagatggaatctacgctatcttgttcaaacaaaatttcagagttctgaaaatcaaccagctattaggatagttacgatgtacttactaaaataaaactgcacgccaatgacttctaatttgaagttcattgatgtgcggttttttggttactgaataaaaaaacgtcacgccaacttttcagtagcgtaacgttaattgcaattatttacttagatttttttctaaggctttcttgtgctctaattcttggcgttcagccgctaacttttgttgtaattcagtcggtgtaccaggtttccgcaataacttggcaaaaatacctttgtactgcatgcttgcgtcttgttcggcaaaacgattgcctaagaacatgatgaccgaaccaaggacgattacaacgattccgatgatcgttggtgtaataattttttcatgtaacataaacattgccatgatcggtgctagtgctggtttaatgaagaaaaccagtgaagcggtggaaacatctgatgtttccatggccaagaagtagaagccgaaaccaccggcagtcacgccaatgcaaatgtaggctagcagtaaaatattttgccaagcgatcccttgaacaaagggaattgccgcaaatgtttttagtgcgggaacactacttaagccggcagcgatactaggcacgtgggacagacccattaaaatggctaattcagcggagccagccagaaaggttaggctagtcattgttaggccgttaaacttgcggcgcatcgaaccccaacgagaaatgatcgagtagaggccgaaagtgactgctgaagtgatcgataatgctaaacctaatggattggttaaatgagctggattaacgatgatcagtaagccaatcaaggaaacagcgacagcaatcaagttggttcgactaagccgttcacgcaagatcaagtaagagaagatcaaggcaaaaatcggattacagctgaacaaaacggctacagtagaggcttgatcaacttcaacggctaactgataaaacgtcatactgatcaacacacaactgagaccagttaacatgaacaacagtaaatcacggccggttaagtggttgtgctgtttctttaaagcactgatggcaaacggcaataggaacaatccaccgacgagaaaacggagaaagttaagctggatcccattaaaggcactaccagccagtttcaacgagatttccatggaactaaacaagatggttgaaattaaaacgtacaaataagttcgcttcataaaaaattaatcggtccttcccaaatcactaacaacgaattattacgtattgtattaaatgttatgaaaattagtttcaaccagttttcataatatagtttaactactattgtaaaactgattgaaaacttgtcaatggtacaggcggaattaaacatgaaaaagctgcagctgctgggctagatatttaccagtgatactgttggtattggcagcaatttgttgcggcgtaccactagccacaattttgccgccggcattaccaccgcggggaccaacatcaacaacataatcggcattagccacaatgtcgagatcatgttcgatcgtaatgatcgtagcaccttgatccagtaattgatcgaaaacatggatcagtgtccgtgtatctaagggatgcaacccaacggagggttcatcgaagataaatagcgtacctgcttgcatctgacccatttcggccactaattttaatcgttgtgcttcgccaccagataattgtggggtcgcttcgccgagttttaagtagccaagtcccatgctctgtaaggctaaaactaagtgatgtaagcttttatatttggcaaataaagggacagcttgatcaacagataaagctaaaatatcggcgatcgataggtcatgccacttaatttgtagcgtttcgggattatagcgctgaccgtggcaggtgggacaggcctgatcaatatccggcagatattgcacatctagggaaatgtggccagtacctttacaagtcgggcacgcaccttgagtggtattgtaagaaaaatgcgccgcaccccaatggtgagctttagcggctggagtttgggcaaataatttacgtaagcgatcaagaatacccgtataagtggccacggtggaacgtgtatttttaccaactggtgtcgagtcgatcatcacaacacgctgtaaatctgcttgcagttgatcaacgtgctgtggcagcggtgttcctttgatttgcgcttgtagtgctgggactaagctatccagaatcaaagtcgttttaccggcaccggaaaaaccagtgactacacttaaacgatttaatggaaattgtgcggtgacatcacgtaagttgtagcgctgcttgacatggaaactaaacttaccggcaccaaaaatatccggctgtggctgccgagccaataaatcagcttgaccagttaaataaggcgcaatcagtgaatctgcttgctgtttgatttgagcaacgctgccttgatgtaagatctgcccacctttacggccagcaccgggaccaatttcaatcactgtatcggctgcagcaattacgtgtgtgttgtgatcaactaccactaatgaattaccttgatcgaccaaggcgcgcatgattttgatcaagccggtaacgttagccggatgtaaaccaatcgatggttcatccaaaacgtaaagcacgccggttgtcgcagtgcgcaaggtacgactaagctggatccgctgcagttcgccagttgataatgtcatcccagcacggctcaacgttaaatagtctaagcccagctcaagcaatggcgttaagctattggtaaattcattgactaaggtttggccgatcttgtgcatttttgctggtaaccaaggtacgatggtttgggcaaaggcggatagatcctttagtggtaagtcgctgacttcagcaatgtttttaccagcgactaaagtttgcagcaacttcgggtcaaaccgattaccatgacaagttgggcaagtggtaaaagaatagaagcgatttaaacgttggattgcccgttcatttttggtagttgctaaactatcggtcactgcagcaaatgcattttcaaattgggcgttatccatatggaaaattttgccggtggcggtaggaatattaatggcgtatttctttttctcaccatgaaggacaatatcgcggtcggcggcacttagctgtttaaatggtgtgtcaatatcgacgccgattgcttgcgcgactagcggcataaagttacgcccaggtaagcgccaagaggctactgcaccgtcgcggatcgtcaaattatcgtcaggaatcagccgctcagacacaatttgccggatttgcccgctaccctggcaagtcggacaagcaccggcagaattaaaggcgaaacgttcagcaccagggccaaaaaagctagtgccgtcgccggcatcgatcggtaactcttcagcaacgtgtaaagttggtgctacccgctggccactaggtgatacgtgggagccaagccgtgagaataacaaccgtaaaacgttgaaactctctgtcatcgtgccaacggtgctacgttgactaggcacgtttggccgctggcgtagtgctaaggctgccggcaaatggcggacaacgcgaacgtctgctttacccatttggctgattcgccgacgcgtataagtggacaatgcatctaagtagcgccgtgcgccttcagcgtaaaggacaccgagtgctagcgatgatttaccggaaccagataaaccagtaatggcgacaaattggtgcagcgggatatcaacatcaatattccgcagattattgacccgcgcaccacgaacttcaatttgctcaggttgtttattttgcataaagaggactcacaatcatcaattaaatttaaaataactgcctctatgatagcagtctccagaaaattcagccatgcgtcttccttgctgtgcgttaatgtgctatgcttattgcgctcaaaataacggtgaacgtggcattaaacctagttgccggttactttattaatagtggtaacccagtgtgcgagatagagccatgtttcttgcggtaagttttttgccacaagaatggccatcgccacgagcattaaaagtttattagtggagttagctaataaacttaacctaattatgcgagatagagccatgtttcttgcggtaagctttttgccacaagaatggccatcgccacgagcattaaaagtttattagcggggttagctaatagacttaacctaattatgcgagatagaggaggcacgtaatgcaaataccaatttccaatcaacaattttttaactggctgcgtgctggtcgtgtggtatttttcaaagatacattgatgcttgaaccgtttgatgaagattttcaacaaattttgcacttagtggagcatgattatttagaattgcgtgctgaaatcggtacaggcacgttcacttacagcattgcgcctgatcaggatctagcgcaggcacaaattgaattacaggccgagagtgcagatcatgaaaaaataatcaccaaagcgtatcatgtatttttggataatgtgcattaaaaagactgcaagcaaggcttaggaagcggatcaaatttaaaagattagcaaaagccaatattgatggattagattggttagcactggctgtatgaatgatgagcgtaaaataaaaaataatctaagctcaataaggcacatcagggactgttgataccgccaactaatgtctagtgctggagggacgtttttaattaaaatttaggtagttactgaagcagaaaacggagagccagattttaattcgatctataatcatcaatgtaatcttgttcaaagtacttttcgatattaaaatagaatttatcgggatgctaaaagctgccagtaaaatcagttgaataaccgattttactggcagcttgcatattatagttagaaaacaattgcttgtcacaggcttattttttagcatcaagctggtagcgtactaatgctaattcagtttgttgaaaggtataaagtttttcgtgatagttggaatccagttgaaaaccgactttttctaacaagcgacgcgaaggcaaatttgcttcaccggttacggcatatagtcgtttgatgtctagctgttcgaaagctagctgagcaacttgcggcaaaacttcctgcataataccgtgacgctgccattgacttaaaatttcgtagccgacttcggcggtttgcttttgaaaatgccaaagttggattaagccataaaattcatcagtttgacgatccatgatgccccacatcagatagttgccccgttgtgttcctgtcaacatccggctgatatattgcatggttgctgttagatcataatccgtgctacgactggtggccgccgcgatcgttgtatcatggcgcagtgcgtatacacctttggcgggaaccgtattaagaaaacgcagctcataatggggtaacaacacacgtgcaaaagcttgagtttgcataagaacacctccgtaactatagtttaaagtagcagcatatttcttacgatgaccaaaatggtttgaacgagtgaacgtaatggaggaatttacaactacgctccgttaggcaaataaatcaccttaattgtgaagtagaaaggatcaactaaaaatggaagcagaattgactttagttaaaacaatgctcaacactattctaacgcaccaagaattaacgcggttggacgaattttttcatccggcctttattgctgttctcaatggtgaaaatattaatcgaacacggtatatcgagcggttgactgatttaaaaacaagcaatgctgacattactgatttaaaaattcgtgatcttttttggtcagaaaagggggcagttactgcacactatatcgcgctaattaccccagaaaacggacgaattgatcaagttgatgtgcttgctctgtggcagttcaaagcgggcaagttgatttttgtcaacgaggttgcctggccactatcaccagttgcggccgatttcgcggctgatcgtaccttcattcatcaatatatcatttaaagtgctagccggcgaattaaatagtcggccacgccatcgtccgcgttactgagcggggtcacgtcgttagctagcgctttgatcgctggccgggcatttttcatggcaaccccccagccagcatgagtcaacatgtcgcggtcattatcgtcatcgccaaaagctaaaacatcgcgtgcgttcatctggtagtaatccaataaatattgaatggcacttgatttatgtgttgcttcccgaacgatttctagtgcagaaaatgggccgctccaagcgccccaagtttgtgcaacaacgtggggaaagcgctgattgactgctgcttgtaattgcggcaaagtaacggcatcggtaaataatgataatgaaataggtgcctgtcgcagtgagtctgcgttaagcagtacttttggtgcgggcatatcggtgaaaaaaggaagatcgcgaaaagggcgatcagtcagcacaaattgtttaccttcagcgatggcgactttaattggaaaatcgtgtttcaattctaatagggctaacgcagtggcttgcggtaaagtggtggcttgttcataggcccattgttggtgcgggacatggactaatgcaccgttgaaattgatcattggtgtagtcaagtctagctgatcgtagaattgttcactaatattatctggacgaccggtggtgatcacgactttatgcccgcgttgactagcagcacgcaaaacgttacgcgttttggaactaagctgtccagcaggatttaatgttgtcccatcaagatcgagtgcaattaatttggttgacatggcgagccttctttcttagcgtctgtctggaaaagtgcgcagaaatttgctttttcaaacacgacttatgctgcttatgcgcagcaactactgtttaataatctaccatagaacgatcgttgacagaactattttgttgctgatcgttttttaattaaaataatttaattattttataatcatattttaatgtaaaacgtaaaatgtgatattatagttaaaattaaattaaaaaaagaagagatttcgttatgaaaaataccaatgcaaaactcaatattattattatcagcgcgattattaggtaatgcgggctgacatttttaagtgcccgcattaagcgggcagcgttggtaaagccaagagctgtcacaagctcttggctttttatttttcaggaaagaaggtgaggattgcttgattaagaaaagttgatcgttgatggatgaaagattaaaaaaagatgagattggaagcggattgagatatgcaagatacagatggtttaaccgaaacaaaagcaacaactgtccttaaacgtgatcctgtacgtacggtcgtttttgcgtcaatgattgggacagcaattgaattttttgatttttacgcgtacgggactgcggcagcggcgtattttcctaaagtgttctttcctgaagtaaccactacgattgcgactttactgagtttactaacatttggggtcgcctttgttgcccgacctttaggctcattcgtttttggtcattttggtgataaaattgggcgcaaacggaccttggtcgtttcgctattgttgatgggctgttcaaccgttttgattggcttgttaccaagttattcaacattagggttaatggccgttattctattgtgtctctgccgcttcgttcaaggcattggtctgggtggcgaatggtccggggctgctctggtggctaccgaaaacgcccctaaaaagaagcgggcactgtacggtgcctttcctgaacttggggcaccattaggctttttcttaagtaatggtctattcttcgtgttggaatcattcctatcaccagcacaaatgatcagctttggctggcgggttccatttttggcttccgcaatcttagttttagttggtttctgggttcgtgaacaaatgcaagaaacgccattattccgtttggctcaagaaaagaacgaagttactaaatcaccattaaaaacagttttcaaaacgagctggcgccaaatcattcaaggaacgtttattgtttctgtcacttatactttattttatactttagccacttggtcgttgacctttgccacgactcatctcggctttagtaaccgcgaatacttatccttattgatgggtgcgatcatcgtttttgctgttatgatcttagttgcttcttattatgctgatgtttggggtcggcggcggatcttaatggcgtcgtcagcggctttagttgtctttgcactattattcccattcttattacaaggtcagcataacgctgttggtgtaattgcattcttagtcattggttttgttttgatggggatttcctttggccctgttggcgcagtattgccagaattattctcgaccaaggtgcgctactctggcgctggtatttcttataatgtcgctgctatcgtcggtgcagcctttgcaccaaccatcgccacttggttagccgataactggggtgttcgttcggttggtatctaccttggtgtcatggcagttgcttgtttcattgctttagctacgactaaagaaactaagtcagtagattttactaaatagcaaattaaaaggcttgcgccaatgacgcaagcccttttttattccttatctgctaataattgccgcagcactgcgacttgttgttttagttcggcgccaatatcggtttcagcgacgagtttccgctgtgctacttggtcgacgatgcgcttagttgaaataatgtcggttagattggcgatcgcatcagccttagaggtaaatggttggtgcgtcaccagctgcataccgtaagaattgtagagcagggtgtagccgccaataccggtagttttatgatagggtttggaaaaaccgccgtcaatgacgatcattttacgatcggccatcactggcgtttgcccctttttcaccggtgtgtgaccgttgatcacgtggccagtggctggtgacataccaaattcacgtaagactgaatcgacgaaccaagcttcacggcgcagtttatagtacgggttggtgcgttcctcgtgggtagctggatcactgatgaagtaacgttcaaaagtggtcatatcatgtttgccaaacagcggtgatagggggccagtccagaggtaccacagtaaatcagtggcacaatcgtcttcgtcgccgggatgcgcaaagctagcccgcaagttctgttcaaaaacatctagcaacgctttaccagcatattctttaccatgtaatttgaaggcttgaaatttgccgtcggcagtaacggggatacacccatggaacaataaattatcattgtaggtcagatacatgctgcctttacgcatcaaaaatttcatatggcgctgtaacttatctgaatggcggaaagccgctaataactgatcaatcactcttttttcttcaggtaaaagcttataaggatcagttggatcaaccgtttgaaagcaagtattttctagcggataaattttaccgtgaagctgaattgtcattttctgatagtcgatacgatcgagtaagcggcggtgggccattttaaattctggccgacgagcaatgactgggccttcaagcttgaactgaataatggcgattgcttggtggatctgggtgatctgtaattcctcagccttagataacggccgctcgctgcgcaattgtttaggccgaaaagccacgttatcttgatagtgttcttcggcaaacagcgataagtggcgtaaattgataccatacgcatcttcaataatactgagattattgtagcgggcgcagatccgcaatagattggctagacataatctggagccagagacagcaccgagccagagaatatcatgattgccccactgaatatccagcgaatgatactgcattaaccgctccatgatcaattctgggtgcgggccacgatcataaatatcgccaactaagtgtaaatgatcgaccactaaccgctgaatcgtgtggcacgacgcaataacaaattcatctgcctgttttaaagcgataatgttttccgtaatttgttggtaataggctgccttgtcgggactattaaaatcaccgtaaagtaattcttcagtgatataaacaaattcaggcgccaaggctttgcggaccttggaacgggtatatttagtcgacacaaaatgcagtaattcgactaaccgctgaaaagtatctaaataccattgatgtaagtcattggcgtcgggatagcgctttttaatggcggctaagcgttcactaggataatagatcaaaaatgaaaaactactaattgtttgcggtgtcattttgccggaaaatagatcagcgactttctgcttaacgttgccggagccgttacgtaaaacatgttggaacgcgtcatattcaccatggacatcactgataaatgcttccgtacttttcggtaaactcaaaatggcctctaaattgatcaattcggttgctaaggcagttttagtcgtatattgttccttaagtaatgctagatcagttacatccatacaaaaaatacccccaaaatattgaatatatgctttgattataccgctttcaattaaaaataccaattatatctgtggacttagtggaaccggctaaataacgatttaaggtatataccaatttaaaaaattgaaaacgacggtggttattctactgaacgatagttaacgaagctgtaatcgaatttactaaaaaaataatttgacaactatgagaaaatgggttagtctttaacacaacttaataaaccgtccataacttcaaatacgaagttataaaccgaagaagtggagatcaagattgtgatgcccgcacagagagccgccgcatgctgggaatggtagtgggaaacaagcgattaaatggaccactgagggcgcggataaaaaaagatagagtgcgacccaaggcgctcaggctttgagcattagcctagcttggtaataagcagcacgcagtgatgcgtttaccaagcgtagctaagcggaaaggcctgccttggggagcacgtttcaaccaacgcagctgaaacgtgctttgccaagcagatttctgcggttagctacgtcatgcaaacgctttgtgaacaaagcattcacacgactaggctaatcctcaaaatctacccgcttggcaaaacactctttctttccattaccccgcgacgtgttggtatacgtgagttaccgggaggatgttagtcctctgctgagatggggaagtctaggcttatattttatttagcgtactttccaactaaggtggcaccgcggaatgaatccgtccttaacaattaattttgttatggacggatttttttgtggaaagagtgcattgaaaaagcgtccagattacggaattatagcctagctagacgataagagacacgcagtggctcgtttggctagcgtagctatatgttgtaagctgctttttcaatcacgtttaacccgctcaattcaaaaatgaggtgaaaccaatgaacaagcgatggcgccgccgtctgtgttgacacattacacggatggaggatatcaaatgacaaaatatagtgttgaacaattaacttataccgatgcaacttttgcgccagaaacgatcacagcggcgttgcgccaacagggccaggatgtttatttactggagacagcgcgttacagctatttaggtttcacgccggcgttaaatatgacgtacctagatggtgagttgacgctacgtgatgcagccgggcaaacgacaacacaaaaagtagccttaaaaacttatttagaagcgctactacaacagtatcaagttgaacgggatgctgacttaccaccttttagcggtgggttagtcggctacttcgcttatgattacgcaaagtatcaattgaccaagccacaaccagtagctaatccgctggggttggctgacgccggcttgatgttgttgacgaaagtggtcgcttacgataagcaaatacagcaggtccatttattgcggacgattgcttgtgggcaagaaaatgtagctcaacaggagttaaagcaattacagcagtacttgcaacaattgcaacaacagcaagttcaaataccgcaaccacaattaaaaacgccgttgacggcgcgctttacgcagactgcatacgaaaagctattgcagcaaaccgtcgcccacatctatcgcggcgacattttccaaatgatcttgtcaaatccgttacgggggcaattgctaggcgatttattgccggtctatcaacaaatgacagcgccatatcatttctacttcagccaggctgactttcaaattgctgcggcctcgccggaaacgttgttgcggcgaaccgggcagcatttagcgactttcccattggcgggtactcggcgccggggccatgatgctgcagaagatcttgctttacaacaggaattgcaacaggataccaaagaaatcgctgagcacaatatgttggtcgatctcggccgcaacgatctgggccaggtcagtgcttttggtagcgtgcaggtcacggcacatatggagctgaaaaaattcaccaaggtgatgcatttggcatcaacggtggaaagcactgctgctaatggggtgacggcgttagatgtgttgaacgctgtttttccggcgggaacgttgtccggtgcgccgaaagtgtcggcgatgacgttgatcagtcaattggagcagcaaaaacgcggagcctatggcggctgctttggattcatcgattttaatggtgacgcggattttgccatcggcattcggttggcccatagaaaaggggatacggtcaccgttcacgcaggggcaggaatcgtggccgacagtattccagcacatgaatatcaggaatgttttaataaatcacgggcggtcgtgcaggcattggcggcggcaactaaacaagcggaggtgttagcgcatgttactactcattgataattacgatagttttacctacaacttatatcaattgctcggtcaattcaccacggcgatcaaggtggtcaaaaatgatcagatcacgtgcacgcaaatcgcggcgttacagccagaagcgattattttgtcgccgggccctggtaatccagatgatgccggcgtgagtttagaagtggtgcgcacctttgctggtaaaattccgctattcggtgtttgcatggggatgcaggtcatttgccaagcactcggcggtcagatcgtgccagcaaagcaactgatgcacggtaaaacctcacacctacaaattacgccaggtagtcgcttgtttgccaactgcccacaagcaatgaccgtagctcgctaccactcgctagccgtgtcagcacaacagttgccgactaatctaaaagtgaccgccaccgcagccgatggcgaattaatggcggtggaagatagcgcgcaggtaatctacgccgtccaatttcatcccgaatcagtgctgaccgaccaagctgccggcacacaattagtggcaaatttcttagcgcgcttgccgcaacaattggctggctaaaaaaattaaaattagtgttgacttttaattacttttattttaatcttaacacaacttaataaaccgtccataacttcaaagcgaagttataaactgaagaagtggagatcaagatcgtgatgcccgcacagagagccgccgtatgctgggaatggtggtaggaaacaagcgattaaatggaccactgagggcgcggataaaaaaagatagagtgcgacccaaggcgctcaggctttgagcattagcctagcttggtaataagcagcacgcagtgatgcgtttaccaagcgtagctaagcggaaaggcctgccttggggagcacgtttcaaccaacgcggctgaaacgtgctaaaaagaacaatttcctgcggttaactacaggaagctcgccagcttttacaaagctaacgtacttccttaggttaatcctcagaaattacccgttctttttaccactctttctttccattaccccgcgacgtgttggtatacgtgagttaccgggaggatgttagtcctctgctgagatggggaagtctaagcttatattttatttagcgtactttccaactaaggtggcaccgcggaacgaatccgtccttaacaattaattttgttatggacggatttttttgtggaaagagtgcattgaaaaagcgtctagattatggagtgtaacctagtcgggcaataagcagcacgcagtgatgcgtttgaacgacgtagttacacgcaataatttgctttttcaatcacgtttaacctgctcaattcaaaactattccgaggtggaaatcatgcatttagacaagcgatggcaaattttaattagttactttaaatttaatcttaaattaacttagatcgctgctcatagcatattggctaatgcgcagtgactaagttagcaacaaactaacttaaaaattttgggggaatcaaccatgatcacaactgcaattcaaaaattagccaacaaagaagatttaacttttaccgaagccgaaactgtcgtcaacgaaattatgagcggtcaaaccagcgacattcaaatcgcctcgttactcactgcactgaccttaaaaggtgaaaccattgatgaaattgccggggccgctaaagcgatgcgggcgcacgctttagccttcaccccacgcgaagatgtattggagatcgttggtacgggtggcgatcacgaaaactcatttaatatctcgaccaccactgccttggtcgtcgcggccgttggtgtgccggtagccaaacacggcaatcgcgctgcttccagtaaaagtggagccgctgatgtgctcgaggcattaggcgtaaaaattgatgtgacgccagcccagagtgaagcgattttagcacatgccggtatctgcttcttgtttgctcaggaatatcaccaagcaatgaagtatgtggcgccggttcgtaaaaccctaggtatccgcaccttatttaacgtgttaggacctttggctaacccagctggggcaacgcaacaactgctaggcgtttacgatgctgccttggttgaaccgctggcacgcgtattgcagcaattaggcgttgctaatgcaatggtcgttcacggcgccgatggtttagacgaagtttccatcagcggaccgacgcaggtgtgcgagctacaaaatggtgaatttactagctacgaaatcaccccagaacaatttggcttgcagcaagcaccgatcgccgcgatcgttggtggtacacccgcggaaaatgcccagatcacccgcgatattttagccggcaaagctggggcgacccgcgatatcgttttgatgaacgcaggctgtgcactacacattgcacggccagaattgaccattgcccaaggggtcgctttagccgccgtaacgatcgacaacggtcaggcagcagccaagttggcggaattccagacattgaccaaaagtgaggcggtggcatgatattagatcaattagttaccgctactaaaaagcgaatcgtgcatcaacagcagctgttgccattggtgcaactccaagcacaagtggcgcagttagcgccgcggaccacgcgaccatttgaaacgcaattagctaagcctgggttagcggtgatcggcgaattaaaaaaagcttcaccgtcaaaaggcctaattgccgctcagtttccgtatcagcaaattgcccatgattatgagcaagccggaattgctgccatctcggtgctaaccgagcctgattattttcaaggcaacgaccaatttctgccagccgttgcagcgacggtcaagctgccgttactgcgcaaagatttcacggtgtcatcatacatgatatatcaggcacgtttgcttggtgctagtgcaattctgttgatcgtggcgatcttaaccgatcagcagttacgtgactatttagcgctggccgatcagttaggtttgtcggcgttggtcgaagctcacgataccgaagaagtacagcgggcattagcggccggtgcgcggatcgttggtgtcaacaatcgtaatctcaaagacttttcggttgatctgcaaaatagcattcagctgcggcaacaagtgccggctgacgtgttgttcgttgccgaaagtggtattaaaattgccgccgatattggtcaactcaaggcagccggtgtcgatgccgttttgatcggggaaacgttgatgcgggcaccagataaagctgcacagctagcggctttaggagttaattaatgacgttagttaaaatttgtggcttgatgcagcttagcgatgcgccggcagttaatcaagcgcagccagattttgctggcttcatctttgttcctggtaagcgccggcagatcagtttggtacaagccgctcagttacgccacgcactacaaccgcagatcaaaacagttggcgtctttgtcgatgcgccgctagctgagatgttaatcccgctgcagcaaggcattatcagtgtgatccagttacacggtcacgaatcagaatcgacggtacaagcgttgcaggcggccggcgcacaggtgatccaagttcagcgtcaggccacaccaacacaggctgattttgtattatatgatgctgcccaaccaggtagcggcaaaacctttgactggcagcaattaccgcaacagccaccgcgaccattttttctggccggtggtttaaacctaactaacgtaaaaaaagccctgacccaagttcaacctgctggtgttgatatttccagcggcgttgaaacggcaggcttaaaagatccagcgaagatcgccgcgtttgtgcaggcggtccgccaatttgactcggaggtacaacgtcatgcaaaaaattaaacccggccgcttcggtgatttcggcggccaatatattcccgaaacattaatgaccgaagtcaaccgcttagcggcggcctatgaacactacaaaaatgatccagaatttcaagccgaattgaccacattactcaatgagtatgctgggcgaccatcgcggctatactacgccaaacggatgtcgcaagatcttggcggcgcacaaatttactttaagcgcgaggatttaaaccacacgggctcacataaaatcaacaatgtgctgggccaaatgttattagccaaaaaaatgggtaaaacacgggtgattgcagaaaccggcgccggtcaacacggtgtcgccactgcgaccgttgcggctttgatggggatggaatgtgaagtcttcatgggcaaagtcgataccgaccggcaagcactgaacgtttaccggatgcagttactaggggctaaggtacatgcaatcactactggaacgggtacgttaaaagacgctgtcaacgcggcgatgcaagagtgggcttcacgggtcactgatacgcattatgtaatcggctcaactatgggtccacatccgtttccgacgatggttcgcgattttcaaagcgtgatcagtcgcgaagcacgggcacaaattcttgaagctactggtaaattaccagcggcagtcgttgcttgtgttggcggcggtagtaatgctatcggtgcgttctataactttattgacgataaagacatccgtttgatcggttgcgaggcggccggcaaaggtgttgacaccgacgagcaagccgctactatggaacgcggcagcaccgggatttttcacgggatgaagtcacgctttattcaagatggtgacggccaaattgcgcccgtttactcgatctcagctggtttggattatccgggcatcgggcctgaacatgttcatttagctgaaatcagacgcgccgaatacgttggcatcaccgacgatgaggcggtcgacgcatttgagtttattgccaaggaagagggcatcatttgcgcgatcgaaagtgcgcatgcggtggcctatgtgcaaaagctagcgccacaattggctaaagatcagatcattatttgtaatttatcagggcgcggcgacaaagacgttgcagcgatcgcgcgctatcgtggggtggatattcatgactaaattaaatgaagtttttgcaaataaaaaagcttttattgcctttgtcgttgctggtgatcctgattttgcggcgtgtgctgacaatattgttgctttggctgaagccggtgcggatctggtggagatcggcattccgttttccgatcctgttgctgatgggcccgtgatccaagcagctgatctacgggcctttgcggctggctcgacaacggctaaagtatttgaacttgtggcggaagtacgtaaacgaacgcaggtgccgctagtttttctaacttactgtaatctggtatatcagtacggctatgatgaattttttactcgttgcgcagaattggctattagtggtgccatcattcctgatctaccgttggaagagcgtgatgaagttaagccgatcgccgaagctcacggctgtcagatcattcctttggtcacaccgacaaccccgccagaacggatcgccaaaattgttgccgacgtggatggttttatttacgtggtgtcatcaatgggtatcaccggaacccgcgacaccattaacaccgaccttgatcaattgatcgccaatattcgcaagtacacgaccacaccaactgctatcggttttggcattcacacacccgaacaagctgcacaaatgggtgccattgctgatggggtgatcgtcggtagcgcgatcgtcgacatcatcggccaatatgggcacgaagcgccagcacatttacaagcatacgttaaagcaatgcgtgcagcgttgccagcgtagtgcggtgttgagtttgagccaataacattactttccttttgatcacacaatttaaagcattagtgaagagacaatccaacttcactaatgcttttttgcagtgtgattttgtttaacggtcagcaaatgctatacttttaagtaagcgaatacattacttatggaggcaacaacatggaatatgatttagtagcactaactaaagcattgaagcatacgatcaaagggatgaatcaggaatcagccgatagctgggtgcctaaatttcaagatatttatcaagtcggtatggggactggcattagtgctgcttttttgcgctatttgactgaggcaactggggtcaacatgcgtgagttaccgaccaaagtgcctaactttgcccaactttccaaagatagaaccgaacaggtctaccaaaagttggccgctaaattagctgaccacactagccaagattatgaaatcatgggtacgcggctaagtggacagatcatgggcgcaaaaggagcaaagacttgggccgaagccaacgcgtcaactaagtcgaatttaacggttgaggatttgatcaacgtttatttttacggctaccaatatggttttcaaatcagtttctgggctggattagtcgagtatgatttcgcctacaaagacagaaaattgacgcaaaaagaaggggctgatttagcccaagcagctgccgttgcggcgactaatgaacaattgcagactacacttgaaagtaaaagtgcgctggcgcaggtttattattatattcagaacgcttcactgtagataaaaagttattttcggttgataacctaatgaatttataacacaaaggatctatatttgcgtagtttacttatatagattcttttttattcctgaacatcaatacgccaatacgcttttagccaaatacgtattggcgtatagttaaaattactggagggtcaatcatgccaataaaaacgtttgaactgattcggttacttgaacaaaatggatttgaagaaattcgtgctgctggttcgcatcatttttataaaaataaacgaactggagcgactacataccggcacaccgccggaaagtaccaaagggaatattaaatagaattttgaaacaagtaggtttgaaacgagaactgaaagtcagatttcttttggaatgtttatgccccaagaatgggtactgtcactcatttttaacaatgatgtttagcgaatatcaatcagataatattactaatttgtaaagtagaacttgttttccgatattaattaaattaatccgaaaaccggtaagttgaagccgtatcgtctgtagtatttgagatttttaattagataatcagcaacaatcatgaaataaaggagattttatacatgtcaaaaataaatatggttatctatccagcaattttaacctcagatgaaggaaacacaatcgatgtcacatttcctgatgtgccagcagcaattacctttggcaattcttttaaagaagccgtcgttatgggggcagaagccttaggtttggcactatatggccagcgtaatttacctgagcctagcgatatacgccagttgaagttagcgtcagcgcagcaggcggtgctgattgcggttgatctagctgaattcaaaaagcgagtcaagacaccgatggtcaagaagaataccaccgtcccgcgtgaattagctttagcggcggagcaacaaggcattaattttagtgaggttttgactgaagcgctgaaagctaagttaggcgcttaagtgtattataatacgaattataatgtatagttgacttaatcaattatttttgcttaatttttattaaaagataagttaatactaaactattgttataatacacctaattatgttcttttaaactagggtccgtctgaaaactacttaagtaagatgcaaattgaggcaatgtagaccgtagccagataaacatgagcgagcttatcataacgcgttgcaatcctacgaaagttcttcaactgattgaagaagttctcaatcaaatggcgctcacaataaacgtggtaatcacaggtccacttgtctttggtattttcctttggcggaatggtatagacgcctgctttatctt

SEQ ID NO: 572 - DNA, 9677 bp, Unknown
  Metagenome-assembled genome
agcaatttaactataccagagctgaggctctttttgtgtacttaaaaggtgaaaatacaaaatacccatcaaacgcgtgatgcatgtgtttgatgggtattttgcatatctttgtgaataaatcaggctacagggtccataagttttcacgtcctttaaaaaagatgctgtagtgggtggattttttaggtgcgaggcttatgggccttttttattttgcactaaaaaatcctgctaatagattaccatgttaagtaagctatcaacaggaaaaagtatagaacctaaaaaagcgaatctcttaattgaggttcgcttttattattttacgcaaactgcgctaattctttccgtgacaaaacttcattcattcggccactgcggaaaccgccaagatcgatcgtcacatacttgaaacctaacttaagtaaggcatcattaactcgttgattgaatactaagaaatcattgaagcaagcttcaggtaattcaatgcgggcaatttcttcatgataacgtacacgcaccgttggaaagccgaggtcgcggatatacttttcggcttgcatgacttgttgtaatttagcggaagtcaatgtagtgccataagggaagcgtgatgatactgagcaggaagcgactttgttccaattggtcaagcctaattgttgcgctaattcacggacatcctttttataaagatcagcgtcttgtaatgggctgtgggcgccggcttcagtgcgggctttcaagccaggacgataatcgttgttgtcatccatgatcataccgtcaagaactgctgcaccagccgcaatttcatttaaacggtcatagaacatttttttagcgtaataccagctgtcgggtaagttttgtttgatgtgtttatttgctaaataatcaagcgttgttgtttgcacattggtgcctaattccttagccaaactaacggctttatcgaactcttcgttagtaaataattcggagttggcgataacagccatcacgtggtcacggccaagtacatccaacgccattttcaaaaccaaagtgctatcgataccgccagaaaaagcgacgacaacgttacctaattgttttaagttatcaacgactacttgtttcttatctgctaaagtttgcatattaaaagcttctttccctgaaataatttgatttaaatgttgaaaaagccgtgcatgaaccatgcggcacaggcagcaccaataaatggtgcaataccaggtacgataatgccatattgccaatcactgtcggctttatttttgattggtaacaaggcgtgagcgatccttggccccatatcgcgggctaaattcatcgcgaaaccggttggaccacctaagcccatcccgattgcccataccagcaagccaacaccgatcggtacgataccaggtgttttgacggtcgaaatcgctaagatcccggaaataaaaataaacgtatcaaaaaattcgacaaagaaattccgcggtaaattacggactgctggcgccgtggaaaatagattgcgaatggtgatcggtgagacttccgcctcggaggctttaaaatgatcagcgtacatgacccaaacgatcatggcgccaacgaccccaccgagcaaatcagccaatgagtatggaataaacatggcccattgaatattgccaagtaaacattgtgccagcaccatggccgggttgatacaaacatcgccaaaaataaacaaggcaatcgtaatgccaaatccccaagtcgtgatcgcaaatatatggcctgatccgcgatacttggttcctttcaaaacttcactacagtggacaccgaccccgaaaatgatcatcaaggcggtccccataaattccgcaattaatcgatgtagcaaggttacacttccttctctctaacttgttgccaagccgcttgataaacggccattaatggaacgtggtgttgttgcgctaaccgagcacaatccgcatattctggtgtccgtttcacgatcgcaccataggtcgccaccttgatctgtacgatcccatattgggtggtaacttgttcaaaatagcgctgcatcactgtccgctgccaagtttgataacgcacaccaatcgtgctggtatgagctaaaagcagctgcacaaattgttcgcgtgctgtagcagcgactaagacggataatttggtagctggtcgatttttcttcatttggatcggcgtaaaataaacatccaaagcgccggcagccaacaataattgcatgacgtaaccaagcgtttcaccagtttgatcgtctaagttagcttccaataacaccacttggtcagccgtcttagttacgacatgctgacttagttttttttttcgaataaaatggcgcgtaacgcgttgaaaccgccagtatctcgtttgccaaaaccgtaaccgatctgtagcggtgtcgccgtttcgggtaatgggccaaagtcgtcaactaatactttaactaagcccatccccgttggcgtgatcaattcagtgtggacttcaggccgcgctttgatcggaatcgctgtaccgacacgcatttgcatcactgccggcacaggtaccggcatttgaccatgagcaacttgaataaaaccactaccatccgccaaagcggagcacttaacggtatcgacttgtaacatttctaaagcgatacaacaaccgacaatatcgacgatcgaatccagcgcaccaacttcatgaaaatgaacttcgcttaatggcaagtgatgaaccaccgcttccgccgcggcgatttcattaaacactgcgctggcgtttgctttgactttttccgataagtcactttgcgcgatcaaatcaagaatttcctgtaaatgacggccgtgatgatggtgctggtggtgatcttcaacgaagccatgatctttttcatggggtaagatcacatcaaaattagtgccgtaaatgctgcttttagcttcgcgcttttggctcaacgtatagccattcacacctagcttagccagttcttgctgcaattgttcaaaatcaacgccgaggtccagcaaagcgccgataaacatatcgccgctgatcccagaaaaagcgtctaaatataatgttcgcattttattatgtcctctatctcacttaatcaggtaaaaatcgccaagttgaaacatggtgctataaatgattgatcatgctggctgaataagctgcgccaaagccgttgtcgacgttgaccactgtgataccagatgcgcagctgtttagcatcgtcaatagcgccgttagtccttgaaaattcgtgccgtagccaacgctggtaggtacggcgatcaacggtttatcgatcaaaccaccgaccacactagccagcgccccttccatgccagcgataacgatcacgactttggcaccgcggatcacatcgagccgattaaataaccgctgaataccggccacgcccacatcgtagattcgttccactcgattgccataagtttccgctgtaatggcagcttcttcggcaactggtatatcagaagttcctgcggtcactacggcaatgtagctttctgtagctggtaatgcctgacctaagacggcacagcgcgcatctgcgtagtaagtgacttgtggtaaagctgcttgaacggcatgaaatttttcggctgacaaacgggtgatcaaaatcggttgtgcctgttgctgcaaggtttgggcgataccgatgatctgagcagccgttttaccggcaccatagatcacttcgggaaagccattgcgttgttggcggtcaaggtcaacttgggcaaagccgatatccgcgaccgactgttgttgcaattgacgactcgctttttctggtgatacttggcctgcagcaacttgctgcaataaggcttgtaagtctatctgtgccattttattttacaatcacgccaaggccatcagggatcacaacgactttagcatccttaccttcgcgtttataggcactagccagtgcgtcatccaacgaagttgccaattccatatgcatatcagtgatcaattttggatcaactagatcagaaacaaagatcacatgatgatggaccaaaatacgggcaaaaatttgcgctgtccattgatcaggaatcgtttttaaccgtggggtattgatggcttgttccaaaaagtcttttggatcggcaacatcagcaagattatgataaaaaccttcaccaccgtgaccgtcgcgagagccggctaccataatgattgtgccgccttctttgttagtcgcttcagcagcagtcatccctttgaccgcttgatagatattttgatctaggggaaagccgccattcgttgagattgcaatgtcacaatcgattttgttaacgctagataactctttaacaaaatcacacccaactttgtgggccgcttccatatcaccagcaaatgagccgataattttcttatcttcatccagcacaacgttgatgataaaggctaatttagccgtccgcgcggcataaaccatatccttatggatcggattgtgcattaaattacccgtccgtgctttgttggagttaatgaattcaccagaatgattggccatgatcgtcttataagaggcgatcccaggtaaaactgatttgcgcccaccagaaaagccggcaaagaaatgcgattcaataaagccttcagaaatcaatagatcagcttcggcagcgactttattaatgatgcagtcaccaccagaagggagttggccaattttgaccattgaactgtcatcggtggatacgtgcatcacgatctcttcattagcgacgattgcttcgccatatttgttaactaattcttcatgtgtcgatggtcgatggaagccagtcgccaccaaaatacggatccgcgcatcaggagcaacgctgcgtaaccggcgcaataaaatcggtgtaataatatgtgagggtactggccgcgtatgatcagaactaatgatgacaatattatgcttgcccttggctagttcttccaaactcgctgaaccaatcggataatccaacgatttttcaaccgtctcctgttctgtaaagtcattatggtatgtcgccgccttagaaacgagcttacccgcaaaattttcatcagcaattttcgcagtgaccgtcgtcttatcgtaaggcaaatcaatagctaccatagcgtgacatcctctttctcttatgtattttttgtctgcatgatcctatgctaaaccagcttcatcattgatttagcataatcatgtttggaaaagcagctccagcttaataagttaaaatctgagcgctttttcaaacacactccagttatacgcatctttttttggcttgtctgccacgtttagcattttcaaagtaggttaacaaatgtatactttaaatgctgtcgctaatttttactaaaagactatgatacattaagtaattgtaattttggcggcacagcgaatctgtatttaccaaaacttacatgaaagaatgaagacgaatggtattgaccgatattgagtatttaatcagctatctagaagcccacaacgtaccgaaaattcacaaaaaacgacatacttatctcacttatcacgggctttctgagcactacacttacattttgaaacaaggcatcatcaagaacagcatcattctgcaagatggccgtgaatttaatctatcctacatcgctaaaccggatgtaatttctttgttgcgcgatgaagtgtcaaaattcacctcacaaccgttcaatgtgcgcatcgaatcagatgaagcaaccttttaccagatcgaccgcgtaactttctggaagtacgtcaacgcgactcctgaattgcagaattacatcaaaaattactatcgaaaaaaattatcggaaaatattttccgactacaacgaatggtaatgaacggtaaaaaaggcgctgtctgtgccttcatttacagcttgatcgacttatttggtcggcagatctccgaaggtattttgattgatttcacggttactaacgacgatattgccggcttctgtggcatcagctcgcgtagtagtgttaaccggatgttgaacgaattaaaacaagacggagcgctgattacccgcgaccgtaaatttatcatcaccgatattagttatttgatcgatcatatcgctaattagttgcgtttggtgttcaccgctgtcttagcctttataactaatttggtttaaccctttatttaacttcttattttaggttctatactagtctcgtttgagcagcgcaaatagtgccaaactttttttgttactacctgcaaatgagaatgaaaactcattagtagcagtggcccaggctcaacattattttttaatgagctaaccggcgatagcacaatgttactgttgtactgttacaccaggtaacacttttttatctgtctcagcttttttgtgttacctagtgcaacactttttcaggtaggtacagacaccaaacgatccacatcatcttgaaaaaaggagtccaaatcatgcacattcctgataactatttaagtccggtaacctgtggcgttatgctaacagcaatggcgccaatctggacggtttctattctaaaagttaaggcacagatcaaagagaaaaaagaaacggttccgttgattggcgtggccgctgcgttggcttttttgatcatgatgtttaacttaccgattcctggcggcaccacggcgcatgccgttggtggcaccttgctggccgtcttattaggcccctgggcggcgtgtttagcgctgtcgctgaccttgttgttacaagcattactgttcggtgacggcggcgttttagcctttggcgccaatgccttcaatatggcagtgatcatgccatttgtcggttatgcttgttaccaaatcggccgccgcttacaccatgaaaaaatcggtttagccgccggtgcctatctcggtatcaatttggcggcattaatggctggtgttgaactaggactgcagccactactatttcacagtgctaacggggcaccactttattgtccttacggtttgcaagtcacgattccggctatgttagctgcacacctactagttgccggctgggtagaggccttgttcagcgtactcgtttatcagttcatcaaaaaagctgcgccgagcaccttatatcaagcaccgggtgcctcaacctcgtttaaaattttctacggcttattgctcggtctgatcgtactttcaccgctaggcttgttggcttccggcaccgcttggggcgaatggagtactcgcgagttgagtcaacgattacagacagctgcgccaaccggtatgacccacggcgtgcattttaacgctttattcagtgactacgcgatccacggcctcaatttaccgttaggctacattttatcagcggtaacggctgtattgatttttaccctgctagtacgggtggtgcaacatgaccgctaaattaccgacttggctaaccgacgatacgccactaccaaccgtcaaaaagcagcaccactttttagcacaaaatattcgccacctcgaacagttattgctgcatttcagccaagcaactgaacaagcacgaccacaactgaaacattattggccaccacagattaagttgctgacaactttaggggtggttttacttttatccttaaatcaaaatccgttgctactgtggttgattttattaggcgaacttggcttacttttattcttacctggtttttatttacggcaaattttaaggcagacattaattagtagtggtgtggcgttatttttgattttacctagtctgttattaacaacgcctgccagtgtcgccgtgttttgtttaaaaaccagtttgatcctgttgacgttaacttattaccgcgctaccagcacctttagccaagtggtgcaggcgctcaagcagctccactgccctaacggcttgattttcgtcatcgatattaccttgacctatttgaaaatgctggccgagtttttactgggattactgcaggcggtcagtttacgtaccgttggcccaaccgctcatccctaccgaacgatcggcttactgttcggcaccctctatttaaaaacccgcgattatgcactagcactttacgcggcaatggaggcgcgcggctttatcggcgactatccagcagcgccccacaccactaaaaaacggcgtggccaccgttacttattcttacgaggaagatgatctaatgctcaacttgcagcacattagctatgcttaccccaccggcaccggtttgactgatattgagctgcaaatcaatgctggtgaattcatttgtttcatgggtcccaacggttccggcaaatccactttatttaatcttttaagcggactaaaaaccgccaccgccggccactattatttcaaccaaacgttgatcgacgctgcctatttaaaaaacgcccaacaacgacaaacctttcatcaacaaatcggctttgtcttccaaaatagtgacgttcaactatttaatttgaccgtcgctgatgaagtggctttcggtctgcgccaactgccactcgcaccagatgtgatcgatcaacgcgtcaacgattgcttagctctcactggatgcaccgatctgcgtgaccgtgtgccctaccatctatctggcggtgaaaaaaagcgtgtggctctagccagtgtgttagccttgaatccaagcgttttgatcttagacgaaccatttaacggcttgaccccagcggcacagcagcagatactcgatttattgatccagttacaacaagccggtaaaacgattttattagccagtcatgactacgcgcagatcaaaaacattgcccaacgctttatcgttttcaatgagcagcaccaaatcgcctacgacattgaccgtgccagcctcgctagccagccacagttacaagctgaattagccttattataaaaataggtgtaaccaagtgtacttagcacttagctacgcctatttacatttaagctatttgttatttcatcattttatgatacgattttaataattatcatttaatggggatggcaaatatgattttattaggttcggtggtcaatagtttagcaatcatcggtggtagcttgctgggcaccattttgcgcaatattagtgaacaaactaaggataccgtcactaaaggtatcggcctcggcatgattgcgctgggattgcaaatggcggtcaaaactgattccttcactttgatcattatcagtctctgcttaggtgccatggttggcgaagggctaaaaattgagactggtatgaatcgatttgggttatttttgcaaaaacatttcgccaaaactaacggcaactttgctgaagggtttgtcactagtaccttgatttttgtcatcggctcaatgggtatcatcggtgccatccaaagtggggtctccggcaatcaccaaaccttatataccaaagccgttatggatggttcgtacaataccccttagggttgacactttaaataataaaagtgtgaatcctagggggtgttttgcattgtaagttattcaactattgaaaagcttaaattacttcatgattatcagaaatcggatta

SEQ ID NO: 573 - DNA, 7007 bp, Unknown
  Metagenome-assembled genome
tgggatcaatttaatataccctaaaatactatttttagattggctactaccaatattgccgctttgatctgggtaaagaaaaaagaaagctgattatatcaactttcccttgactaatggtagaaaagagcaccaataaaaaatccataaccaagcaaactgttgatcagtcggccacaagtcaggcaagtaccaacactcctgctacgcaaacagcagaatcaacagaacaagtagccagtcaagcgactacttcaactgtagcggaaacgcaaaacacgacaaccgcacaatcaactacaccagttacgcattcaggactcactctaggtggggtcgatttcccgattgtttcattttctggttcaggtcacgttcctgctgacggtaatgtttattcatggagccagttagccaatcattacttgattgaatatcaaggtactgcccataattacattagttcagcaactgtcggcgcaacggtatacgttaatggacaagcttatcgtatttccgaagtgctaccatgggtcgactacaatagcgcctacaatgtattgttatcccaccgtgttactggcggtatttcctttcaaacttgtgaaacaactagtgccgcttcaccactgcgtttatttatcgctgtgccagcgtaacaccggtgatcacaacggagcaaaaccagcgatcgtttaaaatagcttaaatctatggatgtgcctataaattatgggtgcatccttttttgttacttttcccgtactgaattgaaaactgaccctcaaaaacaatacaacaaaaaagccgcatccaaaattactggatacagcttttgctagataattagtactaagcttgtgcggccacaacggctgtgatcgactgagccacagcttcggcacaaagacggccttcgcggatcgcccagatcactagactaggaccacgccgggcatcaccagcaacatagacttgatcaacgttggtattatagccatcgtaaatttcgttaacgccaaattgatcaaatacatccgttgccgcaccagtgaaaccaagtgccaataacactagatcagccggcatttcttgctccgtacccgcaatcggctgaaactgtttaactttgctggtggttaaactagtcacctgaccatcggtaccattaaaggcggttgccgtggtttcgtattgcgtgatcacatcaccaaataattcctgtgcttctgcctgaccgtagccatacttggttacccgcggccattcgggccagggattatccgcactacgctcagccggtgcggctgcagtgatctccaactgcttaacgtcggccgcaccttgccgcaccgcagtggcgatgcagtcattaccagtatcgccaccgccaatcacaacgacttttttaccggctaaacgctgcgttgccgcagtgtcattagccacgacggccttagtcgctgtggtcaaaaagtcaaccgccagttgaaccccctttagttcgcggcctggtgctttaagatcacgtgctacacctgcaccgatcgccaagatcacgcgggtaaattgctgccgtaattcgtcagcggtaatatccttaccgaccgttgtattaacgacaaacttgatgccgacttctttcatcaaattgattcgccgctcaacaatcgttttcggtaatttcatattcggaatgccgtacatcgctagaccaccaggacggtcgctacgttcaaaaacggtcacactgtaaccgagctggttcaaccgccaagcagctgctaagcctgctgggccgctaccaaccacggcgacttcgatgccattgcggctaaccggcaggccactttttttgacccagccatgcttaaaggcttgctcgatgatgaagcgttcgttgttccgaattgtaattccctggccgtttaatgcttcattacaggacacttcacacggcgccgggcatacgttaccagtgaaatcaggtagcgaattagtcagtgttaaccgttcaaacgcctttttgtcctcggcacgatagatcaaatcattccattccgggatcaagttatcgttgggacagccgccaaccgcgcggccaccaccgtagaaaaagccagaatgacaatgaggaacgccacagttcatacagcgagcggcctgacgccgacgttcttcctcaggcaaggtttcttctagcgctttaaaatcgtgtacccgctcaaaaattggtcgatacgtatcgttgtggcgggggtatttcataaaaccaaatggatcagccatattctattcactccttcctatctaaatcgtctcaccagtggcgattgcgaaggctttttcggccaactgtgcctttggtgttccttgggcagctaattccgccataatttcgttcatatggcggaagtcttgtgggtaaactttaacaaaatgttgtcgctcgttttcccagtccgccaaaattgccttggctttagtcgactccgtataataaacgtgtttctccaacaatttcttcaagatactgtcgtcgccagttgcacccactggaaatagctcaaccatttccagattacagttagccgcaaacttagccgttgggtcgtaaacataggcgaccccgccagacatcccagcaccaaaattacgtccagtactacctaaaacaaccaccgtaccggcagtcatatattcgcaaccatgatcaccaataccctcaacaacaacatcagcgcctgaattacgcacacagaaacgctcacccgcacgaccattaaagaaggcctcaccggatgtggcgccaaaacaagcaacattaccaacgatcggtgtggtactgtatagctgctgtgctttagctggtgcttgcacgatcaaacgaccgccgctcaaacctttacctacataatcattagcctcaccgactaatttcagctctagcccttgcgtcataaaagcaccaaagctttgaccagcgaccccagtatattgataactgatccgcccagctggcaacgtttgattaccaaagcgttcagcgatccaaccgctaacactaccgccaactgtccgcatcacattattgatcggtgcgctaagttcagtcgacttgacttcctgcagtgcctgcgtcgcaaatgcatctaattctggctgttgtgccggtgtcactaatggctcatttgacttacgctcaatgccgatcgatgtgcttaaaatacggctgaagtccaatgatttagctttacctttagccacaaatttcggttgtaaatgttcagtatgaccaaccatttcgtcaacggtccgataacctaaagtcgccatttgttcacgcagatcttgggccaaataacgcatgcagttcatcacgtgttctggcttaccagcaaagaacttacgtagggctggattctgcgtcgcaatcccagtgggacaagtattcaaactgcagacccgcatcatgatgcagccaattgacgccagcgttaattgcgcaaagctaaactcttcagcaccaagcataatcgcaacagcaatatcacggcccgtcattaatttaccatcggtttccaaggttgctcgctgccgcaaacgatttaaggctagggtttgatgagcttcagcaagtcccatttcccacggtaagcccgcgtcacgtactgagttccgtggggctgcgcctgtgccgccatcgtaaccagaaatcacgactttatcggcaccagctttgactaccccagtggcaatcgtgccgacacccgtgctagcaactaatttaaccgtcactttggcgtgcggattgacttgcttcaaatcaaagatcaattgcttcaaatcttcgattgaataaatatcatgatgcggtggcggtgaaatcaaacgcacaccaggcaccgagccacggattgccgcgacccacggatagttcttcaatcccggtaattgaccgccttcacctggcttagcgccttgggccattttgatctgaatttcttcagcgctcatcaagtattcggtgttcacgccaaaccgcgctgaggccacctgcttgatcttgctatttaagttacgaccatctgcttgcggcttgaagcgttcccgctgttcgccaccttcaccagagttacttttagcgcctaacgcattcattgctgccgcaatcgtttcgtgggcttcttcagaaagcgagccataactcatcgcccctgatttaaagcgtttaacgatcgcgctaactggctcaacttcacttaatggcaccggcgatttagtcgaactgatcgtccataatgaacgtaaagttgtcggactggctaactcctcttcatgcatttccttggcgtattcttgatacaacttgtaattaccaccacgcacagcctgctggaatttgtacaatgtcataggattatacaaatggtgctcgccttcagcacggaacttaaagctaccacctgatggcaatggatcatgcgctttcggcccataagcccgagtgtaacgcgccaaatattcctgttcgatctgttccaaggataggccaccgatccggctaggcgtgccggtaaagtagcgttcaacgacttttgacgacaggccgaccgcttcaaataactgcgccccttgataacccgcaatggtcgaaatgcccatccggctcatgatcttgataatacctttttcacaggcttgacggaacgtttcaacctgatcagccagatcataagcccctaaggtcgcgtacgccccatacggatggatcgctgatgccccataaccgatcaaagcggcaaaatgatggacttcgcaagcttcaccggtatcaacgataagcgaggcttgaccgcgcttgcctttagcgactaaataattatttaagccggcaactgccagtaaaactggaatgatcaatttatcctcagtcgcaccgcgatcggtgaggatcaacaatgtagtccccgtatcaacggccgcttccgctgtttggaaaaagctatccaaggcctgttctagccgattaggccgtgcttttttgtcatagcataatgagatctcagttgacttaaaatctggcatatccaaatgccgcagccgttcaaaatcagttgaactgagcattggggtcgctaacttgatcttcttagcgttagcggcagtatcagtggtcacatcagcgtcacggccaataaataattccgtcccgataaccaacttttcacggatcgcatcgatcggcggattcgtgacttgagcaaattgttgcttgaagtaagtaaataaagattggggtttatcggacaacactgctagtggtgaatcgaatcccattgaaatgattggttcctcaccatttttagccatcggtacaatggcttcacgaataatgtcatcggtataaccgtgacgccgccataacgtttgcaacgcttccggtgatagattctcggtcacatcggcttggggcaaactgtttagcgtcagctgattgtcatgcaaccattgactataagggtgttgttgcgcataatgcgcctttaattctgcagtgtggtagaagcgtcccgcagcagtatcaactaaaatcatatcggcagggccaaggatacccttttcagcaatgtcttcaggcgcaatatccaccgttcccgcttcagaagcaacgactaacaaattatctttagtcagtaaataacgcgatggccgtaaaccattacgatccaacgccgcaccaacttgtaccccatcagtaaagcacaacgctgcgggaccatcccaaggcgcaacaaaactggcgttatattcgtcaaaggcacgctcatcatcaggtaattggaccgcgtcaccccaagcttccggaaccatcatcatcaacgcttgcggaatatcacgcccgttgcgataaaggtactccaaacagttttccaacttagctgaatcggaatcttcttcgttataaacttcaatatcgtgactggccatccaattttcagcaccttttaacgtgttgatctcgccgttgtgggcgagaaaacggaatggttgcgcccgttcccaacttggaaaagtattggttgaaaaacgtgaatggatcaacgcaatattagtttgcatcgccggatcatgtaaatcaggatagaataacccaacttgataagcgtgcaacatacctttatagcacaatgtttggctagacaagctgacaatcgcaaattcatccgccgcaaacgttttttctaatcgacgccgcaattgatacaaagcatcctcaaatggccgccccgctggtatatcatggggccgtgccactaaaacttgggcaaaaccaggcataacgcgttgcgccgtcggaccacaattttcgtagacgtaaggcaccgcacgcgttcccaatacagcaaagcccgcgtggccaatctcagctgtgaccgccgtcaactcagcggctttatcagtcggtgtctggggcaaaaagaacatccccactgcgtaatcaccagctggcggtaacgttaaggcttgttcttgtgcatatttgcgaaaaaatgcatcgggtaatgccatcaaaataccagcaccatcaccggtatcaggctcagccccagtaccgccacggtgattcatccgcgctaacatggtcaacgcttgttcaattatctgatgactacgctccccagttacctgggtaataaagcccatcccacaagccgcgtgctcatagcgcggttcatagagggtctgttcacgatctatcatgaaatcccacctcgggttcgctaagattagaatattttaatttttatctcattttaatagtcattttcataataatcaagttttttcagaaaaaaacatgatttatactagtacataatgcgtactgaacaaatcgtattttaaatatttactaacttttgtcggtttttacagaaaatctgattgataaataccaaccagccaaaaataggccgcgaaaaattagccatcaacttggataa

SEQ ID NO: 574 - DNA, 1234 bp, Unknown
  Metagenome-assembled genome
catccccttgagggcgtggcctttaaacgataggattttccctgacaggaggctgcgttcctaaggtgcgatatggatgttcaggcagggatgctagcaaggctctttaagaggtcccaggggactcagcgacgagtgggaggtcacgggcgtctggtttaaggagcgcaagggagcgcagagcgagctccatgtgagggtggctcacaggaagggccaggcagtggtgagccccgtatgccataggaagtgcggcacctgtgacacgcgcgagaggacctggagacacctcgacatctggcaatacgagacgatcgtgcactgcacgatgcccagggccgactgccccaaggacggtgtgcatgccgcaaggatgccctgaaaggtgcggccgaagacgcacttcacggcgctctttgaggcgcaggcgataagtgagggcgctctttggtatgagcgtctccgcgatagcgcatctgatgcacgagacagcccacgcgcatatggtgcctgctgggcaaggccgtggccgaggcgagggatgccgccgactactcggatgtcgtgcgcgtagggatagacgacaccgcccgcaagcgcaaccaaagctacatcagcatcatggccaacctcgaccaccagcgcgccgtggccgtcacgcagggcagggacaagggcgccttaggcaggctctgagacgagcttaaggagcacgcagggaccgcacgaaggccttagaggtcatacgcgacatggcttaaggcatactcgctcggtgtggctgcagagatgccccaggccacacagagcgtggacaggttccatgtggtgcagctcctgaacgtgaggtgccaagagcggcgcgagtccgccgagaagcacaaggaagcttgcccagacgaagtacctgtggctgaagaagaaggagtcgctcacaaagcgccagctcgcgaagagggaggagctcgaccctgcgaagacccatctcagggaggcacgcgcctgccagatgacagaggcgctgcaggacgtctattcatgcgcaggcagggaatcggcagacagggccccagagcgcctctgctcgtggatgatgcactctgccgtggccgagatgaagagcgtggcgaggacgctcaggaaggagtgggaagggatcctcaactggtggaagaggggttcgaccaactcgttcctcgaaggcctcaactcggttgtccagttcgcccgcagc

SEQ ID NO: 575 - DNA, 12655 bp, Unknown
  Metagenome-assembled genome
tgttggttatgttgggaaaaaactcaagaccagttttagggccctaggctataacttatggacgccttatcgttctaatatgaaaggtgctaaacagcataataagcgtcaactcaaggcgttacggcggacaatagagtcacgcttttcaattttagcccagcaatttgggattgaaaccaatctcacccgtagtctatttggttttcaattaaagattgaattgacgatattggtatacaatttaggcttttttgattttatgacgaactaacaccacgcgtaattaattaactaattttcaggttattcaaggtaactatttatcaagataaagccactttaaataacgattacacatttaatcgttgttaatcatttcccagtttagtggcatttctactgattttattcggtcaaaaaattatgtaggctaaatatataaaatatgttatatttaaaacaaaggagatggatattttggcaaagaccaagtatacctaccgaagactgactaaagttttagtcggtactttagtaatcgttttttcgatcctgatcgccggtggcttcttaatttttaaaaacgaagcgccgcgaccagcaaaaatcgtgaccaacactggggaaacgttagtcactagacatgaattacttagcggccaagccgtttacgagaaatacggcctggctgattatggtacctatttaggcaatggttcctatctaggccccgattataccgcgcaaagcttacatatctatctacagggcatggatagttattatgcgcagaagttgtaccagcaatcattcaaggaattaagcaactttaaacaaggtgcgatcaaagataaggtcaaacacgaaattaaagtcaaccgctattccaaagctaaagaaacgctgacgttaactgcagcccaagcggctggctatcggcatttaactagctactatcgccatgaattcatcaataacccacgccaagcgggcttacctgaaaatatgatcaacacgaaaaagaccgacgccttcatgtataaaggcaacaaggtcgatcagttgaccagcttctttttctggggcgcttggatgtcgtccaccaatcggcctggacaaacttattcttatacgaataattggccatacgacttggacgccggcaatacaatgtcatctgaatcactgatttggaccgccatcagtgtcgccttactcgtcgctggtgtcggcgttatcatctactatcagcgccggtacgcctttgacatggacgctacttatcaaaacgctgaccagatgccgctattggacactgattttgcgatcacccaaagtcagcggaaaatcgccaagtttttcttagtcgttgttggcctattcttagttcagatcttactcggcgaactaatggcccactattatgtagaaaacgagtttttcggtattccgctacagaatatttggccatttaacttggccaaggcttggcatttacagttagttattttctgggtggccaccacttggttagctaccgggatctacatcgttcctcgcgttttacgccgcgaaccaaaacgccaaggcctgctagttgatctgcttttctgggcattgatcatcgtggttgtcggcagtatgttaggcgaatgggcgtcgactctaggcttgttgaaccataattggtggttattcggccaattcggttgggaatatatcgaactcggcaagttctggcaaattctgtttattatcggcatgctattatgggtgatcattttgatgcgtggctttattccagctatgaaacggccggacaactatgaccgcaaacgtttgatcacactgctattctgcggtgccattgcgattcccaccttttatctggcgtcattattcattttaccgaactcccacgtgacttttgccgactactggcgttggtggatcgttcatttatgggtcgaaggtatcttcgaatccttcgccgtgatcctgatcggttacttgatggtcgacctcaaattgaccaccacccgctcaacggttcgcgccttgtacttccagttgaccttactgctaggttctggcgttgtcggcatgggccatcactatttctgggaaggcgatcactcgatttggctagcgctaggtgcctgcttctccgcgctagaagtggtgccactttgcttgttgctgtgggaagcgtacactcattaccgcgtcttcaaggacagcaaagtcgactttccgtataaaggcacttttgtcttcttgatgtggacaggaatctggaacgcgatcggcgccggtgctttaggtttcatcatcaacgcacctgcgatcaactacttcgaacacggcactcaatggacttcggctcacgcccacggttcgatggccggtgtttacggtatgttctcgattgcgatcatgttatacgccttacgtaacatttctaaatctaaaatctggacaccgaaaatggacaagttagttaactggtccgcctggctaatgaatatcggcctcgccggtatggtcttcatcagcttgttaccagccggttacctgcaattaaaagacgcgctggaacacggttactggcacgcccggctattatcgttctaccacagcagcccagtggtcgaaattctgtgggcgcgaatcgttcctgatctcgtgttcaccgccggcgtgatcgttttgatcatcattgtggtcaaagtcttacgcaacttaaaaccagccgacaatgaaaaagcggccgctcactttgatgctttgacggcacaagaagttaaggacgaccaattgaacgtcgactaataaagagcgtgacataaattacagattcattctgaaatatgattttttagtgcacaagagcagagttagttaggttccattccggcgctggcgtatggaacgcgtggcgcgttgacaagctaattttctttccgattaaaaaccagtcggaaaagaaaatggatcttgtcaatcgcgcatgtaactaagcgaccaaagtacggtcaccaagttacatcgacacagctgatacgccagcgtctccatttcaccttggcagtaattgagcattgaatattttgtataattaaatgcttcgctagtgtgattgagtataacctacaagttggataattcgtcacttttaagttaggccaatcgtttctaaacaaaataccagtcaaaacaggtttagctgttttgactggtatttttgcgtccaacttatatttttagttgtacaatcacaattgccgattgcgcaactaaatttggtaggtgctaccgtgaccgtggccaatggaatggaatctaacctactctgtttcacgctaaccatactccagattaaacccaattacacatgtagcggctctttttcatttctgagaatagatcggcagcaaaatatcatctaccaacatggtcaacctctgttcggtcacctctttttgaacaaaaatgttatagcgcacccagtcaaacggcaacaacttcagatcatcagctaaatcagtgcgcacgttttcaccacggtcggttgcccgctttaagacaccatcgatggcccgcatgtcgatctgggagctgcggttgatcattttgcgcaaggcttcattttcatgctgactgatttcggtgaataagctttgtaaataactattgccaaacgtatcgatactgatcaaaaagtggtgcatcaattgtaataagtctgcgcgcaaactatttccggtcaaaacatactgatccatgttacctttattttcccgccgaatttgatcttgcaccgccgcgatcgctaattcaaacggtgtattccaccggcgatagatcaccggcttgctggtcccggcggcaagtgccaccttgggtaaggtcaatccagcgagcccctcccgatcaataattgtccgcgttgcttgataaattgccgcttccagttcagcgccacgccggcgtgttttgcccataacgatcccctcccaattttaaaaataaattttgtgcgtccaaatgccgctacgtcattcgtttaagcttttccatttttaagatactaaaagtttcttattgacttttaccctgcaccgtgtattatacagattgtgccaataagataccaaaagtttcttaaagaaagaagaatgataatgtcaactaaagcacaaaaactaccgcgttcagttatgacggtggcgtgggtcctcgttcttggggccatggcgccgttacttgactcgacgatgatcaatattgcgattcataatttagtgcatgatttaaatagttcggtgaccacggtgcagtggacgatcacctgttacctattggccaccgggatcgccgttcctttttccagttggctgctgaacaaattcaacggtaagcacgttttcttagccggtgaggtgttatttgccgttggttcagtcctttcggcgctatcgccaaatattcagtggttgatcggtgcgcgggtgatccaaggattcgccggcggcctgatcataccattattgactaccttgttagttcaaaccgcaggcgccgcggcaatggggcaaatgatggccaccgttggcctgccgatgatccttggaccgttatttggccctgttctcggtggtatcatcattaaatatctgtcgtggcactggattttttgggtcaacgttcctgtcggtctcatttcaattttattgatcttatggaaaatgcctgattatccggcccaaaataaagccgctaaaatggactttgtcggcatcatccttttggccagcactactactagcatgatctacggtatcgttaaggcctccaagttagccaatttcactaaccaaactacgctaactttccttggcggtggcttactagttctagtgttctacatcatttgggcggcattgcgcaaagaaaaagcggtgctgccactgaacttatttacccacgcttccttcaacggcgccgggctagggttactgatcgctggcacggtgcttaacggtgcaatgctgttgctaccgctgtttttccaggatgtccgcgggatgaccgtcatgacggccggcttagccttaattccgcagggtgtcggcatgctggtctcacgaacgctaacggggcggctgaccgatagtatcggcgctaaatatgtggtgctagtcagcctgctgatcacctttgtcggcacactacccttttactggttcgatgcccacaccgcttattggctgatcgcagccgttctagttgtccgcggtgtcggtgccggtggcattttgatgccgctaatggccgacgcctatactggtatgagtcaccaacaagttcccgcggcttcgatcggttcgcggatcattcaaaatgtcggtagcgcctttggttcggccttgatcgcaaccatcgtcaccgcctattctaacgctcacgttaaaacgttccagcagcagtttgccaatggacactttcatattcccgcggtgcaacaggcgacttttgcccgccagcatttagtcgcgattcggctgcacgcctttcaatacggcttcttagtgactgcgatcgccgccttagtgatcgtcctaccggcggcgctgctgaccaataaaatgaatagcaaacaagccagctaagcgtatttaaaacgaattatactgcgggcctaccaaaatgcgcttgaaaaattaaattgggtagactgttaatgatcagttgcgcgatctgcgccggcgtcttattataatcattttctgaccagtggcgcaaaatcatggtgaagctggcttgaaatgttatgaacaggtacattaaatcatcatccgccaactcaggcgtgctttttttcaccggcgttagcagcaactgatacagttgatcaaagccttcctgaatcggaaagtcatggcgggatcgtaaaataattttataaaaccagccattgtcacgaacaaacgttaaaaattgctgcaacgattctggatcaagaaatttaagtttttcgtgttgtgcaggcgcagaagccacacatcatttcgcgtcgcttgaccgcttgcgtttgtgtgaccaaatcaaacacgtctaaataatgcgcataaaaggttgagcgattgatcttggccgccacgcaaagttgcttaacggtgatccgctccggtaccgtggttttaagcaactcaaaggtgagggtttgtagcttttcgtgcgtacgtcgccaatgtttattatgtttttgcatgttacctccaaaaagccaacacttgtctgaatattgttggctgactttattttaccttgcgcttagaatgaatgccataaggagcgtgaacgctatgaaagccgcaatttataaaggtaagcaaaatattgcattaactgaattaccaacgccgcacgccggcgcaaatgacgtggtgatccaaaatatctatgccggcatctgtgggtccgatgtcgccgtctataaccatggaactaaaactggacacaaagtgggcatagatcacgaattcggtcacgaagccattagtcgtgttgtcgcagttggccaaaatataactgactttcaagttggccagcgagtctttccctacccactttacgcacgtggcgataccagccgcgccggtagtatgggggcattttccgaatatatcctagtgcctaacgcacgcttaaataaacaactctacctcgttcctgaaccgatcactgatcgcgtaggcgcaatgatcgaaccatttaccgtttgtacttgtgccgcacgccatggtcacccgcaaaagggagaacaggcgatcatttatggtgccggtacgatcggccttgcagcggcggttgcgcttagctactttggcattactaaaatagtcattgtcgatcactcggatttacgactcaatattgcgcgtcaattaggctttgccacgatcaataacgcccaaaacgatgtccgcaccggtgcggctacacttctaggcaccacacgcggtttacacggcaacgattatcctaacgccgctatcttcatcgacgccgttggccgcaacgagatcttacaagactttatcgaattcgggccgatcgacagtcgctttgttgctgttggcgtcaataatacccagccggaactgaacatgttggaactgatctacggctccaaaagcatcggcggctccggcggttaccgaccggcagacgtgcaaaccgttatgacgatcatggccagccaacaattcgctttagattcaatgatcacacaagaagttgatcaagcgcaattggaagccggtatccaagcggccaccgacgtcgatcacgcgcttaaagtcctagttaattaccatatttaacctatcatctgatcaaaaggctgctacggcagtctttttttatccagaattcgcgccaaccaatcagaataaccctgctcacgttcgatcgcgtgttgtaaaattaaaaaatggccataattgtcagttttactagctacggcgctaaatttacgcgtcatttgtttttgcagatgcgccaacttagcttgatgtagccttaattgttccgttagcattggctgcagcatgggatcatcagcgttttggacgaaatacaacttcagaatgaattcgtctttactcgcggtcaactcggtggtcggttcatggagccaatcgctgagttgcgcctgtccggccgccgttaatgagtaaacttttttctccagcttttcaccacttacctgcaactgatgcgagatcaagccaacactttccagtcgcttcaataatggatagatctggctgtgattggcgttccaaaattcgccgatatccgcggtaaaggctttggcgatgtcgtagccggtcaaatcgtgctcccctagtaggccgaggatgatgtattttaatttatttttttgcgccataacgatctccttgacttttatttaaggtgagtataacataatcatatattttaaaacatgtaattatatacatgattaaaaatacttaactggaggctattttgatgacggaaaaaacttttaaaactttagatgatttcttgggcactcactttatttatacctatgataatggctgggaatatgaatggtacgctaaaaacgaccatactgttgactaccgtattcacggtggcatggtcgctggccgctgggtgactgatcaagcagctgatatcgtgatgttgaccgccggcgtttacaaaatttcgtggacggagccaaccggcactgacgtcgctttagacttcatgcccaacgaaaagaaattacacggcacgattttcttccctaagtgggtcgaagaacaccctgagatcacggtcacttaccaaaacgaacacatcgctttaatggaagaatcccgtgaaaagtacgaaacttatccaaaattggtcgtgcctgaatttgccaatattacttacatgggtgccgctgggcaaaataataacgacgtgatcagcgaagcaccatacgccggtatgccaacggatattcgcaacggtcactatttcgacgagaattaccaccgaaaacatcagtaagctggcctaaaagcgtgtgacctaaggcacccagctactacgccacagtagcaaaaattttcatcctgaaaatctttgctattctgggcgttgaccattcttgtggtaaaagccttgccgcgctaggctttgagcatcaacctagcgcggcaaataatacttatttaccgcgcgtcgctaagcggaaaaaactgccttagggcccacggtttaactattagaagtggcgaaggagtcggacataacttactatgtcacaactcgtttatccgctaatgctagaagtactttcagtttgcttactgatttaaatgtagtagaatgaggctgaggtgatgaaaatgacaaaaaaagtagcattatcaacattagttgcagccggtgcaactgctggattagtatcaggattagttaagttaggttgggaagccttacttccaccccgcacacctgaacgtgacgctaccaatccgccgcaaacttttctccagcagcacggtctgagttacgcccagacacataaaacttatcgctataacgggcatgacgtgccatgggtgagcttgatgttgcattttggcttttcgtctggtattggggcattgtacagtgttaccggtcattacttaccgttcactaaattaggcaatggtgcagcttatggcttagcaacctgggctggtgcgcatctattagcaatgcccaccttaggcatcgtgcctactgccaaggatcaacctatgcctgaacacgtatcagaggctgcggggcacatggtttggaactgggtcaatcaattaaccatcgatcaattacttattcgctggggccagcatgaacaaaaataatcctaaatggcaaactaaatggcccgaacggcttagctatggcttaagcgatgcggccgataatttagtttttcaagtgatgacaacttatttattgtttttttacaccgacatttttggcttgcgtcctggtgacgccgctattttattcttgatcgcgcggatcgcggatgtcatcgaaagtccaattgttggtttgatgatcgatcatacccagtcacgctttggtaaaagccggccatttttcctatggtttgccttgccatacgcaatatttgcagttttagtttttattacccctgattttggttacaccggtaaattgatctggtcctacgtcacttatttaggtcttggttttttatactcaacagttaacttgccgatcacatccgtactgccgactatgacacaaaatccccaggaacttactttactgggggttattcggcaattttgcggtagcgcggttcaaatcatcgtggccgtatttacgctaccattagtcgcttggctaggccaaggcgatcagcggcgcggcttcctttacaccatgattggctttgcggttatttcattgggcttgattttgaatactttttttcatattagggaacggttttcgcttaaggcgatcgctcatgcatccttacgtaaaaccctccaagcagctggcaaaaatcgaccatggttaattttatcagccatcatctttttattctggctcgtaacggcaatcaaaaatcaaacgacgatctatttctttaaatatagttggcataatgaacaattagttgcgctagctaacgggtttaccttttcttctctgatcggtgtcctcctgattccacgtttatctagtcgttacggacatcgactgaccatgcgtagtgggatcatcgtcgccttaagtggccagttattactcgcgctaggcgtctattcccatgctctgtcggtgatttttgccgcaacattactcaatagtatcggtcaaggcttgatcgttggtttagtctcaattatgttggcggacacgatccgttacggtgtcacgttaggtgtgcaagcagaaggttttctcgcttctagtagcgactttggtgtcaatttagggttgggcctaggtggtctgatcaccgctggcctattcagcctttccggctaccaagccaacgcctcacaaaatagcgccaccctgcaaatgatcaccttaaattacgtgtggctaccgctagtgctctatattctattactgatcctaatccacttttatccggaaaaacaactaacgcaggctatttcatcgcaaccaaattctgtagggtgatttagcctgcaaaagtagttacggcgcgtaacaatctaaaaagagcgtgcgacctgaggcgcccacagctactacgccacagtagcagctgattttccggacgttggccattcttttgtggcaaaaaaaaccttgccgtaaacaacatcgctttgagcattcgtctagcgcggccaataattcacatagtggcttatttaccgcgcgtcgctaagcagaaaaaactgccttagagcacacgtttttaactatcggaagtgcaaaaatttgcaattgaattagttccaaatgatagccagtaatttgcgatacctactaataacgctgctgcaggtaaaactgccactggcagttgcaacgaacgccctaacctctgcatataagatttcatcctaatgccctccttgtataagcattatcacaaggttagcatcttgataaagcggttgcatcaagatggaaattggtctaaaaatcgctttttattattggtatataccgatgatgggtcataataagtgctccacctaactaattcattaatccgtctaccagctattaataactaataaaaatattggtttttttacgcttctagtttgcttaagttttcataaacgcaccattttgcttttacccaaggtcattaatgaaacttttatcccagcctgatgctaccctagcatttcaatttagctacggtcactgacttggaccagcgatgactttaaatgctcgctcagctcttgaatacccgtaatcgtttcacaatgctttattggtcgtcaccacggccgcaaaaaaaggtctagcatgccagacctttttagatggttaaaagcggtttgatcgccatgacccgcagttcatttgcaaaaccaaaatcgatcgtccactcgtccttaaaataagtagcacgatgccacctagtgcgtgcatgcgcatatgcggtcgtatccaccaccacgtcgaccattgtaccactaattcgatacgtacgaacacgtgcgttctgctgatcacgctgcaccaccacgcgacggacccgaatgtttttaatgatctcacgcttgccgcgcgcagtcaatttagccaagcgcgcttcgtttttagtgtacgctaacgccgccatttccggatgtaacgcaccgatatcgccactggcccaagccgcctggtaccgctgaaacaattgcgtgatagcttggcgttccgcgaccgttacccgctgataacggtgaggcaagtgccacggcgccttaagaataactccaatcaaaatcaaaagaccaaactaagccaaccaattgggagcaccacggctatagccacttaccccactggcacctccaccatgaccgccgccaaaacgtgcccacaccggcgtagtattactcaataataatagcaccacactgacaccataccacttcaccttgtgcatgccgctccacctcattttttgttattttgtttataccatattttgaagtgtacgccaattattggaaccgactaagggttatccctaacaatgtaatcgctttattgattttttaccgcagcgtgctatgatgaacttgtgatattttttctcctttagcaccatagtttgtagcagcattcagcctactactcaagtcagtcacccattgtggctgacttttttgattaaattcggaggcggatcgaatggcaaaaataatttacttcacttcaaaagcacggggaaccgtaagcaccaaataactgaccgactatcaaactaactaaatccaagttatgattacctcatcaaataattggtgaggtgatttttattggcaaaacccgatattgtacaaatcaaaatggatcaatctgaaccaca

SEQ ID NO: 576 - DNA, 11916 bp, Unknown
  Metagenome-assembled genome
tgttggttatgttgggaaaaaactcaagaccagttttagggccctaggctataacttatggacgccttatcgttctaatatgaaaggtgctaaacagcataataagcgtcaactcaaggcgttacggcggacaatagagtcacgcttttcaattttagcccagcaatttgggattgaaaccaatctcacccgtagtctatttggttttcaattaaagattgaattgacgatattggtatacaatttaggcttttttgattttatgacgaactagcaccacgcgtacgtaatacacattattcacgaaatccgtatatcgcatgtgcactaactgattttgggcgagttaaagaatttggtgagggtgttgatcgtatctataatgatatgaacgaattcttcttggatgatcccatttatacagttgcgagtaatagtgttgatttaattttaaagaataatattgttactcgttctttgcgaaaggatgccgcgttatcgtcaagattaggtgatgattggcaaaacttaagctttgttgaaaaacttgcggtcagtattgcttatgagaaacagagcgtcaaaactaaggaattgcaaacaatgactaaagtgggggtcacaactgcacatacgactttacgacatctagttgaaatcggtattttggaaaaggtggcaacttccaaggctgcatcaaaccagtattatcggttgatccagtaaccttattgtcgagtaacttgatctcaagctgagctggacttattgagtcggcaactgttataagttccgtcagttattggctgcatttttgtagcgtattagtataaaataagtgatagcgtaagtatgatgaagaatacgaggaagtaaacaatgagaaaacgaacaatgccgatcaaaatttgggatcggggcaaaaaaatcgctaacaatggtaacgttgaaattcaatatattgataataatcgctgggaagtcaatgcaatcgtgtacggtaccgaagcatatggtgttacggttaaccaaaaggattccgcgctggatttttgcgaatgtccgtatttccctgatcatgggtattgcaaacatattgctgcggtgatcaaattgttaaaggcgcagggccgaccgattgatcaactgttcgatgaaacgactgatgatctagattttacaacgaaattcggtgatgattatttattgatttcgggaaactttgaaaatgcattacgtgaacatccaaatagcgcaaccgtggtctatgcgaataaacaacaatataataaactgcgtgcggcgcccgattcatgggcagatttttttgcgaagcaaccagtaaagaaggcaaggcctgaaccgcgcccacaagctactcgggctcactttaaacggcaaccacaagctagtggcgaatactttcttgagcaaatcaaattaccggagcgccaatattttaaaccactaactccaacagacactggtgaagcattgtgtttagaagccacactggtggttagtgcagctagaagtgactgggattatacatctggggagcggttgtttattaaattgcggattgcttccgttgaagagcaaaagttttatgttatcaataatattaggcgctttttagaaacatatgtcgacggtgatgtttaccaaactggtgggaaacggacctttcaattgtcaacgcaggcgtttaccgtggctgaacgcgctttgcttgattttctgcagttagtcgatgaagacgcgacgatcaatacttacggtaccagtgcacacaaatattttgttctacccaagtataattttaagcatacattgtccttattaaccaacctagcacattttatttttcaaccagatgaaaacttaaaaaagatttacacggctgttgaacttaagccgtacactgctgatactgggctgctcactggtgaaattgtaaccaagcggaccggttatgatttcacgatggaatcgcatttttccaactttattaatgctaatttgctgtttattcgccggggtactttttatcaggcaaccactcatcagtttcggttgatcgcccaaattattaataactacaataatacaatgcgcatccaatcacaggggaatccattacattttccgcttggtagcgaggcacagttaagtgactttgtaaatctgtttcaacagatcggcaagcttaaggcgccaccacaactagccagcacaccaatgatcccacattttgcgcttgataaaaataagcagtcgttagaactaagcctggcttatgaatacaatggtgaactgatcgatagtaacgcgatcgcccagttgccagcacagacgcgtaatctagatatggaagagcaagcgtttgattatctgcgcagtttggatttccataaaaacagtcgcttgtgggtcaaaaagtttgccacggcggcagatctgtatcgcttctttgttcaagaattgcctaatttacaggacaatggggtcgtgaccatttcaccagaattgaaaggatcactgcatgatgccacagaattagcaccggaaatcgatgttagtgaagcggatggtttcttggcaatcaacttttcttttaatggtattgccgaaaaagaagtcgattcggttttagcgcaattagacgttgcccggccatatattgagcaagctgacggctcgatcattattgtcgatgatgagttgaagcgagtttccgccgcgttagccaaagtccgcgctcaaggtaaacttaaaaatgggcaaatgaaagtccacgcctcgcaagcactggctgttcaggctgcgttaggtgataccgctaactttgatcaaaaattcaaacgcttgactactgatctggcgcatccagagaaatttgaagtgatagctagtcggccagttaatgcgcaactacgtccgtatcaaaaagttggggtcaagtggctggaaatgttggattcctatcattttggcggtattctagccgatgaaatgggtctaggtaagacgctgcagatgatcacttttctgaataatcatttagttagtgataaggtcaatctcgttgtatcgccagcatcattgatctacaattggaaagaggaatttgctaagtttgcgccggagattgaagtggcggtagttgatggtagtaaggacaaccgccggcaactgattcgcaacggctcggccgccgttctgatcaccagttataatagtgcgcgattggatattgatgactaccaacaacgcgacctaaattatctggtgttggacgaagcccagtacgttaaaaatggcagcaccaaaactaatcagaatttgcgcaaattaacacctaagaatacctttgcgctatcaggaacaccgatcgaaaatcgcgccgaagagttgtgggcgatttttgccttagttatgccaggtttactgccgagtaagaagaactttaatcagttatcggcagctgagatcgtggtgcgggtcaaaccgtttattctccggcgtgagaaagcaacggtactcaaggatctgccgccaaaggtcgaatctaatttatataatgagatgactaaggagcaaaagacggtttatttagcgcagttaaagcaaatgcagatcaagatcaaagggatgtccagcgaaaacttcgttaaaaataaaatcgccattttagctggtttgacccgcttgcgccaaatttgtgacacaccagcgttgtatatggatgactatcaggcaggctctggtaaattggatcagctgaatgaaattctacgccaagcgcaggataatcaacatcgtgtactgatcttttcccagttcacgagcatgctgaatattattgaagccgagttggctaaacagaatattgccacgtttatgctacaaggcaatacaaaaccgcaagaacgtttggccatggtggatgcttttaatgctggtgaaaaatcggtctttttgatctcgttgaaggctggcggaactggcttgaatttaaccggcgctgatacggtgatcttagtcgatctctggtggaatccagcggtggaagatcaagcaacagcgcgggctcatcgaatcgggcaaaaaaacaaggtcgaagtttatcgtctgatcactaaaggtacgatcgaagagcagatctacaagctacaagaaaagaagcgtgactttgtcgatcaagtattgagtggcacggaaaataaaggttcgttgaccgaagcagaggtgcggttgattttggggattgaataagtaaggtagtgctggtcgcgggatcagcgctatttttgtcgaaaaatggtcagcaaatccgtactattgtggtatattcaggaagaaggtagtaaagggagcttgagcataatgacgaaaccacaaactagtgcagcgtatctatcacaaatgaatacttctgctggcttccattacgctgaaatttaaacggagctaggcaaggctggttggattccattccagtgtgcggatcacgtttggtacattggcattcgctaaagtttgcatagatctcagcactttacagtttttcaccaatcgctgaccgacaagaatccaatattcgaacgataatcttaaactgcaacttttttaaccgactttgttcgtatcgcgctaaactatcgaaaagaagcgccgcttgaatctgataacttagctacagcctgcgttcacgcaaactttgactgtcaaaaataccaactcaggatgcgctaacggtaacgtgagcatcaaagtgtagaccgtattcaataaatgctggcaagcttcgattttggcaaccgaacgcacggtatggtcagtaaaatgccagaaagtcttcatttcgtaaaagagtgtttctttcgggtacagctttttcatttgttcatcaaagttatagcaccaaatcaaattcgtctcggtgagtagtagtcaaaaccggtaccatctcgtatactggaattattgaacgttttatgtcaaatcaatcgaaatgaggtgaacctggtggccctatcgatcgcgcaacctttaaaaaacttactactagcaactaatcttggcttgaacaaaaatcacccattagctggctggaatattttaacgatcttgtaccgcgaagggccaactagtggtttgccaaatacgctagattttttggcgcggcgttacaatagtgattatttggatacagttaacgaggagacaccaatttctgatgacgttttgcgtaagattttagtggtgttgaccgaacaggctggcttggttgaagtcaatttgcgtaaagtgcggcggcatatgcaaagcggcaagacgatcactcagcaaacggcactttatcgtattaccagtagtggcatcgagtatttgcgcatgatgcaacgagtggtggatgccgaaagcaccgtcaccgccaacacgctgcggatcgatgagtattgccggttagtgcagaagttggtggcgcgagaaagtgatgcggcaacaacgcaactgtataatgattttgctgacatgttgactgcttacgaagacgtcatgaaaggcatgcataagttagatgaggatcttgatgagttggccaatgatctggcgtttaatcacggtggcacggcggcaggccatctgcagactatgctgcgcgaaaaggcagtgcctgcctatcagaaattgctagggcaagcggctaggatcaaaggtttgaccgcggtgcccgattttgccgaacgggtggcgcggtcacagcagggtagtgatgatctggacacggccagtgcggtgggcgataaagcggggatgttactgcgttttgagcgcacacaggcttatgtaacacgccaattagggcaaatgaatttaagctttacctccagtagtcaggcaattgataatagtttggattcgatctatttgctgtttcagactattttaaacgcgatcaaagtgttgagtcaggcgtttgaacatgtgtgtaatcagacgatcgatgttaaagcgttgactgctgagattgatcagctattacagcattatgatcggctgacggtttatcaaccaattttgcgtcatgcatcgtttgaccgtgatgatgttgaggatcccaatgacttgttagatgccagtggaatggatccggtaacttacgtagcagaaaaaaagacgcgcaaagtgtatacggcagcggataatcccgaattagtggccacggccgcaccaacagctgatcggcaggcggctttggcagagtttaagcaattagttctacgtggaccgcaacatttggtggtggatcatgatctggagtttgctactttagcggcccgcgatgagctggtgcgtttgtatagcgcgactaactatcatcattatgccagtttcacgatctttggccgagcagtgcgccgggttcaacaattgtcgcggccgataccactgcgcttacattgtcgcggggaaaaatacagtgtgtatctacccgctggctttgaagcctggtttgagtagtgccacttttttgattagatgaatgctcgttattcgtgttaacggaattacaagtgggtcaggccgatatttatccctaattgtgaagtagagaggagtagccaacttggttgaattacacgcaaatgaacgcctaattattgatcaactacttgatcgtggtcttttcactagcacggtgacgccggaaatgagtcagaatgtgatcaacgcgatcacggcgtttaagcggccgatcatccagcggcggatcaccaattatttaactgatctgctgggcgttggtccttacagttatcaggaaaatttgttgttaatgttaggcgcacaaccgttggataagactgcggttcacgttttattggcgacgttaaaaacgatcctgaatgagcctagcatccaaaatgatgatcagcgcgtagtggcgacgcagacggtcattcgccaagtacaaagcgaggtgactgagctggacgaaaagttgatttttcggttggttcggcagctatttgttgagcgttaccgcttgtttaaaccagaacgcttagtgcaagctccggatgaacaggaaatggtcgttgaggaatattggagtaccagtcctgatttcactagttttgcgcgttgcatggtcgatgcgctgcatgagcaacatacgacgccgactttatcagatcgacagcgggtcaatcgtggcttattgttacgcccgtttctaagtcctactgtgacacctgaattgtggccgctactgatcgctgatcgggataaaatagcggcgcaatgggaaccattacaacgttttgctttagaaattgggacggattatgctttattgctggatcgtcagcgacaaaaaatcactgcgaaggcgtacacggcagcactggcagtggcacgttcactgggtgctggtatgcctgagtcacagttgaaccagcgcatccgcttgattgtacgccaattatttgctactgataaaaaggtggtcattagtgatgttcgcagggcgttgtttgccaatgggttagcaacgatgtttggtcaaaacgtgctaccaactgcagttagcgggcgttttgcagtacgagcgactgaggaatggggcgattgaaatgataacaaggacacatttaacaccgatcagttatcacctgcgcaattttaataaatacgttagcttggatctggcggcggctggactgggtaatttgacgttggtgggtgaaaatgccgctggcaagactactttggccaattgcttctttccgatgctgattgatggctcgatcgccacaccttcctttaatgcagcgcggggaacggagcgggtggctaaggcgaccaacgcacgcaatagccaacaagacacgcgtacttttgaaagtatgctactaggttgggggccaggtgcgatgaaggtgcgcaccggctacagttatttgtgtttagccagtgagcagcggcaagtgattttaggcatcggcgcgcagcgaatcactggagctagcggcagtacttggtggtttgttgcgcaaactgacggggaagctgagttaccgctagtaactaccgatgcgcagggagccagtttgagcgaggccgattttgtcaagaccaacgcggctttaggtaagcaactgcacgtgtttaaacaggcggacgcttaccgtgaattcgtggcccatgatatttatggcttcagtaatgcggcgattcttagtcagttggctaacgtttatcgcctattagcgtcgccgatcttgaccgctggtggggccaagttttcaccaatcagggcggcgttgcgagatgcccaggccagcattgaccgcgatgtgatctatgccgccgcagcaacgcaacgggaggtcaatcagaaaaacggcctgttgcagcggatcaaacgtgggcagcaacggctagaaaaactgcaacgagatattttttggggtgatctcaatcatttaaatgagaccaaactcggccattatgcagagatccatgcggaatatgaacaagaaaaggcgatcactcagcgggctgaggaaatgatcgccaaatatacgcagcaactgcattttttacagctccaattgacggaaaagcaggaactagtgcagcaattaaatgaggctaaagccaagcaaaaagtgatcgaggagcagcgcgctagcttgcaacggcaagtcgccagtgaacagcaacggttgcagaaattcttagcgcaagaaaaaaaggtcgctgaatttgaacaacaattagcgattttggcacaacagactaccgagctgcaaacgcagacggaacacttaaaaaagtctgaactagcaccgttacaagttcaattaaacgccaacagcgctaacttgcacgagttggcgcaagtattggcccagacggatatcgcggcaatgaatcaccaatttgtgaattacattcaacaaatcaagcgccaaatgactgcgtaccagaatttggcccagcaagcgactaatttgtcacaagatgtggcgatcgttggccaaatgcaagatcagatggctgaaagtattgatcgccgggcgcaagggccactggtcagtcgttttcgcgccggtttgcgccaagataatcaaacaatccatgaagctggtgccgctaaaatgaacgcccagttccaacaaatcaagcagcagcaagcggacctattagctaagcatcctgatgtcaaactaattttagcgcagccgacgttattagcgactttgagtcagcagcaaaaaacattggcgacgttggttgctcgcttagctgatttggtgcaacaacaagataaattgcagttacaacaagctggtgtgactagtcaattggtcttgttgcgggacaacatggaatctgatttgatcccagcggaaatgaaacagcagatcacggtgcaacaacagcaattagcgcaattagtggtcgatgaacaattggcggctaaactggccgatgccaagcaggcggtcgaagatttcagcatcgagaaacaggatcttgaatcgaagaagaacgtcgagcaggggcaacagaacgcggctgataatgccatcaaggcaaaaacaacgcagcttgatatattagcgacccaggtcacgactatgctgcaagtgttacaaccttatttgccgccagaaacaccgctgaccgaagtagcggaggtcatccaatttgtgcgcgctcatggtagtgaagtgcgcaataaccgttatagtgagatcgctgatcgaatcagacgggcgatccatcgcaacaatcaggatggcatcgatcgcaatgcgctggatacgttgtttaccgagcggggatatggtcaaattgccagcgccatgtatcaaggtggtgtggtggaaaatgatatgaccacattggcttttgatattcgcgaagcacaacagattttaaatgatgaattttctggggtccagcgtgctgtagctgagttggaaactggcaatgagttggcgaagcagacgtatttgtcggcggcggtggaacgaatcgccgatcaatatcaggtgatcagcaagtataatcagattttggcggctggcttagctaacggtcaaggtatcaagttgaaagttgatttacggccggccgacgtgactgctgatgtgatcacggaagcctgtgacttgtttgcggaaaaacgaccggcattgactaaggaagtgcagcgacgattggatctgttggctaacgatgccgaagtcgccgatgacgacgcgcagttcatgcagcgagccaccgatttactggatacacggcagtggtcagcgtttcacgtgctgatcaaacggcggcaaagtggcgatgatgattttgaagaagtggacgataagtttgtacgctctggtggttctggtgccgaaaaagcgcaggcaatggtactgccgctattattagtgccgaaaatgttgctgcagcaaagttcagtcagcgatgtgccttatttagtcatgttcgatgaatttgccgataagcttgatccagaaacggccaaggcattcgcacggacgatcgccaactttggttttgattttattgccaccatgcctagcggggcgcagaataaaattttagccgatggtgtggccaatattgcatacgaagtgatcgccgcggcgcaacaaaatgatggcaaattccataccaaccgcgtagtgccagttttgcgctggcaggaggcaacaccggatgactgattatcaacaagtatatcacgctgcaactggtcggccggcgccggcgaacgccgcacagttagatgcactttttgcggcactggcaactggtgtgcaattaccgccgcgggcgcagcaagcggtggcgttaggattgacggcgcacacgttaaatgatgccagtgccgatccgccattatttgcctattatcaatgggtgctgcaccattattttgcggccggtaagctgaatgaactctcggctaagctgatcgggatggcatttaccagcgccaacttgtttcaaacgactttgccgcaaccattgacaataaatccgtggcaggcaccagcaatgagtggtcatcctttagcaaatcgccgcgtggtggtgatcgaaaataacggcgtatttgttttgctgctgcagcggcaccctgagtggccattgttgctgcaaggcggcaatgattttaatccgacatatgtgcaattagtgcaacagttggagcaacggggtgtgcagttcacttacatcggtgatttggatagtcgcggtattcaaatggcggatcacttttatcaattactgcagcaaacgtcgttgaaaacggtgatggctttgcagcagccagtgatggtggttggctggttagcgcgttatggcaaggttgatccaaaacgcacacggccgttgcaagttgttaccagcgattatcaacttgaaatggattcactgacgaccatgggtaagttcgttgagcaagaacaattgttggctgaatatgagcgcctgattccgcagtggttggcagtggaatgagctgaatgaggtacgtttttaaatagactaagcgctaattgtatttcaatcaggtttttaatgtaggaatatctgcattggaagcctttttttgttaaccgttattaaaactatgctgaaagtattgcgtaatttatatttaaggtagattgtaaaatttaagttgaacatattagtggacagaaaaacccataaaggtctttaatggtgtcaccacaacatggattgaagtcaatatttgagacagattttaagagacattcagaaccgcgtttaccttccacagctcaaataaatcattaatcgcgattaataacttatttgaaccctggaaagcattaaatcagg

SEQ ID NO: 577 - DNA, 8260 bp, Unknown
  Metagenome-assembled genome
caatttttaaatggcttatcgattcaaacttcggcgctgatcacgctgagcatgagcaatagttgaaggttaatttttaggctgtaaagcttggtggactaagggattactcgaattggaactttcatgacttagtttcataataaatctttcaaattaagcgatttgtttcatcatgtattcttcacattctctggttatagtaatagacatagagatgaaggaccccacctaatccctaacccaaaacttaattttttcattaccccccaagtaatgaaaaacccaactccttttccagcgtaagcccatacgctggtttttttgtatcgtggtatactaattttcaattaatggatgaagttggaggcgcaataatgcgagcattgttttttaatcaatttggtggggtggaacagttgcaatatggcgagttaccacagccacaaatcactgccgatcaagttttagtggcgatcaaagctagtggcttgaattttgcggatatttatcgattgcggggtaattatcatattgaaccgcacacgccgtacatcaatggttacgaaggtgcaggcgtagtcgctgcggttggcgccgcggtaactgattatcaagtggggcagcgggttttctttgctgatgttccgctagcgcaggctgagtatgtcgtggcaccaccggaaaagttgattccgctgccagacacagttagttttgagttggctgctagtatcgctttgcagggattgaccgctgactttttagcacatgatttaggtcgtgatcagccaggcgcaactgtttttgtgcatggtttaactggtggtgttggtcaaatcttagcgcaaatgttgactgcagatgggatcaatgttatcggtgtgactggtaatgaagctaaacggcaattagcgctgcagcaaggggctaaacgcgtttttttgcgttcaactgattgggtagcacaagctcagagtggcgcaccgatcaccactgtttacgatggcgttgggtctacgttggccgctagtttaaacattgtgcaaccgcggggcaaagttgttttcttcggtatggcggccggtgatccagcaccggttgatcctgtggcaatgcttagttcgtctaaaagtttattaactggtgatttgtgggattacttaagtgatcattcagcgcgcttaaaacgcagccagcgcctgtttagttattttcaagctggtaaaatcaacttaacgccggcccaaaaatttgatttaagtgctggtcgcgctgcatataagcggttattaagtgagcatactggtaaaattattttaacggttggaaataaatcgtctgatgtagtgcgcaccgcggattaaaagcatgctgacaaaaagggcacgcgccagtttgatattgtgaccaggtgagttcgtggcggcaattgccacagcacactacttttgctgttggtgtcagcggcatagcaacaaagtggtgagcacgcatggcgtcgtggcactggtagcaagcgaagtattgctgacagcgcgcacatttattggcgatgacatcggtgggaccatgatagtgttgacaacgcccatccgcggtcaattgtagaccaaaaatcagcgcgctcatttttccaccgcggcaaattgatcgattaggcgcaagcgccgatgcagcgcaatggcgacacctgacttcaagagatcaccaggtagaaaaatgaggccagccaatagcgctttggacaaggctagatgggtggtgacacttagccataatgcgccgcttaaattgatgaacagcacaccaatcaaaattgtggcgctgatttcccatgctaaatgctggtgactgcgtaataacgtacccaacaaaaatggtgtgaccagccaagcgtaaatatagccagctgtgggaccgacaaacacagcggcgccaccgtgaccaccagatagaacagggaaaccaacgaatgccaacgccacaaataagcccaccgcgtagctaccattttttcgacctaatagtaggctagcgaggatgattcccatattttgtagcactaatggtacaggaattaggccgatcggaattggggggatgtaaccaaggacgatgatgaccgccaccataacggcaatttgggtaatatcacgagttttcattgacttagctcctttggttaaccatatattttaattggttaacgttgattataaaataccacgtctatacgcatttgccaatgaaaatattaaatttattaaaaattacagctatgtgcattaaaaacgggtaaactaatgatgacaagattttgaaaaggtaggtattggggtaaatggatcagaatactcggcgtgataagcgcagtacaaaaaagcataaacatttgggtttgaaaattactttagcagttgttgctttgttggtgatcggcatcggggccgtttttggcatgatgtggaatcaaacgcaatcaacatttaataagatctatgatagtgacggtactaagcacgatacgacgatcaagcagaaaaaaccgttctcgattctgctgttaggggccgataccggcgctgatggtcggattagccgtgggaattccgacacgatcatggtagtcacgatcaatcccaacacgcataaaaccgtcgttactagtgttgcgcgggatacattagctgaaatggttgggaccaagtcgctgaatgtgcagaaactgaacgctgcctataatattggcgaatcaaaaatggcgaaagctagtgttaaaaagttactcaacgtgccgatcaactactatgccacgatcaacatgggtggcttagaaaaaatcgttgatgcagttgatggggtcacgatcacttcatcaatgaacgttacgtttgatggtattacgatcaccaaaggtaagcatcatttgaacgggaagcaggcgttggcttattcccggatgcgttatcaggatccccgtggcgattatggtcggcagctgcgtcagcaacaagtgatgatggctgttttgaagaagttagcgacaccaagtggaatcactaaatacagcgcactgatgaagacgttggaaccttacttgcgtactgatatcacgctggatgatgcgatgaaactagcgaccgattaccgcagcaatttagataacatttcttcgaagcaattgactgaaaaatcagcaatgatcaatggcagttcttatcaggttccatccacggaaaccttacaatccgtttctgatgaattacggacacagttgggcttgtctaaggaaacgctaagtaatcagaatacgcgcttgaacaagttaaatgccgcattctttaatgacgaaagtagtacaacttacaatactgatggtgcggttacgcagtattacacgaacaccacatattagtaaataaggagctggaacgattttagttgcggctctttatttttttgccttgatcaagggtggcgcgattctttaatggagtaggtaattgattctcagaacgctgaagcttagcgggcacctaactagtttcagtcacaggtcatttagtttaaatatgatgattagctaaaaaataattgcacaatgacccatgtttagcgtaagctagttaaggaccaatttcgaccgaagttagttagtatggaggaaaacaatgcaacacgttaaaaagatcgtgcaggttactttaattgcaatcggctggtttgtactggctcaattgctaacactgctggtcaagtacttacttttgcgccatatcacagtattaaatcatggttttggtgcagtcgcagcagaattattcagtactggtattttaatactattactttatttttattatcgtcggcgagatccagcggttctgccgtttccacgcaaaaaatggttttggtactatggttgggcctatcttgctggactgttcttttttacgttagtctggttaggcacattaggacttaatgcggcagctgtccattcagtcttgcgttctggcgcttggttgtggttactgatcctatttttcggttacgtgatccaaggcttcagtgaggaactgctgacccgaggttacatagtgggtaagttacttaaaaccgaacggacctatgtcgtggtgatcgttaattcactagtttttgcagggttgcatttaatgaatacggggattaatggcctggcttttattaacattctggcttttagtattctgttaacactgctacggttgcgttttgctaatttgtgggtcgcgagtgcctttcatagtgcctggaattttgcggaggggccactatttggggtaccagtatccggtggcgctagtgatgcattggttttaaaaacgacttcgcacctgggctttgatctgatcaatggcggtagttttggttttgagggcggcttcgtaattttattggtcttattgatcgccattgctggttttgtctggtgggagatccaacggcccaaaattaatgattgacagctagtctatctggttgcataataaacacaattaaagcggatcaattcaatgcgttgacgagaagagtaatgtgctgagcaatgaacagagatggcggtaagctgaaaaagccacgttgcaatgaacatgaagatgagctctgagcaggttgctggtataggctagcaactcgtgggcaagcgttactttgccgggtatcaaagtctggacacagactggcgtaccggcgaggtatcgttagcgacacgaatcagggtggtaacacgcaaagctgcgtccctagtctagttaaatctaggctgggggcgcagctttttttgtccaattgaaaatgaccgcgtgaatggaggatttggtatgcgtaaattaagatccgtactagcaggtgcggcgttagtgatattagtcggggtgttgagtgcctgtggacagaattccaatcagcaggcggccacaaaacaagttttgaatttaccagccagcgctgcgttggacacgatcgatttgtctaaagccactggttatggtcaaaccgggaacgtttttgaaagcttttatcgcttaggtaaaaatggtaaggccactgctggcttagctaagtcagctaaagtatcagcggatggtaagcagtacactttcacgttgcgcaacacaaaatggagtaacggtgatccaatcacggcacaggatttcgtttattcgtggcgtcggacgttgaatccgaaaacaaaatcaccgtacgcgtatttatttgaaggtatccaaaacgctaccgcagttagccaaggtaagatggcggccagcaagttaggcatcaaagccactgatcagcacacagtggtcgtaaccttggataaggcgatcccatactttaaagttttgatggcgtacccactttttgcgccccaaaaccaaaaagtcgccgaaaaatacggtaaaaaatacgcgactaaatcgcaatatatggtttacagtggtccatttaagatcaccaattggaaagggaccaacaataaatggtcatttgttaaaaataaccaatactgggataaaaaagtggtcaagctgcagaaaatcaacttcactgtcgttgaaaatgcctcgactagtttagatctgtatcaaagtgataaatttgatttaacgcaactttctagcgaacaagtggcaacgtacaagaatagtaaagcctatatccagtacccatattcttacgttagttacgttggttataacttcgccgacagtgacgctaccaaacgtaaggtgctaaataatcaagatatccgccaagccttttcattagcagttaatcgtaaacaattggcgcagaaagtgatcggtgacggcacgttgattccgactggttttgtttcaactgatctagccaagaatcctaccactggtaaagatttttccgttgagcaaaagcgtggaaatacaatgtcacatgatgaaaaactagcgcagcagaaatggcaaactggtttagcggcaacgggtgtcaaaaaggttagtctgaccttgctagctgccaacgataacggcagtgatcaggccacgagtaaagtaacacagtacctgaaagggcaatgggagaagcttttcccaggtttgacgatcaaaattcaggccgtaccatcgcaaattgccttaactgatcggcaaaaaggtgacttggatttaactttggcgggttggggtgccgattttaacgacccgatttccttcttgcagattccaacaacagggacttcttacaactatggtaagtacaacaatagcgaatacaaccaattagttgattcagctacgaacgctgacgcaaatgatcccgctaaacggtggagtgatttagtcagcgccagtcatgttttactcgatgatcaaggcattacgccactgtatcaaagcgtttattcgtacttgcaacgcagctcggttaaagggattattcataatactgccggcacacagtggaattataaatacacctatattaagtaatacttgatttgaatcaatttttttagagccatttaggtttataataactttgaaatctaaatggaggcggaaatcatggctcataacggcgagcacgcagaacaatgtattaaactagtcccaatctttcagactttgtcagatgctgaacgcgcagaaattgcgcccttagtgcaacatcgccattttgcagtgggtgaaagcttattcgcagctggcgatgacgttgaatcgttgatgatcgtggcgcatggtcaagtaaagatcacgcaaattgcagctaatgggaaagaacaactactgtatctactgaatcctggcgacttcgacggagaagccgcgctatttacagctagtacgcgtcaaaactttggtactgctttagcggcgactgatgtttgcatgatccgccgccaagatttccaaaagcaactcaaggtttcaccgcaattagcgctaaatattttaaatgcctttggtcagcgcttggccaacgtagccgagcaatcaacgcaagcaacgacggcatcgatcgaagagcggttagctaattacttgttggaaacagcgggcgatgctgctgatgatttcaaattaccaatgaagaaaaaagatattgctagctaccttggcaccacaccagaaacgattagccgcaagttccgtgactttgcggatgacggcttgattgaaaaattagccgtcaatcggtttcgaatcttggatgctaacgggttagcactggttgaataataaaaaacgtgcggcgttagccacacgttgaaagtaagtctacatttcggtgtaggcttattttattgcccgaatttcgttgatgatttgactgagatgttctactgccaaacgatactgttctaactgattgccgtatttagcgttgaaggcagctaaaccattcgctgcgaattcatattcatattgataaactgtatcgtaaacaccagtaaaacggactaataagtcatgttgatcttgtgctagttgcagcgctagttgaatcgtacgaaagtcggtataagccagttcgaactgaactgcccaggcgcgcatgaaatcgtgttgtgcggcgatatgtcgataatgatgttcagtcgtccaagctagccgatcaagtgaatcagatacatcaagcatagcgtagcctcctaacttaagcgcgctgaataatcagttagcgcgctggattttctttgagaccagcgttatttggttcagtgaaatcgataaaaccaaggttatcatcgatcaagccaccatcaccggataaactgagtgtacccaaattagcgtttaagtgtacgaccatgttctcatccaaactatccatggagtaacctttaactagaaaatccccaatattgctggtgatcgtttgatcatagccgggtgcttccatatctgaattaataatgttaatcgagaattgaacttgcatatgaatcatggcatgttgtgaataagggccaaccccgtcttcaaaggttagtagtaatttcttacctggtgccaaatgtgcttgaatttttgcagcagctgcatcatcaaattgaatcttcattatcattcaccccactctaaatttttgttttgactagggactgtctgaaaactaaaaattcaggtataatctgaggaaaaacgaatcgaggcattccgatgacaacacctaaacgatacgaactggaagatgctcagtgggaccgaatcaaaggatactt

SEQ ID NO: 578 - DNA, 3271 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttatgggtttttctgtccactaatatgttcaacttaaattttacaatctaccgcttaaaaataatcattaataaaaattatttttaagctaattttattatagcatttttgccgttttaaaacagcgcttacaaaagctttttaattcactgttaatttttttgctgcgcatctaagtttgcttgaccattttaacttgagccaacaatttcctttgtcaaatcacgtcagtagccctacaataggattaggacaataaataagccatgcttcaactttgtgtccttgactaataaaaacctaaaagtgaagtagaggagccatcctatgacaaagttacgacaaccaaatctgcagttagctgacgggcacacaatgccgcaattaggttttggtgtctataaattagcagatcaggcaacaatgaacactgcaattgcagctgcttatcaagcaggttatcggctatttgatactgcacaagcctatcaaaatgaagctgaattaggcactgcctttaaacagttagcactaccgcgaactgaactatttattacaaccaagattgctgaagttaatcaaggttacgataatactttgcgttcagttgagttatcactaaaaagattacagatcgaacaacttgatctattattgatccactggccgatccattcacaattttttgcaacttggcgggccctagaacgtttaaaagcagaaaaaatcgttcgtagcattggggtttcaaattatcatcaaacccatttggattatcttgctactaaggctaatgaacagcctgtggtcaatcaaattgaaaaccacccttacctatcacaagaaccattattggcttataaccgtaaacagcatattgtcagtcaagcgtggagcccattaggccgcggtgctgtactacaggatcctacactgatcaaaattgctttaaagcatcaacgctcagttgcgcagattattttgcgctggcatttacaacgtggtttagccgttattcctaagtcacaaaatccacaacggatcaatgaaaatgcgactatttttgattttaaattagatgctgatgacatgacagcaattgcacgactaaatcgttaccaacgtactggggacgatcctgaagtcgtttatcaaattgaacatcaatatcattagctactgctacagagcttaattcattcgagacaaggagattttttatcatgcctgctgccaatcacgattatactttccccattaaaatcactaagggaccacaacgcttcttgatccagtttttaacgatcccacaattaactgcctcgggtgaaatctatgctgaagttgaatattacgcttaccgcgtattagctgaccacttactcacgctcaagaacgatcccgcaaagattcaagcgttaactgggactactgctaacgaaccagtcgatgaccactcttttttaagcaatattttagtcccgcagaatttagacccgcataaaatgcaagcgcaatttgttattccgcgggattcaccagaacacgctcacagtgagatcaataaaatcactaaactgatcaatgaagaaccacatgaatagttaaaaacaaacacaaaaagctgattagcttaagcaagctaatcagctttttgtgtttgtccaaataaaatgacgttacgctagatctgtgccaatgcttggtccaaatcagcgatcaagtcatcgacgttttcaatcccaatcgataaccggatcaaatcaggagtgatcccagttaatttcaattcttcgtcattcaattgcgcatgagtcgttgaggcgggatgaataatcaaggaatgcgcatcaccgacgtttgccaataaggagaacagctcaagatgttcgatcaaggctttaccagctgcttcgccgcctttaagcccaatggtgaagatcgaaccagcgcctttagggaaatacttttcagctaggtcgtgataagggctatcggctaattcaggataattgacccatgctaccttaggatgttcatttaagtagttgacgatcttgcgggcgttgctgacgtggcgttcaacccgtagtgacaaactttctaggccttggatcaacaagaaggaattgaagggactgatcgtgccaccgagatcacgcaaggattgtgcgcgtactttagtcgtgaatgcagcgggagcaacatcattccaaactaaaccgttatattggggatcaggtgttgtgaagccagggtaacggccgctagccgcgtagtcgaattgaccgttttcaacgatcacgccacccatggtcgtgccgtggccaccgataaatttagtggctgaatggaccaccacatcaaccccatgatcaagtggttggatcaagtatggcgtgccgaaagtattgtcagcgatcaagatcaagccatgcttatgcgccactgccgcaacggcttccaggtcgatcaagttgatgctaggattgccgatggtttccacgtacaaagctttagtgtgttcgttgatcgccgcttcaaagttagcgggatcatcaggatcaacaaaatgagtggtgatgcccagcttcttcaaagttacactgaacaggtcgtaagtgccaccgtataaggtgctggctgagacgatctcgtcaccggcatcagcgatgttaaggattgctgcggtgattgcggcagagccagtggccaaagcaaccccggccgtcccattttccaaagccgcgacccgtttttctaggacatccgtcgttggattcgttagacgtgtgtagatgttaccagcatcggtcaaggcaaagcggccagctgcttgggcggcgtctttaaacacgtaagaagtcgtttggtagatcggcactgcgcgagcaccagtttcatcgatcgtttgtccagcagtaacttgtaaagtttcaaaacgtaatgattcttttgacatatgattaccctcttcttaatttaggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 579 - DNA, 2344 bp, Unknown
  Metagenome-assembled genome
ccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccatgaaaccaacaccatttattaacgcgtaccgcaaagccggtaagcgggcagatgtcgtgctgatcgatgaaggccatttactactgacgatgcctgatccgtataataaattccgtgggcataatcagcttgctgatattcttcagttggctcgagtggtggtgctcgtgttcgatttccaccagctagtcaagctaaagagtttttggacacctgctttattgaaaagagtgacgcgcgattacgcagtgacacattatcatctgaccgaacagatgcgggtaggcgatgcggcggtgaatgattggattgatcattttgttcgtggaaaagtgttgcctttgccacatccgcaacattttgattttcaagttttttctgatggtcagccgatgtatgacctcattcagcggcgcaatgccgaaaccggcctttcgcgcatgatcgcgacagctgactatccattcacagtgctcgatggtaaaacctggtatgtccaagctggctctctgcggttgccttgggacaagatcaacttcaccgatcgcccgtgggcacaacgtcctgagacattgcatgaagttggttccatttatactattcaaggctttgacttgaattacgcaggtgtgattctagggccgagtctaggctatgatccctcaaaagaccgacttacggttgatctggcgcagtaccaagacaaggaagccttcaaaaagcgccctgatttggccgacaccaccgacgctaaagccgcgattatcatgaatgccattaatattctgctgaagagggcgaagcacgggctttatctttacgcagctgatcctgctttgcgccaacggttattgcaattggccaaataatcttgcaacctcacttttgaaatgcaatagattgtgagtcgttccagttagcactatactgaaactgagtctaaatctaaaaggagtggtttgcatggctgaaaagtatacagcagaaattgtgccattgaacgctgagaagattggcaccgcgccgcacggtgccgcgacgttcacgattgatggtgcgcaaatgaagattcatatcgatatgtttgatacacctgctaatgtgcagcattgggaacatttccacggattcccggatggtaagccagcagaaatcgccacagcggcacaagatgctaatggtgacggtttcgttgatctgccagaaacagaaccggtttccggtacaacgatggtgccatttgacgctgaaccggccaagatgcatgtgccaaatgacagttacccagtggctgatgcagaaggtcactatgcttatgacaaactcgttgatctgaaggaattgcagacagcgtttaaagccgcttttggcagtgacgatttgcagctcgataaaagggtcatttatattcatggtgtgccggataccttgaagctaccggctactgttcaaggaactgtcatgaactacgatgcccacgttactttaccaattgcagttgggaaaatcatcaaagcttaaactaattagtttaataaataacctataagtagtcttggaacttactggcaatacgccggctgtttcaaggctacttttgggtttgaagaccttatttacctataaatagagctttttacattatatgtacagattaatacctataatgtcaataagtatgcactgttaaaaatatcttgttaaataacgaacattatcattcctttgcgcggggtcaacttgttaagctggtgttggaagaagagagacgccggaaacaatggaaggaggcgcacagatgcctaagaagttgatccatatcgtcatgttggcgatgttgatgctgacccaggtcggcagcgccgttgtccctgtagccgacaacggtgagacaaacatcaccgaacatgaccgtgcggcgccaaaatccgatccatcctcacaccagaacgatgcgagcggacaagcggcaattagccaagacacaattgagtctgacaagaaacagacaagtgcagcaatgagcagttctgagaacctgtctagtatcttttaagaactatcttcaggaaggccaatacaaccatttgaagactgctgttaagggcacgttcacagtttttccaaagtcgccgacatttgtctagccaactccatgaa

SEQ ID NO: 580 - DNA, 12137 bp, Unknown
  Metagenome-assembled genome
tcgcatgacttttgatctggtactttctagcgatcaagataaaacctaatgaggacgtcagatagtcttgaacaacatgtagtttaaactgcttggtatatttggtcatagtaaaacccccggtattagattttggtccaataccgggggttcacttcacgagctgatttttaattcgtaattatattattcagtaagttaaaatcgttacgagttatagcaactatgccatactaggtgtgattaaaataagaagataaaactgcggttattgtcacaaaagtggacgaagtgacccaaataaggcagaaaagattctaattaggtattactaggtttgcgatgcactaaaaaatccacgtttacggcgtggattttttagttagcaaacagtaactggacttcttgctctagtaaatctaaattgatcgtcaaatggcgattcaaatcttgaactaaattgtaggcaaacgtggcctgtgcatcgggcgttttgagttctcgagtaaactcatgtgcgtcaaaatcaaagttttcgagaatgaaaatatggtcgctgacgtattttaaattgttatctttatgactcgcaccgggctttaagacactatcgatatagtgatataacgttggtaggtcatgatacaatggtttagccgtgtcgagtgttacgtggaaattagtggcctgaccggctaattcatcattaagcgtcacttgagtcaaagcttgataaagtttcattgtggcacctgctttcaaaatagtagtagctaattgaacattgcgtatgaacctaataaaaatcaactgtttatagactcattatatgcaaaaccggcggtcacgtacaatttaaacgtttggatgaacagtcagtttctgtttagattctatatgaattatactaaaatcagaaaacatgttaaaatagaggtattgttcagaaagctatttttttaatagtttgagtattggggatgaatcagcatgacaatgttcgtgcttgttagcttattgattgttgccggactgatttatttaacggcggcacatctatttgctggctttgtttcagttattatttttctcggtgatcttattctcaccgtgagcggcgcattactaacgtttgtgttacaattctgtattcgtatcaagcgcttagctgtgcgggccaaacaattcgtacaaagtgaatcatgaaagatgagccgccagcaaactaattttgttgcggctctgttttttatttctgtgatcgattcaagatagcggctggcgacacttcaagacgactggatgtgaaatgatgcaaagtaattatcgtgttgctgaattaattgtgcagttcatgagtggcgcgacactacaactggcagatattcagaaaaaatatgatattagcgtgcgtaccagccaacgtgacctttcttatattaggaaagccttgaaagagtacgacgctggcgatttgatcgagcaacaaggtgcttactatttagcacatgacagcgcacagttggattatgaaatggtactggctaccagtaatattttgttgggtacgcgggcactagcaccagataaattaaatgtgactttagattatttgtgttccgggttatcgccgacaatgcaagcagcattacgcaagcagctcacgattccccagggtagctatgtaccgttatccaagcctaagcagttactcagacgcctgcatgaggttgcactgtgtattgccaataatcagcgattgacctttacctatttgagcagtcagccaacggagcctgaaccattgctgcaccatgcacagccagtggcgctattttttgaggtgcattacttttatgtagcaatgctgagccaagagcgtgctggctactggctttaccgattggatcgaatcgtcgatattcaagccaaaacagccggtgaaaaattagattatgcggagcgcttctcattacaagatcatcgacaccacacttatttggttgatgatggtgaattaatgcagattcacttcatttatcgtttctatccgcagacagcattggatgcttttccgggttcacgggtgatccagaaaaatacggatggtagtgtcattattgaggcatacgttaaaatcggtggcgctatccgctggttattgagtcaaggatcgggagtgaaagtgatttcaccggtatcgttggtcaaacagatgcgtaaagaattggccgcagcacgggaccaatatacagaataaattgtcgtacggcacgctttgaaaaaagcgtgtctttttttatgaatttttttatggaaaatgctatcaacgccaaactgtgacactacttttttgtatgctgtagtcaatcttatttaagttttttggattttattcacgcataagcccatagtgacaaaatcagacactgtcatttgggataatgctagcgaaaaggaggctacattaaatgacagctaagcaaaaggcagaagacgcggaaactaaaagtaaagtcgataaccgtgcaggtattgaacgagcaattgaactaacgatgcgcttattgaaaggtgaaaaaatcacctataacagatggctggatattgccgcaaaagagactaagcaacctaataagaaagatcgtaatttttggcgggatctcgcagatattgaagaccaacttgataaaacccactataataagcgcttgctacgcccaaaacgtgatccaaatattcccaatgcagaaaaaatctatcagctggttaattgtcccgataaggtgagattagtaagcatgatcgcgctcgcccatattattttggccagccgagcgctcaataaaacagaaatggatcaattagtgaccacattgcaaagtaccttagcattaaatgaacaggaacaatttaaattagcggttgctggcgatcaaggcagttatgttacttcaccaagacgaccaccgttattagcatatcttggccaaattactgcagcaattgaacaacatcaacgcttagtttttacctatcagaacgctgaaggtgaatcgaaaatacatgaagcacaaccagaaacactttttttcgatacttattatttttatgtggtgatgcggcttaaaccagaagcagactatctgctatttcggctggatcgaatcactgccatcaaagaagttaagtctggtgccgtgccgcagcaacactttcggttacgtgagtatcgtcagcaaacttatttattagccatgggtgagccaattgtatttagttttaaatgctggatctcaccgcaaaaggcgctggaacgtttccctggttcaacggaaaaagtcgattcaaaaaccggcgatacagtgatcactgcgtaggccagagaaaagggtgagctgatgtggctgctaagtcagggaccagatgtccaagtgatctctccaccatccttgatccaaaaaatcaaggcgcaatatctggctgctattgaacgttatgatccgcaataaaaaatattttgcgagtataacgaaattgtcaatatatgactcgaccctttgctaagcttgatctatcaagggagagtgggtggtgaacgataaaaatcagtagcaaaagtcagtttagaaagtgaaatagaggaggaaatattaatgaataataacaaaattagtgacgcaacttatacaactttacaggcgaaatacggaaagtacggtagctgggcactttggcagcgaccagcagcaggccaaaaattacatgcagttgattgtggaatcgattcatttgccccacaactggccgatgccgcttttcggcaaacccatttaactagtgtcggcgttgcgctggcattaaattggtcggaccgcgggccttgtagtgatgacgattgggctaatttccatgatataacggcgcacagccaagattataaagcagctaaaatgctacttgatacgccatttgaaggtagctatatgaccgatgccattaaaaacttccccgaaactaaggcaacgactgcactaaaagaaatcaccaagccagaaaatgcggataaatttgctgcaagcgccgctatgttacaggaagagcttgatttgattcaaccgcaatacttgattatttttggtcgttcggccgaggaattagtcaaaattatggtacaacgcggtgtcttaaatttgggcgatattaaatgtgaagaaatcgaccattatgccaatatgttgtcgtatgaaaaaatagccgcgattgcggaacgcttacggcaattgccattggactttatttaatcaaaggagcgtgggcagaatgagtaaagataaaaagcataagaaaaattctaaaaagcaacagaaaaaagtaactgagtttgttcgtgcagcggcaacggtggccgaaccagatttagcggccactggcgatgtgaacagtgaagaaacagtggcagaaagctacacttctggcgaatatgtctacggtgatattgttcgtgattttccagaaatgctcaattatctcggtcatttacgggtgtttgagcaagcgacttgtgttgatttattaggcttggcgcaagcgctacaagtcggcttttcattatacccacaaaaagaggtcgtcggccaaggccggcgggcggtggcggcaacacttatcgtagctgatcagaaagttacctttcccgaacaagcgtggttagttggtcgaggtttggcgacctacattttaaatattgcccaatatgtgcctgactttagcgaaaacaaagcggctatgtcgaaatggaccgttgataagttagccagtaatttactattaccagcagatttagttgagcgcgacaccgacttggccgaaaatctgaatgcggaactactagatgtggctgatacacataatcagcatttgattttcaacacaccacatctgagtgtgattgatgcgactgcagcgcgtttggctaacgtgccagaatggttgatgcgtcagcggatcaacgatgtttttaatttgtaatctctaagtctgcgcagtaaataattagtgataattttgtattattttacaattaatgattttaatgccacgttgtgacactggctttttgtatgctgtagtcagtcgtacataacaacatcaaaaaaagtgaaaaagttttgagggggatatctaatgaagaaacaaaaactcgtaaccttagctactgctgctgtaattgccggtgtgactgcaacaaccaacaatctagattcagctaaggcggcaaccacgaccaccactgaaccacaaacacaagcaacgaatgatgcgactgcccaagctaaagcaaaggttactagcgctcaggctgacgtagctgacgcgactgcggctcaagctacagcgcaaacaacggctgatcaaaccactgcggctaaagattcggcgcaggcacaattgaccacagcaactagtaatgccagcactgccgcagccagtcaagcaactgctcaacaaaataaggatgaagccacctcagctggcattgcccaagccgaaacggcagttgaaactgcccaaagtactgccgcaaccgctagccaagcagctagtgaagcacagcaaccagttgccagtgcccaagccgaagtaaacacgactagcgccgcagctacaacagcaaatagtcaagtggctacacaacagcaagccgtgtctgcagcgcaaacacaggtcaataaggaccaagctgccactgatctatcaactgcacaaacagcagcaactaacgcgcagaatacagtggacgagactaatagtcaagttgatgcacttaaagctaaagaaaataccgaatcagccggaattacgttatcgcaaagttacattgatgcatataactcccaaggaacatataattctcaagatgaaaattacaatccagatttattagttcaagttgaaaatgaaattaagaactttcctaatacagcaacaatcattgaatatcagccgacagccgcagatgaagaggcaaaagttacagatgctggtcagctgacttttgatcagtctaaagaattaactacttttgcggctagtattatcaatggtattcgtaaacaaataggcgtagcaccaatcaaggttacggatggtgccgttaagatcattatgctgagagctgcgcaagaagtaaaagaaggtaatgatgcaggcaaaagtaatgcgctttatgaacagaattttaataaggcatggaatgatgctgatctaacgtcagcaggtatcaaatcaaatttagttagcgatgctgagatcgctaatgaggttggtaagtataactatgaaatcaacggtcgggatacacttccaatgagattagatagtacaacttcatggataaataatggtattgaaagctcatatactatggctagtttgaaacaaaaagtatatgaagctatagctaatcctaaccaatattatgaggaaccaaatagcttattgacgggaaaagatgacgaacttttagatcaatatcttggtgtagtcttcgatgcatatggaaatttacatatgtattttattgataactacaaagccactgataatagtggaaatgagtatgaaattccaacagattcaattttcttcaatggcgaaaccactccagcaccactcagcgcaactggtggcctaacgacagctgatcaagctaagctaaaagacctacaagcaacgttgactacccagcaagcaacactaaaatcagctaaagcagctttagcaacggcgcaagctgccgccacaaaacttggcgtaacggctgctgtggacgctacaattttacaagctgaccaagctaagttggcaaccgcaaaagctgctttagcaacagcgcaaaaaacggccacaacggcgcaagctgcacttaattcagccaaagccaatttgaccaaggcacaacaaaaagcgctgatcgccgatcaagcattaacggcggctaaaactgcgcagcaaaaagccgaacaacatttagctaatttgcagaatgctgatgctaatttggcggcggctaatgcagcagtagcacaggcacaaactgacttagtagccgctcaagcggcatacgataagacggttgcaccagctaaagcggccgcaacagcgttagcagcggctaaagccgtactagctaacgcacaaactaaattggcagctgcacaagcagatttagctaaacggcaggctgctgatacaacccagaagacggttgtactacagccagctacgtctagtgcaagtgcacaacaaacagcagctaatgtgcaagggtctggtagtagcgtacgacaactagctgtagataagacggctagtagcaaagtaacgtcacaaccagtgatccttaagaagcaagcacaaaatagtgcgactaaagcagcacgtagtcagcagtttcttggtcaagcattaccgcaagctaatggtgctgaacaaagttatttgaccatgattggtctgttattattgagtgcactgggtttaggtgcttacggtaagaagcgccgtgtttaagctagctggattaaaactgttaggaataaaaatttaggcgcgtgtattttgggaaatattgcgcgtcagacataaaatggagcagtaaggaaaccacataaaagtggcaccttactgctccatttctttacgcttattgggctgacttaacaatctgttccatctgcgtttgtaatgctggcaatgccttttctggagtaacgtgattggcagccatttcgctgatggcttttagcatggccaaccgcgcttgattatacccgagaaaagcgggatcttggaaaccgaaacttagtgattgttcggcggctttagcagtcggatttttggcgaggtattgctgatagcctttgtctgtctgcgctgatttgactaaaggaacgtagccagttttttcggcccaatagattgtttgttttttgttgagtaagaacttaacaaaagcagcaccacctttgcgctgggcggttgaggccgatttgaacatgacgatgtcactaccagcaattgtagtggcacgtttaccttggtagcttggtaatggtgcggttctccaatgaattccttttggtgtgctagccagcatcgttgagatcccagccgaagagccgctgtaaaatagtgttttacccgccaagaatttagtactgccgtagccatcagtaccggcagttaccgcggtaccgttttgcaacatatcccagataatatgagtagcagctaatgctcgtttgctagcaatgttcactttgttattaggatgtggaaaaaatgaagcaccactctgccgcaccagtccgtctagttcggcatcgtagctctgatcaaaggctattgtggtgattccctttgctttcaattgagggcctaatttttggatatccgtccaagttttaggtaagctaagcccctcttgtttgagcagctcttggttatagaataaaacgcgtactgacttagaaaagggcattgcgtagtattttccttgatacttgctcgactgtagaaaagcaggatagatatcgctaagttctgttttgttgatgtaagaatcaaatgaagtcacaaacccaccttttacgtaatcgggtgtattggtgtaagccgtttgcgcgatggtaggtaaagttttagatttagctgccgcagtgattttttgctgtagggcagttgaattaccttgcgaatggccaatgactttgtatttagattgtgactgattaaaatcgcggatcattttatttaaggccgttttgcgtgggccagtcataccatgccaaaatgtgattgtaactcgtgagttagcggcgctttttgggtggcttgtacaagcactaagtagggtgacggtggttaataaacaaagtccgaatatcagtagttgacgtaattttttcatctatgtagtgctcctttttttaactgtttagcagacgaagaacgcgaacttaatttagccgcagtgatccccgtaatgatatatttttgcaagaatagatacaagatcaacagtggcaaaatgacaaacacagtggccgccattaatagggggtagttagtgccagtttcgctagtaaacgctgttagaccaactggtaacgtccacagacgatcggagttagtgacgaccagtggccacataaaagcattccatgaaccgatgctttgtaatattgcaatagcggtgatcgttgttcgattagctggcactaaaattgaccaaaggtattgccaattattagcgccatcaatacgagcggcgtagtaagttgattttggttgcgcttggaaagcttgacgtaaagcaaacatagcaaaaatactagctagccaaggaatgatcagtgcagcgtaagtattgatccaatgtaaattagttaacgtgacgaagttaggtattaatagtagctcaccgggcaccatcagcaaactgatcaaaagcgtaaacaacagccgacgtccataaaattgtaggtgggtgaaagcaaacgctgccagaatgctggtaaataattggccaactgtagtggtgatcgtgactagtaacgaattcaaacaatagcgggcagatggtgcggcgtgccaagcgtgaatataattggtccactgtagtgattttggcagccagatgggtggtactgctaaggcgtcagcttgagtctgtaagctagtgacaatcatccagataaaaggcaacattagcgccacagctcctagtgttagcagaatgtagctaagtacgtttttatagtttttactcaatggtgatcaccacctaaacgcagtgtacgtcgtcggaaataccaaaaagaaatggcagttagactagcgatgaagagaaataaaacgacaccactagctgcagcaacaggatattgatgttcgacatagaatttttgataaaggtaatacatcatcgttagatcggcgttagctgggccagcactaccatgaaaaagcgcataaacttgatcgaagactttgaagttggcaatgatcgtattgatcgtgatcaatacggttgtcggtgtcaacaacggtaatgtgatattgagcagctgttgcccagcattggcgccatcaatactagctgctttatagtagcgttgatcaatgttatttaatcccgcgagaaataatatcacgttaaagccgaggccgcgccaaatgcagacaatgatcaatgccagcagcgagtaacggggatcgtttaaccaatcgattggcgtgatatcacttctacttaagagtaaattaagtaagccattgtcgcgatggaagattcaattccagactaaggcgatcgccaccgttgaagtgacaaacggcaaaaagtagattgcacggaaaaagacagctaaccaatggatacgattgagcaatagcgcggctcctaaagctaagagtactgtcagcgggacgacaccgatcactaaaatcaatgtgttgcgcaccgctaaatgaaagtcggggttgcaccagaggtaagtaaagttagcgccacctagcgcacttactttgttggtgaaatagttgtacttagtgtagcaactcattagaaatgaactaagcagcggccagacagtaaaggtagcggtaataatcaataatggcgctggatagagtaaagcatgcaaagttgatttaagcgttggttttgcgttgatcatgcgtcctcacctgcccaaatacaagtgccatcctgggagaataagtagcaaccaatttttgttacataaagtggggcattttgcggcaatgaattactagctgagattgcagtactgatcaagtcatatttttggtagtggctgtgggtttgtacctcgcggccaagctgtacttgcgtgttgatggttaccggtagttgagcaaaaagcggcttagcagtagcggcaagcgaaatagcttcactgcggatgccgacggtattggccttagccaaaatggctgctggaatcgacaccgtgatgttaggttcaatagcggctagcggtagtgtattgatttttggcgcaccaataaattgggcgacaaaaagattctgtggccgccgatatagttctgtgcctgttccgctttgttggatctgaccgttggctaatacaataattttatctgcgattcgtaatgcatcatcttgatcatgagtgacgaagatggtggtgattccggtcgtttgttggatgcgccgaatctcatcccgtagttcgattcgtaatgcggcatctaagttagacaatggttcatccagcaacaaaatggcaggatcttttgccaaagcacgggcaattgccactcgctgttgctggtcaccagaaagcatgttgggaaatttatccacaagttcatccacatgaactaattttgctagttcgtaggcacgcttttggcgctgcgtttttttgacatgcgccattttaagtggaaaggcaatattatccaggacattaaaatgggggtacaacgcgtagtcttgaaagaccataccaatattacgcatgcgtacatcctgctgggtgacatcagtgtcagcaaataatatttgaccggcagttggtgtcaataagccagcaatcaaattcagaatggttgttttgccgctaccgctgggaccgagtagtgccaccagctgaccgttgggtactatacaattgaggtgctcaaaaatattagcttgctgatcgtaagttaatgtgatgtttttaagcgtaagttgcatagtctcatttcccccatcttcagaaaaacttaattcgtcataagtataacagttcaagtgtggttaaggtatacactaaagttaagagaagatacgatctttttaatattaggtacttaaacgtaattactctaaatgagatttattttcatttagtcactttttatttataggtgctaaataccttatatatgtgatttataaaggtctatgtaatgtctactgaatcgttcttgtaatccttttgtagcagtaatctcaacgccagtttagtataattactgcaagggttttatccacttacgacaaaaggtcgtgcacttttactagaaaatgaggg

SEQ ID NO: 581 - DNA, 2812 bp, Unknown
  Metagenome-assembled genome
caagcactcctttgtatcgtggtttagacgactcaagtatacttcaaggagctgcttgtgtttaatcttgggctaaaataacttagtgcaatcaggtttagctgggttttgaactttcacggtttagaaacaataattaaaactagacaaaatcgggtacgtttgacagtaccttatttttgggggggggattttatatgcattatcggcggggattcattattggcgcattgactattttgttgactgctgccgcaccaattagttcagtatcggcaaaaagtcaggtgttccatagtacaagcaacgcaacgattgaaagtttggatagtaccaaatattcattagcggttagtaccgaggcaataaaagcctatgcagaagggctttatacttatgatcaaaacaacaaagttactgcagggatagcagaaggagcacctaccgttgataaaactaaaacggtttacacattcacattacgtgatgcgaaatggtctaacggtacggccgtgactgctgatgattttgtttatgcttggcagcgtctggctgatccgaaaacagcttctagtaacgcttatcaaattgacattattaaaaatggcgccgcggtgcgttcagggaagaagccaattagtgatttaggtgttaaagccttgagtgcacataaattacaagtgacattgacacaaccaattccgtttttgaaacagtatttgacgggagcttcctttgtaccaatcaatcggaaatatgctgaagcgcagggaagtaagtatggtacttctgccaaacatgttttagctaatggtccatttatcgtcaaaggttggacgggcactaatgataaatgggaatatattcgtaattcacaatactgggatgccaaagacgtgaaattggataaagccacggtacaagtggttaaagaatcagctactgcggctaatctatttgatagcaagcagatcgattatgccgtattaggtgataataatttgcaacggtataccggtaaaaaagtgttgcaccaagaaaccacgccaacgattggttatgtcagtatcaataataaacgtacactgactaaaaatcggcatttacgtttagctttagcacaggcctttaataaaaaatcattgactaaaaacgttttaaaagacggctcggtaccattaaatggtctgatcccagctaattttgcagactcaccgactggcaaagattaccggcaatccacgggacaattattagcgtattcacctaaaaaagctcaggttaactggaaattagctcaaaaagaattaaataaaaagaaagtcacactagaattattagttgccgatacaccacaggctaaaaatgttggtgaatttttgcaagaccaagtggaaaagcatttacctggtgtgacgatcacaatcaaatcaattccagtagcacaacgaattcaagcggaaaaagatggcaaatatgatctagcctttggtacttgggcaccagattatgcagatccgattgatttcttagccctatatcaatcaaatagtgatttgaacttttcaaaatatacgagtaccagctatgatcaaaaattaactgcgatcacagatgacttagcgactaaacaaactgctcggtggcagaaaatgcaagccgctgaaacgcaattgatcaagcaagatgctgccttggcgccagtttatcaagccggtgttagttatttacaacgctcagatgtcaaaggtttgcagctatcaccattcggttcgatcgttaactataaatacgtgactgtcaagtagaacggctatcgtggagtagaggtgaaacattttgaaaccattaattgcaattgtagcaaatcaatatgaatatgccgaagaagtatttcatcaccatccggcgagctatgttccacaatttttcttgacagcgatcaatgcagctggaggtgtaccagtgattttaccgctggtcgatcgtagtgctatttcacgttatgtttccttatatgacggttttttactgactggtggtcaaggagtttcatcgtttttatatggtgaggaaccattacctaagttaggcactacctttttacaacgtgatctgtttgaaattgcgttggtcaaggcagttgcacagacacataagccattactaggcgtgtgtcgtggcctacaagtacttaatgttgccttaggtggaacactatatcaggatttagcttatcgagaaaagccgagtttaaaacatatgcaaataccaacggcagatacgcagccaacccatcatattgttttagcgccagacacagttcttgcgcagacgtttggtgaatcggccttagtcaattctttgcacaaacaagcaatcaagcaggtggcaccaggattagaagtgatcgcgcatagctctgatcaggttattgaagcattacaaagctcgactaccgaccatcagtttatgggggtacaatggcatccagaaatgttgctagaatacgacgcacgacagttgattgtttttcaagatttagtaaagaaggcaaagcaagctaataagtaaaattatattctatacgtgtggtgctagtttgtaacatttagaaatttaacaaaaaagtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 582 - DNA, 2392 bp, Unknown
  Metagenome-assembled genome
tgtttgaacccactttagtgggttcttttagtcgtatggtcaattttcttcgcataagttggtcaattctttcgccgagtgtggtcaatttttacgctcacttggttaattcacgatgccgccttcagcttcaacgctgcctatccgttggcctttgcggctgatgagtggcaagcttttgagcggccatttgatgacgaagcgatttttcaggatagcttgcaggcgctgcatttctggtatgcgcaaggcaagctgcaagtagcggcccaagcctactttgctttgcctagcgcggataatttagccgagttacaggtacaaagtgcgcagctagcagcgctgaatcagccgaagttgccgacacggagtatgtcggagcacggcgcggagctgttgcaagccttggctcaaccgcaagctaacggcatcaaaaccttttctaatgtggatgcggtgttcaatggcggcctgcgcggtggtgtactctggacaatcggtgcccgccctggcattggtaagtcagcttttgcggttaatctaattcagcgcgcgctaagccatgatgcggccttgacggtagatctattttccctggaaatgacggcgactgacaattatcagcggacggtggcttattctactggggtcgcagtgggcaagttcgccaatccgttccagttgtcggcggcggaaaaacagcaggtgcaggcagcggtgggtcagttagatcagcagcgattgcaattgcacgataaactgttggtgctaccgcagatcgtcaaggtgatccgggaccatgcgttgcacgcaccggcgggtcagtatgtggcggtgatcgattatttgcaaataatcagtttggatcgggtggcggcgcggcatgatcggcggcaggagatcgagattattacccgcgagctgaaattgctgaccaacgagttggatattccgatcattttgttctcgcaattgaatcgggagttggaaaaacgcgtcgatcgtacgccgcaattagctgatttacgcgagtcgggcagtattgagcaggattccaatgtggtcagttttctgtatccggccagtttgagtgaggagcgcaaggccacgcgccatctgaatctgatttttcgtaaaaatcggtcggggcggctggcggaattggcgtttagctttgtgccggggcagatgcgcttcacgccacaattagtgcaggaacaagctgtggctgtgggtgacgggggtcatttgccgatgcagactgatgtggtgccagcagatgtgcgcagctaatggcgctattgtagaggaggtgagagctgatgatcgagacggtcaccgttagtacggcaaagatgtatttgaacaaaatagtgcgtgagctagaccgcacagacggcgcactggtgattcgcaatatgcgtaccaacgattgcgtagtcgtactcgcggcgcataaatggcacagtgagctagaaacgttgctcggtgaagcttttgactgctagagtgtgtttgcaaaagcgtccagattttgagcactagcctactacttcgcagtagtggtggattattagcaaggactgctaataatctttaatgttccggacgttgaccatgcaactaaggcaaaaatcgccaagttgaagcatggcagccgggtaataagcaagtgatgtgcttgactggcgtggttaggcgcagaaatcggctttttcgaccacgtttaaacaaattagtaatgaaaaaagctgacagcatttttcaaatactatctagtttttaggaaaggagtcgctttgatgacagatttaggattaccagtcggccacgagctggctaagcatgactttttagatcgaccattgtcggctgatgcgtcgatctatgtactaggtgagtttttgtaccgtcaagctgacgccggcgaatttctgcaatttttacagtttttgtgccagaatcagcgtagcgcggcgggggtgttgcggttaatgggggcacgggcagtggaatagcaataaataagttattggtttaaagaaaaaaagctgatcgaacatgccacaaaaaatggtatgttcgatcagttttattttaggactaacaactataatctagctccatcaaaaatgataaaacttaaagcgtgtgacattaacgttgactagcgtaatgatggattgaagtcaatatttgagacagattttaagagacattcagaaccgcgtttaccttccacagctcaagtaaatcattaatcgcgattaataacttatttgaaccctggaaagcattaaatcaggcggccatttggctcgtaagtgttgcaatttcaacttgtaagggggtctggtagcccagtgaactatgaattctcttcctattgtag

SEQ ID NO: 583 - DNA, 12250 bp, Unknown
  Metagenome-assembled genome
gcgaaacagcacggctttagggtaactgcttgagggaggtcaaattctgaggtttacccacctttatttaagttggccttttttcaattaattaggttgactgctaatatctgtttttttcaaactttctactccttttctaacgttaaaacaaaaaaagtccccgatccattgatcagggacgaaaaattccgcgttaccacccaagttatagctttacgctaccactcatacatgtaaacgacatgcgcgtcaacacggtttttcaaagttgtaattcatcacctagctgctatcagttttcagcgccactgactttctgcaatgccactaagcgactactagtcttaacgtgttcattattaaattagtttcaatatagcctagcttggccgacctgtcaatagtcgatgccaaaaggggtttatgcaaagagactaattggccttttggctgacgttagctagaaaatgcgtatcgttccagcgtggcaaggtgaacgacatatctgccgtgccctgtagcacgctgatactggtattgtctaactgtggctgcgccatgatctcaccaatagatgcccccagcgctgaccgaatcatcagcgtcagcatcgttccgtggccgacgatcaataaccgttgctgcggaaatgccgtcactaattgatgcaataatgcttggccccgtgcaaccactgacgtaaaagtttcgccgtgaaaactttgtggatcgtagtgaataggatcagcaaagaagcggcgcaacacgggatcttgattcgcttctttgattaaatgcccctcccaatcaccaaaatccatttcgtgtaattgctcagcaatctgcatcgctggtgcagttggattaggtgccaatactaatttagccgttgcttgagcgcgcttttgcgggctgacaaaaacttggtcgaatgtaacttgctgcaattcccgaccagcggcttgagccccgctcaccccagtagcagtcagtggcgtatcaacgtgtgccccattgatcttcttttcttgattaatgatcgtttgtccgtggcgtatgaaataaagttccgtcattagtaccgctccttttctacctcactataaattgctggaggaatatcctcctcattatagaatagagcggctacttagtcacctgttgcccacgaactttccacgttgtcgcaaataggactgccgcaaacaacgctgcgaacacgatcgtcaaaaagcccgttgcccaaccaaaatggtcaacgatcatacccataaaggcgtttgccattaccgaaccgaatagataaccaaatagtccagttaagccggcagcagtcccagccgcctttttaggcactaaatcaagtgcctgtagcccgatcaacattactggcccgtaaatcaagaagccgatcataaccaaggaaagattgatccaaaatatcgaagtcgcttgccaataaacgatcgtaaaagcagtcaccccgagcataaaaacaaaaccagccgggccacgacgacctttgaaaatcttatcggatacccagccagcaaaaattgtacctggaatcccagcaatttcgtacaagaaataacgtacttagaatagcatcaacgagttggaaaaacaatttattttgcttattttcaaatatagaccaattacatgatatatttaattatcgtttacataattaagaccataaaaatagaccaataatagttattactacgattggtctactgatcacacttattattcagcagctactggcaattcattgatgaatttctctacttgctgctttgttttacgatccttattaacgaaacggccgatttcttcaccattttcgtaggcgataaagctaggaatgccaaacacattaagttcaatggctaaatcgatattttcgtcgcgatcaacgcttaagaaagtaaaatctttgtattcggcttcgatctcaggcattgctggtttgataaatgtgcaatctgggcaccagccagcggagaagaaaagcatatatttgccagttttgattttttcgagtagttctgcttttgtaactttaggtaaagcttccatcgcgattactcctttataattaaactcagttattaacaacgatactgcgatcaacgaaacttgatcgcctctaactgctttatattttactcattttctcgcaaaaagcaatttactgacttttaataggctaattattttctgaaaaagtttttagttcattttttcataaaaatagtttatgataacaataaggaaattcaaacagtccgcgtcccttattttaggaggatcatatgcaaagaatcttaactattaacgccggtagctcatcgcttaagtggaaattatttgcgctaccgatggaaactatcctcgctcatggtctggttgaacgtttaaatcagccagtagcgactttcaagctaactacagcggaacaaaaattcagccaatccgttactgatctaactgcggaaacggccgtaaatttagttttagataagctggaagaattagctgtgatcaattcacgccaagaaattaccgctgtcggtcatcgggtcgtcgctggtgcggatatttttaagcaagcaaccctgatcacaccaactgtgctagagcaaatcatgaacttaagtgactatgccccactacacaacccagccgctgcccactacattaaattagtgactgcagcgttgccacaagcgcaacaaatcgcagtctttgacagtcaattcttcacacgaatgcctgaagttaatgccatttacagcattccttacgaatatacgcagcaataccgcattcgccgctacggtgaacatggtatcagccatgagtatctagctaatcgagccgctgacttattaggccaaccgcttaaaaaattaaagttgatcaccttgcatcttggtagtggtgcttcgatcaccgcgatcaaagacgggcaaccatttgatacatcaatgggcttaacaccattagctggcgtgactatgggcactcgttctggcgatgctgatcccgcgttagtgccatttttacaaaaaaaattggcgctagctaatgcaacagacgtcactgatatattaaataataaatcaggattactgggtatttctggcatttcaactgatatgcgtgacttaaaagcagcggagcaaactgatacacgggctaagttagcaattgatatatttgttaatcgtattgtcaaatatatcggtagctattacacagaattaggtggcctggatgcattgattttttctggtggtattggtgaaaatgatgccgatatccgcgcgcggatcactcgtggaatccaagctttaggtatcacactagatgaacagcgcaatcaaaagttacgtgaaggtgtgatcagtccagcaggtgcgtcgacaacagtattattgatccctaccgacgaagaattagcaatcgtgcggcagacggttcaagcgctcaatgttacacaaagatgacattttataaaatagctagtctttcaaatttggatatggtaatatgaaattggcttcaaaagctcgcttggaaaaggtcatagatgacctaaagtaaacggcattattctaattacgacatatcctttaattatctattctataaaacataaaaaaacgctaacctccgggttggcgttttttatttgacctattttggtggcggtaattgtcgttgccgcggtttgaaaaagcgttgtaaaagacgagtcaaccaactttgttggcgtgggcatgggcgtggcgcaattgccgcactggcggccgctgaagcagcgctagtggcaacactatcagccaattgacgtaaagcagcttgatcactttgtagctgggctaacatttgattgaccacggcctggttgctttgcacttgagcaactaacgcagccaaactagcggtgttatcggctgttgccgcactggcaactgttggtttaccactgctggccgtgtgaacttgtgcactagtcatctccctaattgcggcactggtgacagatggtgcggatggcacagtcgaagtagccacttttactggtgcactactcgccactgatgttgcttccgttgctgcatcaaactcaatcacatcagcaggtagcaactgccgcgctgctggtttagcgacagcaactgcactgctgccaaaattgatcgtgccaaaattagcacgggcactagtcgccgctgatgcagccgaacttaatggcggctgcacaataccatgtgcgtggcgataggcaactaaatcataaccgcaatgtgcgcattttccttcctgtaatgtaaccggttgaccacaacttgggcaaataaattctccgacgcctagactaccaaagtccatcgcccaaagctttttcgcaatttgtttcaccgtgcatcccctaccattaccagttttattgttgaattaaccatagcacgaatgcaggctggcgacaattgcgcttgacttatttttatcacgcgctagaatatgaagtaatcttaaaaacgcattgaagaggaaagtacaagatggcgcgtgtttagagagcatcgtttgctgaaaagatgccacgacaaaatcaaggaaaatggcctcggagcgggtcgcgcaaaatgagcgtgacaacggtcagctgcctgttagcgcagcgcatttttgcttaaggcagaagtggctaagtggcaatttctagaattgcaattaaggtggtaccgcgctcaagcgtccttttttcgtgaacaacgaagaaggacgcttttttgttgttctagagaactcacaaaacttggaggaatttagtatgaaaaaattaaagtattggttgatcgcattagccgcaattctattctttggcggtgtcagtaccgccacgcacgctgcaactaccgttaaagttggtgttgccagtgccaaacatgaagaatgggacgcagtaaaagataaattggctaaaaaaggcatcaatattcaaatcgtcacctttaccgattatgtccaacctaataacgcattggctgaaggttcattagatctgaacgcttttcaaacaaacatttacttacagtcttacaataaggaacaccacactaacttagtcccaatcgccaaaaccgttattgcgccgctaggtttatattctgataaaattactaagatctcacaagtcaaaaagggagcaacaattgcgatccccaatgatgtctctaatggcggtcgagctttgttactattacaatcggctggtttgatcaaagttgattccagtaaaggccaatacccaaccgtgaaagacatcacgaaaaacaaaaagaacttaaagatcaaagagttagatgctaaccaaactgctcgcgcactgaaagatgtcgatgcctcagtaatcaactccggtatggccgtcgatgctgggatcaatccgaaaaaggatgcgatttatttagaaaaggtcaacaaaaaagctgaaccttatatcaacgtgatcgcggcccaaaagaagaaccgtaataaggcagtctacaagaaagtcgttaaagctttccaatcagaagacattgctaaggttatttctaagtcatctaaaggcgcttcgatccctgtttggaacacaaaactaaaataagcgattcaaaatttaaaattaggagctgttgaaatatgagtcaaactaaaactgcaatttttgccggtggttgtttctggtgtatggttcgccccttcgatgaaacaccaggtatcgttaatgtagtctctggttatactggcggtcacgttgctaacccgacctatgaacaagttaagtcacacaccactggacacactgaagcagtcgccattacttatgacccagcagtgatctcctaccaacaattactagatatttattggcaacaaaccgatcctactgatgctatgggccaatttcaagatcgtggcgacaattaccggccagtgatctttgttcagaacgaaactgaacggcaattagcgatcgcttcacgcgaaaaattagctgccagcggtcgcttcactgacccaatcgtcaccaaaattgaagacgcacaaccattttatccagcggaagctgagcatcaagacttctataaacgccaccctgaacgcttcgccgaagagattgctggtcgcgaagaattcactgctaaatattggcaaaaagaggcgaacgtccgtggataaagcaacactgatcaaaatcacacaggatctgattcaactagacaccgttaacgaccatgaagaagcagtcagcgattatttgactacactatttaccgctaacggaatcagtactaaaaaactaacttatgcgccgggacgcactagcctaatcgctgagatcggtgatccgactagcaaacaagtcttggtcttttctggccatcaagatacagtcgcaaccggtgatgctgccgattggccatatgccgggccgttttccggcgaattacatgctggccgcatttacggtcgcggtgctgctgatatgaaaagtggactcgctgcaatggctgcaacgctgattgcactaaaggatgcgccactaaagggtcgtttacgttttgtagccactgtcggtgaagaattcggcgctcacggtgcccgtgaattgaccgaacaaggttatgctgatgatttcagcggtttagtgatcggcgaaccaacaggtcaaaaattgatctacgctcatagtggttcaatcgattatacagttacttcgatcggcaaagcagcccatagttcattgccagaaaccggaatcaacgcgatcactaacctagttaaattcatcactgccgaagcgcgcgcttttgatgacgtcgccccacatccagcactaggcgattttgtccatagtgtcactgtgatcaaaggtggcacgcaagtcaacagtatccccggttacgcgcaattggccggcaatatgcgcccgattcctagctttgacaatgcacaagcaattggccggctacaaacgatcatcgatgatctaaaccagcaacctgacgttaacttaaaacttaatgtagatttcagttttgtacccgttttgacagctcaagatgatccattggttaccgcgctccaagccagcgctcaacaagttacgggtaaagaactgatcgaagatgtgatccatggcgccactgatgcgtctgagttcaccaagtcagcgcacaagttcccggtaattatttttggccctggcgattggtcagctgcgcatcaaagtaatgaatccgtcagtgttgccaacatcgttaatacgcaaaaaatttatcaagcgttagccctgcggcaactgagttaagctttaattgcactataacacaattaaagcgatcaaaaaacttatgttcgcattggaaattaagccaattgcttactaaattacctgactactttttgcgtagccccactgaaagtcaccaaaatggtggcttttttttcggcattagttatgctaaaatgagaacaaccgttcgttttaattttgaactaactaagtgcttttttgctagtctaggatcacaggcagctactattgcggagcgagggatacttatgcgaatcaccgattttttagccatgatcgccgacctaaaccgaaatttttgggtcatgtatgagttcggtgccaatcgccatggtaaacggactgaagaagtggatcatgtgcaatatattaagctaagcggcctgcatacagccgagatcacacaaccgcagttgatcctagaaaccacgccccatcagcaaacactccatttatgggaattatcagtgttactgcggcagcaccaattacgccgctacatgtacgttgagtatcaagaccagcagcatccactatttggtttccgcgtagaaaagaatttagttctgctgggctaaattgaattttaagtagaaagtagttttttaggcatgaagagacgcagaaaaaaacgcaccacttcgctacttgttttagcgatcgttttaattggcggttggctaggactcaagccaagccaatcacaaaatttgtggcaaacagcgcaggcattgttgcccacagcacaaagcagtaccaccaacagtaccagccaaccaaacgctagcaccgcgcaattagctgacctagattatcaatcaggtcaaagtgctgtcgttgctgtcaacaataacaaagcgactttggatcctgctagttggaaaaccaaccacgtcgtttatgctgatttagatcagctaaaccgcaccagcacagccaataccgcttatttagaacagcgcaacgtcgccaatgattcactgcgggtcagacaaacggtacaacctacgggctggcatcagaagttttctggtcgccaagcaatcctcaatcgtggtcacttagtcgcctactcaatctcaaagggcatcagtgttgacggtaattatgatcctaaccaacaaagcggcgaccaaaataatttgaaaaacttatttacacaaacggcttttagcaatcagcggctacaaaccgtctacgaaactaaaattcgaaccgcactgcgaaatggtaaaaaagttatttaccagcctcacgctatttttcgtggtagtgagttaatgccccgcggtgttcagttacaggcgatcagtaccgatggcagcttgaattttaatgtctatattttcaatgtccaacccgggttcacctttaattacagcgatggcaccagccaaaccagcagcctccaagtaccggatacaacgatttaaaaccagcaaagcctctgctggcttttttgttattttaatgtaacctttatgtaacacaaagagcatattgtaataattctgttacgctagctacacattttcgtgctaaagttaggttactatttaacgaaaacgttcacttatttcaggaggatctctgcatgcaaaaaaagaacgctctattacttagcgcgacaactttacttagtgtaattggcgtttccgctatcgcaactaaagcggacgcggcaacagtcacagtcaaagccaatgataccgtttgggacttttctcaagaatacggcgtcacggttgatcaaatcaaaacagcgaaccaattaagtggtgacaacccaattattttaattggacaaaagttggaaattccaaccgataataatgccacaaccaatacttacagcgcggcggcaactcaaaccgtgcaaccagattggaacagccaattagcagcacagtcagccgcgacagcttcggccaacgcagctagccaggcagcagcacaatcagctactgacgctgctaatgccgctttgcaggctgctaacgaatcagcagcagcggcttcagctcaagcagctagtgcagtggcacagtcggcagcaacagcctcagctaacgcggcacttcaagctgctaacgaatcagcggcttcagcccaagcagctagtgcagtggcacagtcggcagcaacagcctcagctaacgcggcacttcaagctgctaacgaatcagcggcttcagcccaagcagctagtgcagtggcacaatcggcagcaacggcctcagccaacgcagctagtctagcagcaacgcaagctgctaacgaatcagcagaagcagcttcagcccaagcagctagtgcggcagcacaatcagctgcaacagcttcggccaatgcagctagccaagcagcggcggaatcagcgacagcagccagccaggcagctgtgatcgcgtcaacgcaggcagctagtgcagcagcgcaatcggcagcaatcgcatcgaaccaagccgctagtcaggcagcggcagaatcaacagcagcagcgacacaaacagcaacaagtagctcagccagtaccagcagtaacacaactaccgctagcgctgacagtaactatacattcacttactacaacgcaacaccagatcaaggttggggcgacgccagcgcaactgctgatggcaccagtaccgcaactggccgtgacgctgatgggtatctgattgccgcagctgacagcagtattccatttggtactcatatccaaacaccgtatggtgaagccgttgtccacgatcgtggcggcgctgtttctggaaatcatattgatgtattgcaatagaaatgtgaaaatcaccggtaaggcgatttttttatttggcagattgcaaggatacgctttgaaatgagatttaattgtttattaaccaaaatatcaaaaaaagcgtatcattgaaagcgtaatgattaaaacgttttttacaaacgttatagaggggagaagttaatatggacttagtcgaagaactagtcaatgttgttggtaaaaaaaatgttattactaacaaagcaaaatctttacgttttaggaaagggtaccgctcaggtaagggcgatgcagttgcagtcgtatttccaaccactttaatggcaatgtggcgtgtgcttaatgttttgcatgataacaatattatcattattatgcaagcagccaacactagtttgactgagggatccgtaccagccccaggttatgaccgttctgcagttgttgtgaacggcatgaaaattaaagatttacagttaatcaataatggggaacaagtactagcattccccggtacgacactgtttcacttagaaaatgaattgcgaccacttaaacgtgaaccacattcagtcattggctcatctaatttgggtgcatcggtcattggcggtattaacaacaattctggtggtgctttgatcagaagaggtccagcttatacagagctatcattgtatgtttggattgatgaacatgacgaaatgcacttagttaaccatttaggcattgatttgggcaaaacgcccgaagagattattactaatttgcagaaccgcaattttgatttgaatcaagtaccagctactgaacatcatggttcaatgttccatcatgaacaggttgtgcgtgacgttgaatctgataagcctattcgatacaatgcaaatcctaaagaattgtatgaagtatctggatcgtccggtcacgttgcggcattggctgtccgcttagatacattcccaatggataaaaaaacacaaatgttttacattggaacgaataatcccgatgagttggaagatattcgtcgccatattatgacgacattcaaagaattgcctgtttctggtgaatatatgcataaaaatgcttataaattggccaagaaatatggtaaagactcactaattgtgattgaaaaaattggtacgggtcatttgccccaaatgtttgcgctaaaagcatggggcgaacgctttttgaagcacattccgtttttcaaaccttatttcccagatcgtttgcttcaaacattaagtaatttatttcctaatcaaatgccaaagcggttagatgattattacgaaaagtacgaccattacctacaattgaaaatggctggtaatggtattgaagaagcgcgagagtatctcaaatcttattttgacaaagccagtggcgactactttgaagccgatgccaatgagaccagtaaagcggcaactcaccgctatgtaacagctggggttgcgattcgatatcaagaattaaaacaggatagtattgacattttgccactagatatcgcgttggcaagtaatgattataagtggttcgagcatttgcctaaagagattgaagacaaaatagaacacaaaatttattatggtcacttacttgatcacgttatgcaccaggattatattctaaaacctggcgtcgatgcgcatgaacttaaaaaagaaatgcttaaaattttggatgagcgtcacgctgtttatccagccgaacacaatgttgggcatctatatttggcagcaccggccttaatcaagcactataagaaaaatgatccaactaatagtttcaaccctggcgttggtaaacaaacaatgtctaaatattggggcgaatactaaaaggtagattgtaaaatttaagttgaacagattagtggacagaaaaacccataaaggtctttaatggtgtcaccacaacattccactagaaagaaggacctttatgggcaccactattttatcatttgaagaccgcgttgtcatcgaaacacttcatcatgaaaagcactcacttcaatatattgccgattatttaggctttagtaaaaccac

SEQ ID NO: 584 - DNA, 48630 bp, Unknown
  Metagenome-assembled genome
acatgaaagcagtgtttcaaacgttcaaaaagaacttagtggttgtactcaacgccagtgaatcggactatacgaatggcccagtcgaaggcatgaatcgaatgattaaacaaattcaacgcacagcatttggattccgtaattaccatcatatgatttcacgtattaagttacggcaaatgagaacaaaaccaatgaaaaaaacagagttgaaagtcgcatgactttcaactctgtaaaagctattcatcaacaggatttgacaaagagccaaaacttatttgagtaaatatttagcatcgtattctggatcttgtgaggtcaaaattttcggaccatcatcggtgatcactaacgtatgttcatattggcagctaagtgagccgtcctcagtggtcacggtccaaccatcgggcgcagagctatcgcagcgccagtcaccaacgttaaccattggttcgatggtgatcgtcatgccggcccgtaagcgcaaacctttacctgctttaccgtagccgggaacgtctggtgattcatgcatcgtcggttgaatgccgtgccctacgtattcacggacatcgccgtaaccctgctcatcttcaacataagtttggatcgcatggccaatatcgccgacacgattgccaacgacggcttgatcgattccgaggtaaagtgcctttttcgtaactgccatcaaacgtttgacctcatcactgacttcgccgaccgcgtaggcccagcaggaatctgacatatagccatcgacagaaacgacggtatcaactttaactaagtccccgtctttcaataggacatccttgcgtggaaagccgtgacaaacttcattattgatgctgacacaagtggcgtattcgtagccttcaaaacccttttcctctggtttagcgttattttcagccaaataacgtagcgcgaatttttcaatatcccagctagaaatacccggcttgataattttgcgcagaccgagatgcatccccgccaaaacggcacctgatttttgcatcccgcgaatttcgcgagctgattttaatgtaatgagtgacattgcgtaagttcctcctaatttaggtccaaaaatagtttatactgtatggtcgcctattaactgatcatgttctattatagccgtttttgtggctgtggtggcccatcaagaaaaacattacattttctgtagtcaactgaaaatttgggccacgatcgccgcaatatgaattgccgccggatctaacaatggtaatgccacatccgttgtttttaataataaaggtaattcggtgcaaccaagaacaacgccatcgatctgctactcgaactgcaattgcttaataatggctaaaaaatcctgtcgtgtcgctggtttaacaattccgttttccagctcagttacgattttatggtgaataaattgttgctgctatgaatttggcgtgatcacttcaatgccagcgtcacgaaaggcgcgtttaaaaaagtcgtgttgcatcgtgaattcagttcccagtaaaccaagttttttcagacctaatttttgcgcgtgttggcagctggccgttaccatgcttagcagcggtaccggctgctgaatttgctcaaacacgatatgcggtgtaatcccacacatgaccacaaaatcagcgccagcggcagccaattgctgggcagcctgggataaataattggccaccgcagtgtaatcttctttttctagccaggcaaacatttggtacatattcacactgttgatcattaattctggtaatgtcgtttgattgccttgatgttgttgaaactgactaataattgcgcgataatacatcatcgttgcttccgggcctaagccaccaataatgccgactttttgcatttgctcacggtctttcattaaagttaataacactaagcgtagaataataatttagcttaggcaatagcggcatttgtgtttagccagttaattttctacaataaacgcaaggaggtgacggccgtgcgccgggcaacgattattttaactatgttgatcacaggctgcttgttggctttaggtttaacaaccacacaagccgctgaccacgatttaactaacaatactaagccgagtttttgggtgctgtcggacccacattttattgcgcccagctcacacgaccagcaggcggcttttaagcagatcacccagaccgcagctggcaaagacttgaccgaccagccagttgccttgcatgccttagtctaaacggctttaaaaaagcggccaacggcagtgatcatcactggcgacgtaacgtttaacggtgaattagccagtgcaaaaagtttagcccgccggctgcggccactgcaaaaagctggcattcacctgctgatcatccccggtaatcatgatattaatgacggttgggcgcgtaaattctccggtaagcagcaaagccccactccccagatcagtcccagcgcttggcgccagatttttgctgacggttatcaaaatgcttgcgccgtcgataatgattcactgagctacgcggttaatttgaataaacgttaccggctattattgttggacgataatacttatccaacccacacctcaactgacgcgccgaatacgggtggaaaattgaaacagagtacgctgctgtggcttgaaggtcaactacatagcgctaaagccgctggccagcaaacgctggtgttcacacaccacaatctttatgcccattcaatgatgaagcaaggttgggtcctggataatgccgctgcgttgcggcacatcctgaatcggtatcatgtgccagtcttattttctggccacattcacgcgcaagatattatggctgcgccgaagcaaaagcacgccacaattgagatcgttagcggtagcttttctatgactccggccagttatggcgtggtaacattgacgccgcaccggctgcattatcaaacacagcaactcaagctgacgccttacctgaccgctaaacagcgccagcagccgtcattggttcactatcaacgccacttaaaaaagttgttccagcaaatgaacgacaacatggtagcgcagcacatcaaaaccaatcatgcactaactaagcagcaagcaaatgtcgaaattaatttcttgatcaatgccaattggcgcttcgaaaccggcaatgactttatgacggcccaacaattagcgaaactgaagcaaacgtcaggctacaaattggcggcccatgattcacagttaagcggccccttaggcacattaaatggtgatcataatttgccggatcaccatttgacattgcgctattaaaaaaatcacttggtagtcagttgcactaccaagtgatttttagcaattacgccatgactttttcagctttaacgctggttctaaccaaatagtcaaaagcgcttaaggctgcggttgcaccggcgcccatcgcaatgatgatctgcttgtaagccgaatcagtgcagtcgccggcggcaaaaataccgtcaacattggttgcttggcgtgcatccgtaacgatttcatgatgcgcgttgacttcgatcggcgcagtgacccagtccgtatttggtactaacccaatttgcacgaagaccccttctagatccaaatgatgttccgtttgggtggcacgatccgtataagttagaccgttaacccggcccgcaccagtgatttctttggtggcggcgttggtgagcagcgtaatgttagttgccgcattggctttagcctgcaaaacgctatccgcgcctagttcaggtgcaaattcaagcacggtcacatgctgacaaatgccagccaaatcaatggctgcctcaatgccagaattaccgccgccgatcacggcaacctctttaccggcatataatggaccatcacaatgtgggcagtaggcgacgcctttgtttttaaattcagcttcgccgggaacgccaatagtcttccattgcgcaccagttgcgatgatcgctgttttagctttaagcacatcgccagcggctaaagtcaattcgaccacatcatttttgacgatctgttcaacccgttggcctgtcagtactttgacgccgtacttttcaacttgcgcttgaatattggccatcagctgctcaccttcaacatagtcggtaccagctaagttttcgatacccaacgtatccagtggttggccgccaaaatgatcggctacaattgctgtcgagatccctttacgtgcggcataaattgctgcactgccagctgctgggccagcaccaacgatcacgacatcaaattgttggtcagtccaatcactagcaacatgctgcggtgcagcgccagcagctttatcaactagttcttccaacgttgctcggccattatgccattcttcaccattcaaaaagaccgttggcacagccaagatattcttttccgtggcttcatcctgatacatgccaccttcgatcatggtatgactgatatgtggattaagcacgctcataatattcagcgcttgtaccacatcgggacaattatggcagcttagactggcaaaagtttcaaaatgtaaatccgtgttgatagcagtgatccgctgtttcgtcgccgcactaatttttggtgcgtgaccggaaacctgaagtaacgccagcacaaatgacgtgaattcgtatcctaatggtaccccagcaaattcgatcccgctgctagcttggcccgcttgatcaagcgcaaaacttggttgccgttttagtttgccactgacaacggtgatccgtggcgtcaacgctgcgacttcatttacaaagtcactgactttttgcgaacgctgatcggtccctagatcggtggtgatcaccacatcatgctctaataattttaagtaaccaaccagttgttgcttaactgttgcatcaattgccatcgctgtaaaacctccttgaagatttacttctatcgaaaaaggccgaactcgcggccttttaacatgctttactctaaaacgtaattaacaaagcaacttctttcagctaacgacgctaaattttaccgacaagatccaagccaggcgtcagtgtggcttcgtcttctttccacttagctgggcaaacttcacccggatgcgcggccacatattggccagccttgatccgattcaaatattcaccagcgttacggccgataccatcagcgttgatctccatagcttgaacgacaccttcaggatcaagaatgaacgtcccccgttgagcaaggccttgttcttcatctaaaacatcgaataagcggatgattttctgtgatggatcgccgatcatagtgtattcgactttaccaactgcttcggaatcatcgtgccacgctttatgtacaaagtgtgtatccgcggaaacggaataaacttcaacacccaatgattgtaactgtgcgtaattatcttgaagatcttctaattcagtcggacaaacaaatgagaaatccgctggataaaacatgataatactccaatgaccgagtaaatctttatctgaaacgtcaacaaactcaccttgccgatatgcatgtgcgttaaattcgccaattttttttccaactaatgacataatatggtagcctcctaaaatttaattgcctgcaacctttattctaaatgataatcattctaagtcaagtctaaatctaaaatagaaacgattaatttgtattcggttactaaaaaatagcgaccaccaacttaactgtttgcagataacaaacagaaagtcggcgatcgctattttagcggtgaccgtcctaaatgtgattaaatctgtggccggcgtcgatacacgatgaaacgacggtaaacgtattgccatggtaaggccaacgcgtgaaccaagcgcgtatacgggaaggcgccaaaaatcataaagccgaagataacgtgcatcttgaacattagtggcacttgcagcatcaagcggaaatcaggatggaacatgaagatctgccgcgcccaaattgccaaggacgtccgataattaaaatcaggattgatcggccccgcaacaaaggaagatagcatccccagtgtgatctccacggtcaatgcgacgatcaccactagatcacccgttgagctagcgtggaacacccggtgatcatgaaagcgacggaaacaaaggatatataccccgaccgtggccaagatcccgaagaaagcaccggctggcatggcgataatgtgatgataaaattcatcgctgatccccagtgcgtccgtccaggcttttgggatcaacacgccgataatatggccaaaaaatacaccgataatgccgacgtgaaacataatactaccaatcatcaaggtctttttttccaacagttcactggatttggcagtgacggttgggtggaaaaaggcaaagcggatgatcgtgccgaagaaaaatgaccccagcatgagatacggataaatactccacaagaaaaattgaaacggatggctcgcgatcatttatgacacctcctgttgtgcgccgatgcaggatttaaattcttgccgcagtaagcgaatcaattcgagataggcttcgccggcatattcggcttcatttttcagtaaattgtaagtgccgtcttcaatgacttggaacacaagcccaatatcttgttgccgttcatcttgatcccaattaccataggtcaaaaattccagcatcaatggaaaataatcagctagctcgtcaccctcaacggagacgccaaacatttcgtacaacatttttaattttgctaacagttgcccgcgttcccgagagtcttggtagcgataatagcttaaatatagcgtaaaacgcttattcaggtcaaaaagatttgaatattcttgttgcaggtcaaacaatgacttttgttgtaattgtttgatccaagcgactaacgctgctttattaggtgtttccggatagtcgcgggcaaagtcagcgaccaacgttggctgcaataattcgtcgctggggtaatctaaccagtgcgaaaaatagacgaagccgggccgcatttggtccacgcgttcaatattaatcacgccagatccccccatagaatgtttcggcatagatttctgccgttgacttgccggcctcagccttgcggaacatactgctatgttgcggtgctaagctgcaaccttggcattcgtcataacctaatgtcccttgttcatcataaccatcttcaacttgttctttatggttagttggaatgacaaaccgatcctcgtatttggcaattgcgagtaagcgatataaagaagtcgcactacgttcagttagatcaacgcgacctaatttttccgtgtcgaaatctttaccgctagtccgtgcccgcatgtaaagccgcatcatcgctaatttgtatagcgctgctttgatagcttccgtgttgccgccagtcaataggctagctaaataatcaacaggaatacgcatttcatcgatccctgggaaaatcatttctgggttattgatcgaatcgcggccttcaaagtagttcatgattggtgacaaaggcggcacgtaccaaaccattggcattgtccgatattcgggatgcaatgggaaggcaattttttccgtaacggccatccggtaaatcggtgaattctgggcagcggtaatcatttcatcgctaatgccgtcagcataggcttgttcgatcactgctggatcgttagggtccaagaataagctcagttggctttcgtacagtttagaatcatcgggttcttcggctgcttccgcaacgcgatcagcgtcatacaacatcacgccaatgtaacgaatccggccgacacaagtttcagcacaaactgttggcatgccttcttcgatccgtggataacagaaggtacatttttcagctttattcgtccgccagttgaagtaaactttcttatatgggcagccagtcatgcagaaacgccagccacgacagcgttcttgatcgactaacacgataccatcttcgtcacgcttgtacatagcaccagatgggcatgaagcgacacaaggtgcatttaagcaatgctcacatagccgtggtagatacatcatgaaggcttgttcaaaattagccttgatatccgtttcaatttttgccatattcggatcttgttgcaagtattccggcgaacctgctaaatcgtcgtcccagttggggccagttttaagatccatatattcgccggtgatctgtgactttgcccgcgcaactggctgatgtttcttttctgggccaaaaagcgtttggtagtcataagtccacggttcatagtaatcatcaagctctggcatgtcaggattgtaaaaaatcttacctaaagcgatcttgttaagtttgttgccggccttcagttgtagcttgcctttgctattaagttcccagccaccgtgataatgactttcgtcttcccaacgtttcgggtagccgaccccaggcttagtttcaacgttgttaaaccacatgtattctgcaccgggacggttggtccaagtgtttttacacgtgaccgaacacgtatgacagccgatacatttatctaagtttaagaccataccgatctgtgctttaatcctcattccagttcaccttctttaattttctgactttaacgtacaaatcacgctgattaccgatcgggccatagtagttgaagccgtaacttaattgcgcgtagcccccaaccatttgcgtcggtttgatgtggatctgagttggcgcattatgactaccaccacggttaccagtgatcgtcgataatggttcctgaatctccatatcttgagcatggtacatatacatcgagccttccggcatccggtgactgaccactgcccgtgcagtaacgaccccattacggttgtaaagttccaaccaatcgttgtccttgataccaattttatcggcgtctagtgggctgagccaaacgtttgggccgccccggaacaaggtcagcatttccaaattatcatagtacatcgtgtgaatgttccacttaccatgcggtgtcatataacgcaacgtcaattcattagcttctggtgtgatcttcgtatccttaggtcccatcaccgtcggcggcagcgttggcttgtaagtggctaattcttcaccgtattcttggaacgtttcgtgatcaagatagaattgttgccgcccagttaaggtacggaacggtactaagcgctcaacattcaaggtaaatggtgaatagcgatcaccatcatgcttcgagctactaaagacaggcgttgggatcgcctcgcgtggttcggtggtgatcgccttaaaggtgatcttttcctcggcacggccagcgctgatatcttgtagcttacgtccagttttactttcagcatccgcccacgcccgttgtgctacatgaccattggtggcactggaaagtagtaagaccgcttcagcgactttcttatcttggtctaattttggacaatcgacattgataccgtcatcccaaaccgaattacgatcacgtaactcagcatattctggcttaacgctgtatgaatagccagtcgcaccgacgttaccatcagcgtgtggccctagcgcaacatacttcgaataaacttgggtgtaatcgcgcttaactaaggacaagctgggcatcgttttgcccggaattggttcaacttcgccgtacttccaatccttgatctcacctaatggttgggaaatctccgccttagaatcatgccctaacggctgcgtcttcaagtcataaactggttccggcatgtatttagctgccatcgttgagaatttccgtgccagtgccgcaaaggcttgccagtcactcttagattcccataacgggctgaccgcagcattaaacggatggataaatggatgcatatcggtggacgatagatcttccttttcgtaccaagttgccgctggcaagaccacgtcagcgtatagcggcgtggttaccatccggaagtctaaggaaaccaacaggtcgagcttgccttcaatggtttcgtcgttccatttcatttctgttggcttaaagttatcgttactcttggccaataaaccattttccgcaccaagtaagtgtttcatgaaatattcttgacccttaccggaagaagcaaataagttggagcgccaaacaaacattgcttttggctgattttgtggcgcatcgggatcttcagcagcaaaatgcaagtcaccagacttcagatcacggaccaccttttgactgagctcaccgatgtcagtggttttgtactgttcagtaaagttcagcgaattacgatcgaattgcggataaccaggcaaccagcctagacggatcgccatttggttgtagtccgcaggatgatcgtaactgtgcttcacttttttgaccggtgacttcagcgcccgattgtctaattcatcgtacttccattgatcactagcgaaatagaagaaggacgtgccgttttgttggcgcgcaccaccaggttgccagtcattggcaaaggcgatcgttgcccaaccttcagctggccgcaacttttcttgaccaacataatgggcccagccaccaccggaaacaccttcacagccgcataatagcagcatgttgatgatcgtccggtaattcatatcgctgttgaaccagtgattgatcccagcgcccatgatcaccatggatttaccgccagtatcgatggcgttttgggcaaattcacgggcgatctgcacgactaagctctgtttaacgcctgtaacttgttcttgccacgctggcgtgtaaatgctggcggcatcatcgtaaccttgcgccgctaaatcatcattggcggtgcgcttgataccgtattgactcatcattagatcataaacagtagtgactaatttctgctgtccattggctaaagtaattgaacgaaccggtaaatgccgagctaaaacagcgttgccttgccgatcaaatactgggaaatcaacaacgacattctcactgtcagcaccgacacttaattcaggatcgatcggattgccagcgtcatcctgcagcgtcagattccactgccgattatcttcccaccgttgaccgaccgtgccgtttggtaccacgatctgctgggtattttgatcccagaccactggcttccattcagcgttagccaccttgtcactagataaatcactgatccgcacaaagcgccccgatgtaaagtgatgatcattagccgcactcgggtctaagaaaactaagaatggcagatcggtaaattgtttcgcataattgataaattgcggttcctgccgcttttgataatattcatttaaaataacgtgggtcatcccttgggctaaagcagcatcggtccccggatgtggcgccaaccagttatcggcgaatttaacattttccgcataatctgggctgacggcaacaatcttagccccgtgatagcgcgcttcagtcataaaatgcgcatccggcgtccgggtcaacggcacattagaaccccacatcataatatattggctgttgtaccaatcactggattcaggaacgtcggtttgttcaccccaaacttgtggtgacgccggtggtagatccgcgtaccaatcatagaaactcaacatttccgagccaagcaaggaaaggaaacgtgcgccggaagcataactgatcattgacatcgcggggatcggtgaaaaaccggcgatccgatcagggccatattttttcaatgtatagatcagcatcgttgagatcaattccagtgcttcatcccaatgcacccgaactaagccaccatgaccgcgggcactcttgtagtaatgtgtcttttctttgtcttcaacaatactcgcccaagcagcaattggatctgccgcgttttgcttagcttcagtccataattgccacaacttgccacgaatgtaaggatatttgatccgtaccggactatattcgtaccacgaaaaactagcgccacgtgggcagccccgcggttcaaattccggcatgttcggcccacacgatgggtaatcagtcgcttgatgttcccacgtaatgatgccttgcttcacataaacgttccaactacacgagccagtacaattgacaccatgagtcgttcgaacaactttatcgtgggcccaacgctgcttatacagtttttcccagcggcgattattttcttccagctgcgtaaaactgccgttaaatttctcgacttgcttaaaaaagcgagatttcacgattattcacgtcccttccagaactaaagtattgaaaaaagcgcttagattatagaacgtatcgcctagctagtcgtttggctaatacggcgataggtcattttgcttttttcaacacgtttccacattgaatattttttaactaccttaataccaaatataatcacaaacgcgagctaacttctccggcaaaagttgcgcacaaaagtaagacttttccctaatattcacaatatcatttacaatgctatactgcgattagggaattgcccgaattttatgaaaaatacataactttttgttaaaaataagagtgttcaactagtggcttctttagtttttgctcaagagttggttcactacattttgtctatgcacacggaggtgagcgtcatcgaacgttatgatcggcaaatgcgcgtcaaacaaattggcgccgctggccaagctaaaatcagtgccagcacgattttgatcgtcggctgtggcgctctaggaacttatgcagctgaacagttggtgcgcgctggtgtcggtacactctatttagttgatcctgataccgtcagtgaaactaacctacagcgccaaagtcttttcaccgaagctgatgccgccaatgaactgtttaaagtcgatgcagcagcggctaaattacgccagatcaatcacaatgtcaccattgacgtctttccggtggaactgcgccccgaattgctggcgcaaatgcagccattgacgttggccttagactgtagtgataattttagtgtccgtgatctgcttaatcgcttggcgctcaatcagcactttcccttcgtttttgcagcctgtgccggcgtttctggccaattaatgctggttgatcctactgctgggccgtgccttgagtgtgcctttcccgatatcaccaagttaaaagagcgcgactgcgacattctcggcgtcgctacgccattgattccgctggtttctagtatccaaatttcattggcgttgcgttatattgtcagcggtgctggcgccttggatcaattgacgacggttagttgttggccaccagcgcagcagaattttaaagttaaaaaacgcgctgactgcccagtttgccagcacaaacaggtcccgatcacgttaaatgataaaacgttgttgcgccgcttatgtggcagcgatgcttggtcagtttatttaccgcaaacacgtagcattgccgaagtagccgccactttggccgctaagcatgtcgcttatcgcgtcactccaagtatgatcacctttaagtggcacgacgcaccggctagctactttaaaaccggtaaagtgcaactttataaactaaatgagcaacaagcacagcagcattaccgtgcgctgtggcagctactcaaagcgccgcgacagaaagaaggtcagccataatgacaacggcagcaattttaacggtcagcgatacgcgtaatttagataatgataaaagtggtcaaacgattgtcaccgcgctgaccaccgctgagatcaccgttacccagcgcttagtggtgcctgatgatattgtggcgattcaaagcgcatttttgcagttagaattaacggaacctgacctgatcatcaccaatggtggcacaggtatcgcccagcgcgatgtcacctttgatgctttagaacctttattgcccgtaacgatccctggttttggcgaacatttccggcagatcagttttactgagatcggcacgcgtgccttggcttcacgggcgctagccggttttaatgttcgcgatcaactttgttttgtgctgcctggttcgaccaatgcctgccaaaccgcgttacagcagttgatcttacctgaatggcaacatttgttatttgaaagacgaaagtaggtaacttgtatgttagaacgtcgtaaaccaattacattagaagaagcacaagcaaaattagccgcattaaaattaccccaacaggtagaaacgattccggtggctgacgctaatcatcgcgttttagccgaagatgccgtagctgcgtatgattatcccaatttccgtcgttctggttatgacggctacgccattcgtgctgccgatgaccatgatttcccgaaaaatttccatgtggtcggcgaaattcaagccggcgctacctttgatcatgatctaggtgaaaatgaaaccgcacggatcatgactggtgcctttgttcccgataacgcagctaaagtcattatgttagagcaaacgcggtcggtacctgaacaacctgatcaggtgaaaattatggtcagccaagaccgcgacaacattacccccgccggttccgaatttaaacaaggggcactgctgatcgctgctggcaccgaattgaatcctggtgggctcagtctgctaaccgcctttggtgccactgaagtcaaggtttaccggcaaccacgcgttgccatcatcacgactggcactgaattactaaatcctggcgacaccccacagccaggtaagatttttaatagtaatgggcctttgatcgctaatctagtcgcagaaagcggcgcgatcgtcactgaaaccgttcaattagtcgatgattataaattattacaaaccaatttagaacgacttaagcaaaccaacgacctagttatcactgatggtggcgtttcggtcggcgattttgactatttagctactaccgcccgcaattcagagcagttattatttaacaagttaaaaatgcggcctggcagtgttacgaccgcttttgttgatgacaataccttgatcatcgccttatctggtaatccgggggcttgctacactggtttttacttatttgctgagccaattttacggcgctttgtcggccaaccatcacattgccagaaagtgaccgcaaacttagcccgcgtttatcctaaaactaacggttacgataaaattttgcgcggtacttatcggttaaacgacggtcgttatcaagttcagctaaacggcagcgatgtatccggctcactaggcaacctgcaatcgactacttgcctcttcaagataccgcatagtcacgaaccactacccttaaacgccgaggtggaaacatggttgctccccttcaagtagttggctttaagaaaagcggtaaaaccacgacgatcaacgattttctagcagttttaaaacggcagcaccagccggtgtgcgtgttaaagcacgacgcgcataatgcacaaatggatcaagctggaactgataccgctcgtttcactgctgctggtgcgcaaaccgttttattggcaactgatcaggcaacgatggtacaacagcagatcactcagccgccaactgcagcgcaactgatcgccgcttacgcccagcccgagcaattttgtctgctggaaggcttcaaggcggcggcctaccctaagctcgtgttggtacgacctggcgaacggccgactgactttaagcaattgagccacattacggcgtacgctagcttgcataccccagagttcagtgcctgtttggatttcagcactagcgcacagcgccaagcttggtttacgacctatttgcagaaagaaggattttaatggctgaattaactcatttcaatgatcaaaatcgtgcacggatggtcgacgtcaccgccaaaaaagtaaccgcgcggatcgccaaagcaaccggccaaatcacgatgcatccggaaacattagcgcgtattcacgctggcacaatgaaaaaaggcgacgtcctcgctgtcgcccaagttgccggtattatggcggccaaacagacgagtaatttagttccgatgtgccatttgattcctttaactggcgtcgacattcactttagcgataacgatcaagatacgatcactgcagtggtcaccgtcaaaaccaaacacgtcaccggcgttgagatcgaggcgctgacggcttgccaggtcagcctactgacgatctacgatatgtgtaaagccatcgaccgcggcatggtgatcaatgacgtccatttgctggaaaaagatggcggtaaaagcggccatttcacttacgatgccgcaaaataaaccgacgggaatcgtattagctggcggtcattcgcgccgctttgggcgtgataaagccttggccgtcttaccggagcaaacacaaccaaatgtggttttagctgtacacaaattgttgccgctaacgaccaaaatttatgttgctgccaacacacaaaatgccgctgcgctaaccaccctctttatcgacttaccgcaggtacatatttgtgtggaccacgctgattttactgattgtggtccacttggtggtttatacgccgcgaccgcagtacaaccacggcgccatgactatttattgcttgccaccgattatccttatttgaccagtgaattgctgctaactttggcccagcagccgcgtagctatcttgcaactacagcgcaagcacattacgctttggcccatttttacactgatcatgctaccgtacgtcaatttttagccagtggccaacgccgcttgcaaacttttatcgttaacgtggcccaatgccagcccgtaatggtcgccgctgatctggcgttacagaatttaaattataggaagtgaacccatgctacaaaaaaacgagatgtccgacgctgatttccaaaaattattaaagattgccttaatggatctacggattcaccggacactgttagaaaatgaaattgctgaccaacgtgctgatctgcgcacactagaacaagatgaagcgatcgagaacctagaacagcaaattcggccgattcgtgaagattacgatcactataaacaatttttaacagaagatatttaacataatttataaatttaaccgttttttttagacatatatgtaattaaaatctaattctagcgtaaaatcatgaccagactatgctatactcagagaggagtgacattgattatgggtgacgagaagatcgccaaaaatatcgcttaccatgatttagtccagttgatctatcaacaagaggacttcgagtttgttggcgttgctttacaagataataccagctggcgtaaaattcattggcgctatgcagctggcaataccagccagcgtttccgcaaaattatcttgcgtagcggaattgggattgctggtttagtgatccgcacaggtgagccctttgcagaaaatgacctagcacaccatcaatatgcgggttacatgtcgcagccgatcacgatgatcgagcacttaaccagtgcggtggcgatacctatttttgatcaagatcagcttattatcggcgttttactcgctggttatcgacaccaacaaaaagtcactgctcactccggtcacgtgttgcaggaatatttacagcgattccagtaaatcacgattcatcacgtgacaaggattttcttgtcactttttttattactgtataaccaaaaaacttaccttttaagctaatacttggctattctattcatatacacggcataattgttcgcaatctaatgaaccacaacctgtataagttaaaagtagctgtaagcgcttctacaatctgttattattatatttgttaagttgccgtaaacttaataaagtttatccataaaagtaggtgaatcacatgttagaatctgtcagttgggtcgaaaaaaatttcaatgaaacgccagatgcgattttcatttttcgtgatgatcaactgctagttagcaatcatgccgcgcaaacgctgcaagctgactacgcgctgagcaccgcttatattactaagttaatgaacagtgtcgtcaaacaacaaaagtcacgcaccaatgattgttttaactgtgtcgttttggatatggcgaagacggcaattccgttcactttaccagtcaaaggtgcgcactcgctctcctttttcctggtttattctgaattagatgccgcacaaaatgtttattcactaactttgaagagtagcgacttaatgcaacgtgtcgatcaattggcacaacagcgtaaactcgttcaatacgtcaatcgcgcccacgaagaggaacgtaaacgattgtcacaggatctgcatgacagcatcgcgcaaggggtctattcatcgatcatgggcgtacgccatctggaatcaaccgtgaataatgccgattcagaggcttttgctcgccaaactaaattgatcgaaagtcagctttacgccaccttgcaagaaatcaaagggatggcactagatattcggccatcagtgttagatagttttgggctgacggctgcattgaaagcattagctaaacgtttagaggaaaataccggcattgatattatcgtggttacccgggatgcagaagagctgaaattatccgaggatgtccaaactgtactctatcgcatcgcgcaagaagcgatgaccaacgcgatcaaacacgcggaggccaacgaaatcaacttatttttagtggcgcatgaacacgagatcagtttagagatcattgatgatggtactggcttcgatgttaaacaacacgttagttttaatggtcactcactggggctgatcaatatgaacgagcgcgtcaagtcattgcatggtactttccaaatcaagtcggagccaggcagcgggactacggttaccgccaccttcccgatcgcttaagtgatatttgcaaaatactgctaagttagtttttactatttacttagtgtaaacgtgattgaaaaagcattgtcactcgtttttggttgaactagagggagccgttttggcggtgcaaaaagcgacaggtagttgcaaagttcgtagggcaaaccattttgattattgtcaaaagctgcccggttccaatcgcagatcattccataagctaagcactttttcaacacactctaatactatagacagggagggaccgcgcttgtataaagtcttgattgccgatgaccacgccatcgtgcgcagcggcctgtcattcctcattaatcagcaacctaattttcacgttgtggcgcaagcagccagcggtaacgaagcttattttgaagttgagcgcgctggtgtcgacttgatcgtccttgacttaaatatgccgcctggcgaaaatggtctgatcacgactaagcggatccatgaccgttttcctaaagtcggtatcgttattttatcgatgcacgaagaacaggattatatcgatcgtgccatgcaaaatggtgctgactcttacgtgctaaagagttcaccggatactgaattactcagtgctctgcaggcggtggctaatcaccggacgtacgtcgatcagaatattatcttaactaaaacagatgtcgccgagatcaattcgaacgataacgatgttaacttgaaaattgagggatatgcagacctttctagccgtgaacgcgaagttttaccattgattgcgttaggctattcaaataaagaaattgccaaaaaattatatatttcgatcaaaacggtcgaagcacataaagccagcattaaccgtaagcttggttttaaaaaccgggttgatctagttcattatgccttacaccatgggttgatcgacttttgaggtaaaaccctaatggtgttagtttcgtgaaattattatcataggagttattaactatatactgcggtatatagctttttatataaaggttgtgtttgaaaaatacgccaacattagtactcactgctgattcgacctaaacatagtcagctagtgcgtaaaatctagcacttttccaaacacactctaggttctggaggatatactttgaaagttttaggtatcttaggcgcacataaaaaggatggctttaccggtcaatatttagctgccatcgctaaagggttacccgcaaatattgactacgaattactttacttagctgaatacacgatcaagcccgacactggtcagccaaatccggttttagatcaattggagaaaaagctgcaagaaagtgatatctggatcatggcgacacccacttattggggcaccctttctggacttatgaaaaactttttagattgtatgcggccgcggatggtacgaatgacaaaaactgccgatacactaccggcgcagtttaaggacaaacattatttgtcactgacgacctgctttcaatcaagtctggaaaatttcttcgtcggtatcactgatgacacttttaaaacgatcgatcgtgcgctaaccggcgctggtttgatcaaagtcactgaaatcgtcggtactggtacttggggcaccaaacaacctgatcccgctaagttagcactttgtgaacattggggcgctaaattagccactaaacaaaagaaggacgacaacaccgtgaaacgatacatacaattattctgcatgatcgccgtaatggcacttataactatgggcttgcaacaattgatttttggcgtttttgccaccggtaagttttggatgacttacgctacttttgtgattattttctacgtcttattggcaagtatcttacatttcttcacctttttacgccatcgcagacgctaaaagtagctttaaaacaccactaatgctaggctctgacctcaaaataatcactatagaaagtaggagtacttatggcccataatgttagccgcacagaagaattgatcggcattttaaccgatgtttccaaccatcgcttccggggagcccggagcatcaatcctgaatcaatgctttaccaaacaacttattatgccgtccaagaaaagttactagctgacgcttcagttgaagacccaactaacaaaccagtcgctagcattgatttacgcaacgccagtttgacacctgcaggtgaagaatttttggccgcgcataaaaattaacgattaagcagacactcacatcatgcacccacaaaggaatgagtagatggacattcaaaataaacttaacgcaaaatatgaaaatacaccgatttatacttccggcttttatgcagatccggaagaccctttgaaaaatcgatcaactctgctgacaactttaaaatcttttaccgaaaatcaggatgcagcgacaccatttgctttgcagatcatggccactaattctgagttgacgatcgcaccattagggttactcgacttacaggaattacgtgattacacggcaaaaaaacgccaaacagaaggcttaattgccggtgaggatacctttgagctgccattagtggtacaatttgaagcgcatactgaaaaggctagtgtcgagcgtgagttggtcaccaccaccgatgagctattcggcgacttcacccctgctttcgataaaatctgggcccaagttaagatctatttagcgaaaaatcaggctttattggaagaaatggtggctgatctgatcaccgacagtcaaaagatcgcaccaaaatttgttggtcaactgaccgaaatgtcagcggcagaacgtgaaaaaacgattggtttcaagttacctgatactgaattagaacaattcagtcgttatttatctgataatcatgaagtcaaagcagtaatttcctctgctgccgcctttgccacgcacgaaattgttggcgaacaactatttggtcaagccatgaatgatcgtattttacggaatacttttttctgggatcttgacaatacttttcatgaaattttctactatttcttacgtaaatacgcagcagctaattcaaaattagccaaacatctgaaccacatcaaaggtggcttgctttcaactatgcgcaaagacgcgtgggataaatctagcgagttggccactgatgccaaaacgactcaaaaagatctcgagcgcatgtttaccgctgttttcatgcctttgactgaacagttgactgccgagatcgccaaatttaatcactagaacaagaggtagcctatgacgcttcaaatttgggatgacttcccctacattcaagaaaaattaaccccgctgacgccttatttacttgaggcagcacggatcaaacagcctgccgtcaatgagcgggtgcaagccttgatccacaacgggggtaaattagtccgcgctgggctattttatttatttagcgaattcggtacgacacctgatcaagcacgactaaaagctggtgccgctgcaattgaattactccacttagccactttgatccacgacgacgtgatcgatcaagccgctgaacggcgccacaccgctactgtccagactagcgttggtaaccgcaacgccgtttacgcaggtgatctgctgttcaccttgtactttgatcaagtattgcgttcggcagaaacatttgctgatatcgatactaacgttaaagcgatgcacggtattttgaccggcgaacttgatcaatataatctcaattaccaactcaacgaaacggtcgaccaatatttacgcgagatcgaaggtaaaacggctaaactttttgcgctagcctgtgcgcaaggcgctaaattggctcacgccgatgagatcattgtggaaactggtgaacaaattggtcgctccttaggcttagcctaccagatcttagacgatattctagattacaccggcacccaagacagcatccgcaaaccgattttgcaggatattcaaaatggtatctataccttgccattattattcacattagaagcacaaccaacggcgacgcgggcatttctcagcaaaaaagctcgcctgacgacggctgaattacaagagttacaacaacttgtgatcgacagcggtggcgtcacccaggcgcagacgatggctaacgaattgactgatcaagctttgatcgatattcagaccctaccagattctcgtgcccgtaatgacttagaaaaattgacccggcgtttgttgaagcgccaaaaataaaagctgttcgcaaatttctgcgaacagctttttgattataggcgtttttcgccgtctaacttttgaatttctgtgatatcttgcgaaacctctaaacaaccgagataggtccccttcgtatcatgaaccgcaaaataacggatatagacttttttagtaccgtgtaaatcgatccagaaatcggcgtgatcttgcgcgccactacggaaatcatcaaggatcttctgcactttatccatgctcttaggtggatggcagttgaccaccgcacggccgatcaccgcgcgcgtccgggggaagatccgttcaccattgtcagagaaccaacgtacgatatcattggcatcaacaaaggtaacatctaccggtaaaacactgaataagccagttaattggtttaaatcaaggtccccagttggcatcacgatcgtggcgtgattgtcagcgccaatttctaaatgtgattccgtgatccgcggccgccgcttgctagccggcttagctgcttcatcagccaacatttgcttaacaaattctggcatttctttctccttcgcagccggttgtttgctgatattgacgttgatctgcgcacgcgcgtcttctttggctggctgctcggcttgaacttgacccatttcggcacgtaaatgcaatggcagggcattgattgccgccggatcatcttttttcgcctttaaatcatctggaatcactggtgccgcatctgattctggttcagcaatatgctgcttattggcgagatcctgttcgtcagccatcgactgcgccatcgcatttaattcttgcgccattttagatggcttgcgttttgctgcttcagcgtaatcccgctctgacggttgccatggtaacggctcagggatcaatgtgtagccaatatcagcactttcactttggatcaacgcccaatcatctggcgtaaatacttcggaaaccattggcaataaaatctgctcttccttgaagatcatttcttcaatatctttacgcgccttttcaatagcggcttcgatatcatatttgggtggtgttggctctgtgttgactaagcgcaaagcatccttgatccaaccacgaatatcatcatccacgccccacatcactttaggcggcgcagtaattccatagcgatccatgatcgggaaaatcagattttctttacgctgatagtgtttgtcgatcgtcaaaaggtcgcttaacgcagttttcatccgttgtaaataactttgatcttgcgctgagggcgttgcatcgttgctggactgctgccatttctttaaaactggcaataattcgtcatccaataatgacgtgatcacggtgttctccaatttgatcaccgcaactggatgtccggggacttcctcgacactatcgccggaaccaggattgatcgcacctttaaataccgcggcgtgcacattacatagtcgctggatttccatcggattcaaaccactgccgatcaattcacgttccgctgaagtgatctcggaaacatcgacactggaaaaggtgctatcgaagattcgtttagcttcgtcaaaactaccgccttcatggagcatctttaaaatttcaacgatttttttctgacgataaacgctattatgttcaatttccggcatcattgatcacctcaaatcctttagcttccagcttagcaacgatctgcgccaacggcacctttttcatcgctgcacctttggggatcgtcatgaagcgccccatcgtgttaagaattgccggatttttaatatcttttaaaccaatttcatataatacatcggccacttctgggtgtgccgttactaattcataaactgattgttgcagatcaagtgtcgccatgtgtcgatcccctttcaaaacggtggttaatttaacgtgtgccaaaaagcgcttcgactttatgtactggcattgacacaccacgcggtcaacaattactgccggaccgcgtctttcaaaattagctttattataacaggtaaccacggtaatgagaacgattctcaataaaaattagggtcagcccttagaaaaacgtggcgaatcgttccacacagacgaacactgccagtcgtggtaacattaaattattatctggcaaaatggagggagctacatgcacgaaattttattgtcaccagctgaattacgtttttccttgctgattctttatttttttgcttacgccttggtgggctggctatgggaaagtgcctacgtcagtgtgcgtaaaaagcatctgaccaattcaggctttttgattggcccaatcatcccagtttacggcttcagtatgctggctgtgctgctaatccttgaaccatttaaaaataacattggtctacttttcatcactggcgccctattgatcacgttgatcgaatacgtcaccagctggttgatggaaaaactttttcaagcacgctggtgggattacagcacgctaccactgaatctaaatggccgcgtggcgctaccgatctcgcttttttggggttttggtgtggtggtgatcgtcaagctagtccacccgtttgtcagccatattattttaggtttacctagtgtcacggcgatcgccactagcgtcgtattaactgatctgctaatgtttgacctgggctttacggttgccaacgtgattggttttggcgcggccacccaacggattggcaataccgtggaaacgttgaaagctgagctaaaaaatcaggttacaactgataccaagctaagcaggccacttgcttggtttgaaaatttccgtacgaatattaagttgatcgatcaacagcccaaactaaactacgtacaacgccgcttgcttcgggcattcccgaatattaaattcaaacgtaccaccacatcgccaaccgatataacgcgcattgttgatttcttacgcaaaaagcggcgctgagacgattttaaaacggagttgtgacataagtcatttatgcccaactccttctttgtgtttctgaacaatatagctaaaacgtgtgacatcagaatggtcactatcgctcgtttttatttgccaaaatcagctttgaagccccaaaactttttgcctttaaatgtttgctgctttaaagcgcccgtagcagtataggccttgccatacttgctggtggcattaaaggaaatcgtgtcgccttgtaacaatttgcgaatttcttccgcactaaacttatggccgccccaagttgaattgaattccaccgtctggccatcacgatactgtccttgtgttttaggcttagttttgtatttcttagtggtacgtactttggattgttggccgacagattgagccagctcttgactatttcttaagatcagcggtaaatcgtgggcgataactttggtggctgaattgaccacgaccgccggggcttcatttaatttaccaacagcatccatatgatcaaaaagctgcttcgtaatttgcggtgagccgatccaagtctcccgcactaaaatcgctgcgatcgtcccgggttgcgtcaaagtataaaaaccgcgcttttcgttgataaaggcgtttttgccgctggtcaactgcgcttggacactcaaccgcgtcgcaccagtaccaatattatgcttttccaaaaacttgccgatccaatcagcgctaggtcgcgttggtttgggattagcgccttggtacataaagggtgctgcctcagggccaactgtttgattagctagctggctttccggtacccctttttcagcatcatcaaagatcgccttgtagttcaattttacgggcacattgaaacccgttttaaatgccggatacaactgtaattcggcggtaatgcgatcgaattcgtaatcttcgcctaaaatagctaaatagttggcagctaacgttttgtaaatggcttgagcgctggggccatatttagctaattcagccaacgactgcggcaccttaacaccaggacggttagcaccatgggcggccgaactagcgcggtgcttgctgcgtaacgttcggtgagtcagcaattgtggatccacgccgatcacggcagcaatgcgatcggccacaggcaaaagttcattgtactgttcttgtgtgattttccgatcttccgtccgcggataggagacgatctccgcctcgtacattttctgataagtcgccaacacttccttagggttaaagccttgccgggctaaaagtgagcctaatttggctaaatcaagtaaagcgccgggcgcctgagttttatgtacccgtttaagcttggtcactggacttttggtatagcgggctacatctgcctggccgcttttttcatcagcaaagcgcgcagcttgtttttgtgcttcggttttaagttcacgagcaaaaatatgtcccgccggatccttaaacttagtttcaaaatacggcgttttgacgtaattatcaatcaattgttgttgctgccaaatttttaaaacgatcactgattttaagcggccttgattgatcaccttgacccgataaccggcctgccgtgcggcgtaggtcgagatccgcgtcaattgcatcgacaaaaaatcccacttgctgcgcgcatctgacttcagatattctccctgcttaaattgatccgtgatctcaaccatttgtcgtatggcttgatttaacgatttaggagtttcatcggcgaaacgaatgcgatacactggcccgtgccatttgatcgcattgatgatctcccagcccaataaatcgccttcacctgaaggatcattatccgtcgccattaaaatcgccttagcgttggctgcttctgctttaatggcagtcacatcagcgcgggtcgacttggactttttcgtgtaggcattataagctttcgcataggttttcgcccaggaaaaatcatcctgattccagggcatcgtctgcatatccgtccacgaactatagcgctgtttatctgcttctgtagttaccattttttcaggatctttaaattccattaagtgtccgtgagcgtgaacaattttatatgtcttcccgactacactgccagtcatcccaccaaacgctttggccatgtgcttagcagcgctggatttttcggctaaaattaacatatcgatcattgagttaccatcctttatatccactatgcgaacatattttctacttgattaattctatactatttaggccaaaaaaacaccaagctaggcgaatccgccttagcttggtgtaacgataaaataattattggacaatgtgcgagccaccacgaataaattcgcgatacaggacgaaccaacaaataaccgcaaatacggctaaaagccagaagccccacgtataactgcccgtcatttgttttaaactacctaataaaattggtgggaagtagccccccagaccgccgatggcaccaacaaagccagtaacggcaccggtgttacctttagagacgtacggcaccattttgaaaatgatcccgttacctaaaccagcgaccacaccaatcaatactaagccagtgacaaatggtccaatgccgctaagcgttaatcccatttcaatggcaaaaacgccaatgccgatcaaaacccattgtagcaactgcatcggccgtaaatgatcggacaacatcccaccgacgggacgaacaaaggtacacagcgcaccaaacgctgccgcccacatgccggcattaacggggttcatttggaacaaactatccaataatgttggcgttaaattactaaacgacataaacaagccgaaagtcagcgcataaaataaggataagtaccaagtattggcgtctttcgctactgctaaagaaccttttaacgttttagttttatcgactggcatttctttacaaagtacgatgaacaaaacgatcagtaccaacaataaaccgatcagcacgttataaaccatactgaagttccattttgcggcaatccgcggtaacgtcaatgcagagattgcattaccgatgttaccgagactagcgatccccaaaaccaaaccttggcgctctggtgggaaccaaaccgatacgtatgaaattccgacagcaaacgaggtcccactcattcctaataataaagcaacaaataatagcatgccaaatgaatgcacccgcggtactaagaacaatggaatcaaaacaaaaatcatcaaggcaatgtacacttttttaccaccataacgatcactgagaatccccactggaatccgcatgatcgatccgagtaataccggtgtagctaataataatgtccgttgtgacatggataagcccaatgtttcttgaatctgtgctgctaatggcgcaaaacttgaccaagccataaaacagcccaccatggccaaagtgcccatgatcaaagctattatcgcgctagacttggaacttgcttctttttgcatcgctctcaacctccaatttgactcatatgacgccatgtcggggctttgttgaccaccttatccgcatccgccatcgccatttcatggttaagcggcttattatctaaggctttttggatcaagcgttgaaattcctccttatccggaatagcttggcgaatattgatctcttcgtcccagtataggcaagcttttacataaccatctggtgtgatccgcaaacgattgcaggtctcacagaatttattactaatagggtggatcaaaccaaaactccctacagcgtccttgatttggaaattttccgacgggccattacccgttaactcaattggttcatactctagcccattttccgcacaaacatcgaatacactcttcaaaccaacgtattctttttgccatgtttttagcggattgccgatcggcatgaactcgatgaagcgaatatttacgttgtgtgtccgggtatagttcaaaaagtcgatgatctcatcatcattttgtcccttgatcaccacgacgtttaatttgatcataaaaccaagttcagcggcgacttcgatgcctttaagcacctgcttaatgttaccaccacgggtgatttttttgtaacgatccgcatcgaaggtgtctaaactaatatttagccgttgcaaacccgcttcctttaaggctgcagctttgcgcggtaaatacagtccattcgttgtagccgaaatatcgtcaatgccaggaatctcatgaacacggcggacaatatcgacaacatcactgcgtaacaaaggttccccgccagtaaaacgaactttagaaatacccatttcggaaaagttttctaccatttggacgatctcgtcttgcgatagaacacgctccgtcgggaaaaacggtagtccttcttttggcatacaatagacgcaacgcaacggacagcgatcagtgatcgagatccgaatataattatgcaagcgatcatagcggtcgtataattgtttcatgaaaagttcctcccataccctattatgctgccacgttaaacacgtgactatatctgactaatcaagcagagttcagcaaatatttctgaacactgttaatttaacctacatgtggttggaaaatcagtttttccaacccactctaaccaccactgactggtggaattaaggcaatctcagtaacctcgtcaggggcaaaacgctcctcactgacaaacgtttggttgatggcaaccaggcaatcggctaaaacagcggctgtttgtggaaattgttcctgcaaagcagccttgactgcagcggctgtgattggtgccgtaagtgacaattgaacttcagtttggccaatttgctcagctaaaatcgcgaataacttgacgttgaacatcattgcggacctccccagcgcactttgtcggtatcaaattctttcttccaaatcggcacttgcttcttcacagtatcgatcaggtactcacaccacttaaaggcttcaccgcgatgggctgctgccacaccaacaaaaacagcttcttcagttagcgctagatgacccactcggtgaacgatcaccacgttggcgcctttagcttcgatcgccacggctaacttagtcaattctttgatggccatttctgtataggcactgtattcaagcgactgcgtttccacatcatcggtccactgacgtaccgtacccacaaaggtcacgataccgccaaattgtggcgcttttaatttttcatacagcgcttgaacatctaatggttgcgctgcgatggcaacataatgcacggcgtttccctcacttctaccattccaaagaatgtgcgaattttatcatttgttgcctttagtatggcagacgcttacacgaatttaaattagtcaattccctaataagcgtgaaaaacgccacatgctataattgaaacgagtagataaagatattctgcaaattttttctaccatagaaggccggtggctcacattcaaaaaaaacatcaactcagcaatcggcaattgatcggcggtagtagtttattgttgctggtagtcgcgctggttgcgcttagcgttggccgctaccccttgtcagccacaacgatcacccgttttctattgcatccactgcatttggcaccggcgctaagtgccactgaccaacaaattattttcgaattaagattaccgcgcattattgccgcagcagtgatcggtgcggcgttggcaatttctgggaccgcctttcaagctatttttcataatccactagtttcaccggacttactaggcgtgtccaatggggctgccgctggtgccgcgttggcgattattttaggcgcacatacagccggtattcagtttagcgcctttatcgggggactattggcagtgactgcagcgatcacgatccagcgtttattacacacgcgcggtagtttgaccttagtgctagctgggattatcatcagcggttttatgcaagcaatcatcgggctattaaaatacgttgccgatcctgatcagcaactaccgagtattacttattggcaactaggcagtctggaaaaagtcaccttgaccaatcttggacttaatttaccgactttactcttagctggaatcgtgctttatgcgttacgctggcgtttgaatttactcagcttgaatccgctggaagccaccactttaggcgctaatttacgcttagaacaaggcatcgtcattttatgcgcaacgattttaactgccagtgcagtttgcctcagtggcacgatcggctggatcggcttagtcattccccatgccgcgcgtttagtatcaggccaaaacaatgccaaatccttgccgctcgctgctattttcggcgctattttcctattgttgttggacagtttagcacgcaccgtcagcgccggtgagattccgttaggtattctgactggtttcatcggtaccccactgttcgtctggcttttgctaaagaaacgagtgaccttatcatgactgaattaacagcgcagaatctcagttttgcttaccaagcgacgccactgtttagcgggatcaattttcaccttaaaagtggtcaaattcactgtatcttagggcctaacggtgtcggcaagtccacattgctcaactgcttagccggtgcttaccaaccgactgacggccagatcaagttggatcagcacgcactaacttcgcttacaccgactcagcgcgcccgtaaaatcgcctacgtgccgcaaatgagtagtgaacgtacgcctgtctcatttagtttacgcgactatgttttattaggccgcgcaccttatctcggtttgctcgctgctcccagcaaaaaagacattgccaaagctgatcagctgctggaccgttttggcctaagcgagcgcgctgataacagttattcggcggtcagcggtggccagcagcaactcgctagtattgtccgtgcgttgctgcaggaaccggcgttgatcatttttgatgagcccacctctgccttagatgtcgccaatcaagtgtgcgtactcaaattgattcgccaacttgctcacgctggttacggcattgttttgaccactcacgaccctaaccaagcgcttttacttaatgaccaagttagtactctagcgcaaaatggccagtggcacagcggtacagcagccgaacttttaaccagtgaccacctaagccaagtctaccaattaccattgcgtgttctggaactaccggacagccaccaaaaaacttgtatcgtcgatcaaaccacttttaccacgatttaaaaggaggattcttcgtgaaactttggaaaaaatgtgctctagttgctggtttactggtagcgactacgatcatggcaacacctagccaaactgccagtgcgcgtacggtaactgatctaaccggcaccaaagtcactttgccacaaaaagtgacccgtgttgccgacctctggcacgccaataatcaggttgttttattgttaaacggccagaaaaaattagttgctaccacggatacgatcaagcagatgccttggttcaccacggtgtacctggggatcaaaaatgtgactgcaccgctaagcggcagtgatctccaaacagaagaattactgaaacaaaaaccagatgtagtgctgactgcagatgccagccaagcggaacaagccaaaaaagccggtattcccgctgttaacctgatgtaccaagattttgccggcttaaaaaaatcggtcaaagtaaccgcgcaagtattaggcggtaacgcgccgaccatcgcccaaacgtacactaaggaactgaatggcaatattaattacgtggcgaaacatcttaaaaaaggcacgcaaaagcctaaggtcttgcacatcgtcaacgcccaagatctactgaaagttgacgggcgcgatacgatcgtcgatgaatggatcaaattaagtggcggtcaaaatgcgctaacgatcaaaggtaatatgaaagcagtgactgccgagcagatcattgcggctaatcccgatgtgatcatcgttggcagcaccactagcaaagcggcgctaaaaacattacgggcggattctcgttttgcaaatttaaaagctgtcaaagctggccgggtttatggtaacccgcaaggtacctttgcctgggatcgctatagtgctgaagaggccttacaagtcttatgggcggcgaaaaaattacatcccgctcaattcaaacaattaaacatggtccaaaaaacgcaacaattttacgaaaagtactatcactatgacttaagtaaagcggcagccaaacgtatcttggccggggaaaaaccagcttagtcaaacaaaaaagcacgctcagtgagcgtgcttttttagtggtacatacttatttaagactaatttcttgaacaacttcgccagcggtaactgatcgtgtttcaactgtggttaattcagctaccacatccatattcgtgatgaccacaataacggttgtttctttaccagcagctgtcactgctgctagatccatttttacaagtggttcacctgccgtaaccatttgaccctcactaacatttaatgagaatggtgcgccatttaattcaactgtgtccaatcccaaatgcaacattaattctagaccagtagatgtactgatcgttagcgcatgtttagttggaaaaatactttcaattttaccggttattggtgcaacgatttcaccagtatctggctgaactgcaaaaccatcgcccatcattttttgtgagaaaacatcgtcagctacttgttctaacggtatcagtttaccagttgctaacgcgtgtaattcatcttttggactacttttcttttttaaaaagttaaacatatcgaacctccacttagtcaaaatacttaccgatcacgtcatgtgagttgacgatcggtaaaatactagcatgataattagatgccacataagcataataaagtagatcaactgcatatagttgggccaacaaggaagttgtcgctgcactacgcgtattcatattttcttcgctatcatcatgcaatagcagtgttgtcgcaagtttagcgagtttacttttagccgcatgggttagcacgatcactggcacctgttgatctcgtgccaacttagctagattttgactatcttttttttgaccagaattagaaatgagtaccaaaaccgttggttgtgtttgtgcagttaaaccagctgctaataaatgtgtatctaatgattgaactactgatttacctactcggataaacttctgttgaaaatcctgtgccactacattcgaggcacctaaaccataaacaaaaattgttgcagctgcagttagttgttgcaccgcagtttgtactgatgcttcacttaagacctgattagtttgtgtgatcgtatgactgacccgcatagcaaacttatttttcacaacagccaaactatctccaggattgatctcgctataaagccgctcatcaatttccgtttccgctgaaagacgcaactttaatgctggaaaaccaccttccggacaaatattcttactaaagcgaatgatcgttgctgtactgacgccagctttttgcgcaaaagtcgccgtattcatttcaatcacactacgaggatgctttaaaatataagccgctacctttgactctgatggtgatagtttacttaattgactatgaatttcaaatagtatattttgcatacatgtcattccgtttcattttctaaattaaccttatcataacggaattagctatatgtcgctacctcattatgcttctttaggcaaagttgcttccttaggtacaccaaagaagtaagttgcgataaaaccaccaatgtaagccgccaataaacctgcaacatagcccaaccagtgaccgttattgatcagtggaatcaatgcaatacctgaaggaccgatagcaattgcaccaatattacctaaccaacctacaacagccccaccaataccaccaccgatacaagctgtaataaatggtcgacctagtggcaacgttaccccatagatcaatggttcgccaatacctaagaaaccaaccggtaacgcgcctttgatcaaattagttaattctttatttttacgacaacgaatccataaagctagagctgcaccaacttgtccagccccagccatcgctaaaatcggcagtaatggagttgcaccagttttattgatcatctcaatatgaattggtgtcaaaatttgatggagcccaaacataaccattggtaagaagaatagtccaagaatgaacccagaaaaagcaccgccaacttctaatacccaattgatgccaccaactagtgagtttgagattacccccgcaattggcatgactaagaaaattgtaaagacaccgactactaaaagtgagattgttggtgttacaataatatcgatcgaatccggaatgattttatgcagtcgtttttcaataatagctagaacccacactgcgaaaataacaccgatcacaccaccttggcctgctgtcaaagcttggccattaaagatattatgcaagggcgcttctggtgtgattccattcaacaatgtaacggcaccgatcacgccacctaaacctggcgttgccccaaactcattggcactattgataccgacatagatcactaaataagcaaagaccccgtttttaataacattaagcaccgctacaaaatcagtccagctcttaccaatatcaccggcaacaaggagattcgacattatcgccgcaatcccgccaattaacccggcaccaacaaatactggaatcagaggaataaaaatatttgaaattgattttagaattcgcttgatcggcgtttgtttttgtttagctttttgtgctgccttaacttctgctgcacgtgcttccactttttcacgatcagttaaacccgcctcaacaccagttgcttttgccgtcggaaaatcttcacctaagcccacgccgacctgttcaaccattgcggcggctaccttattcacggttcctggtcccacaacaacttgtaacgtatcttcttccacaacacccataacaccgtcaattgcctttaagccagccatatcaaccttcgacgtgtctttgatcgtcatccgcacacgagtcatacaatgaatcaacttggaaacattttctggtccaccaacattttgataaatctcacgcgcaagtcgcgttaccttatcttcagccataataataacctccctataaaactaaattgtttttccaacaaaaccattagcttgaagtaaacgttgctcagcctcgtgcttaggtaaatcagtcaataccataacgatcgctaacttcacattttgatcagcagcatagaacgcttgctcagcaacttctgccgaacattcagttgcttggcagataattcgtttagcacgggctaccaacttttcattagtcggcttaacatcgaccattaagtttttgtagactttaccgatgccgatcatggcggtagttgataacatgtttaggactaacttctgtgcggttcctgcctttaatctagttgaaccagttagaatttctggaccaacttctacttcgatcttaattgcagcgtgttgactaataaccgcatcacgattacaagccaagctgaccgtaccggcaccaattgactgagcgtaatctaagccaccgatcacatatggcgtacggccactcgcagcaataccaaccaccgtatctttagccgataggttgcgttcttttaaatcatcaatagccaacgtcaacgaatcttcagcgccttcaaccgcaactgtcatcgcctgcatgccaccagcaatcaaaccctgtaccatttctggttctgtaccaaatgtcggcacacattcggcagcatccaacacacccagacgtccgctagtgccagcgccaatataaaataatcgccccccttgttgaaaactacgaataatttgttgcacagcttgttcgatctcagtaagcgaatgcgcaatcttttgtggcaccgattgatcttcctgattcatatcacttaatatttggtgaatcgattcctcatctaaatgcattgtttttgtattccgtgtttctgttgctaaactttccaagttgaccatcactgttcctcctcatgaatattttccttaataaaacgaattgtttgtttaggtcgtactaaagctaacaaagtttgactatgagctgccacatggccaataacatttacgcgctgatctgcagttaaatttgtacgacaaatctgtagttcacccatataacgcccgtaccgctcattatcttgtgtaattgttcctaaacaacgttctacagtattatctgaatgaataacgcgagttccgagctgcacacgtccttcaatcaaacgcacaacttgtgccgcaatatcgggacgactgtgccaatcctgccgatacaaaaagtgatgtgttgtcgttatcggcaacacaagtgcctgttgctcaaagtaggcgctaatttgttgctgacccaaaactgataattcaggatcaccaatataaacattatccgtatgccatttttttaataaatctataatagctattaaaggatgacgttgtcgatcacattccaaagttggtaaaccagtatatattggtccacgtttacctgcatcaccagccacaaaagccattgtccgcaagccttgttgctgtagccattcatttttttcacttaaccaaatcgcacttaagccggtttcaggacgtggataataattatgccaagcttccaaattagaaaaatcagcttggaactgacgtaattgtactaattcatctacggtgatcgtgctggcatttaacatcactttagtttgctgcgatagttgagcaatctgccgcaatgaaaagccatcgtcgatgcgaagcccgatatttttaaatacagttgctgataataaatcatcatagcttaaatgtaatcgtccaagaccttgtagtgataaatcacacgttaattctagattcaatgttttacaccattgaactaagcgttgaaaacgtgtcattactaacttaggatcatcctctgggatatgtaatgacgtaaaaacacctgtaaaaacatgattttgcatagaagctaaatattgatactggttatcagttaattcctctgctaaatatactgaaaagcctaacataatctatccaccgccttgttaaccgttttcacaaaaataagtatagcctgtttgtaatttaattacaagcatataatttaaaaaaatactattattgtaatttaattacaataatagtattaaaaaaaggcattccgccttcttgttgttattaaataaagttcactattcaaaactcaggaacaaaaaacacataaactaaaatcaaacgccgcttactgtgttcggacaaattcatcgatcatatgcgcaatgacgagttgcccggcatcattgggatgcagactatcaatactatattgtgccgccataaccggatcggcaaagttcagccaacttcgatacaaacttaaatgcggcacactataagccgcagtcactgcggcgatagcttcctcgtaagcagcctgttgcaagcctaactgattcgtcgttgaaaaaaaatcatggccaatcttaacgtgggaaacaaagtaaaccgccatttgcggatgggcctgcagtacgcgacgcaataattgatctaacgcaccataaaaagtgatgttatcactattacctaactgacctagtggctgactcatcccaaaatcgttgatcccaccataaatcgttagtcgatcacaatcagcaggtatcaagcggcagctttgcgccattgatgcataatcagcgttgatcgttgcgccagaaaccgccagtaaactaacttggttaggctgccaccaatcttttaaccagtcgtggtaccactttttcactaattggttgctggggtcagtgatgctgtcgcccatggcacaataatgctggatcgttatcaacttaaagctcgtcttcggcgatttggtcgatcacagtttttgaaggaataaagaacaaggcgccagtgatcggtgtgctgaaatctaataaccgatcacttttggtaaacatgctggtcagcatgcgtttggtgatcgcccactcgcgggcatagccgataaaataggtcccggtgacaccttgatcagaatacggcacgttcatccgaacgattttgtgttcgacgccattttcattatcttgcgcaacaacattatgggcattctctgccttttcatcgtcagctaattccaaatcagaatatttccggcgaccgatggctttttcctgctcttcagttttcagtgctttccaagcctccatattatggatatatttttgggcaaaggcgtacgagccgttaatgaatttggaatcttcatcaccgatcagcgcatagtcagccccttcgaccgccgctggattttcagtgccatcgacaaacccgatgatcgcgcgaccttcaaaataacggaagccgtgggtttcatccagcacggtcgtagcagcctgaataaaactgctaaattgatccatcacttcatacgtgatcgcttcattatgcgcacggacatggaaaaacaagtcgccaccagttgcgggtgcggtatatttaggtccttcgatcgtagtgaattcttctagttcttgcggccgtggtgcctcagggaataaataagtccaggccggcgcactaaaaccaaaagtcacgctcaaacgaccatctggataacgaacattcatactattgatcactgactgcatattggcggctagatcctgcacagcggctaactcttgtacctgatcctctcgtttcaataacagggtttgaaaaataacactttcaccagcatctttatatacagcttgcgcatcgcgaacatcaattggcattaatagtccttctttcctataacggttatctatttagattgattctaatatagtcattatacgtgaagtcgctaattttgtaaaaacaattcgcttatacaacacaaatagacgtacctcagattggcacgcctatttcatttaccgccgttgcatgatcaacgccgcagtttcctcgactgagcgttcagtcgtatcgatcggcgtgatctgcaatttggtaaaaattgccgctgcgtaatcgagttccttttcgatcgaagcaacgtcagtataataattatcagcggttaaccctagcgccgccattcgtgtctgacgaaccttttgtagccgttgcggactgatcgtcaaaccgacaattttttccttaggcaattgatacaccgcttcatccagcggattatcgggtaataacggaatattagcgaccttcaagcgctgttccgctaaataaagactaacgggggttttggacgtccgcgacacgcctaggatcaatagatcagctttagccagcgtctgtaaattctgcccgtcatcatgcgccacggcaaaatccagcgccgccacttttttgaaataatcgccattgatcgtatgcagcctccccggctgcgctaatggcgcggtacccgtttgcgtcgtgagcacttgcattaatggcgacatatagtcgaccaactgcaactgatgctgcgcggcaaaatcagtcgcccaagtcgctaattttgcggtaacaaaagttgtcgcaaccaccgcttgttctgcgacagcatcctgcatgatcggcgctaattcatcgaccgttgtcacaaacggatacgtgcggatcgttggcttcagttgcggatactgcagcaatgtcgcctgcactacgcgctgtgccgtctccccaacggcatccgaaataatgtaaataatcacaacgccacttcctctacttcacttttaaggtagctaattagcaaagtgcgctaattaaccttgatgttacggacgatggccattcttgtggcagagacctcaccgcaagaaacatggctctacttcacttttaaggtagctaattagcaaagtgcgctaattaaccttgatgttacggacgatggccattcttgtggcaaagatcttaccgcaggaaacatggctctacttcacttttaaggtagctaattagcaaagtacgctaattaaccttgatgttacggacgatggccattcttgtggcaaagaccttgccgcaggaaacatggctctacttcacttttaaggtagttaattagcaaagtacgctaattaaccttgatgttacggacgatggccattcttgtggcaaaaaccttgccgcaagaaacatggctctacttcacttttaaggttaaatcaaagccgttcctgttcgaattttaagccttgctccacaaaataggccattaagcgtgttttggtgagcttgccgacaactttttgcgttccttcggctagcactggcagcgaatcaacctggtgctcctttaataaatagccggcgtcaaggatccgcacattgggtgtggtcgtgactacgtttggcatccgcgtcatgatcaatgaggcgtaattctgccgcagatcaccaccatttattgtgctgcgtagtaagtccttacgcgagatcacgcccagcagctgctgttgttcatccgctacatatagcgagcccacatcattcatgaacagattagtcactgcatcctgcaccgtggtcgtcggcttgatcaacactggcgccaacatgatcgtcgcaattggcgcttcatacaaggcctcaaatgacagattagccacctgttgacctgcgtaaaaatagcccacttttggtttggcatctagcatgcccgtcattgttaaaattgatagatcattacgcaatgttggccgcgttaaattcaggtgagcggcaatctttgccccactgattggttgttcgcgttttacgatcgctataatttctcgttgtcgcttagtaaactccacggccagcgccatccttcatctcataattaagcttagcgtgtttgaaaaagtgctaagacacactttagtatagctgatttttagtgtgcctgcacggcaactttgctggcctgatagttgcgctgtaatgctgcttgagcgctagcgaggatcgcacttgggacgcggaagggcgaaacggatacgtaatcgataccgatttcagcaaaataacgaatcgatgctggatcgccaccgagttcaccacaaacaccgatcggcagcgagcggcgttcatagcggcctttatcgacagctattttcatcaatttacccacgccttcaacgtccaaggttttaaatgggtcagcctttaagataccttgatccaaatacgttggtaaaaagctaccgatatcatcacgtgaataaccgaatgttaattgcgtcaaatcgttggtgccaaaactgaagaagtcggcggcttgagccaattggtcggcgatcaggcatgcccgtggcatttcgatcatgatcccaatttgataatgcagcggggtgtgcgcagccgctaataaatcgttgattttcgccactaaacgcgctttgagccactgtaattcaggcaatgtatcgatcagcggtaacataatgtgtggcttaaccggcacgccttctttttttagccgtaacgccgcatgaatgatcgccgtgacttgcatttcgtaaatatcggggtacgttactgctaagcggcagccgcgatgacctaacatcggattagcttcatgtaaaacagccacccgttttgctaatgccgcaactggcatatccagtgctgctgccacccgcgccatttctttagcgtcgtgtggtaaaaactcatgcaatggtggatctaataggcggatcgtcaccgttttcccttgggccaagcgataaagttgatagaagtcctcggtctgcaattcttgtaactcagctaatggttccacacgatcaagcgccgtacccgcaatgatcaagcgccgcatcttcagtaaccggtctgttttaaaaaacatatgctccgtacgtgtcaagccgattcctttagcaccaaaattaagtgcttggacaaaatcattcggcgtgtccgcattggcgtaaacatctagttggcctgcttcctgcgcccaagacaataaaacctgtaaattttgatcttgcgtcgcttgtgtggcttctaggtgcccttgatagagctgtcccgaagcaccatcgactgataattcactgcctgctgggaaaacttttccgttgatcgtgacctgctgcttttcttgatcgaccaccaagttctcgcaaccgacgacgccgcacttacccatcccgcgggcaacaacggctgcatgagaagtcatgcctccacgcgaagtcacgattgcttcactgacgaccatcccttcaatatcttctggtgacgtatcttgccgaactaaaatgacctgttcaccagcttcatgtgccgctttagcactagacgccgtgaaataaatcttgccactggccgcgccaggactagcgggtaagcccttagtcaacggagtgtgtgcagctaacgttgcagcggcaaattcaggatgcaataaattgctgacctgttccggatcgattcgaagcaaagcagcgttgcgctcgatcaaaccttcgttaacttgatccactgcaatcttaactgccgctttggccgtccgtttaccattacgagtctgtaagaaatataacttgccgtgttccaaggtaaattccacatcctgcatatcgcggtaatgcttttccaatttcgcaacagcggtcaaaaattgttgataggcttgcggcgccattttttccatcgctggtaacccttgcggcgtgcgcacaccagaaacgacatcttcaccctgtgcattttgtaagaattcaccaaaaattttcttctccccagtaactggatcacgggtaaaggctacgccagtaccactgtcagcaccactattgccgaaaaccatcgcttgcacattgaccgcagtaccgatcgtgttatcgatatgatgcagttcgcgataaacttgcgcccgtggattttgccacgaggtgaagacggccgctaccgctaattctagctgttcttgcggtgattgtgggaacgtcccatggccagattctaagtacagatcctgaaatctagcagcgatcgcctttagatcaccagcggtcaaatccagatcattgtggtagccgttgcgccgcttataactagttaatacgctttcaaaagtttgttccggcatcccataaaccacgttaccaaacatttgtaataaccgccggtagcagtcccaagcaaagcgttcattatgtgtttgttccgccaaaccgagcaccgtttgatcatttaagccgagatttaaaatggtatccatcatccctggcatcgagatcgccgcaccactgcggaccgaaaccaataacggtgtctgcattgaatcgaactttttatcagtgagtgcttctaaacgcgttaatgcttgcgctatttcagcacgtaattcatcagatagttgattttgatttttttcgtaatcgtgacatgcaactgtcgaaatggtaaagccctgcggcactggcagacctaagtgcgtcatttctgctaaattagcacccttaccgccaaggagtgcgcgcatatcccgtcgaccttcattgaagaaatagatttgttgcatactgatagccacctttttattttattagtacgttattaaatatatatgacatactaataaaatgcaagccttttctattttaaaaaattaacgccgcccctgaagttgtcgttgtcgaatttttgttttaaactgaagagtggctgaaatcgcagtaaaaaatagccgcacctatttgcctaaccagccgagaaacaaaaaacggaggcccttcatggaaccttatttcaacaaaatgacacaaaacggttatgaccaaatcgccgccgaaatcgcgcaattacaacaggaaaagccacagcggatcaaagttttacaagcggcccgcgcattaggcgatctctcggaaaatgcggaatacagctcggctaaacgcgacctacgccatttggaaagccgcctgcgctatttgaataaacaattacaatacgcgcagatcatcgcgcctaaaactgatggtaccgtcgacatcggcaacacagtcacgctggaatttcttgatgaccacgatcaagtcacttatcagctagtggggaaagaagaagtcgatgtgactgccggtaaaatttccaccgcctcaccgctaggccaagcgttacgcggtcaaaaagcgaatgtggtgatcacggtcacagccccggaggcaacttatcaagttaaaattttgacggtcgcctaaatttgatctaacatcattcatccgcgacataatgtcgtgctaaactgacgaaacatcatttcaaactgacgaaacatcactttagactgacgaaagatcacctgcaactgacaaaacatcactttagactgatgtttcgtcagttacgccttaataaaataactagctgcattaaaaaaattcctgctataaacgttgataactcaatgtttcataacagaaatttattttttttgaaaaagagcgagacaaaagcgcctgctcaaacgtatatataagtgaagtataaaataaatgattgttttaaaaccctattatttaaaaaaataaccaatggctaaactaattttgtgcaatgatctaattggtgttaagctagaccgcacttttaaatcaacttattccgataccaacgaccgccatgaaagcgcagctggaatacgatcgcgcggatcgcccactcggaggacatcacaacgaagatcccgaaaataccgtaaccgagcacgatcccaattaagtagccaaaaccgatgcggaagctccacattgagatcagtgaaactaccgtcgtaaatctggcgtcgccagcagctcgtaacgcggacggcaacacgaagctggaactccaaaatagcgcgtgcatcacgatcaccactagataaatatgaaaaatgatcggaatcgtggctggcgctggcgcaaatagccgcatcccgatcgaaaagaacggtaataagcccagatcgactgctaaaaaggccagcgtacctaaaccaagaaacgatttggtcagttttttagcatcaccgatattgttgcggccgatgcactgcccaacgatcggtaccaacgccacactcagcgcattaggaatgatctccgacaattggatccatgagctagcgatcgcgttagcggcgatcatcgccgtacctagtgtcacgatcatcatctgcataatgatcttgcccccgttaaagaaagttgattccgcggcgaacggtacactgacttttaaaacccgtttggtcaggccccaatcaacgtgacgtagcgttttaaagtttaggccaaagtgcgcccgattgcggtataacgtccaaatcgccaataccgcaatgctgtagcgggagatatttaacgacaaagtcaaaccgaatacccccaagtgcatgaacgtcacaaataaaaaattgaacagcaagtagatcgtgttcatcaacaatgacaactgcagggaaactttagtgcggccaataccacgcaaacagccgttgaccccttcaatggttgattcaccaacataactaaataaaataccaatcatgtagatccgtgcaccgtgaataaccgccggcgatgcagcaccgaatagcaacgccaaaattgggctatgtagcaacatgaataaaatcgccgccgtggtcgccactagtacagttgcgtagacaccaccgttgaccattttaccgatcattttataatttttctgaccataatattgggcaatcagcactgtgccgccaagggcgatcgaggtaaataattgcaccaataaaacgttcaagctgccgacgatattaacggcactgatcgccgccgcgccggatgaactgatcatcgccgtgttgatgaagttaaagccgatcaggaaaaattgatcgaccaccaccggcaatagcaacgaaaacacgtcacgataggacatgccttcaccggaaaagaatcgtgccaaaatatctttaaatttagttttaatgctggttatcaatggtgcatccccttactcacactttaccgcacagccaatttttcaacctaatcattactatagttgaacgtcagcgaaaaaaatagcgccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 585 - DNA, 18957 bp, Unknown
  Metagenome-assembled genome
ccatcattgatgaactcttcgatcaatttatccgaacactgcccaataatctggcccaattattgggcaatggcgtgtaataactgaattaactaatttttagtcttcaaactcaggactagcaggagtttgaagttatttgggtactttcaacctttagttcctaatatatcgaatctggtgggaaaacaacttgataagtatcaagtaatacaaaaaaccgcgcaaccttgcgcggtggtgaaaatgatcaataactaatcgggcatgatcaaggctgcaattgcgtagagaacgaccattgggaaacctacagtcacaacggccagaactgcgaaaataattcttaatacggtagcatcgatcccatagcgctcagcaaagccgccaagtacgccagcaaccatccggttagtcgctgatttgtgtaatctttccataattagcctcctctgcttgacaagcaagatgcaaatgcaaaaactagcacatgcctgccgtctaactttacttgataagtttattataaagccggttgcacttgccaacatcatgcttccgaccgagtttcatcttgcgctgcgggctgaaattttagcaaaaaagatttacctgtgctgaatttaatggtaaatttgaaacgaggactgcttatcctcacttcttaagatgatgtgcctgctacttgctagtgggcattttttatacttttttgctgaaaagttgaccctaattagactataatagaattgttaccacattacgaaagcgggggaagtattatgttacaagaatatcgcaacattttagtgcccatggatggctccgacgaagcggaattagctttagagaaagcagtttctgttgccaagcggaatcaagctcacattgacttattaaatattctcgataccaagcagtacagctataattattctggcttgatcgatggcgatgtaatttataagatgtctgaagatgcacaacaatatttggaagacaccgttaaaaaagttaaggaaacagataactttgacgatatcgcaatccatgtacgttttggtagtcccaaaacagttatcgcacaagattttccagcagaacatcataatgatctgatcatgattggtaccactggtttaaacgcggtggagcgtgtgttagtcggttcagtaaccgaatacgttaaccggcatgcgttacctgatgttttagtggttaaaactaagctagataaccatacagcgttagaaaaataaatcgattgtagcaaaaaagcaagcagcggcgttatgtacgtcagctacttgcttttattttatcgtcattctagtttcgtcgaatactcgactcgattacgccgaaaacgtaagagatgatcgcgacaacaatactgactagcagtaaagttgcaaccacgcttactagcgtcaacgcccagggcaactgcaaggttgccaaaattccgagcaagacgactaaacaaacgcaggccgcaaatgcaatcttccattttgtcttcatcaattaagccacctttgcttttttaacaggtcgttttcgtgaatagtaaaaacaagagctatcttagcatattcggcgcttgcttgcaaaattgccctcattttccccacagaaacgcgatcaaagcaccgtcaacgacaggattattttgatgtaaccgactgtgctcagcgttaggcccagtgactttctgcgtttgatagctggcggcgcgcttggcaactaaataacggagcgaggtggctgatactaaagtaaccaccttatctgaatcagtaccatccttgaggtcaccataaatattcagaaccttggcttgccgcggaaaattttgccgtaagtgttctaatcgcaaatattcagaatgcacgatcaacggttccccgtttgccatcaagtggttttcatggaaacggtcagtccaagtcgtgccatcagcgggatgtgtggctgacttttgaccagcaatcccatcaaatgggcctgcgatcgcaactaatttattcaagcgcggataagcagcctgattacccaccttcaatgcataggcgaccacagcgtaagcgcccatcgagtgtcccaccagattcacttgtgcgacttggtaacgttgctttaaatcgcgcattaatttgatcaaccaacgcgtatactgtacttcgccagcgcgattattgctgaagatcacctgaataattggattacgttgatttttgcgccaataaccactatagatcagcttgccctgcggcgtaactgtcactgttaaaactttcttagccgcacccgcttcttctgcagcactgatcatttgatccgttgaatgggcagttccccgccacccatgcacaaaaagggttggcgtatgcgcactcaaatagcgcatgttttgttgctgtcgctgataccacgttaatagtagcgcggctaaacaaaacgtgccaaataaaccgatcacccataaccgccacttcttcatcgcttgatcacacctgttcataaatatttcgcagttgttgcatttggcttgagcgataggttattgcaagcgcggtgttaaccagaacaagcgctgtcgactctcttttaaccgctcaaatgataccatcaccattattggtatcataagccccgctattgctaaaagtaaccatgacccgccggccaagcgttcaaaaatagcgaaaactaatttatgcagatacatgatgatcatcgtatgtttaccgacaaaagtcagcccattaacaaaaggtgtaaattgcagccaataagctaacataaaaatggcactgcacaaaattaacggtaagatcagcgccaatgattgactcgtgatctcatgggatttcatgtacaagtgtagatcgatcacaccgagttgttgggccatgatcccagcgctacttaacgcaacaatcacactcagccaccaattggaacgcagtcgctgccgctgatagcggaacaactcgcgaccagcgtacatataaaatagcgcacacagtgtgacatccgcatccccaggcaaagcaaagccgaataaatcaccggcattagagtacgccgtgcccactaaaaaagcaactgtaatgatcagccaacgcaaccaattttgcggtacaaaggagatgatcacagtcaacaacgtgaccgccagcaggtaaaccgtcatgtaccaaaaagcgcttagcacaccatttagatgcgtaccaccatatagcaagtcgcttagaccttgcgccaagccctgccacttttctggtgtgacccaagcactgactaaagtcagaaacaaaccaaagccaaaatactcacgtagcagcggaactaatttatgctgagcaaaggttttgaactgtcccacttgcaatggtcggagaaaaaaaccaccgatcatgaaaaacagtggcatgtgccaccaatataaaacgttataaaaagtatcgtgttcgggatatgcatgtccaacaactacagcaataattccgattgctttggcaatatcgatccatgcaatccggcgtttcccgctcattaaaataactcctcccttatgcacaacagacaatctatttaaaaagataggttaaattagttttttagttattttccattgtagtccctaaatttgaatgaagtatgaaaaaaataccgtaattttcagagaattatcattgcgccgtgactgatatttccaaaaaagtaattgacattctttaattcaaccgataaactaataataattaaaaataaatgaaaataaaatgtgaattcaattaaggagtcggcgttaggtaatgttgccagaaagtatcgctgctgagaagataccttacctaatgccaaaagtcgttgaacatgcagtctttatgaggagtgctggttagctgccaatatcaagcataagcgtttttaataaacgcttactgagcaatatcatgtaagtgatgttgaatgatacaggtggtaccgcgctagtcgccctggagagtttaaactctctagggcttttttcatttaaaattaatctaattaacagagaggaagattattatgcattatggaattattggtgccggtgcaatgggctatcgatttggggtattattacaagaaaacgcaggggtcaaagttgattttatcgatacttggcaaccaaacgtggaaaaagtacgtgaacaaggtggtgtctatgccgcccgcaaccacgagaatcgtcatttagttccaattgatattttttatccagaggaatacaaaggccaacctgacgcctggatcatcttcgttaaacagatgcaattagctgacgtgttaaaacgttgtgcccctctcttcaatgaccaacagatcgccttttcagcaatgaacggtatgggccatattgataaaattcgccagtacttcgctgatgacaaaataatcggtggcacagctatgatcgccactgttttaaacggccctggtgatgttgactttattggtgaagctggtgctggtgaaatgcatatggctaactataccgaagagatcaatccgcagatcaaggccgttgaagcggactttaaagccgctaacttaaatccgatcgtcactgacaactttatgggtactctaatggccaaagtcgttttcaatgccgttgttaatacattatgcacgatgttcgaactgaccatgggccaattcatcgaataccctggcgccaaagaaatggccactcagttgatgaatgaatcctatgacgcctgtgaacgtgccggcattcaaatgatttccacccgccaagaagagatcgattccgtggattacgttagtcgcataggcaatccattgcattacccatcgatgtaccaggatttctctaaagggcggcccactgaagttgattacatcaacggttacatcgctaaattaggtcgtgaacatgattatgtttgccgcacccacgaattcattactcatgaagttcatttagccgaaatgatgcgtaaatacaaaaaataatttccctgcataagtaaaagtccacgacgtaaaatatcgtggactttttgttgtattttcttctatttaatcattcatctagtttagccgtcgctttagctggcacgtcacccttggtaacatcttgccaactgatcacacctttttgacggctgacctttaattgcagatatgcattgcttttcaacggccgttctttgttgccattaaaatcaacggttcgtttatcaccggctttattgtaagcgggtaatttatactgataatcaatatatttatcaccattatctgcggtgcgcacctggcgttcacctttagttgtaattttagtgtaataactctgaccaccgtattcatactggtaccagccaaagcctaatccaacaacgatcaacgccactaaggcatagatccatttacgcatattcgcttacctccaacactttttcattagtatacgaatttacagactgaattaccagtgacagttttgtaagctcagcgctctgaccacgcgactttcagcatgctggcagtacctagacctaggcctaacaaagccccaagcgccaagagtagccagaaaagccagcctaacgcacggtcagcataacgactttcagctaaaaccccgagcattgcaccgaccaccgttccaatcaataagcggctactgaagacgagccaaagtaatttatacgtcacctgctctaactgcgcataataagtttgccactggcgataatcaggattgactaccaaaggattttccggtgcatcgaccataaaaaccgtttccgcttgcgccaatgcatcggcttcatccattcccgcggccgtccgtgcttgaatataatcgatcatatagccggccaattcatcggcttcgaccaaatgggttttcggcgtgaaacgtaaaattccgtgataatgaatatcgcggccgacgcgtgcacctaattgttcaaaataagtccgttcatttttgactaaccgcaaacgcgtttgcgcccgcgcgaaacgttgtaattctgactgtgtcgttttactgatcgccattttacccctccgtatcgttttatcctactttattaaagtgttcttgttctattatttttactactaatttgaccgcaagatagaagattacgttactttgcctctggtgcgtccgtttggtacagatcagcagtggaatgatcatgattttgcgaatacaagctagttgacttttgacctaaggtttcacgcagttgggccagcttagtgaagccatccgtataattataattctgtggttgcaccggtttaaagccctttggcgtgtaaaagcgcaataaattaccgttattcaatttatccgataagcgcaatgccgttgtcactctattctgattgtcatcgacctgcgtttgttgcgttttagtcagcttagtcaattcagtcccagttttttgatcataaacattccccgccgccttagtgtactgcggactgacccaatcgccatcgcggaacgccaccacttgatcatgctgcgacgaaaaaacgtccgttccaaattgcagataacgcttagtcttgattcctaacaaatgctcgattgttggcaaaacatcgacttcaccagcgtattgctgctgaacactaccagttttcaccccaggaatgtggatcataaacggaacccgctgcatttgtgcatcatcgtatgccgtccaatcatcagcggacttccctagcaaaggtgccaagtccagattacgcgtattagaaataccgtaatgatcaccgtataacacgatgatcgacttatcatataaaccggaggccttcaaataagcaaagaattcttcaactgattgatctagataatgcgccgattgaaaataattattgaccgagctgtcagcggtatccgccttaggaaagtcagtatcttcgctgtccatttcaaatggaaaatgattagtaacggtaataaattttgcataaaatggctgctgcatttgttccaaatatttgactgagtctttgaacagcagtttatccttcaagccataaccaatactgcgatcgccagccgcatcaaaatagctcttatcaaagaagttttggtagcccatattcttatacacattattacgattccaaaaactagccacatcaccatgaaaaactgccgatgagtagccttgcgtttgctgtaagatcgctggtgccgcttgaaacgtattatcgctgcctaattgggaaaatagcgagccttccggcaagccataagtactggtctccaacaaattctccgcatcgctagttttcccctgcccgacttgatggaaaaaattagcaaaggcataggtttgtttgtcatgatagagactattcaaaaacggggtaacttctttgccatcaattttatcatcgatcaaaaattgttcaaaactctctaaatggatcacgatcacgtttctacctttcgccaagccaaacatttgcggatcagctgcagcgtagtgctgcttaatatactgctgcacactagccagatccgaagtactagctgatgcgcgcacctgatcattgcgggcagttttgaaggcatcattgatcgtataagcatcgatgcctaagtacttaacaatataattacgatcaaacgtccgtgtcaacaactgtggccgatcgatttcacctaaagtcagattaaacgcaaataaaacgacgcccaacgaagtcagcgcccaaggtaaccgacgcggtagtggctttttatcaaccttgatcaagcgcgccaaaagcaaaactagtaacacaacgatatctagccaataaaacacgtcgtgacccttagttagcgccaacgaactaccactgatcccattagaaactttggaaaaaccggtgatcgtgttgatcgtcataaagtcggtaaattcacgataatagatcacattaaaatacagcagtgccgtgttggccgcgtgtaaaaccagcagagtcaggtacgaccaccacggttttttgatatacaaagcaatgccaaaaaaaataagcgtaatcgccaatggattgatgatcaaaatgaaatattggtaaatgccactgacgcctaatgaaaaatcaagcgtataagctaaaagtgtttttagccaaaacaaaatcacaacgaggccaaaaaagcctagccgactatttacacggtgcctgatcgctgttaacaaagcattcacactttctcgattaattgttttcaaggaaactaaattagttattcaagcttagtcaaagtcgaatttcgttgatttagcaagaacaaaatcacttgacaaaataaattttaccagtaaactaagctaagtgttcttaaaaaagcccctaaaaataggttctgaagcttttttgcttatcttatttcaactaatcgtgtctaaaaaggccgattgctttgcttagcgacgtaagttaaacacatcaatctaggttgcttattacctacttagcgttcaaaaatctaagcgcctttttaaacacgttctaatcaagcttcagtatatcaaattagtcggcctgaactgtggatgatccaagaatattacacttttttaaggagaattgattaatgatgaagcaacacaaactttgggctagcattaccttgttagccagccttttattgctcctcgttggttgcaccaccaaaccagctgccaagaatgatggcatcaccgttgttagctcattgaacttttatggtgaagttgccaaagcagtgctgggtgatcatggcacggtgacgtcgatcatcaccagcccgaatactgacccacacgattttgaaccgacgacaaaaacagcgcgcaccgttgctaaagcagatgtcgtgattgctaacggaatcggttacgatggttggatgcaaaaactgatcaatgctaatggtgacgacaatgtcaccaatatccgcgtcggcgaggatttaatgggcaagaaaaccggcgccaacgaacacctttggtataataaaaacacgatgccaaaattagcgcgccatttagctaaagtctacgccaagcacgatccaaagcacaaagcagcttaccagcgcaacgccgagaagtacattaagtcattgcaaccgatcaacactaaattaacgcaattaaaacaaaataaacaacagcaaaaagttgcagtcagcgaacctgttttcaattacgccttgtccgcactaggttatcaaattagtgatcaacattttgcgcgtgccattgaagaagggacagacccttcacctagcgacatcaaatcactacaaaatgcgatcaccaatcgtaaaattgcctttttcgttcaaaatagtcaatcaacagataaagtcatcgctaacttggttagtttggcacacaaacataatgtgcccgtcattaaagtaaccgaaacgatgccccatggtcttaattatcggcagtggatgttaaagcaatacgaacaattagctaagattcaggccgctgaacagtgagcaggatcaatcgtaaacgtggttgaaaaagcagattattgcgcataactatcataattaaagcctttaactaatttttagaactctaaagtttggttgaatcaagacagagctagttaggttccatacgccagccccggaatggcatctaaccagctctgcttacatctttaaatatgatatctacgcaacactagtactcaaaacctgagcgctttttcaacccactctcttataaaaaggaaggtcatcatgacgcaatcaccacttttagcagttgagcatctggcggtcaacttccctgaccatcaggtatttcaagacttgaatttcacactccagcgcggccgctttctgagtattgtcggcgaaaacggtgctggtaaaacaaccttgattcgaactttattgcagcaattaaaacctagtagcggtgcgattcgttttttcccagagcgtaaagccattcggatcggttatgtgccccaatttcgtaatttagatgaagaatacccattatcgattcgcgatttcgtcagccttaatcttagcgggatccatttaccgtggttatcacgcaaagagcgacaggccgttgacactgccattcgcagcaccaatttgacggccatcgctaagcggccgctgggtatggcttctggtggcgaaaagcagcgtgcttatttggcccaagccatagttgaacagccgaatcttttgattttagacgaatcgactgccagtctagataatatgatgaaatacgaacttttagatctcgtcaaagaatttaaccgcgaacaaaatttaacggttattttcgtgacccatgacctaccattagctaagcagtacgcagacgattatttattattacgccgtaaaggctatgaatacggcccaatcgctgagctaccagaagatgcgctgatcagcactgaacgtggaggtgatctgacaaatgcttagcctaccttttatgcaaaatgcctttttggcaagtacctttattgcaatcattagcggcatcattggcgtcttcgtgattgcccgtaatatgtcatttctgacccatactttatctgagatcggctttgccggtgctgccttcgggattttcgctggctggccaccgttaaatgggatgttattatttacgatgatcagttcggttattgttggtcaactcagcgtaaaggctgcccggcgcgaggcttcgatcagtgcgatctctagtctatttatcgggctcggtattttatttctctcgctagctaacaaaacgtcaagttacgcaaccaatattttgttcggtagcatcattggtatcagccgcgcaaacgtgatccaagtgatcgttttgtccgccgttgttttgttagtggtcttattcatctatcgcgatctaaaattcgattcgtttgaccacattggagcccgcgttaaaggcttatggaccaacgttttatcaattgcctttctcgtcctactcgcactatccgtcagtgttgccgcacaaatcgtcggctcgttgttgattttcgttttactaacgttgccggcagctagcgcgcgctactttgcccacacggtcagcagtatgatggctgtagctgttggcatgtcgttgatcggcgtttggggtggcctgtatctcggctacatcactaactggccggttaccttctttattgcctcgtttgaatgtttgttttatatcattgctttagggtataatcattggcggcaaggataatttaagcacgactaaatacaaattagacagcgttagctcatagctcacgcgggtctaattttttttagaattaattagcatgtgtaaaaagtgctcagacttggcgcacatttatctaggaggatctttttaatgagtaaacgacgggaactttggttattgattttactgggaacgttaagcgcgttcggaccactatcaatggacatgtacttaccagcactaccccagttacaacaacaactacacacgagcgcatcattaacacaattatcgatcaccacttgtttgatcggtttagcggtaggacaaatctttatcggtccatggagtgatcgtgttggtcgcaaattacccacgttgctaggaatggttggcttcaccgctgcatctttattagctggactagcaaccaacgtctggtggttaatttttctgcgtgcggtccaaggtgtggccggcgcggctggcttagtcacctcacgtgcgattgctactgacttattcagcgggaaaaaattgacccaattctacgctcttttaatgggagtcaacggtatttttcccgtgatcgccccaattattggtggctttgttctcacctttacgacttggcgtggtattttctatattctcgctgtagtcggaattatcttgctgatcagcgtttggttaggtttaccggagacccatccaaaccagactagcgcaccggaaaaaccactaagcattttacaaatgttactccgtgatcgtatttttatgggctacacgttggtaactggcctagtttctggtggtttatttgcctacatctccggctcttcctttatgctacaaaatattttcggcctttcatcgcagggttttagcttggtctacgctttaaacggtctcggcattgtcgtcatgtctcaactggctggttacttagccacacactttaatgagtatcgggtactacaaggtggcgtgattattgcattgatcggcgcactggcgctatttgccacactatttatcccgcataaccttgttttagtgttgattccactttttcttattgtttcaatggtcggtatcgtcagcacagtggccgcatcactggccatgcaacacgcccatgccaatgccggtagcggctcagcgttactagggctgacccaaaatataattggcggtatcctgtcaccatttgtcggtttaatggggcaaaattcttacttaccgatggccgttttgatcttattgtgtgaaattgctgcattagctgtttaccaacggcgcctcgcccgcctacgttattaattccgtaacgctaaatcaaaggacgattggccgggtaattttctgggtgccagcgatcactaaaccaaaatcttgctcggtcaatggctgcgacacccgcattccattttgcgccaagatcgtaaatggataatcaagttcgaccgccacttttaaataacggttgatcaaagttttacccattcgcccattgatatagatccgcaatcccggataacgggttaaaacattacgcactaaactttcagccttaaccgtgcgtaattgttgaatcgttaacgccaaggctacccgttcgcgaaaattacccagaaacgagcgtttttcgtctggctttaattgtggttgaccgaaaacatggctttttaaataatcttgaatatcgtctgccatttacaacatcccctctgaatagtgattgatttttgtggtttaatttgtgctgcagaaaccacggtacaatgattttgttctactgtcatgttacaataaagttgcgacaaatcaaccgaatgttggcgccgtcacaaattcacaaccaacattcaacactgacaatgtgcgtattgtacagcgttagtgtaaaggagacttgtatgatgaccaacaagaaacgtatttcccaataattgaccataactcaagtcactatacctatggaggaaatatgcaagaaatcgaattaactaaagtattgatcggcggcgtcagccaaaaccaggcttattttgaaagcgatatggccgaattagccgaattagtcaaagccaaccagatgaccgtcgttggcgatattcggcaaaacctagagcgagcagttgcggctacctattttggtagcggtaagttagaagaaattcgccaattggctgaagaaaatgacgctcaagttttagtggtcaacgatgaattaagcccctcacagatccgtaatctcgagcatgaactgaaaatgactttgcttgatcgtactggcttgatcttagctatttttgccaatcgtgcacaaagtcgcgaagctaaaatgcaagtccaaatcgcgcgactacaatatgaattaccgcgcttgcgggttggtgaacaggctaacttgatgcaacaaggcggcggtcctggcttcgctaaccgtgggagtggtgaaacaaagctggaaatgaatcagcgcacgatcaaaaataaaatcagtcaattacgccacgaactaaaaaccatggaagtggcgcaacaaactaagcgcgcgcaacgtgaacgttccgcaattccgaccgttgccttagtcggctataccaatgccggtaagtccacgacgatgaatggtcttttacgacgttttaatgccgacgctgagaacgctaaaacagtttttgagcgtgatatgctgtttgcaacgctagacactagcgtgcgtgagatcacactgccagacaacaaaaagttcttactcagcgatacagtcggcttcattaataaactaccaacccaattggtcaaagccttccgttcaactttagcggaagcagcggcggcagatcttttagttcaagtgatcgacttctctgatccaaactatcaagaaatgatcaaagtaactgaaaagactttgcacacaatgggcatcgacgacatcccaatgatctatgcctataacaaggctgatcgtaaaaccgatactgcttttccactgcaaactggcgaacacgatctagtctattctgccactgatcaagcttcattggagttactgacgcagatgatcaccaaagagttatttgctgatctcactaaagttgctttcatgatcccctttgctgatggtaaatgggtcgactatttgaatgagcatgccaatattctggaacaggactacacggctagcggcacacagatcactgccgaagtcagcccagaagatcgtcaacgcttagctaaatatattattgaagtttaactgatttgcagctgttccttcgggagcagctgcttttttattttgctggcactaagaatcgattatacttaagttagcgagattctatagcgggaggggaccaatcatggcctggaaatactatttgctcatcctagcgttcgtcattgtcgttggcatcgaactctggttcagcgcacgtatcagccgctggtggttattcgcattgattccgacacttgcgattctctttatcaaaacacgccggcaaagctaatttgatcctcactttagaaatggaggccaagcctatgtttaatttaaaacgatatggtctgatcatccttattcttatcgctattggcttagttctttggttcttagcgcagctcaatccgtggttagtgattccttttgggattattttcatctttttcttcatccgcttgcgtatcttgcgttgaaaaaagcctccgctgatcctgcgcgggggcttagctattgatcacacgtcggtaccaacgttctaactgaaaagccagctgtcgtttagtctcacgcagttgattatagcgattctgcttcgtcggtgatctagtactttgcagccaaaatgttcgcaaccacggatctttagagcgcgttgttggcgtattatagtaaacgtccagcttgcggtggatgttgtcgttgcgctcagcataattaaatgagctacaattgatgatctgccccggatcagcttgtccgatatcagttaaatccagatacatgaaattacccgcttgatccaaaataaattccacatgaaagccataaacacgcttaatattccaaccaggcgttaggggcaaatttaattgccgatctaacttgttatgcagtcgtgctggttctggccggctcattggttgctgtgcatggtaacagtcaatatcaaaagccactagccgcgcccaatcatttttagccgttgggtaacgttggcgcaaataatgcacgttgatcagatctaaataatagcgcagttgatggaccattcgccgcaatgctagtgtcgcgtcaggtcctgcagctaaaccagccggaaaagcagtctgcacaatttgtgctaaaaccctaaaaaatgatgactgaggattcaacgagctggcaaacttattcgtaagttttagatcaccgtgaccatcaaaataagcacctaactgcctaaataactgttttagtaacgcttgacagtgctgtggcgttgcattgctgataaatgcttgctgtaactgttcagtataagccaacgaacctacttccatttcaatccctcaccttcgctagcacttgtattcagtatacgaactacagccaggttatgtcgattttgcgacatacagaccaaaaaagcatggcctctgaagatagaagccgtgctttttcattgaattattttgctaaattcaattcgggtgctgttttaccaaataaaacccggtagcgtacgctgatgccaactgaaacgatgaaacctaacgccgcaacgatcacatcaaccaacataatactgtgcatattggtttgtgctaacgcgccggtgatcaagggaatcgtaaacgatgccagtgcgccggcagtatagaaaataccggtgaccaaacctttgccgatcgggaaaaatttcgccattgtggtcaatcctagttgcataaccccaccagcggcaaagaagccaactgcaaagccaccgacactcaggacgactggcgtggggaattgccacatcgccatgatcgccaataacgccataaaggtgtagctaacttggatcgtcagcggtttaactaagcgattgaccatcactgccgttaaaatcacgctggcgatcgagccgatactgtagtagctcaacagcgcatgggcagctaaattacccatatttgccacggtcgcaccatatttagtcagccattgcgcaatcaaataaaaagttgccattgacaagtagccgtacatgacgaataaaataccatccaaataccattttgctggtgtcttttgcgccgcctgttcactggcactaagttgttggacttcagcctggctaggaaaatctgcgttccagagtaagatcacatttaataagatcaccgcgacgacgaatagcatcgaccagccataccataaatgaccaactgtcagcaacccaatgatcagcggaatgaaaagttcgcctagtgacatgaaggctttcagcatcaccgttgcggcgccatcacgctgtggaaatagatcgatcaacgtagggtaggtgccagtatccagacaagaattagccacgccagacaaaatactgaacgcaaaggcaatataaatattgggactgagcaaaatacctgcatagaaaaccacaaaggcacccataccgatcatcacgaatggtcggcgaccaaaacgatccgatagaaagccagaaagtaagtaaaccaataagcggccgacgcctaatgcagagatgacaaaagcaactcccgcagttgttgtgtgccaatgcaaacgtagtgcgtccatattttgcgctaaaataatttgactgatccccagcacaaagtaattcaaatataatcctaaaataaggcgtttagatttcatggataaccacttcctgacttaataattgttgaatttgttggctcacctgtaacggcgtccgcgcatccgtggtaaccgtgtgcgttgccacgaattgatacagtggcgcgcgccgctgccacagatcacgtaaccctgcttgacctaattgttggactagcggacggccatcgtcgccttttaagcggtcaaaaattgctgcaggacccgtttgtaaataaataacaggaatactggtttgttgcaataatttacggttagctgccgattcgactacgccaccgccagtcgataaaataccacttttagcaaaagcttgctgcaaaacttgggtttctaattgacgaaaagccgcttcaccggaatcagcgaaaatctgcttgatcgacttaccggctgctgccacgatctcagcgtctagatcaatttgtgggcgtctaaagttagccgctaacacctcacctactgttgttttgccggtgcccatgaagccgactaaaatgacatctaacataattacgccctccttaaaatattgatctgctgtgcagctaacagttgctgcgctttttgttgcgctgctgcgctggcaaacgtcagctgcaaaataccattcagctcttcacgcgtttccagtatctgaatattaacaatttgaatctctgcttgcgctaaaatcgttgtcacttcagcgatagcgcccgtgcgatcaggaatatcgacaaaaacatcgaagaatccagggatcgcacccgcctttttcggattgatcgcatcacgggttacctttgcttgaccaaaaaagtctaacaatgcagcttgatcacgctgcatcattgcctgctctaattcagtcagatcagcaatataatgatgtaaaatttgctgaatggactcggtattcgttagcagaatattggcccacatttgcggatccgaagaagcgatccgcgtcatatcacgaaagccccccgcagccaaccgtaaggccgttggcgaatcttgaaactggctagtggtctcattgactaaagttgccgccaacatatgtggtacatgactaagcatgccaacaatatggtcatgttcagctggcgcgacctgcaaaaatttagcgtttgtaccggctaataaacgttgcaaccgcgcgatttgtaacggggcagtattttgactcggtactaaaaagtagtacgcactacggaaaagatcaacgtttgcagcgtgcacaccagatttatgtgaacccgccattggatgaccaccaattacggtcaccccttgcgccactaaatcagccgccgcagccagcactgtttgtttagtactaccggtatcagtgacgatcacattgggttttaacgttacctgagttaattgttgtagtgatgccgcaatatttttcaccggtgtcgctaaaataatcacatcagcccgtggcgcgaccgccgctaagttagtgccgatctcatcgatcacaccattttgtttcgcgtagcgcaaactgtccaagttttgatccaaaccgatcaaataggcgtcagccacctcctgtttaagcgcaagcgcaagtgaaccaccaattaaccctaagccttcaataatcactgttgtcataactgacacctcccgatcggtttggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 586 - DNA, 49377 bp, Unknown
  Metagenome-assembled genome
aagtatcctttgattcggtcccactgagcatcttccagttcgtatcgtttaggtgttgtcatcggaatgcctcgattcgtttttcctcagattatacctgaatttttagttttcagacagtccctagttgatcaaaaatttattactatgtaattttttaaaactaacttttatgaatgcgcttttgatcggggttaggtattgttagccgattaatgttgacagtctctgtctgcaactataaaatgaatagtgtgtaaataatcaaataataaacatcttaaattttatacggttattaaaataatcgtttttgatgatgcggaggtgaagatatgagtctatttatcacgataatcctcgcagtcatcatgttagttgtcggtttaatcttaggctacgctgtgcgtaagtcaattcatgaaaaacagttggctatggcacacaataccgctgatagcatcatcgctgatgcaaaaaaagaagctgaaactcagaaaaaagaggcacttttagaagcaaaagatgaaaatcatcgttatcgggctgagattgaaaatgagttaaaagagcgacgtggcgaagttcaaaaacaagagaatcgcgtcctacaacgtgaagaaacacttgaccgcaaggatgatacgttggacaaaaaggaacgactcttagagaaacgagaaacaacgctaggtagcagacaacaactcattgatgagaagcagaaggaagtatcctcactgattgaacagcaacaagctgaattagagcgcgttgctgcgttatcccaagaagatgctcgcaatatgatcattgctcaaaccaagtctgatttagctgaggaacgagcagttatgatcaaggaaagcgaagcggatgctaaggaaacggcggatcgtaccgctaaaagtttgattgcctacgcgattcagcgtagtgctgcggattcagtatcggaaacgacagtctctgtcgttaacttaccaaatgatgatatgaaaggtcgcattattggccgcgaaggtcgtaatattcggaccttagagaccttaactgggatcgatttaattatcgacgacacaccagaagccgttattttaagcggctttgatcctgttcggcgcgaaattgcccggatggcactggagaagctgatccaagatggtcgaatccatccagcgcggatcgaagaaatggtggagaagtcacgcaaggaaatggatgagcgaatccggcagatcggtgaacaagcgatttttgatgtcggtattcataatatgcatcctgatttaatcaaaatattaggtcggcttcattttagaaccagctatggtcagaatgtgttgaaccattcgatcgaagttgccaaattagttggcgcattagctgcggaattaggtgaggatgttacattagcaaaacgcgcaggattattacacgatattggtaaggctttggatcatgaagttgctgggtcacacgtcgagatcggcgttgaaattgcccggaaatatcatgaaaatgaagttgttataaatgcaattgcatcacatcacggggacgttgaacctacttccgtcattgcagtattggtggcagctggggatgctatctcagccgcccgtccgggagcacgttccgagtccttagaaaactatattcatcgactggaaaagcttgaagcaatcaccaatgatttcaaaggggttaaaaccagttatgccattcaggcaggccgcgaagtacgggtcatggttaaaccagaagaaattaatgatttacaggcggtaacattggctcatgatattcgtaaacgaattgaagatgagttagaatatcctggtcacatcaaagtcaccgttattcgagaaacaagaacagttgaatatgctaaataattaaatgaaaacgggacgaagaaaattgactcaaatgacactgttttaatagtgctacgagttgtttcttcgtcccgtgttttagttcaacaagctagagtagtacagtagaaatttgtgtttccagtcggggatttgtataatacttaacataggggaaacaactgaaagagagttaaaaaaactatgtttagaataattgtcatgttcagtctgactatggtcctttctgccgttatcacaccatttgtacggcgcttagcaattaaaatgggcgcggtagataaaccgaatgcacgacgaatcaataaggcgcctatcccatcaatgggtggtttaggtctgtttattacctttacgttctcaacattcgtactactgcgagcgcaatttccaaccatgatgctatacagcatttttcttggtgaatgtattatcatcattaccggcattctggatgatatcttagaattaagaccacggcaaaagatgttaggtatactgctagctgcattggtcatttattttgtggcggatattcggatgacaaacgtttcgattccgtttgtaggccattttgagttaggtatatggagtctgcccattacgattatttggatcttggcgatcaccaatgcggtcaacttgattgatggcttggacgggcttgccactggtgtatcaatcattgctctgtttactatgggtgtgattgcgtggttcttcttgacggtgacagaagtcgatattccaattatgatctttgctttagtagcaactttgcttggcttcttaccacataattttcatccagctagtgtttttctcggcgatactggttctttatttattggttttatgatcgcagttttttcattagaaggattgaaaaacgtgacttttatctcggtcgtgatcccagtgatcattctcggggtaccaatcaccgataccgtatttgcaattttccggcgtttattaaaccataaaccaatttctcaagctgatcgccaccacttacatcatcgcttattggctatggggttgaatcagcgacaagcggtgctgacgatttatggtattgccttagttttttcactgattgcgttactatttcctttatccacacgactagggtcaatcttactagttattgctgttctgttcggtttagagatctttatcgaagagatcggcttagttggcagccattggcagccactgttgaattttattcgccggatagcaaaacaccactgatcaattatgatcggtggtgttttttaatggcgtttcaaaaaattgttgtgcgcctaactcaaaggttacttgaccgttgagcaattcaacaattgcgtctttaactgcaactaattcattattgtcgaccatagcggtaaacgtcacattggctaagtaactagtatctgcgatcgtgatcgcgtgttgagtcaggtaatgttctaacgcaccgatctgggggtagccaatggtaatggttaaagcttgttgtagtcggccttctactaaaccaattacgtcgatcgcttgagaaacggaattgctataagcacgaatcagaccaccagcgccgagtttagtgccaccaaaatagcgtgtggtgacggcgacaacgttttttaaatgttgtcggcgcagaacctctagcattggtacaccagcggttccggcgggttcgccatcatcgtgtgcgtgttgatgttcatcctgctcaccaataacgtaggcactacaattatgattggctttgtagtacttttttttacaggcagcgataaatgcttgtgcggcagcttcgttgtcgacgcgcgctaattggcaaatgaagcgtgattttttgatctcaatttcatgctcgccatcacttttgagcgtaatatagtgagtcaacaaacagaacacctcctaaatccatgaatagtgaatttttgttcctaagatttttgatatcgtgggtggttgtacaacggtaaataagtgttggacaaagtaagaacagcgaacatgctgtcagttacaacctactgcatcaaaaaagatacctttaaaaataaattgtatttttagcgtagtttatatatatggggtgatcaaaatcgaagttacagaactttatggtcggcaacaattagtgactacgaccgaactcgcttcacttaataatataccacacctagtacaacgtcccgccatgacctcgttaaatgcgaattggttactttgtgcgcgttgcggtagtcgccagctgaagcaacaagttcaattagccgatggccgttactattgccctgattgtttattgctgggtcgtgtttgtgcggatgcgtatttagtaagcttagcggaaccaaatcggtttattactcaagctgatccgttgacttggacaggacaattaacggctgcgcaacaggttgcagcagtcgcaatccaaaatcaattccagcaccggcaagatcatttattatgggcggtcactggtgctggcaaaaccgaaatgttgtttccagggattgcgtgggctttagtcaatcagttacgtgtgggcattgcttcgccacgagttgatgtttgtttggagttgatgccgcggttacaagctgcttttgcgcaaacgccgatcatgctactacatgggcgacaaacggcaacgtatcagtatacccaactagtgttgtgcacgacccatcaattattacgattctatcaagcttttgacattttgatcattgatgaagtcgatgcctttccctatgcgcagaatccgcaattggcgtacgctacccgacacgcagttaaaaaggatggcgcccgattatttttgacggcaacgccgagtccccaattattacgccaagtgcggcagaaaaagcttgaattaagttatttaccgcgccgctatcatgggcatccgttaccgcagcctaagattcgtttgtgttttaagtggcgacaacagttgcggcaacgacacctgccgaagttattacggcaactgttggtgactaaaattgcgcagcaacaacgtttcttactttttgtgccgcggatcgaactgttacggccattggcagaaattttacagcagcagttcccagaattaaaattcgcaacggtctacgcagctgatccacaacggttagaaaaggtccaacaaatgcggcagcaacaagtgttttgtttagtgacgacgactattttagagcgcggagttacttttccaggaattgatgtgattgttttaggtgcagatgatcctgttttctctgccgcagcgttggtacaaatggcgggccgtgtcggtcgttcagctgcacggccgacaggtgcggtcgatttcctatgtgcaggactaagtcgggctgtgaaggctgccagccagcaaatcaagcaagttaatcgaaaggcggggtttaaatgaactgtttgttatgtcagcaaccatttagtcagagtttaatgctggcagaattgctacattggcagccgttattaacggaaaagatttgttcgcgttgtcgtcaacgcttaatgccaatcacgacggcttgtcctgaatgcggtcgtacacaaaagacctctgagctttgtcgtgattgccaacgctggttagaaaaacagccgcggcaacaactccataatcacgcattgtttgtctataatgaattattgcaggacttctttaaacgatataaaagtctgggcgattatcggttgcggggcgcatttaccacagactgtcaacgctggttacgccagcatccggctgatctatatgttccgattcccactgatgcaactagttacgctaagcgcggctttaatcctgttgtgggactatataaagactgtgtaccgttaaccttttgcttaaaaaaacagccgcaaaaagtaaggcaagcgcataaaaaacggcgggcgcgtttgcgcacaccacagttattttattttgcgggtgaagcaactatattaaattataaaaaaattttattgttagatgatatctatacaactggccgaaccatgcgccacgcacaggcttgcctgaaaatagctgcgcctgattgccaagtgcacacgtttactttagcgcgttaactgaatatagatacgcttttgattgtcaattagaccgctttctattataattaaggcataagcaagggagcgaagcaaacccgtactcacgttttaaggtacctagcgtgtgggcttggttacagacgatcgctgtagccatcttgcttcacctatgtttaccagccatggtaaacttgcaagtgaaaggggagaagttctatgcttaattacaatgtccgtggagaaaatatcgaggtaaccgctgcgattcggagctacgttgaaaaacggttaggtaagttagaaaaatactttactaatactgccgagtccactgcacatgtcaacctcaaggtttatccagataagacagcgaaggttgaagttacgatcccattaccatacttaaccttacgtgcagaagaaacttcaccagatctatacgcgagtgttgacctcgtaacggataagctagaacgccagatccgtaagttcaaaaccaagatcaatcgtaaatcacgggaaaaaggtatccgtgactttgacttaacggtgccggctgctgatgccaacgatgatagtaaggaagaaaagctagacgttgtgcggactaagcgggtcaacctgaagccaatggatagtgaagaggccatcttacaaatggacatgctgggtcataacttcttcatttttgaagatgcagaaactaatggcacaagcattgtttacaagcggcgtgatggtcgttacggtttgattgaaactgatgaacaataaataaaccatttatttgcggctgaattatcttgtttaagatagttcagctttttttacgttaaggagtcaatgtgttaaagttgtttgcagagaattaaattaatgctaaacttgaagtaatgtttttataaaactgggacgataaagtggcccggagatcagggttactttttcagtgtacgtaagcttattttagaaattagatacgaagttgaagccacgttgtttcaacctccattgtcgacatttgacaagaagggaattagtcatggcaaatattttaagaaattgggtcgaaagtgataagcgtgaggtcaaacggatgggcaagattgccgatcaagttgaagcactcgctgatgagatggcggccctttctgacgaagaattacaggcaaaaacgccagcgtttaaagaacgtttagccaagggtgaaaccttagatgatattttaccagaggcttttgcagtcgctcgtgaaggggccaagcgcgtactggggctttatcctttccgcgttcaaattattggtgggatcaccttgcatgaaggcaatattgctgaaatgcgtactggtgaaggtaaaaccttaactgccacaatgccggtttatttaaatgcactggaaggtaaaggtgttcatgttgtaaccgtcaatgaatacttgtccagtcgtgatgcgacggaaatgggcgaattatataattggcttggcttatccgttggtttgaacttgaattcattaagcgccgaagaaaagcgcgccgcttatcaagctgatattacctattccactaacagtgaacttgggtttgattatttgcgcgataacatggtggtttataaggaacaaatgtctcagcgcccgttaaattatgccatcgtcgatgaagtcgattctattttgatcgatgagtcgcggacaccattgatcatttcaggacaagcagaaaagtcgactgccctttatatccgcacagatcgttttgttaaaaccttaaaaaaagaggaagactacaaaattgatctccaaactaaaacaattagtttgacggaacaaggtattcgcaaggctgaagctaattttggcttagataatttgtatgacgctgacaacatggcattgacccatcatttggaccaagcgttgcgggccaattatattatgttgttagatattgattatgtggtccaagatggcaaggttatgatcgttgattcatttactggccgagttatggaaggccgccgttattctgatggactacaccaggcgattgaagctaaagaaggcgtcgagattcaggacgagaccaagacaatggctaacatcacttatcagaactttttccggatgtacaataaactggctgggatgactgggactgctaaaacggaacaggaagaattccgcgaaatttataatatgcaagtcatcacgatcccaaccaatcggccaattgcccggatcgatcatcctgatgtattgtacccaacgctacaaagtaaatttaaggcagttgtcgctgatattaagcaacgccatgaaaagggccaaccgatgttggttggtaccgtagccgttgaaacgtctgaattactgtctaagttgttagatcgtgaacatattccccatatggttttgaacgcgaaaaaccattttaaagaagccgaaattattatgaatgctggtcagcgcggtggggttaccatcgcaaccaacatggccggccgtgggactgatattaaattaggccctggggtcaaagaagttggcggtttatgcgtgattggtaccgaacgccatgaatcacggcgaatcgataaccagttgcggggccgtgccggccgtcaaggtgatccaggtgaaacgcaattttatttatctttggaagataccttgatgcgccgttttggttctgatcgaatcaaagcgctattggatcggatgaaagttgccgatgatgatgcggtgatccaaagtcggatgatcacgcgccaagttgaatcagcccagaagcgggttgaaggtaacaactacgatacgcgtaaaaacactttgcaatacgatgacgttatgcgcgaacagcgtgaagtcatttattcgcaacggatgcaggtcattgatagcacagaatccttgaagtacgtcttgattccaatgattgaacggacgatcaagcggatagtcgattctcacacccagggtgagcaaaaagattggaatttgcaagccatttatgactttgccatcaattcaatggtaccagaagatacgatttcgatcgccgatgatcttgaaggtaagtctagtcaacaaattattgattacttgcttggtcgtgccgatgaagtttatgcagaaaagaaaaagcaactgtacgatgacgcgcagatgcttgaatttgaaaaagtggtcatcttacgagttgttgattcgcattggaccgatcatattgatacgatggatcaaatccgccagtcgatcggcttgcggggttacggtcaattgaatccactagttgagtatcaatccgaaggttatcgcttgtttgaagaaatgatcgccgacattgattttgatgtgacacgattattcatgaaggctgaaattcgccagaatattcgccgttaatctattttgagtaaaaaacgctaaaaagcgacgttagctattaagcacgccgcttttttggctaattacggggaggttccagtatggaattaagtgaaggaaaacatattttggccgatgtggccgctaaattagatcaatttagggggtcactttgacttagatgcgctaaaggataatattgctgaaaatgaagcgcaaatggctgaaccaggtttttgggatgatcaagcacaagcacagaagttgatcgacgcaacaaatggcttaaaggctaaatatgattcatttcagcaattgcagcagcaatacgatgatctgactgtatcggcagaattactggctgaagaggatgatccgcagattgcagcggagtttgatacggggattactaaattgcagcagcaaatgcagcagtatgagctgggcttattgttaaatggcccatatgacagtaacaatgccattttagaaattcatcctggtgctgggggaactgaatcccaagattggggtgaaatgttgctacgaatgtatatgcgttgggctgagcaacatcattttactgtggagacagttgattatcaggctggcgaagaagcggggatcaaaagtgtgaccttgctgatcaaaggacacaatgcttatggttatttgcgctcagagcgtggtgttcaccggctagttcgtatttcaccatttgatgcggctggtcggcggcatacatcatttacgtcagttgatgttatgccggagttggacgacacggtcaacgtagagatcaatagtgatgatctacgcgtggacgtttatcgggctagcggtgctggtggtcagcatgtcaataaaacgtcttcggcagtgcggatcacgcatttaccaactgggatcgtagttgccagccaggcggaacgctcgcaattgcaaaaccgacaaacggccatgaacatgttacgggctaaattatatcagcgtgagttggaagaaaaggaaaaagaacgtgcgcagattcagggtgagcaagctgaaatcggttggggttcacagattcgctcgtacgttttccaaccgtacacgatgatcaaggatcaccggacgaactatgaaactggtaatggtcaggctgttttagatggtgacttggatccattcattgatgcttatttacagttacaattaaaagcggataatccaaaataatagaagcaatttgctgtaccagctttgatttttaatcgaaagttggtgcagcttttttgttactagattgtgaatatttttttggaaccagtaatgctatactaacagtaataataaatgaatcgtggtggcgtttgatggttaggagcttatcacgagcatgaatgaggagttttccggtttatgatagtagaattactggtcagtttagtggcccagccgctattatggtgtcttattttggcaggttatttagtcagccgtcgtcgtatccaacaggaacggcaaacttttcatattgccattgatagccggctaaatgagttcaaggccttttttatttatggcttaccgttggggatcgttttgtcggtggggacaattttattgagcctaaaattatcggcggcttggtggctgggctatcaaatcattggtattttagcaatgatcatgactgttagtgtagtgtggccgactgctgcggtgttgttcaccacattgatcacggtcgtattattgcctaatagttggcgcttagcggtaccgagatttactgatcaagtagcgactaatcggttgatcgccgttagtttgtttttgctgctggcaatcagtgcgctggctagtgctggcttacgacagcgtttagcgattcgcaatttatcaccacgaatcacggaaagtaatcgcggtcggcgaactggttattttaaagcacaacaattggcattgataccgttggttttcttagtaccaggtacaaaactgtccagtggcttatttgcttggtcaacggttcatgtcgccggaaatcaatatcatttagttattgttccgttgctgatcggctttttactaacggtaaggcaacaactaccggcagtgcaaatcaaacagcaaaatcgctggcaattggtaactggactgatttatttgatcagtgcagtgattgtttatttccaagcacggttatttatcccgttgctcttgattgccgtagtggttgcggtgattgggtggttaggtgctcgccgtgtgcaagggttggtgcactatactgaaccgttcactggtgtaatggtgttgggaattcaaccagaaacgccagccgctaaaatggatctggtagctggggatattattttagaatgtaacaatcaggcagttcatgatgaggattcattctatgctgcgcgcatgactgatccgacttattgtcatttgcgggtcaaaacgcaaagtggcgacatcaaaattactgaatcagctatttttgaagattcgccgcataatttgggcgttatgacttttccggaacaagtttagcgtgtgttgaaaaagcacccaatttttgggtaaaggggggatacgagcttgaagcaagtacttgtagtcgatgatgagccttcaatcgttacgttactgacttataatttgaaaaaagaacattatcaggtgacgactgccaatgatggcgcgaccgcattacaactagcgttagccaccaagtttgactttattttgttggatctgatgttgccccaaatggatggtatggaagtgacgcggcgtttacggcaggaaaaggtaacgactccgatcattatgttgacggctaaggacgctgaatttgataaaattgtcggtcttgagctgggggcggatgactatttgactaaaccgtttagtccgcgtgaggtgattgcgcgcatgaaggcgatcagtcgccggttacaaccggttacgcccagtgtcaatgaggatgagcaaattcagattggtgcgctaaagatttcgcctactgagtacacggtttttcgcaacggccagcaactgcaattaacgccgcgtgaatacgcgttattgctgtatttagctcagcggcaaaatcgggtgttgagtcgtgaacaactgctaaatggggtctggggttatgattatgccgggcaaacgcgaatggtcgatattcagatcagtcatttacgcgataagatcgaagttgatccgaaacagccgcaatatttggtgacggtgcgcgggtttggctataagttggaggcgcctcagcatgaagcggattagacgaatcagctggttactttttatggtggtcgctgctgggatagcggcgatcattctttttttaaatcagcgttatattgctgagcagcagttagggctagtgcggcaaggcgagttactgcaaacgcaagtgttgcctaaagtgacggcaactaaattaccgcgagcgctgctgcaaaaatggcaacgccagcagaatgtacatgtggcaatttttgatgcccgtaatcaattagtatttccagtcggcgggccgcaagcagatctgatcgatagcgtggtggcctttcaaagtaaaacggctgcgactaagcgtgagcagatccgcgttgctagccgtgcgcaaacggcttatttatttagccaaaaaccgtggacctttgtactgtacacgccacagcataatttatggcaaccgttttggccgcagggcgtgcatttgttattcgcggtgcttggactaagtttactaagtgttctgatttttcgtggctatacgcgctgggagcggcattccttgcagcgggttcaacggcaattagctaaggttggcgcaccacagccaacaccagcggtattattgaagccaacggatcattattttgccttggagcgtgctgttacccacgttgatcagcagctgcaagcccagacggccttagcgcaaaatgagcagcacaactttaatcgctttatcaatcatttgaccatcggcgtattgctgctggatgaaaccggtgatgtggtggcgcataatcctgcggctgcgacgatgctggcgcagcaattaagtgatcagccgcattcctatctaaatgatattcatcattttgcgctcagtcgcttgatcaaacatgcgttgaaccagcaaaaaagtcagcacgcaacggtcagattagtgcaaccgcaggagcgttacttggatgtcaatgtggtctggatgaaggctcaggcactacaggcaacgtatcaagtcgcagtgctgttatacgacatcacgccagttaagcagatccagcaaatgcagttggattttgtcagcaatgtgagccatgaattgaagacgccagtcacctcgatcctaggttttacggaaacgctattggcaggcgcgcagaatgaaccggaagtacggcaggaatttttaacgatcattgcggcggaaagcaagcgactgacagcattgatccaagatattattgccttatcccgcggccagcagcaacaattacaagtggcaccggttaacatcaaacaaacggtgacgaacttactagtaccgctgcagcaaacgattgataccaagcaagtaacggtgcaactaaatattgcggcaacggcacagttacaaactgatccgcataaattcgaacaagtggtcaagaatttattgatcaatgggctgtcgtacaatcgtcaaggtgggcggctgacggtgacagccgaaaaaaaagccgcacagtggcaacttagctttagcgataacggcttgggtattgcggcggatgaccaagtacggatctttgaacggttttatcgcgtggataaagcgcgcagtcatcatcaaggtggtacgggtttaggtttggcgatcgtcaaagagttggtcaccgcgctgggcggtcaagtgcgtttgaaaagccaactcggtgtcggtagcacctttaccattaccttaccggaaaaaattgaagcttagcaggtggcgttagaaataacggcgccttttttgtgtcttcataggcataattgaagcgttttctatgtgcagcatgctattattagtctggagtttgcattttaaatcaataccgtgaatcaacaaaatttacattatttttacaaaagaacgcattggattttacgttgatcttttatgcttaaagagaattgaaataatgggggtcttgctgtgaagaagcgtatcctactggtcgccgcgttattaatgagtttagtaacgttaacggcgtgtcaaagctcggctgatcggggcgaatcgatcaccgttgtcggttcatcggcgctacaaccacttgtggaagcagctggtgagcaatatggcagtgagcatttaggaaaatttatcaatgtccaaggcggcggttctggaactggtttgagccagattcaagaaggggcagttgcaatcggtaattctgatgtgtatgccgaagaaaagcgtggcatcaatgctgatcgtttagtcgatcatcgggtcgcggttgtcggtatcaccccagtacttaacaaaaaaatcggcattaaaaatttaagttttgcgcagttaaaagctatttttaccggtcaagtgactaattggcgtgaagttggtgggccaaatttaccgatcgtgatcgtcaatcgggcgcaaggtagtgggacgcgggtcacctttgaaaaatgggtgctacgtggtgcccaagctaagcaagcacaggaacaagaatccaccggaatggtgcgccagatcgtcgccagtacaccaggggcgatcagctacatggcgttttcgtatgtcgataaaacaatcgctgcggtcaaagttgcgggcgtggcgccaaccgatgaaaatgtgacgacaaatcgttggcaaatttggtcgtacgagcatatgtacactaaaggtcaacctaaagggctaaccaaagacttcatcaactatatttatagcgatgcgatccaggaaaaaatgttgcctaaattaggctatattccggtaggtcatatgcaggtcgagcgtaatcttgagggtaaagtcacaccggtaaagtaagctagactggtggcgtggcacgtctatgattatagttattacaaagctagtttagcgaaaacgtggtcgaaaaagtagcttattgcatataacgacgctagtcaaacgagccacttcggatcttttattgcctggctaggttatatgccataagctgaccactttttccaccactctgtttttgaaagaaggagctgagcagatggatccaattcgtgaaagtatgttaaaagtatcgcgtcaagcaaaattagaacggcgcggtcggtggttaggcttattttgtatcagtttgatcgtgatcgtcgtcgcagcaattttttattttgtggcttctcgcggtttagcaacgttttatcatgataaaatcaatgtttgggactttctgactaagcaagcgtggaatccaggaacgaaagatagtcacggcattccggcggtcggtgcgttacctatgatcgtgggctcgtttttagtcaccatttttgctgcattggtagcaacgccgtttgcaatcggtgctgcgatttttatgactgagatttcgccgcggcgggggatgcaaattttaaagccagtcacggaattattagtcggtattccttctgttgtttacgggtttatcggtttgaccgttgttgttccggtgatccggcagatttttggcggcacgggctttggtattctggcggggacctttgtgttgttcgtcatgatcttgccgaccgtgacctcaatgagtgttgaggcactacaggcggtgccgcgccattatcgtgaagcatccctagcactaggggcaacgcgctggcaaacgatttacaaagtggtattgcgcagcgctactcccggcttattgacggcaatcgttttcgggatggcacgggcttttggtgaggccttagcggtccaaatggtgatcgggaatgcagctttgttgccacataacttggtatcgccagcatccacattgacgagtattttaaccatgggaatcggcaatacgataatgggttcattggaaaataatgccctgtggtcgctggcattgatcctgttattaatgtcactcatctttaatttactgattcgcttgatcggtcggaaaggggcaatgaaataatgaacagtaaacagcaagataagttagcgactggcattctttacgcgatcgctggtattattattttagtccttgcttcgttgctgggttttattttgattcaagggttgccccacgtgacttggcatttcttgaccacgccggcacgggcttttgaagctggtggcgggatcggtattcagttattcaattcgttttacttgttacttttagcgatgttgatttcagtgccgttgtcgttaggtgctggcatctatttatctgaatacgctaaaaagaactggctgacttcgttgattcgaacttcgattgagatcctcagttcgttaccgtcggtggtcgttgggttattcggcttcttgattttcgtgatccagtttaaatttggcttttcgattttatcgggggcgctagtgttgaccgtttttaacctaccgttgctgacgcgaaatgtggaggaatccttagccagtatttccagtatgcagcgtgaagctggcttggcgctaggcttgtcgcgctgggaaacggtgattcgaatcatcgtgcctgaagctttaccagggatcaccaccgggatgatcttaggtgctggccgtgttttcggtgaagctgcagctttgatctatactgctggtcaaagcgcaccggcgttagatttcaccaattggaatccattttatattgccagcccactaaacccgctgcggcctgctgaaaccttggctgtgcacatttggaaaatcaactctgaagggatcatgccagatgccgtggcggtttctgctggggcttcggcggtgttgatcgttgccgtattagcctttaacttagctgcccgctggtttggccagcatttgtatcagaaaatgactagttctgggaagaagggggcctaaagatgaaagattatgatttaactaaaacggcgatcaaaacctttgacccggcacaacaagaagttgctttaagtaccgaagatctgcacgttttctacggtgatcatgaacagatcaaaggtgtttccttgcaatttccgcgctacaaaattgcggcgatcatcggctcatcgggctccggcaagtcaacttacctacgttctttaaatcggatgaacgatgagatccaaaccgcgcgggtcaccggcaagatcatgtatcgtgatctagatatcaatcaaccgaaaatcgacgtttttgaaatgcgtaaacatatcggcatggtatttcagcggccaaatccgtttgccaagtcaatctatgacaatattacctttgcaccgatccgccatggaattaaagataagcatgtgttggatgaattagttgaaacaacgctgcagcaagctggtttgtggaaagaagttaaggacacgttgcataaaagtgcgctggccttatctggcggccaacaacagcgtttgtgtattgcccgcgcggtggcgatgaagccagatattttgttgctggatgaacctgccagtgcgctggatcctatttcaaccagtgttgttgaagacacgttggcacaattgaaagagcactatacgatcattatcgtgacccacaatatgcaacaagcagcacgaatcagcgactacaccgcctttttccatcaaggggtggcgctggaatatgcggaaacaaaccaaatctttaccaagccagcaatcgaagcaaccgatgattacgtgtcgggacattttggttagcgtgtgttgaaaaagcgggtaaattttgagtactagcctagtaaggcgcagaagtctgcgacttgaacttggcgatttttgccttagcacaatcgacaacgggaagcaaatgctacttagcaaataagctatcgttcagctgcttttcaaaaagtgttgtcgaaaacgagtcacaatgctttttcaaccacgtttacgtaggaggtcaatcatggcaactgaaaaaattattaccagcaaagacgttcacctgtactatggtcagcgtgaagctttaaaaggcatcaatttagatttcaccgctaacgagatcaccgctttgatcgggccatctggttcaggtaaatccacttatttacgtttgttaaatcggatgaacgatttgatccccaatattcgcattaccggcgatattcgcctgcatggccaagatatttacgcaccggagacggacgtggtccagctacgtaaggaagttggcatggtgttccagcagccgaatccatttccattttcgatttatgagaatgtgatctacggcttgcgcttagccggtgaaaaaaataaggccgtgctggatgaagtggtagaaaatagcttgaaggcagccgctgtttgggaagaaactaaagacgtgctccatgacagtgccttatcattatccggcggtcagcagcagcgagtctgtatcgcccgagtcttagcggtcaaaccagcggttattttgctggacgaaccgaccagcgcgctggatcccatttccagtagtaaaatcgaacaaatgctggtaaatttaaaggatgactatacgatcatcatggtgacgcataacatgcaacaagctgcccgttcgtcagatcgaacggcatttttcctcgatggtcaattagttgagtacagtccaacggcgaaattcttcacggcaccagataaaaaggaaagtgaagactacatttccggccgttttggttagaaaatgtgctcaaaaacagctctatcaagccgttttaaacagattttaaatataaaaatatcataagaggaggtaacaggatgcgggaaatatttagtgaagaattagaagatttacacgtgcgtttctccgaaatggggatgctggtcaatgaggcagtttacaattcggtcaaagcgtttgtcaatcatgatcgtgaactggcgctagaagtgattcaaaacgacgaggcaatcaatcagcgtgaagttgatattgagaagcgtagttttgagatgattgccttacaacagccggtgactagtgatctgcggatgatcgtcacgatcatgaaggccagcagtgatctagagcgcatgggtgatcatgcagtcagtattgctaaatcaacgattcgtgtgaaaggtaatacacgtgtgcctgagatcgaagaagatatcgccgcaatggcggatattgtcaaacaaatggttgaagacgtgctggatgcttatgtcaaaaaagacgagcagcgcgcacgcaagatcgctttacaggatcaacaagtcaacgaagcgttcaaaacgatttatgataaatgtattgatgagatgaaaaatgatccgcaaaccgtgatcggtagtactgattatatgatggtcggcacttacttagagcgggtcggcgattatgtgactaacatctgtgaatggatcgtttatttaaagactaacaagttgactgagttaaatacgaataatcaggaaatgatgtaatcttatttccgccaccgaggctgccgtttaggcagtctttttttgtgccgctaaacacaaacatttcaatttttttatggttttaagttcgatttaagcttacctcagtaagatgaaatcatcgataaaacaaatggagatgaatatcaatggaaaatatagtggaatttggtgtagggcggactcaccggcgctggaaaattacttggcagcgattattaccttggttgatcccggttgcgttgatcggtttttggcaactagccgttagcgctggttggatcaatagcaacttattaccgtcaccagtagccgtggttcaggatggtatcggtttgtggcaaaccggcgagttaccgaaaaatatcagtatcagcctttaccgcgcgaccacaggatttgtgattggtggcagcatcggcttcattcttggcttgctgaacggattatcaaaaactgcgcgggcgctatttgattcttcaatccaaatgttgcgtaacattccgcatctgtctttgatcccagtagtaatcattgctttagggatcggcgagaccgccaaaatttcgttggtgacggttggcgtcatgtttccgatctacatcaatactttccatggcatcaccagtattgaccctgaattattggaaatgggccgggcgtacggcttatccaaacgtgcgttattaacaaaaattattttccctggggctttgcccacgatcttagtcggcgtgcgttatgccttaggtgtgatgtggacgaccttgatcgttgccgaaaccatttcttctagttccggtatcggttatatggcgactaacgcgcaggaattcatgaatatggacacggttttgctatgtatcgtcatttacgctttattaggtaagctatccgatttgatcgcgaaagctttagaaaatatttgtctggcatggcaacgggaagggagcgctaaggcatgatcaaaccattattgaccttagaacaacttggcaaaacttacgacactaaagtcgcgttacacgacgttaactttaatatttatcccggcgagtttattgctttagttggtatgagtggcggcggtaaaagtacgatcttacgcttgatcgcccaattagaacaaccgaccaccggccaggttcaatttagcgatcctgacaccacggtacgggtaatgttccaaaatgatcgcttgttaccgtggatgactaatttagaaaatgtttcctttaaaagtaaagacgaagctgagcggcaacgtgcgcaagccattttaaacgaagtgggcttagcagaattcgctgacagttaccccggtcaattatctgggggccaaaagcagcggctggccttggcacgagcgttaatggccaagccacaactgctattgttggatgaaccattaggcgcattggatgccttgacgcggcgcaagatgcaggcgtttatcgcggaaatttgtgccaaacaacagttgaccactttattgatcacgcatgatgttgacgaagcagcgcgcatggctgatcgggtgatcgtggtcaaggatggcactaacgtttacgaggcggacggcgcaaaagatcaagctgccgcaacgattgccaccgtatcagaacgcattctcagtgtgatcctgcacgcaccggcgaccgctgccagtgtgaacggctagagtagaaggtgaagatgctgacaaatacacaaacaacaccgaagaagaaacgcccctatctttatgaagttgatttaatgcggatcttctttattttcggcgttttactcaatcacacaacgaccacttttgccgcccagatggcgagcagtggttggccgcatctgttattgaacagtacgcatttgatgatccactttacgcgaatgggctttatgttcatgactggcttagtgttaacgttaaattactaccaccgcaatagctggcccagcttttttaagaagcgctttgcgggctccggttggccatacttgctttggaatttagttttgatgatttttgccaccttactgctgttaccaggcttttcttgtgccaacttcgggtcgacttatctcagcgcaatcctgcacggggatcaattctacatgtactatattttagtgacgttacaactttatctgctgttcccattgatcgttaaactatttaaacactggtcccacgcacacaatcgcatcttgttgatcagttttctaattcaattaggtttaatgtttgccattaaatacggattgccccacgtggatcgcagcaattggctttggtggttccgcgcttacggtgtcaatgtgttcacgtaccagttctactttatcttcggtgcgtacacttccttacattatcaggaagtcaataattttatccagtgccatatcaagccgatcgcggccgttacgctcacactaggcttaggcacgattgcttattatgcttggaaccgtggtattctcggtttgactcacaccgccaccgtttcgccgcaccaaccgtatatgctggtttatgacagtttaatgatcgtttttgttttttggatcggtaaatgttatgcctactggcggcagcatggcatctggaattggtttgaaaaattcgttcgcaacggcgccaaggtttccttcggcatttatttggatcagacgatcggcttaaccattttaagcgggttgctcagtttgatcaatattcccgattgggcgctgctgttattaatcccgctcgtctatatctttgtgatcgccatttcgtttggcatcgcttggttctgttaccgcgtcgcaccgttcggcattctgattgggcggccgcaagtacatctgtttaagaagaaaggaatggtgctgcatgaccacactaacaaagctattatcacaacaactgaaaaataatttaaatgaaccgctaattaaagatgaaaacttaggcacttggtttaccggtcaggacttacaggccgatgtgacccgcttgcatgacgcctttgtcgccaataaattaggttacggtgatcaattgttggtttgtttgccgaactcggcggttttcccagtgatcaatcaagcagcgtgggaattaggtattatcgtccacccaatttcaccgtcaacgccgatcgctgaattacgagctgattggcaggaacgtcactatgttggtattttattggcgccggcgttagcagctgaattgaccgaagccccatttgcggcggcaacgctgcacttgcacaccgtaccggagctgcctttcttagtcgatactaagcagttggcggggcggttgctagccagcacgcaggtaccccaggaagatgatctcggcttgatcctgaacacatccgggaccaccggcaaaccgaaacgcgttggcttgacccacgcgatgttagtcaatgcggcacgcaacgatattgtcagcaatcatatgaccgcggacgatgtggcgatgatcacgatgccgatgttccacatcaatgcccaagtcatgtcggctttatcgactcgcttagctggcggtaaaattttagtcacacccaaattcagtgccagcaagttttggcaacaagttaaggataacggcgttacttgggtctccgtggtcccaacaatcattacgttcttattattaaatgacaatgccaatgccgtttatcgcgccaacgctgccgatattcatctgcgctatgtgcgttcatcttcatttgctttaccagaagacaaattgcgtgccttccaagataatttcgataccttagtcatcgaaggctacggtatgaccgaagcggctagtcaatgcacaatcaacccatttgatgcgccgaagatcggttccgccggcaaagcctttgggactgacttgagcattttagttggtggtgaattcaccaccgaagcgaacgtacttggcgagatcgtcattaaaggtgaccacgtgatcacccaatatatggatccgaatcctgattcatttaaagacggttggttcttgaccggcgatctcggttacttggatgaagacggctatctgtttgttaaagggcgcagtaaggaaatcatcagtcgcggcggcgaaaaagtggccccagcggcagttgaaaatgtgttgaacgagctagactttattgaacaattatccgtgatcggtatgcccgatgacttatatggtgaagaagtgactgcagtcgtgatcagcacaacaccaggcttaaatgaagctgcccagcggcaagcactgtttgcttatgcgcaagcgcatttagctaaatacgaaacaccgacccgggtcgagttcgttcgtgaatttccgcagaataccactggtaaggttttgcgatcacaattgcgcgatcaattattgaccgtcgccgctagatagtttaataaaggaaggagtaggggccttaaataaggttgtcccatgtagaaaatgaaaaagcataaatggaaattaggtttattattagtcgcgctgattgcgtggctagggatcgcattttatggttatcggcaaactgacaccagcagcagtaatctagccaccgttacggttggttatcaaaaaggtgatccggtggatatttcgcggcaacgcggtgaattagctaaaaaaatgaagacgaaagggtataaagtcgtcttcaaagaattctccgacggcacggcgctgatcaccgccttaaaatcgggcaatattgactacgcccgcttaggtgatacgccgccagtaacggcacaggctagtgggatgaatttagtttatgtcgcggccggtgcttccaaggaaaatggttcaggtattttagttaagcagaattcgagtatcagtagcttgcaggatttgaaaggtaagcggatcgcctacactaaaggcacctcggcgcaattcttgatcattcaagcactgaaaaaagcaggcttaacgacagatgacgtgaccttagtcaatatggatcaatcggccgccagtgtcgcttttgccaaagggaaagtcgatgcctgggtgacttgggatccctttactgctactgccgaagtcgaacaaaacgctaaattgttagttgatggcactggtttatcgaagaatcgtgatttcgtggtttccaccagcagctacgctaaagcgcacaccacggtcagtaaatatctggttgcctatttagctgacgatatgcagtgggcgaccaagcaccaaagcaagctgatcacgatgatgagcaaaacgctacatttatcaaaagcagtgatcaaaaaacaagttagccgccgcaccttctcgatgggcaaagtgactaatgcaatcgttgaagaacaacaaaaaatcgcggatgttttctataacgctggcttgatcgataaaaaaatcaaggttaaagatgcgttagtggatcagtaggacaagggggagttgtgacataagtcatttatgtccaactctttctttgcactttcgaacaatattgttaaagtgtgtgccataaggcagctttatggcacacactctttttaataaaaatcaatggcaggagtcactcatgaaaaaacacaaatggcaagtcagtctattttttatcgcattattagcatggttaggaatcgctttttacggttaccggcaaaccgataccagcagtagtgcgctcactaccgttaccattggctatcaaaaagcggatccggtggatatcgcgcggcaacgggggcagttggtcaaaaaaatgcaggcgaaaggctataaagtcgtttttaaagaattttctgatggcacggcgctactgacagccttgcaagctggagatattgattatgctcgtgttggcgacaccccgccggtcactgcccaagctaacggaatcaaactcgtttatgttgctgcgggagctgccaaaccgaatggctccgaaatcttagttggtcaggatttaggaatcaagcgcctagctgatctaaaaggcaagcgaatcgcgtatgccaaaggaacgtcggcacagtttttcattatccaagcattaaaaaaagccggcttgacaactagtgatgtgaccttagtcaatatggatcaagcagccgccagtgtggcttttgccaaaggtaaagtcgatgcttgggtgacttgggatccgtataccgccaccgccgaagtcgaacagcaggctaaagttttggttaatgggactggcttagttaaagaccgcgacttcatgttgtcaacgcgtagctatgccaaaacacatacgacggtgacaaattatttgacgacttatatcaatgacgatatgcagtgggcgactaagcaccaaaataaattgatcgccatgctcagtgagacgctgcatttatcgaaaacaattattaaaaagcaagtccagcggcgaacctacaccatgggcaaagtgaccacaacgatgattaaggaacaacaaaaaatcgcggatgttttctataacgctggcttgattgataaaaagatcaaggttaaagacgcgttagtggatcagtaggagcaaggattgaaaagcgttacactataagtgattatggtgtaaccttttttgattacctcagtctttttcgaagtttttcacaccactctaactctagccggttatacagttccaccaaatagctgagcgtaaaatccaacttaggtcctatgctttttttcgccaagcaagccataatagagtcatggcaaaagaagttgttaattgcccttaaactttgattttaaaataatgaattgctttaatagcccaaggaggacaataacatgaatgaacgcgaacgaattctcgatttagttaaacaaggcgtcatctcaactgaagaagccttgttgctgctggaaaacttggcgcaagataaaaatacggctgaacaacactcaacgacaaaaacacagacagaacgtcaatcaactgaaacgacgacggccgatgaaaaagaaactactgataacaccgcagctttagctgaattacaagatcagatcaaagaggttgatgcgcaattaaaggacgctcaacacgaattgaaggcgcagcaggaacatttgcaagtgctagacacgatggaagaccttgagactttatcggcggacaaattagctgaacgcgatcgtaccaaagaaactattggtaaaacggaaagtcagatcgccgtgctcaatgatgaaaaaacagccttgcaaaagcaagtcgctgaattgcataaagctcaacgtgatcactataaggaacgtttagcggataaattgaatttaggcgatgactggaaagataccgccactgacacgctgaaccaagtcggtgaaaaagtcggcgatgccggtagtcagttaggcaagttcattaagaatacggcgcaaacaatcatggaaaacgtggattggaaagaagttaatatccgcgttcctggtattgcaacaactaaatttgatcatgattttgtttatgaaaatgccagcgccacgattttagacgtgaaggtggctaatggtgacgttaactttaagacttgggatagtcctgatatcaaagttagcgcacatgtaaagttatttggtaaaatggaatcagatagtccgttggaaaacttcttgcaacgtagtgaattagccaatacggccgacacattaacgttcaaagtgccaaacaagcggatccaggccgatttgactttctacttgccagaacggacttacgatcacacaacaatcaagctattgaatggtaatgtgactttagagggctttgaaggcgacgacttgttcattaagagtaccaatggtcagctcactttcaatagtgtcaacgcctcaatgcttgaggttgaaggaatcaatggtaacattaaagtcagcggtggtcggctgatcgatgctttagtcaatacagtcaatggtgaggtgcgcttcgtcagcaacgtcgaatcggcggaattgacaacggtcaacggtgacgttaaagcaacgatcacggaaaatacgttgactaagctagttgccagctcagttaatggtaatgtgaaagtcgcggtaccgactgaattagctatttccggtaaaagtaagacccgttttggggcaatcaaatcacgcttaagcaatgtcgatgtcctaaatgagcggcataacaccggtaactcagtgtatgactttgaacgtgatcttggggacacaccagctaaattagaattaagcaccacctcaggtaatgttttattaaaagatacgcaggaataaacgcgctgccgaatcgcttactagtgtttgtaaacacgttagataaatcggcacgctaaataatttatcttatagggagcgataaaaatggcagaaaaacgtttatataaatcagatcgacacgtcatcagtggggtgttgggcggtatttccgaatattttaacatcgatccaacttgggttcgagttatctacgccgcagttacgttatttacagttggtttcccgggggtcgttttatacgcgattttagcattagtgattcctagtcggcctaaacacccagactatctagcacaggatagtactgagcaacaaagtactaaagatagtgattggagtgatttctaatgccgtttctgttttttctctttttcagtccaatattgattctgttaatggtcgttttgttattcacattgcgcatattggcggttccattattgattttatttttcattttgatgttcacgcgacggcgccagcattatagtcgtagtcagtggacccaacagcaacaatggcaacattatggtcggtcagaataccggcagcatcaccacgaccaacgccaaaagcaacgtaaaaatgcccgcgacgttaaggtgcaagatgatgactggagtgacttttaatgggtttttggaaacgagttctcgttaatgcgctgatcttcttagcgctagccggcttttttccacacttgatctatatttcaagtatctggatggcgctaggcgcgagcttaatacttggtgtgcttaatgcgctgatcaagccgatcttaatgattttatccttaccgatcacgattctgacactaggcttgttcagtgttgtgatcaatgcggtgatgttacaattaacagcgttgtttgtaggtagtggctttgcctttagcggcttcggtgcatcgattttaacggcgatcatcatctcggtggtcaacgcaatcgttagtgaccgctttgcccgcgactaatgaaaattatggcgatcgattcgatagatgaatcgatcgttttttattgcaattaaaattaaagctactttacaacgacaatatctaccttataaaaagttgtttttgatatattggttgggtatttgtgggccatcaaattggtggggccttgatggcctacattagcggcgtagtccatgacagcattcacagttatgtgatggcatttttcatggccggttttatgtgtttgatcgccaccttattagtgatcacagttccacagccagaattaaatgcttggttcaatgtcattgtcacgactaattttagttgttggcaatgaccttttttgtatcaaatattgatgtaactgccgctgaaaatgacctttccataagaatgggtgcgctatcgtatgctaaatgttaaaatataaaacaagagtatgatcttgtattgtgaatcatgtaatcaaaataaacgacgatgctaactaagacgtcgctattgataagataggagcaaggcctaatggtgcaaagtgtcaaagtaagtgaattggtaacacgcgctaatttagaggtttatgctggtgcagaatatttaaagcaacggcagatcaccgtcagtgatatttctcgaccaggtctagaattgactggctatttcaattattatccgcacgatcgaatccagttattcgggcgaacggaaatttcatttgcgaaaaagatgatgccggaagagcggctgatgatcttccgcaaaatgtgtggtgaggatacgccagcatttatcgtttcgcggtcattgccggtcccaacagaaatgttgcaggctgctaaagaagcgggcattcctgtgttagggtccaaattggcgacaacgcggctatccagcttgatgaccgattatttagaaggtcgcttggctgaacggcgctcactgcatggggtgttagttgatatttatggtatcggagtgctgatcactggcgattccggtgtcggtaaaagtgaaactgcgttggaattagttaagcgcgggcaccggctgattgcggatgatcgggtagaagtctacgagcaagatgaacaaacgttgatcggtgaagcgccggccattttgcgccatttactagaaattcgtggtatcggcattattgatgtgatgaatttatttggtgcgggagcagtccgcagtgacacgccgatccaagtagtcatgcatttggagacatggactgcggataagaattttgatcggctcggcaatggcgaagagacgatgcagatttttgacgtgacgttgcctaaaatcacgatcccagttaaaattgggcgtaacctagcaatcattattgaagttgcggcgatgaattatcgggcgaagacaatgggctatgatgcgactaaaacgtttgaatccaacctaaaccaattaattcaagagaatacattagaagatgaagcagctgaggcagcacataaaacgacgaatgatgctttaccgaatacaccgacagagaaggacaaggagcaggataaggatggtggccaagcttgatgccaacacctttaattgcggcgttaaatccgatcgcactacgtctaggaccgctagaggttcattggtatggtgtgatcattgcgactggggtcgtgctggcggtaattttggcgatgcgcgaagctgaacgccggcaggtttccactgatgatctgttcgatatgattttgtgggcgttaccgtttgccttgattggtgcacgtctctactatgtggcgtttgaatggccgtactatgcggcgcatcctagtgagatcattgctatttggcatggtgggatggcaatttatggtagtttgatcgcagcggcaattgtggtgctcgttttttgccggcggcgtcaattaccagtctggcttgtcctcgatattgctgcgccaacggttttgcttggtcaaggaattggtcgctggggtaacttcatgaatcaggaagcttttggtgcgaaaacaacgctacattttttgcagcaactgcacttacctgattttatcgtgcagcaaatgtacatcggcggtgcatatcgacaaccgactttcttgtatgaatccttgtgggatctactgggtgttgttgtgttgttaagtattcgccaccgcaagcattggtttaaacagggcgaggttttcttagcctatatggcgtggtacgcctttggccgcttctttattgaaggcatgcgtactgacagtcttatgctatttggcggtcttcgggtctcacaattactatcagctgttttggttattgctgcaatcggattatggttgtggcgtcgctattatcagccacttttgccggattatttagcaggcaatcagttagcttcagcacaacgtgcaactaaaaagtaagcaaataccttaattgatggaaaaggaagatttttttaaatgaagagaattgcagttttaggtgctggttcatggggcactgttttggcgaatttattgttgaaaaatggacatgaagtcacgctttggacacataagccggcacaggccgcggaaatcacgcagcaacacaccaatcagcattatttgcctgattttgttttggaaccagaactaacggcgacagcggatttaaaaactgctttggttggtgctgatgtggttctgtttgttgttccaacgaatgcaacccgcgaagtagctaaaaaagtcgttgccggtttaactgaattacaacaacgaccaattatcgtacatgctagtaaagggttggagcagcaaactcataagcgtctatccgaagttttagcggaagaaatgccagctgccacacgacaggcgattgttgtcctttctggtcccagtcatgctgaagatgtcgctgctggggatattacctcgttgacggctgcttctaatgatttagctgcggccgaaacgatccagcaactctttatgaatgattatttccgcgtttatacgaacaccgacgttatcggtgttgaaatgggcgcggccttaaaaaatgtaattgcgatcggtgctggtgctttacatggtttaggttatggtgataacacgaaggcagctttgatgacccgggggttagcagaaatcagtcgcttaggagtggcttttggcgctgagccattgacgtttatcggtttatcaggcgttggtgatttaatcgtcacttgtaccagtgtccattcgcggaattggcgcgccggcaaccagttaggtcaaggtgaatctttggctgccgtattgaaaaatatgggtatggtcgttgaaggcgtggcaactactaaagctgcttacgagttagcacaacaaaagcatattgatatgccaatcacaactgcaatttatcatgttttgtatgagcaaaaagatattggtactgagattgctacgttaatgaaacgcgcaggtaaaatggaattggcttagttcaaccaacgacgggaagcaagtgctgtttaacaattaaacattaaatctgctacttgccaaaaagtgttgtcgaaaacaagtgacagtgttttttcaaccatgtctagactgaatgagtggtaaaatctgttttttaaacacagcctaagtttggtggcgcacgttgcgccgatcgaactgaaacgattctttgggcattatctaagaaatcaatgagaaattttctaagtgttagttgtgatatttaatgctataatcaatgtactttcaacggatgaatgcatttaaagggggagacaaaacgccatgggtgaagttatttcgtttctaccatcgtgcgagttttattttaatttaggcatgactgctttttcgaaaagcaattacaagaaggcaattacgtatttggaacgtgcacagacactagcacataccgatgatgattatgtatttgctaactgccaattggcaatctgcctacaatatgataatcgttataatgaagcgattcagcgtttggaaaagctgaatttgcattatggtgagcatcacccagaaattcaatatttcttagctaactgctatgcctttatgaatgagttcaagcgcagtttagaatatgtcaaaggttacttagctagcggacagcaagaatttaagcacgaagcaacggatctattatcccagttgcaccatgaacaaggtaacttctaactaaaagtaagcagaacgctagactttccgaaaatctcagcgtatgatgagagcatagatttgtaagagcgatgttgtctacagcatggttttgccacaagaacggacattgttcatgaacgcaataggtagtctaattatttactttaattgtggagtagagccatgtttcaacttagcggactttgctttagttgaatggacatcgtccggaacattgggaataattagtggtctttactaattatttaccttaattgtggagtagagccatgtttcaacttagcggactttgctttagttgaatggacatcgtccggaacattgggaataattagtggtctttgctaattatttactttaattgtggagtagagacggaggaatgagaatgacgaaacaggcagatgttgttgtgatcggtgctggtcctggtggcttgaccgcagctttatacgcatcacggtcaaacctttcagtgatcatccttgatcgcggtatttatggtggtcagatgaataacaccgctgaaattgaaaactatcctggctttaagtcaattttaggtcccgatttagcgcagaatatgtatgatggcgcgacacaatttggcgcagaatacgtttacgggaacgtgactaatgttgaagaccagggtaaatataaattgattcacaccgatgatggtgattatcaagccaaagcagtggttatcgcaactggtgcggatcatcgtaaattaggtgtacctggcgaacaagaatatagtggccgtggtgtctcgtactgtgccgtatgtgacggtgcattctttaagaatcgtgaagttgctgttattggcggtggcgattctgcggttgaagaaggcctatatttagcccaattagcttctaaggtaacaattattcatcggcgtgaccaattacgcgcgcaaaagattattcaacagcgtgcttttgacaacgacaagattgaatttgtttggaatgccaatacggaagagatccttggcgacgaacaaaaggtgactggcgttcgttacacagataaagttactggtgaagaacatgttcttcctgctagtggtgcctttatctacgttgggatcgacgctttgactgacggtttccaaaatttaaacattttagacgaaaaaggttgggttgttactgacgaacatatgcgtactgcagtacctggcatttttgccattggcgatgtacgtcaaaaagatctacgtcagattacaacggctgttggtgatggtggcgttgctggacaacaagcctttaactatattcaagaattagatgataaagtgaaacatgaagcatccgtaaaataaaaataggtagtggcagaatgagaattctgctactatttttttgcacttttttgacctaagccgttttcatggaaacattgttcaaataagattggcttaatcatttccacttgagttttggactagaccaataactggtatatgaaaatttgattaagtcgtcttaagttagtttagtgaagcgctgtcgtttgtagtatactattgatgaataactgtgaggagatgaagcgattggcatggcaagatacatatcaaacttgggtagcttatcctgagttagatgctgatttgaaaaaagaattaacagcaaccactgatcaagaacaattagaggatgcattttacgcaccaatggaatttggcacggcaggaatgcgtggtgtgatggggcctggtatcaatcggatgaacatttatacgattcgccaagcaactgaaggcttagccctatttatggatacgttggatgcggcaactaaacaacgtggtgtcgcaatcagttttgattcacggtataattccgaattgtttgcccacgaagcagcacgggttttaggtgcacataagatcccaagctttgtcttcgatggtttacggccaaccccagaattatcctttgctgtccggcacttggaaacttatgcaggtatcatgatcacagcaagtcacaatcctaaacaatataacggttataaaatttacggtcctgatggcggccaaatgccacctaaggaagccgatttgattaccagttatgtgcgtaaagctgccgatttatttggcattgcggtcgttgatgagcacgatttgcggacagcaaaattaatgacgatgatcggggaagatgttgatgaagcttatttagctaacatcaaaaaagttacgatcaatcaggatttagttgatgaaatcggacccaaattaaaattagtttactcaccattgcatggtactgggaaaatgttaggtgcacaagccttgcgtaacgctggctttacgcaatttaagttagtcgctaaacaggcgattgctgatccagaatttccaacagtaccgttccctaatccagaatttccacaagcctttgatatggcaatcgaattaggtaagcgggaaaatgcggatattttggtagccactgatcctgacgctgatcgtttaggtaccgcggtgcgccaaccagatggcgagtatcgtttattaaacggtaatcagatcgcagcattgatgttggattacattttacgtgctaaccaaaatgccgacactttaccggctaatgcggtggcaatcaagtcgatcgtttcaacggaattagcaacgcaaattgcgcataattataatgttgaaatgttagacgttctaactggcttcaaatttattggtgaaaagatcaagcaatatgagcaagatcacagtcatacttacatgtttggttttgaagaaagttacggttcattgattcgaccattcgtacgtgataaggatgcaattcaaggcttacttttgttggctgaaattgcggcttattatcaaaaacaaggtaagacattgtatgatggcttgcaagacttattcaagaagtatggttattatgctgaaaagacagtttcacaaacctttgatggtattagtggtgccgacaagatggctaaattgatgacaaagttccgcgaagaacaaccagcagaatttaatggcgttaaaatcagtgcagtggaagactttgctcagcagacgaagacttatgctgatggtcatcaagaaaaaatggcgttgccaacatctaatgtattgaagtacttgttagcagacaaaacttggatcgctattcggccttcaggaactgaaccaaaaattaagttctatgttggtacgattggaactagtgaagcagatgtagcaactaaattagatgcattcgaaaatgctttaaatgaatttgctgctgaataaagtagtgagagcttgaccctttgtggtcaggctcttttttggatatatttatgcgctagatcaattcatattaataggttacctgtcaaagccaaatacttgtcaggtcggataaaagtcgttagaatagtaacaatttaatctaaacgggagcgtgagcagaatgggaatgcatcagtatttacagagcttaagtaatttagagacgattcatcgggcaccaggttattttaagtacgaagaacactcggtggcggcacattcgtttaaggtaacacaaattgcccagatgctcggcgatattgaggaaaatgcaggtcaaactgttaattggcgggcgctgtatgaaaaagcgctgaatcacgactatactgagcgttttattggtgatatcaaaacgccagtaaaatacgcaacgcccaccctacggcaaatgttagcagatgttgatgctaatttaactgaaacttttattcaaaatgaattaccggaagaatttcaagcagcataccggcgtcggttgagtgaaggtaaggatgatacgttggaaggtcgcattttatcagttgcggataaagtcgatttattatatgaatctttcggtgaaattcaaaaaggtaatccagaatcagtttatactgaaatttatcgtgaaagtctgcgtacgatcgtcgcctttgctgatatggttagcgtccagtatttctttaaggaaattttaccagatctgttggcggagaacttcactaatcaagaggaattgcgccgtattacgcaacagatcacggctgagaaataatcagcttaactagtggcgaaaatatgttcgctatgctaaaattgaaccagtaaattaaccgggttgggagctgcttccagcctttttcgtttggcacatattgggtgcctagtagataggattatgtttcagtttggcatttttttattaagaaactaacctattttaagtgagatagagggggctaacttttgattcaacgtgaagcacatcgtgattttgatttggtttcgccttatcagccagctggtgatcagccaactgcgatcgcacaactgaccaagggcattgaagctgggacaaaagcccagattttacttggggcgactggtactggtaaaacatttactatgagtgaagtaatcaaaaatgtaaataagccaaccttgattttggcccataacaaaacgttggcgggtcagctttatggtgaatttaaacaatttttcccacacaatgcggtggaatactttgttagttattatgattattatcaaccagaagcttatgtaccatccagtgatacttatatcgaaaaggattctagtatcaacgatgagatcgataagctacggcattcggcaactagttcgctattggaacgtgatgatgtgatcgtggtagcttcagtgtcgagtatttttggtttaggtgatcccaaagaatatgcagatcatgtcttatcgatccgtgttggtcaagaattggaacgcaatgaactattgcgccagttagtcagtattcaatttgaacgtaatgatattgattttcagcgtggtcgtttccgggtacgtggtgatgtgatcgaaattttcccagcttcacgggatgagcgggcactacgggttgaattctttggtgatgagattgatcgaattcgtgaagttgatgctttgacgggcgaagtgttgggtgaccgtgatcatgtcgcaatttttccggcaacacattttatgactaatgaggatcaaatggatcatgctattgacggtattgcggcagaactaaaaacgcggttagcggaattgaaagatcaacataagctactggaggcacaacgcttagagcaacgaactaattacgacatcgaaatgatgcgtgagatgggttatacttcaggaatcgaaaattattcgcggcacatggatggtcgtaagccgggtgaaccgccgtacaccttgatcgactttttcccgaaggattttttgatcatggttgatgaatcacatgtgactatgccgcaaattcgcggtatgtataatggtgatcgagcacggaaacagatgttagtcgattatggtttccggttacctagtgcattggataatcggccattgactttacaagaatttgagcaacatgttaatcaaatcgtttatgtttcggcaacaccagggccatacgaatatgaacaaacagatcaggttgcggagcaaattattcggccaactggtttgttggatcctaagatcgaagtgcggccaattatgggccagatcgacgatttagttggcgagatcaatttgcggatcgagcgtcacgagcggacgtttatcactactttaactaagaaaatggcggaagatctaactgactacttgaaggagttaggcattaaggttcgttatttgcacagtgacattaagactttggaacggacacagattattcgcgatttgcgcttaggtaaattcgacgtgttagtcggcattaatttgttgcgtgaagggatcgatgtgccggaagtttccttgatcgccattttagatgcggataaggaaggtttcttgcgtagtgaacgttcattgattcagacgattggccgggcatcacggaatgttgatggtacggtaattatgtatgctgataacgtcacgtattcgatgcaaggtgccatcgatgaaactgcgcggcggcggtcaatacaggaagcttataatgagaagcatcacattacaccgcggacaatcaagaaagagatccgtgatttaatttcaccggtgaaatcagttcctgtcgatgagcataatagtgaagcaattgctgaaaccgactttgcggatatgaccaagaaagagcagaaggcaatgatcggacgtttagaagagcagatgcggactgcagctaagagtctcgagtttgagcaggcagcgacattacgcgatacgattttagaattaaaagcggaaatcgaataagtcgcgctacgttttttggaaactgaatagtggaaacgtgattaaaaaagtagcttatttaatcactctgagtaggaggaacttttttggcaaacgataaaatcgtgattcatggggcgcgggcccataatttaaaagatattgatgtgacgattccgcgcgataaattagtggtggtcactgggctgtctgggtcaggtaaaagttcgttggcgtttgatacattatacgctgaagggcaacgacgttatgtcgaaagcttatcggcctatgcacgtcaatttttaggccaaatggacaagccggatgtggattccatcgatgggttaagtccggcgatctcgatcgaccagaaaacaacttcgaagaatccacgttcgacggtggggacagttactgaaatcaatgattatctgcgtttgttatgggcgcgggtcgggcacccgatctgtcccaacgatggaactgagatcagcagccaaacggttgaacaaatggtcaaccgggttttagccttacctgaaggaacccggctacaggttatgtcgccaatcattcgtgctaagaagggtcaacacaaaaaggtgttgcaacgaattcaaaaagaaggttatgtccgcgtccgtattgatggcgacgttcaggatatcagcgacgaaattgaattagataagaataaaaaacacgacatcgatatcgtgatcgatcggatcattgtcaaagacagtgcgcgttcacgtttatttgactcgttcgaatcagcgttaagactgtccgatggttatgcgacagcagatattattggcggcgaaccaattctattctcagaacattatgcctgcccttactgtggcttcacgattggcgagttagaaccacgtctattttcatttaacgcaccatttggggcttgtccagaatgtgatggcttgggaatgaaattagaagttgatactgatttggtgatccctgatcccagtatgacgctgcgtgatggcgctttagcaccatggaatccaatctcatctcagtattatccacaattgctggagcaggcagcaacagcttttgatattgatatggatacaccgtttgaaaaactatcagctgaacaacagcagacgattctttatggcgctggcgaccaaaccttccattttcactatgaaaatgattttggcggtattcgtgatgttgatgctacttttgaaggggttattaacaacgttgcgcggcgttatcgtgaaaccaatagtgatttcacccggacgcaaatgcgccaatacatgactgaattaacttgtcccgtttgtcatggctatcggttgaatccgcaagctttagcagttaaggtcaatgatgaacatatcgccgaagtctcagattatgcgatcaacgactcgttggcgttttttaagcagctaaagttaactgaaaaagaaaatacgatcgctaaaccaattttaaaggaagtcaccgatcggttaactttcctgaaaaatgttggcttggattatttgaatttaagtcgctcagccggtaccttatctggtggtgaagcacaacggatccgcttggcaactcaaatcggctctaacttatctggtgtgttgtatattttggatgaaccatcgattggcttgcatcaacgcgacaacgatcgtttgatcacgtcattgaagtcaatgcgtgatctcggcaacaccttgatcgtggtcgagcatgatgaggacacgatgcgcgcagctgattatttgattgatattggtcctggtgctggtgaaaatggtggccgcgtaatggcagcggggacaccagctgaggtggaggctaacgagcattcattgactggccaatatttatcgggcgaaaaatatattccgttaccagagaagcggcgtaaaggcaatggtaagaaaattcgcattacaggcgctagcgagcacaacttgaagaatattaccgttgattttcctttgggtaaatttattgtggtaactggggtgtcgggctctggtaagtcgacgctggtcaacagtatcttgaaacgtgttttggcgcaaaagctgaatcgcaataagcagaagccaggtaaatataagtcggttgctggggtcaaaaatatcgataagatcgtcgacattgatcagagtccaattgggcggacgccacggagtaatccagccacttatactagtgtttttgacgatattcgtgatttgtttgcccagaccaacgaagcgaagattcacggctataaaaagaatcgattcagttttaatgttaaaggcggtcgttgtgaagcctgcaaaggtgacggcattattaaaattgaaatgaatttcttaccggatgtttatgtgccttgtgaagtttgtcatggcacgcgttataattcagaaacgttggaagttttgtataaaggttacaatatttccgatgtcctgaatatgacggtgatgcaggcgttgaagttatttgaaccaattcctaagatccgccgtaagttacaaacaatcgttgatgtcggcctaggctatgtgactcttggtcagtcggctacgactttgtccggtggtgaagcacaacggatgaaattagcctcagaattacatcggcggcagactgggaagacgttctacattttggatgaaccaacaactgggttgcatactgacgatattaatcggttattgactgtgctacatcgtttagttgatgccggcaatactgttttgatcattgaacataatttagacgtgatcaaaacggctgattacttgatcgatcttggtcctgaaggtggtgctggtggtggcgaagttttagcaactgggacaccagagaaaattgcagcgacgccaaacagttatacgggtaagtaccttaagccagttttagaacgtgatagtaagcgggcacgctttaaggaaccagaatagaaatgagagtgagctgaaaatttagctcacttttttattgcagaaaaaaggcttaatatacacttaaaagcgaatatttaagttatttttgaataaatatcaaaaaatgttgcatttttttaaaaggtgcgctatgatgaatccattcaaatgattaaagaaaattaattaagtttaatgataatttaaatgtgtaaggagtggctttaaatggcaaatgaaaaaattattttagcgtattctggtggcttggatacttctgttgcaattccttggttgatcgaaaaagggtacgacgtggtcgcaacttgtattaacgtgggcgaagttggcaaggacatggacttcatcaaggaaaaagccttgaagatcggtgcagttgcttcttacacattagattgtcgtgaagagtttgcccaagattacgtcaccgttgctttacaaggccacaccttgtacgaaggtgaatacccattggtttctgctttgtcgcggccattgatcgctaagaaattagttgaagtggccaaaaaagaaggcgcgacggctatcgcccatggttgtactggtaaggggaacgatcaagtacggtttgaagttgcgattcgggctttagcaccagaaatgaagatcgaagcacctgtccgtgattggaaatggtcacgggaagaagaaattaattacgccaaagaccatgatattccagtaccaattaaactaggcagtccttactcaatcgatcaaaatctttggggtcgggctaacgaagccggcgttttggaagatccttgggtcacaccaccagctgatgcttatgatttgactaacgcaattgaagatacacctgatgaagcggataaagttgagatcgaatttaaacaaggtgtgccggttgccttgaacggtgaaaaattaggtttggttgatttgatcgctaaattagataaaattgccggcaaacatggtatcggtcggatcgatcatattgaaaaccgtttggtcggtatcaaatcacgggaagtttacgaagcaccagctgccgaagttctgatcaaggcgcataaagctttggaagatttgacctttgaacgtgatttagcacatttcaagccaacgattgaattacaattgacgaacaccatttataatggcttgtggttctcaccactatttagttctttattggcgttcttgaagacgtcacaacaggttgtgactggtacgatccgggttaaattatttaaaggcaacgcaactgttgaaggtcggaagtcaccatattcgttgtacgacaaagatttggcaacttacacttcgtcagatacattcgatcatgtttccgcagttggtttcatcaaactttggggtctaccaacacaagtttatacacaagtgcaggacaaagttaacggcgaacaggcaaaggagtagtttatggcagaaaatcatcaattatggggcggtcgtttcaccgcagaaccaagtgaatacgtccaaagctttggtgcatcgatccattttgatcaaaaaatggcggctgaggatctgcacggctcattagcacacgttgcaatgttgaaacacaccggcattttaaagggcgacgaagctgatcaaatcacggctggcttgcacactttgcaggaaaaattagccgccggtgaattgcattttacgattgaaaatgaagacattcatttaaatcttgaaagtctgttgactgcggagattgggcctgtagccggtaaattgcataccgcacggagtcggaacgatcaagttgcaactgatatgcatttatatttaaaaaatcatttgcacacgattctgcaattagtcgttgaattgcagaaggtcgtcgtgaataaggcagatcagcacgtggaaacattgatgccgggctatacccacatgcagcatgcccaaccgatctcttatgcccattatttaatggcctattatgaaatgttgcaacgtgactacgatcgctttgaatttaacttaaagcacaccgatcgttcgccattaggggcggcagctttagccgggacaacatttccaattgatcgtgagtacagcgctgagcaattaggttttacggatgtctaccagaatagtttggatgcggtcagcgaccgtgactttattctggagtttctcagtaactgtgcgcaattgatgatgcacctttctcgtttctgtgaagagatcattctgtgggatacccaagaatttcagtatttggagttatctgacacgtattctactggtagttcgatcatgccgcaaaagaagaatccagatatggctgagttgatccggggtaaaaccggccgtgtttatggtgatctgatgggcctgttgaccgtgatgaaaggtttaccgttggcgtataacaaggatttccaagaagacaaagaaggcatgttcgacgcggtcgatacggttgaacaatcgttgactgttttccgggggatgctggatactttgacagtaaaaactgacaatttggcgcacgctactagtcacgatttttccaacgcgactgagttagccgattatttggctagcaaagggttaccattccggcaggcacatgagctagtcggtgagttagttttgaaatgtattcaagaacataaatacttgaaggatgtttcattagccgattatcaggcattgtcaccattgatcgcggtggatgtttatcaagcactagatccacggacagccgtcgcgcggcgtaattcgctgggtggtactggttttgatcaaatcaaaaaacaaattgcagccgcgaaagctgctttgcaataagctttaattaaacgtcacgcttaagtggcgtttttttttgcgccgcaaaaaaagtgtaatttaagcgctttttaatctaattaagttataataaaaatagataaataaataggtaattgctggtttgagctactgctaaaacgttgggaggcgttcaggtatgaagtatcaagcaaggctattaagcactggttcttggctctgtggttgtttagtgattatgttaatggccgcgaacccggttgtaccagaagcatcgatgttcaatggaactggaatgtggcttgcattatgtgtgtttactggattatacattttgccaatgctaggtaagttgatcaaaattgattacggatattatttattgacggggtggttggcaatcaacttgttgctatttattgttgccggcgtaccggtagtatttagcgtgggtgcactgggtttacgtctattattgggtgtgacggcgctattagggctgatcgatttaatgttttggttaccgcaggcgttagtgcctgaacgaccgctacaagagacttaatgatggggaataaaagctgtgctactgggcacagcttttttaatcggtataaaactagtaatgatacacccggtatgttacactaatttagatacgaaagtgagacactagggggcgttgccataatggcggcgttagctaaatgtaaaatagcaccagattttttgcgactatattgtgccgtaaaataatcagtacccggaataatagccgtttattcgcaaaaaaatacgagtaaacttaaccttaatcgtgtaatcatgcggaaaagcatggttcagcacagctctagaaaggaatttgaaaatggtagatactttaaatttagttgtgatcactggcatgagtggcgctggtaaaacagttgccatgcaaagcttcgaagatctcggctatttctgtgttgataacatgccacctagcttgttaccgaagttttgggaattagtcaaagaatcaggtaaagttaccaaaatcgcactagttatcgatttacgttcacgtgcgttttacgatgaaatagatgaaatgctggctaatttggataacactaattttgttacaaccaagatcctctttttagatgcttctaatgaagagttggtttcgcgttacaaagaaacacggcgcgctcatccattagcaatggaaggccgtttattagatggtatcgtcaaggaacggaatttgttggctgagatcaaaaatcggtcacaattgatcattgatacgactgaattgacgccacggcaactgcgtgaggagatttttaataactttaaatccgcagaaaccacgacgttccatattgaagtgatgtcgtttggctttaagtatggtgtgccgatcgatgcggatattgtgatggatgttcgtttcttgcctaatccatattatgtgcctgagtttaaaaagttaactggcttgaatcaggctgtttatgattacgttatgcaacaaccggctacggaagacttctatgaacggtttagcagtatgctacatctcatcatgcctggctatgaaaaagaaggtaaaacgagtttaacgatcgcaatcggctgtactggtgggcaacatcgttcagttgcgttggcggaacgattaggtaaggatctggggcaacactatccggttgacacgacccatcgcgatatgaataagcggaaggagactgtgaatcgctcatgacaagatcgcccagaaattatcgacggccgaagatggttgtcatcggcggtggcactggcttaccggttattttaaaaagtttgcataagcagaatactgatattacggctgtggtgactgtggctgatgacggtggttcgtcaggcgccattcggaattacgttaacgtggttccacctggtgatatccgtaatgtcttggtggcattatctaatttaccgcaactttatttggatatttttcaatatcgtttcaatagtgatgattcatttttagccggtcatgcgatcggtaatttgatcattgcggcgttatccgaaatgcgctcaggtatttttggtgcggtccaagagttgtcaaacatgatggagatcgatggccatgtttatccggccagtgatgatccattggtattaaacgcgcattttagtgatggtactgaacttgctggagaagcagaaattacagctgccggtaaaagtattgatcgtgtgtgggtcaccccagcagatccgactcatgctgcgccgcaagcagtagatgaagtcattgcggcgattatggacgccgacacagtggtgttagggccggggagcttgttcaccagcattttgcccaacttaatgatcagtaacgtcggggaggcagtgcgccaaaccaaggctgatgtaacttatgtctgcaatatcatgacgcaaaaaggtgagacggagcattttactgatgctgatcacgttcgtgttttggctaaacatttaggtagtcaattcgttaatacggtattggtcaatactgaaccagttccacctaactatatggatcatcaaaaatatgatgagtacttagttcaagttgaacacgattttaagggcttgcgcgaacttggttgtcgcgtgatctcagataatttcttgtcgctccacgatcgtggtgtctttcatgatggcgataaagtggcacaagaattattgcatttagcctttcaaccacacgattaattagaaagtaggtggcggatttggggtcatatgctagtgaagttaagaaagaactcaccacgctggaggtccaccgtgaacacgcacgcgctgaattagaagctttaattcggatgaatggttcattaagtattgccaatcatcaatttgttttaaacgtgcaaacagaaaatccagcaattgctcgccgcatttacgccttgttgcgtgataattattcaattgaagctgagttattggttcggcgtaaaatgaaattaaaaaagaataatctttacattgtccgcttaaaacatggcagtacattagtgctcaatgatctgcatattttaactggtgcatcgacgttatcaaccttaccttctacagaagttaaggagtccgaccagaaaatgcgttcatatttacgtggggcctttctagctggtggttccgttaataatcctgaaacgagtcgctatcatttggagatctattcattatatgaggaacataatctacagattgccgcgatgatcaaccagtttggaatgaatgctcgggtgaccgaacgtcgtggcggctatatcgtttacttaaaggaaggcgagaagatcgctgatttcctacagctgatcggtgcgactagtgcgatgctgaaatttgaagatatccgaatcgttcgtgatatgcgtaattcggtgaatcgcttagttaactgtgaaactgccaatttgaataaaacgatcgatgcggcgacgcatcaagtggagaatattaagtttattgaacaggtcgcgggcttagatagcctgccgcaaaagttgcaagaaattgctattttacgtttagctaatcctgatattacgttaaaagaattaggtgagcgggttcctagtggcgcaatctctaagtcaggaatcaaccaccgcttacgtaaattaatgcaaattgccgataatttacgggcgggtaaagtcacttcgtaagctgaaaaagccgatcaaactattttggtactgtgccctgtcaagtttacacattaaataataaaaattagttggctttgccaaaacggtattccgctgcggtaaggtcatttctcttcgctgagataaatttttcagtgaaataggtaattc

SEQ ID NO: 587 - DNA, 63104 bp, Unknown
  Metagenome-assembled genome
aaaaagatgctgtagtgggtggattttttaggtgcgaggcttatgggccttttttattttgcactaaaaaatcctgctaatagattaccatgttaagtaagctatcaacaggaaaaagtatagaaccgctttttcaatacactgcaattttgcagtgtattttttttgcaaaaattttagtggttagactgcgtatattaaatatagacaagtaaaaatggaggtgagtgcttgtcaattacaacagaagtaacccatttattgcgtgaatgtattgttgcacaggcaagtgatttatattttttaccctatcagcgctcgtatcagttacaaatgcgcaccactaatggcattaccttgattcgtactttacctgttgagcaagctaaatcgtggctaaatcatttgaaatttaccgcaaaaatggcgttaagtgaaactcgtcggccacagttaggcgctcgccaattggaaatagacggccaaacaatatttttgcggttatcgacagtcggtaattttcagaatcaagaatcactagttttacggtttatttacgtgcagtctactcacgccaaatacgttttacctgaacagtttatgcaactagccactttatgccagcggcgtggcttagttgtttttgctgggccaacgggttcgggtaaaacaacgacgttatatgagttagcggcacaacttggtgttggaaaaatggtgatggcgatcgaggatccaattgagatttttcagacggattttttacaattacagatcaacgaagcagctgggatgagctatgctgccttgcttaaagttggtttgcgccatcgtccagatatcttgattgtcggcgagattcgtgatgagcagacggctaatgttgcggcacgggcagcattaagtggtcatttagttttaagcaccgttcatgctcgcacagcgcgccaagtcccaacccgtttggctgaattaggaattgcgccagccacacttagtgcttgcttgacgggggttagctatcagcgtttgttgccgaccaagcaaggtaatgcagtgttatttgacatttacgatccaattgaaggaggcgagtctgatgaatcgacttggcagcagaatctggcccatgccgttaagctgggtcaaatcgatttggccacgcagcaagcgttcgctcaagggtaaacagcgtcaagtcaatttccaagcggacttttttagtttattagcggatttattgttagctggcttttcaattgctcagagtattcagtttatgcaagtactgctaccacaatatgcggagcgcttagatcaattaagtgaagtcttacgtaacggcgctagtttagcgactggatttcagcagatcggtattgatcaagaaatcgtcaatcagattcgaatcacgcaagaacatggtgatctaactgacgctttaacccagattggacaattattagctgaaaagctacgtcagcgtcagcagctcaaacgacttttgcgctatccactactattactatcgttggtagctagtttattgttagtagttcgctatttgattgggcccgaattacgccagtggcaactgaacttagataatgaagtgttgctttattggttagcttttggcggtttattaatactgctattgttggtgttagcaggtcgtttattgcaggtttatttacaacgtgatccgttaaaaaaagcacaagctcgaattcatttaccagtactaggtaagacctatcgctattactatcactattatttattattcaatttggcgattttactaaaaagcggcttgaatctacaggcgatttgccagttacttaaaacgctagcgccaaatagtctgttatattgtcttggccaacaaattgagccgcagttggaggctggtgtgtcgttgaacgaaattattagacagcaaccaatactgccagcacaacttgatttatttgtccgcaaaggtcgttccctagatcatctcagtgaagagctgctgatggcatcgcgcttgacctataagaaaatgttagcaagtttggctaagcttgcgacttatgttcagccgttattattcggcatcatcgctttactgatcattggagtttacttgagtttattattaccgatgtaccatatgatggagggactttactaatgaaaattgatagtcagaaaaagccggcatttacgttgattgaaatggtagttgtactgtttattattactctgctgattttaataattttaccaaatgttggggcacaacgtaaaaatgcgcaaaagacaggtgatgaagcgtttgtcaatacagttgaaacccagcgtgagttgtatcgtaatgctcatgatgataaaacacctagcttgactgaattaaaggagcaaggctatttaactgagcggcaatttaaacgagcacaagaacttccggaattaaagccatgaaacgaccagcattcaccttattagaatcaatcgtcgtgcttagtttagtcgttggttttgcactgattccagtgactcaattcggtccgatcaagcagcaacatgctgaacaactttttctgagccattttgatcaggagtggcgttatttgcaagcttacgccttgttgcgtggtgagcgagtacagatccatgtgcagcgacaacaggtcgtttttcgtatttttagtggccaagattgggcaacacaaaaaatattggctatgccaccggggatgcacgcagatggtcatgccattttaatcgatccttctgggcatatcggaccgacaacgattaattttaagtcagaatattttcaccgagtgaccagcattaaaccgcaaatggggtggggaacttatgaataaaccacgggcatttatcttattagaaagtttatgtgcattagtggttgtaacgattggtatttatgcgtttaattcaacgtttcagcagtttattggcaagttacgttggcaaaggcaggcgactgatcaggcacaggttttatgggccacagctcaacataagcagtacaaaactggtttgtcgcaattacaaatgaatgatcgagtttatcatattcaacaacaatcgcataaaatccgtgttgaccaaggagttcatcatgcagagatcacttggtaagccgcatgcggcttttacattattagaaacccttgtcgcattactggtattcagtttgacgctcagtttaatacaaacagaattaaagcagttacctaaagtgttgaccggtactttcgttgaagaagatattcgctggcatttagcgagccaacaggtggaggcttttttaactggggcaacttttgagaaatgtgaacataacaaagtttatttttatcaaccggctaaccaaaaacattatcgaattgaaccatataaacagatgattcgactgatgggagataaacaagggcatatgccggtattattaggaatcaaagcagcaacgtttaattatcacgcaccttttatacaattaacggccactacgactagtggtcaacactatcagagtgaattttatttagcaccgatggagaaacagccatgaaaagaaaacccgcaagtttattattatcagcgtgcttattcttgagcttactattattacttttacaaggttacttacacgtttatgaacgacaaatgcgcaccttacaattagcagaagaaaattatcaggttaagagtttgattgcattggcacaaatgcgaaaagcacaaggtgaagactgtgattggtatatgtttaatttaggacgtgttcatttagataaaacgcatgcaaggattaaattaaagatacgaacaaagacgattgttaagccgatagcagaatgaataagttgatttgttcacgctatcacgcaaagaaagcgcttgaaataaaacgacgtattggttagaatagtaaagtgaacaattttatttgaggtgaaaaaatgggacaagcagatgttggtgaattgtacaagcaccttgatacaacgaccgcattgttaaaagaagatctagatgtgtcctatatggatgccttaatcgagaccagtgaaaatattttagatggtggccgcgtcaaagttgaagatggcttaccgcaccagcaggttcgtgaccagttgagtgaacagtataaccagattaaattggcacagctaacaactgatgagatacgccaagcaatgcaactcgcaattttacggggtgaacggacagatttaattcaagctaatcatcaaatgacacccgattcaattggctttttagtagcatatttactagaagcgctagctgacttgccgtctgatgccactttattggatccaactgtggggacagggaacttgttgtatacggttttgaatcggctacaagttgctgacgagccagctttaactgcttatggcgttgataatgatgatacaatgttagctttagcgggcgttagtgcgcgtttacagcagcttaatgttgaattgtaccatcaagatgcgattagtgatttggttgttccgcaggtatctgcaagtgtagctgatctgccgattggctactatccggtagatgaacgggcggcaacttttgcgactcatgcggcaaccggtcactcttatgcgcatcatttattgatcgagcaaagtatgcggtatactgtagccggtggttttggtttctttgtggtaccaagcatgatttttaagtcagaagaagccaaaggtctgacaaagtggatgacttctgcaacgtatatgcaggggctactgaatttaccacgagaattatttagtagcgaggctgcccagaaagcaattctaattttacagaataagggcgagcaggccaaacaggctaagcggattttacttggtgaatttccttcattgaaggatcaagctggtttccgacgctttaccgctgagttagcgcaatggaaacaacaaaaccttgcctaaagcgcaataaaattgtggtgacagtatatgctgagaagttcagcaagtctaagtcgcggcacgtgtaacatcagagtttttgatatagaagtaaccattatttgttgagtagaggagtgttcgtcatgacaaaagtaattgcaattaacgcaggtagttcaagtttgaaatggaagttatttgagacgccagcggagaccgttgtcgctgaaggcatggtcgatcgggtcggtttaaaggattcagtcttcacagctaagtatggccctgatgaaaaggagcgttttaaggcaaccttggatatcaaagatcaaactgcagctgttgacatgctattgaagaagttgactgatttaaaaattgtcactgatattgctgaaattactggtgtcggtcatcgggtcgttgctggcggtgagatttttaaagaatcaactgtgatcaatgacgaagttatccagcagatcgatgacttagcagaatatgcaccattgcataatccagccgagttacaggggattaaggcgttctgtaagttactgcctaatgctttgagtgttgcggtatttgatacttccttccatcaaacgatgccagcagttaattacttgtacagcattccctatgaatattatgaaaaatacggtgcgcgtaagtatggtgctcacggtaccagtcaccgttatgttgctacacgagcagccgaaattttaggtaagccattaaatgaacttaagctgattaccttgcacttaggcgctggtgcttcgattacggccattgatgggggaaagtcaatcgatacctcaatgggcttcacaccactggctggggtcacaatggcgacccgttcaggggatattgatgcgtcgttagtcgcttatttaatgcagaaattacatctgtctgatccagaagatatgattgatattttaaacaataagtccggtatctttggtatttccggtgtttctccggatatgcgtgatttggagaagacacgtgatactaatccgcgttcgcaattgggtatcgatattttcgttaatcggattcaaaaatatattggcagttatgttgcagaaatgggtggtactgacgccttgatctttactgctggtattggtgagaatgatgtgatcatgcgtaagcggatcattgatggactaagctattttggtgctaaaatcgatgacgaacgcaacaatgtccatggggttgagaaaatcatcagcacggatgattcaaaattaaaggtcttgttagttccaactgatgaggaattaatgatcgtacgtgatgttgagcgtttacggcgcgaacagtaataaattaaggatttggtcgctgttttaagaccaagtccttttttataatgttaaaggtcccaaataactgtccaaactattattagacgtttttgattagtgtcatttgttcacgataaattagctgagtgaaataaattcactttaatttgaataagtttcagtcgcttcaccttagaaataaagatttctgatgttataatcaatcttgttacagaaaatttatttagtctgataggagtaaattatgacacggaaagcaattgatgcaccacaagaattagaacgtaaccttaaaagtcgccatgtacaattgattgcgattggtggcacgatcggaacgggcctattcttgggtgcgggtaagtcgatccatttagctgggccagcaattatctttgcgtatttgctgacggggcttgcttgtttcttattgatgcgttcgctaggcgagttactgttatcggatcttaaattaaattcatttgttgattttattaagcgttatttaggtgaaaaagtcggcttcgtgactggttggacctattggatctgttggatcacgattgcgatggctgacgtcacggcaattgggctatatatgcgtttttggtttcctaatttaccacagtggttacctggattagtggtgttgatcatattgttaggggttaacttagtaacggtcggcgcttttggtgaagtagagttttggtttgctttgattaaaattgtggcgatcgttgctttgatcgttgccggaatctttatggtgattgttggttttcaaacaccagttggaacggccagcgtcggtaatttagttaactttggtggggtctttcccaccggtttaaaggggttcattctctcattccaaatggtcgtttttgggtttatcgggatcgagatggtggggatcacggctactgaaaccgaaaatcccaaaaaggttattcctaaggcaatcaacgatattcctttgcggatcattttattttatgttggcgcgctgacggtaattatgtgtatttatccgtggaatgatttgtcggcttcgcaaagcccatttgtgcaagtatttaaaaatgtaggtattcgttcagctgctggaatcattaattttgtggtgatcactgctgcggcttctgcctgcaatagctcgttgttcagtactggccgaatgttgttctcactgacttacgatagtaaaaatccgcggttgcgcaaattaagcaagttgtcgcgtagccatgtgccagcgacagcattattattttcaacggcaatcatcgctattgtggtgttattgaatttatggattcctgacgttgtgtttacgctagtttctagtgtcgcaacgacctgcttcttgttcatttggggcgcaattattgtcgctcatatacgctataaaagaacagcagccgcgcagaacagccaatttaaggcaccacttttccccttaggtgattactttgtgttagctttcttgctatttgtggcggtggttctatgtttagctcaggatacgttgattgcgctagtcttggcactggtttggatcatcggtttatatgcatttagatcatggcacgagcatcgcgttgaagttgaagcgtaattcttgttttcgaccactgcaaattgcggtggtctttttttaaccttcatttaagttagactgcgtaaaatgcagcttaatgaagttaaggagatgagaaccatgaattatttaaagcgcgcgcgactatatttgacccataagaaagggcagagtttattgatgctcttgatcatgtcggccattttagtttttgttctatcaggtattattattcaaaatgcggcgatcacggcgactaacaatgtcactaagtccgctggctcaacaatcacggtttcggctaaccggaataaaatgttttcgcaaatgcggtcaagttccgcgaaaaccaaaacgctaaagacgccaaccgttgctaacactaaaattgctaaagccggtaaacttagcacggtcgcatactataacattaccaataccgcttcggtcaatgccagttcatttgatgccatttccaccagtactggcaccagcagtatgggtggcggcatgggtggcccaggtggcggaactaatgctagcagtggtgatatctcgcttagtggggtttccagtacagcccacaccacaacatttaccagtggcgaagctaaattagtttctggtcgcaatatcacagccagtgacgcgaatacgaaaaatgtggtgatcgaaaaagaactggccagtgataacagcatcaaagtcggtgatacgatcaccgttaaaaccacagcgactaacgccacgaagatcaaattaaaagtagtcgggatttacaaggcgaagtccagcagcacgaccatgcccggcagtgaccctagcaatactatctacactagttacactttaccagccagtatcagtggtacggccggtaaatcaagttcagtcacttatacactggaggattcctctaaagaaaaagagaccacgaaacagatcaaaaatattattgacagcagttcattctctgtcagctccaataatgaaagttatcaacaattactacaacccatgaaaaacgtgcaatcttttgctaagaaaatcgtttggttagttgccattgccggaacgatcattttaggcttgattattattttatcggtgcgtaatcggcaacgtgagatcggcgttttagtttcactaggcgagtcgaaattgcatattgttggtcaattattcactgagatgtttatgattttagtcggtgctatggtcgtcgcgttattgctaggtagtttcgtcggtaataaagtcggtaatcagttgctatcacaacaacaaacgacctctgtttcttcgacctcagctagcggtgctcctggtggcggtggtgccccaagtggcaacatgccaggcggtggaatgcatggtggcggtatgatgaattcacagacaaccactagtgcagctaacaagaaagccttaaaaacattgaataccagcattacaccaagttcagtcattaaacttggtggcatgggcctagtgatcatcgcgctagctgtttgcctctccgcggtcagcattttacgcttacggccaaaggatattttgatcggtgaataaattggatcatatttctataacaacaaaagagtgagaatagggaggctgtaatatgttaaccgtaaaaaatttggcccattggtatggtaaaagtgggaaaccactatacgaaaacgtgaatcttagttttgagtccgacaaagtttatacgatcatcggtgcttctggttcaggtaaaacgacttttctagcttttatcgctggtttagacaaaccgcaggccggggagatctttcttgatggtgaaaacattgaaaaaattggcgccactaattaccgtaaacataaagtggccatcgtctttcagcaatacaatctattagtctatatgtcagcgctggacaacgttttgactgcattggcggtcactgattctgagcataaaaatgataaacaatatgtacttgatgcactaaaaagcgttggtattgacgaagctgatgccaagaaaaatgtgcaacaactgtctggtggtcaacaacagcgaatagcgattattcgtgcaatgttagttgatgcgaatatcgtgatcgctgacgaacctaccggtaatttggatgatgaaaattcagcgatgatcattaagttatttcaagatctagcccatgagcatcataaaactgtgatcattgttacccatgatactaaaatcgcccaaaaaggtgatgttcagatcaaattagctgatcaccagtttgtggctagctaagcaaataaaagggttaggtagtgcccattttatggctatgacctaacctttttaatataaaaaagtagccgctaaaacccaattggattttagtggctacttttattttatggaggcggcgggagtcgaacccgcgtccaagcatattgcctctaagatatctacgctcatagtcatcctatttcgaaattcacctaacacaaacgccagacaacacggcaaccagcattaggctaacctgatgatctcttgtaaaaactccaggtggaagtctttaccgtagcccacttaatttgagacccgtatccagcacatgggcgatactaggcggatctacgcagctactgtttaggcagctaaagcgtaagagttgttattgttttttgcagttatattaactgttaacgttttaacgtagtcgtaacctacgaagcgcaatcttagctcaaactacacctgtcgaatcctaaacgtccccatatattactttcatagtataacatcgatttggttaggcgccaagtggtttgatcagaacacttcaccggtaaatggcttctctggcaacgtgacaaaatttaattcacgcagttcagcgagttgatgacaataataggtcaggccttgtgcgatcatcaaattcactctttgatgattttcataataaaccaacacggggatcttgttagcaactgcgtagccaatctcgaacatcgttccaggatcgctgtaagttgcttcgtaatcgtaaacagcaacgacgacatcggcattagttaaaccagctagatcttcatggtacgcaaggtcacgccactgcggagtgccgaattctaatcctgcagcgttggtgtcattcataggaacgaaaacattgccgacactaggattagcgtttaagactttttcgaccgcctgtaaacgctggatttgttcatcattgaaaaaaggtgctgctagatagatattagctgccacgataaattgcccctaactgaattaatagtgtcattattatacgttaaacgcgaataaagttcaattttaaatctgcttcattcggttacgcacaagcgcgtaatcaactgtacaatttttgtagcgtgcaggttaattcaataattacgattattaattaaaattttaaggttaattttagctaggataggtaaaatagatgttacgaattaaattagatgatgaaaaggtgactggtttgaagcgagcacaacaacgacgtaaaaagcaattaatgactctgagaatagcggagatcatgctgctgatcttaatttgtggtgcaatttggctaggcatccggcactttacgcaacctaaggtcactaagatgatcactgtaacagcaccagcattaatcatacgtcaagcacctaattcgagcaaagcggtggcgacagtgaaaagtggcactgaagtcggctatctgagcaccaaaaatggttgggataaggtcagctatgatggcaaagttggttggctaccagcttggttgatcaagagtacttatgatgctactaaagcaactaaccgtttagctgagcaaacgatcgtgatcgatgctggtcatggcggcgttgattcaggagcattagctaataatggtaactacgagaaaaaatatactttgcaaatggcattggctctgaaaaatcaactgacagcaagtcatgcccgcgtgatcatgactcgtagtggcgatcaaacagtagccttggcatcgcggcctaagttagctaataagcgtggtgcgagcctatttatcagtttccattttgattcaacgccagttgcgaacacggcttctggattcacgacttattactatcataaagctagtaaatcgttggccaggacattatcgcagtcgctgaatccattgacattagataatcggggaatcgattatggtaatttccaagttattcgcgatagcaccatgccagcagtgttattagaaatgggctacattaatgattacactgattaccaatatattagttccagcagttatcaacaacaggtcgcacagttagtttataaagggttagaaaattacacaactaattaaattaataaaagctttgaaaaatgcatcccatttttcaaagcttttttagtctaaaggttgttttagttgtttgatcagattctgttggaggtgtgattgtaactggtttttacgataggctagtgaaattaaaaattgtggttggtgggcatcagctagctctaatgcgatcacattatctgcaggtgaaatggcgagtgccgctaaaaagccaataccgatattttcggcgaccatgcttttgagtacgctgatgtctggtgtcgtataggcgacattttgggtgaaacccgcagtctgcgctaattcacgtaaggcagccgggtgaacaaaaccttcttttagggtgacaaatttttcatcggctaattctgcgaacgcgacttttttggcattagctagcggatgagtggggctaacgataattttaaacgtctgttgagctagaatttcggcattgatcaattgatcagtcagcggcgtggtcgaaccaagtaaggcaagatcaagttcgccggtacgtagttgatccaataatgtagttgaacctgcttccatagtatttaaatggctgatcagatcatgttgcgctaagcgctgtgctaatttaggaaaataatacgtaccgataattgggggtaagccaaatttaactgtttgctgagtgctggccgcaatctcggtggcggctaattttaattcgtgcagaataattgtgacgtgttgctcaagttggcgaccattagcggttaattcgatttggtgatgcgagcgatcacgaatcaatagctgtgtattcaattcgtcttctaggcgtttgatcgcgtaagtgatcgttggttggcttacgttaaattgttgcgcgacggcggtatagtttttcagcgtcgccaaagcgtcaaaataagttaaatcacggaaattcatagtggcctccttattttacaatggtagttaatttttgtaccaaagatttctaccgatgattatttttatggttaaagatcgcgtcgtaaaaaaatattagcaaaatttttataaccaatcgtaggctcaatttgtggcctagtttaaaatactgatttatcaagctttattgtgatcatataaatatagtttatcacaacccaactgtttgactataatatttgctgccgtgtaaactgtgattattcacttatttaaaagaagtatttagaaaatactgtcttccaaataagcttaagtagtaaaaatcttgatataaaaatgcgcgatttaattatggcgcaggaggagcgattttaaatgacaacaccacaaaatattttaaatgatccattcttaaataaagggactgcttttacagtagctgaacggcaagcacttggtttaacgggtttggttccaccagtggtccaaactttagagcagcaagcagaacagacttacgggcaataccaatcaaaatcatccgaccttgaaaaacgcttgttcttgatggaaatcttcaatactaaccgcgttttgttctataaattattcagccagcacgtagttgaatttatgccgatcgtttatgatccaacgattgccgatacgattgaaaattacagtgaactttatgttcagtcacaaggcgctgcatttttatcgatcgatgaagacgatgcaacaatcaaagaaactttgcgtaatgctgcagcagggcgcgatattaaattgatcgtggttactgatgcagaaggtattctgggtattggcgattggggtaccaacggtgttgatattgcggtcggtaaattaatggtttataccgctgctgctggaatcgatcctagctcagtactaccagttgtgttagatgctggtactaataaccaaactttattagatgatccattgtatttaggtaatcgacatgaacgtgttcgcggtcaacgttacgatgattttgttgatcattttgtagacgccgccgaagatctattcccagaattgtacttgcattgggaagactttggtcgtagtaatgccgctaacattctgaatcgttaccaagataagatcacgactttcaatgatgatattcaaggaacagggatcattgttttggccggtattttaggtgctttgcagatttctaaacaaaaattcactgatcaagtttacttgtcatttggcgccggaactgcgggtgctgggatcacccaacgaatttttgatgaaatggttgaacaaggcctcacacctgatgaagcgcgcaagcatttttatttagttgataagcaagggctattgtttgctgacgacccaactttgacaccagaacagaaattattcgctcgtgatcgtgctgaattcagtaatgctgccgaattaactaatttagccgcagtggttaaagccgttcagccaactattttggtgggaacttcgacgcagccaggtgcctttaccgaagcaatcgtaaaggaaatggcggctcatactgcacggccaatcatcttcccattatctaatccaactaaattagctgaagccaaagcggctgacttaattgaatggactaacggccaagccttggtcgcaacggggattcctgctgctgatgtcacttacaacggtgtgacttaccaaatcggtcaagccaataatgccttggtttatcctggtttaggtttaggcacattagccgcgactgcaacgcgcttaaatgatacgatgatttccgcagcagcgcactcattaggtggcattgtggatgctagccaaccaggtgcagctgtattaccaccagtttctaaattagctgaattttcacaaactgttgccgaagcagttgctagtagcgctgtcgcacaacaattaaatcgtgaaccaatcagtgatgtaaccgcagcagtaacaaacttaaaatgggtgcctgaatataaatagatcaaatcgatcagtgcccgtttttaatagcagtgatcagtaaaaagctttggacaaaaattaaccttttaagcgaggtatagtggggtgctaacatgactgcatttatgacgtcagtcgaaagtgttgtcgaaattattttagtgattgcgttaggtttttacctgcgtaagaaaaataaatttgatgaaaagtttaaaacaagtatttcctttttgatcatgaatattgcgttaccagcttcaatctttgtttccgtcttaaaatatttaacacgggataaattagttagcttatctggtggcctattgtatgcacttggtagctttgcgttaggctatttagtagcatggctgttaacgaagattttacggatccggccaggacggcggggcacgtttatcaatatgtttgttaacgctaatacgattttcattgggttaccattaaacttagcgttgtttggtgaaaagagtatgccatacttcctgatttattatgtcatgaatactgtttccacctgggcagttggtgtcttctttatctcaaatgatgatccaactaaagataagagccacaaggaaccatttaactggcggaagttattgccagcgccattgattggtttcttggttgccttggtattcttattgttggccattccagtaccagcttggatcaatagtactttatcaatggttggtggtatcgtaactccaatgtccttgatttatattgggatcgttctagcggatgctggtttagcttccattcattttgatggtgacacgatttgggcattattaggtcgtttcatcattgccccagcattgatgatcttaatgttagtcatcggtaaaagtggcggtgcacaagttcctagcttggaatcaagtactttgatcatccaagctgcagcaccaggcttagcagtattaccaattttagcgggccaatcacatggtgacgttgagtacgcaactaatgttgttactacaagtacactcctctttgtgatcgttgtgccaattttgatgcaattagtacaatttatttaaatccgaaaatcgccgtttagcggcgatttttttgttttctgcagcaagaggattcttagaaaaattgacactgaataagagatgcattagaattaaatggctaaacaatgaaattgacgagggtatcgtaagtggtcaaaagccagcacaacgggtgtggttgcgtaaaagcgatacttcgccatttttttgtgagtgacaggaggaaattaatattgaagtttacattaaagaatttatttgtccgcaagcacattgaccttaatgcaatcacggactccaagcaaggtttggagaagaacctgtcagcgtttagcctaagcatgatgggtgtcggtgccattgttggttcaggaatcttcatcttgccgggaatcttagctgcacaatacacaggtccaggagtcatgttttctttcttattagcagcggtggtttgttcattggcggcgctttgttattctgaattctcgtcgacgattccgttggcgggaagtgcctatacttatatttatagtatttttggtgagtttttagcctggatcttaggctgggccttgatttctgaatatttgtttgcggtctcgtcagtagcggtcagttggtccgcatatttccaaaatattttatctggttttggcttggaattaccagtggcactaacggcagctgccggaaccagtagcgtgccgggtgcggtttttaatttaccagcgttcatcattgtattattgatcgcattgttgttgactggtggaattactgaatcaactcgcgtcaataatgtgatggtgttgatcaaaatttcagtgatcgttttgttcgtggtagttggcgctttttatgtcaaaccttccaactggcatccgttcttgccatttggtttccatggggttctaaccggtgcttcggtagcattctatgcctatatcggctttgatgccgtttcaacagcttcggaagaggttaaaaatccgcagcgggatatgccgattgggatcataacatcgctaattattacgacactgttatacactgtgctatcaacggttttaactggggtcgtccattatacgaaattaaatgtcgatgatccagtggcttttgccttaggtttgatgaatcaaaattgggtcgctgggattatttctgttggggcagttgtagggatgacgactgtgttattggttatgtcctacgggggaacccggttgttatttgctatcagtcgtgatggcttattacctaaagcgttaatgaaattgaaccgtaaaacgcacgtgccagtattgaatacttggatctttggtttaattgccgcggtttttgctgcgattattccgttggatcgcatcgctgagctggtcaatatcgggacactgtttgcctttgccttagtctcggttggcgttgttttcttacggaaggataaagtgcttggtaatgcaccgaagtcgtttaaggtaccgttatatccatacttgccgtggttatcatttatcttttgtattgttttaatgacacaattgcggctattcacctgggttgcttttgtgatctggttgattattgggttgattgtttactttagttacggttattggcatagtttaacgcgccaagaagaggaataagcaaaagtcgctgacactagttggcggcttttttgctgcacagcagaatatgttataataacaattcgaattaacgcctagcaaaattgaccaaatttcttaataaaatttcaagttcatggcagataacttgtttatggacgaacagctcattataattaatctgtttggaatcaattgctagaagaggtagctttaaattgcggccagtcgtgcggcaatcatttaaataaaatttcagtaccaccaaaattataaatagtattaaaaatgaaaaggggttccccaatgtccaactatgtaaccattgcggccagtgcacagtatgtacctgatcgagtcgtgaccaatgatgagttgagtcaactgatgccaaccagtgatgaatggatccaaagccatactggaatcaagacacgccatattgcgctggatcagaatacatcggttttagctagtcgtgttgcggcggagttattaactaaaagcggtgtggcggcaagtgagatcgacttgatcattgtgtccacaatcacacctgattatttaacgccggcaacagcttgtttagttcaggaacagatcggcgccaccaacgcgatggcgtttgatattagtgctgcttgtgcgggctttatttttgcggctgacacagcagagaagttcttacgtcaaggaaagtttaagcatgccttggtgatcagtgctgaaactaacagtaagatgttggactggcaggaccgtacgaccgcagttttctttggtgatggtgccggtggggcattgttatcagcgacggatgatccgcaagcggaaagctttcttgatagtttattacaaaatgatggtagtcaacatgaggcaattatgagtggcgccgttgcacccttgaatacaattcaagccgtgcataaaccagagatcgagccattcacgatgcaaggacgcgctgtttttgaatttgcgactaaaacagtgccacaacagatcaatgcgctattagcggccaatcaattaacggtggatgatattgatttattcatttgtcatcaggccaatctgcgcattattgaaaaaattgctgcaacgttagaacagccgatgagtaagtttccaaccaatgttcagcgttttgggaatacgtcatccgctggtgtgccgatggctttagctgaggttcaaccgcaagcaaccggtaaattggcagtattgtccggatttggcggcggtttagcctatggtagtttattagtcagactttaagagctaacttgttttgagactaattaactactttaagagtagaggaggatttggggatggacgcaaaaaaagttgctgatttattggcggtgttagcaaaaagtgaatttgctgagatcgagctaaaagatgcggatttgtatttacatgttaaacgtgatgctgcaccgcaagttagtcccactgtggcaacaaaatctgagccagtagctaagggtaaaacggtcaatagtccaatggtcggcatcgtgcatttattagatgatacgaagcagccttttgttaaattgggtcaacgagtggatactgaaaccacactggcacaaattgaaagtatgaaattgtttaatgatattaaaagcccggtgacgggtacggttacggcaatcaatgttagtgatggacaaggcgttgagtttgccacgccactatttgaaatttctgaggctgactaatgttcaaaaaaattctgattgcaaatcgcggcgaagtggcgttgcgtatcatacaagcttgtcgacaattgaatattgcaaccgttgctgtttacgctaaagtggaacagcacagtttatttgtgcaacaagcagatgaagcttactgcgttggtcctgacaccgcaccttccagttatttgaatcgcgaaggaattttgatggcagcattattaagtggtgctgatgcgatccatcctgggtatggttttctagcagaggatgcgttgtttgctaaaatgtgtgctgagtgtggtctgacctttattggtccgcagccggaaacaatcgcgttgttagctgataaagcagcggcaaaaacttatgcgcaacaacaggatgtgccagtcattcctggcggaagtggactaaaagatgaagcagcactacgccaaacggcagcgcgtctgggctatccggtcatgctgaaggcaagttttggcggtggcggtaaaggaatgcgcgtactttcatcagaacgtgaattacagcatcaatatcacttaattcaagaagaagcgcggcaagcctttttaaatgacgcggtttatttagaaaaatacttgacgcgagcgcgccatattgaagttcaggtactgcaggatcaggcggggcacctacaattattaggtgatcgcgaatgcagtttacagcgcaaccatcaaaaagttgtcgaagaaagtccggcggctattttgacgccggctgagcgggaaaacttataccaattggcgcgtcagatcatggcaggattagattatgttggcttagggacgttggaattcttatttgctgagcatcatttttactttctggaaatgaatacgcggttgcaggttgaacacgcagtcaccgagttgaccacggggatggatcttgtggtcacacagatcgaagtggcggctggaaaattgattaaacctggtgtgcaaacttttaaaggacatgcgatcgaagtgcgcttaaacgcgcaggcacaaggagctttattggctactggtcgcttagagacgtttcgcttatttaccggtgcgcgagtagacaccggttatcgtgaaggtgatcagattttgccttattatgatgctttagtggccaaaattttagttaaacagccaacacgaaaaaaagcaattgaaaaattacaacgctgtttacaacatgtccagatcaaagggattggcactaacttagcgactttgacccaaatcatggcgttgcctagttatcaagctaatttagtggacattcattttttagctcatttggcaggtgatgcgcaatgagtcatttaccagttgcaggaacttggcgacagtgtccgcactgtcaacgccacgtacatcaattagagtggggtcagttacagatttgtcctcattgtagttattacttacgcttgacggcggctcagcggatccagcaattgacggagacgtttcaaccactaccagagatcaccgcagcaacaccgtttgcttttcccggctatcaggaaaaattagctaaagcacaacaaaaaacgggaacaactgaagcctttactgctggtattgcgacattgaatcagcagcattttcttttaggcgtgatggatagtcatttcatgatgggaaccttgaacacaattgtgggggcccgtttacggcaagcaatcacggcagcacaaacgcagcgattgccactggtgctagtgattgcttccggtggtgcccgcatgcaggaaggcattttgtcgctgttgcaaatgaatacggttttggcagcgtacgatacgttaaatgccgcgggcaactttacgctgaatattttaaccgaccccacaatgggtggggtcagcgcgagcttcgcctttgccgctgacacggtaattgctgaaacaggtgcaacgattggctttgctggtaagcgggtgatcgaggaaaccagccgcgaaccattaccaccagattttcaaagtgcagccagcttgtatgaccatggccaattagatgcggtagtggcgcggcctgatttagcagcgaccgtcacacaattattgcaattgcaccaaagaaagtgagcttggcgatgttagaagaacaattaaaaaagattcgcagcgcgcaacgaattagtgcggctacggtgattggtgcactgacgactaacttctttacactacacggtgatcgtttgcaagctgatgatccggcggtaacagtcggttacgggacttttgaccagcaaacggtattgttcgttggtgttaatcgtggagctaccttgcaacaacggctcgattatcattttggcgcattaagtccagctggttatcgtaaagtttgtcgcgggttaacgcaagcggaaaaattcggctggcctgtgatcacgttgatcaatatgcccggcgcggcagccgatgtagcggccgaacttaacggtcaaagccaagcgttggctgtaaccatcagtcaaatggggcgtttaacggtaccgaatattgctttattcttaggtgaaggcgaaagcggcggggcattggcattagccaatagtaaccggatcttgatgctgaccaacagtatctattcagttgcttcgccagaggccgtccaagcgatcctaaaaggagcgcaacaagatctaaccaaatacttgccgatgacggcagcacaattagccgagattggtttagttgatcaaattattcccgaagacgaacaattacttgaacaaataaaacaggcgttacaacagcaattagctgaattaggtacatggtcggcgactcgtttgcagcaacagcggacggaaaaatatttagcggtgctggctcagtttgaataattaaaaaaggattatctctgcaaaattagtgctttctgcaacatgatgattaagtgcacgaggacagagctaattgggtttcattctggcagtggtattcgctagtttagttagttcaattgagtatgaatggcaatttcagtaattggtaattctaaaattaaatcggctacaccaataaaaagcaccgatgaaagtagtgaaaattcactttctcatcggtgctttttgtatgatgaatttgaacggttcaattaaggctgccactacactaaaaatagctttaagtccactatcagctgtaacgtattctataggtttttaacaggaaactgcagaattcgtggcgccacctttttacttacaacccaatattggctaaggaattgacggtattgaagaattgatcttgccgccgagctcttttttctagtggcgtgtctaattcagtcatgtcaatacggacgatatgatgacgaactaggttaactaaagttttgtcgttcatcatgatgtagagattatctgcttcgactttttcgcaagcatcctgccacactttagttgccggtagatcagaagccacattacgtttaatgaatgctttaccatcgatcgtgttaaaggtcacatcataataattagccatttcactcagctcctctactccacaatagtggatgattttgtactaaaaaccgctgctgtttcggacgatgcgacttgggcttgctgggtttcggtttaattcaatcgacagcggaaagccgttctatttagcaagtaaggtcccgtacttgccaaataacgttgcctaaaataagcgccaagtatcgcaggaaacatagcttttaattaacttacaagtttagtataacgcatttcatgcaaatgtaaccgttttatgtctgaatcgacactttggaaaaagttatgaaagtggtaaactgatagctattataatgataaggtgtggtttgatgggcatatttttacaaagtatcgagggtgttttggtcatcctagttatgatcgtgcttggttactgcttggcacgcgccggctggttcgacgaaaaaagcagtaagctgatcgcacgtttggttacacaagtcgcgttaccttgttacatgttagatacgattacgcgcgattttacagctaaagaattattccgtttactgccggatctgaagtttccagttgtttcaatgctaattctttttggtatttcggtggcagtagcacggatcattcgcattcgtaaagaacgccgtggtttgttcgaatcaatgttttttaattcgaatacggtgttcattggcttaccaatcaacatggcgttgtttggtgccaaaagtttaccgtacgtgttggtgtattatatggccaatacgacgtttttctggacgttaggtgtgtatttgatcaagcgtgatggtaccagcaccgagcaattcagttggtgggcgacgatcaaaaaagttttctcgccgccgttattaggttttatcgtggccgttattttagtgttgttacatattcaggttccgaagttcttgatgtctgacttcagctatatcggtgggttaacgattccattatcaatgctttttattgggattgcgatcgagaatgctggcttaagtcaaatgcggttatcacggcatagtatcgggattttagttggtcgttttattttagcaccagtgctcatgagcgtattagttttgccagcaccggtaccattgttaatgaagcaagtcttcattctccaatcagcaatgccagttatgactaatgcaccagtggtggccaagttatatggcgctgatgctgattatgcagcattgatggtaactgagtcgaccttgttgagtttagtcgtgatcccaattttaatgacgattttacgccaatagaaaaaagtgtggcccagtataattagggtcacacttttttagaagacttgaatgccgtctttgtcggctgataatgaaattacggtgccagtgggatgtttttgcattagtgcagctttgatattttcggtcgcttcttcgggacacatggtgatgattgctggtccagcaccggagataaacgtgccataagcgccgagctcttttgcggtagtgcgcatttgctttaaaaaggggacaaaattatcgcggtaacgctcttgcagtaggtcatgttccatcatgtcgccggctaagttgagatcaccatttaaaattgcagcgatcatcacgtttgcaatggcactaccagcaacagcttggttgtaatccagtgatgttggcagcacttcacgacttttaacagcggctaacttttcgcgcggaatatagatcacaaaatctgaatcaggaaataggtgccgcaccgaataaacttgctgatcgatcattgctgcagtaacaaaattaccgcggattgctggggccacgtgatcggggtgctgttcgaatttagtggctaacgtaattttttcatcaatgcttaggtttaagttggctaagcgattagctagctcaatgccaccgacaacagccgccgcgctgctaccaaggccgcgttgtacgggaatatccgacatcacgctgagttggtggggtgctattggttgctgaccagccacagtcaaagcagttttgacgatcaaattttcctggtcattgggaatttgtgggcctaaattatgctgcacctcccaatgcgcactttcagcaccgatctggatccgtaaataaagtgccaacgcaagaccgcatgaatcaaagccaggacctagattcgaagtcgtcgcaggaacttgaattttcatgagtaacctccatagtagaacgaaaaattaaaattcaattagataattatttaattttaattataacgaattcggtgaccgttgaaaataggaaaattagcctagcgctgtttttttcaggttaatttcggtaaactagaggatgattgaaaaaatacctagattaaatgtcatcatctattttttcagctacgtttaaggcaataatcagttttgaggagtgattagtaaatggcacgattggttttgttacgccatggagaaagtaccgctaatcgtgacaatatctatactggctggtcagatgttccgctgacgtcagcagggatcacggaagcacagcaggcgggtaaacgtttagcagcacttgactttgattttaccgcagtgcacacatcactattacaacgcgcaattatgacggctaatattgttatggaacaactggatattttggcagtgcctctgaacaaaacttggcgcctgaatgagcgccattatggtgcattacggggacagaataaagacgcaacccgtcaagaatatggcgctgaacaagtggccttgtggcggcgtagttacacgactgtgccacctaaattggcgcagccggattatgatcggcgctacacacgttacggctatcgttttgaaccactggctgaaagtttggccatggcgttgacgcgggtggttccttattggctagatcatattggccccgcgttgatcaatgggcatgatcaattagtggttgctcacggtagtacgattcgtgccttgatcaaatatttagaagctgtttcagacagtggtatcaatggcgtcgaagtggctaatggtgagccaattgtttatgacctcgacgctaaattacgtattaaaaataaaacaattatccacaaacaataaaaagcattcaggttgccacttttacggtagtaacctgaatgcttttaaattaattgattaatgtgaagctaaagcgcccattgggtcccaaggagctaagacttttggatcttctttagttgcagctaataagtcggctggcaaatactgcttgttgattacgatttggtaaacatattggtctaaccaagcatcactcatgacgaagtagcctttttcgccgactttgtcaccccaagagttttcaactttccacttagttggtttatcgtcaactaaatcaacgccagtgatcaccatggcatgagtcatcagactttcaccgtaatctaagcgttgggctttcgtcatgcttaaatcaacgttgaagagatcatctttattgtaaatggcagtgtccatgatcccaatttgacgatcggaagcttgaccaacatcgctaccgaaccaaacactttcaccagcttgcaattgtttgattgccaattgtttgaaagtatcaatgtctaagttcaaatgccgaacttgacggccaccaaccacattacctaacatttcaactgtgtataagtgattgtaaggtttgtcatctgttggggcgttgattatcgattgatagttatcaagatcccaacccacatatttcttaaagaatgtttgcggggttagatcacgatcaatatgataagttttatcaccatcacgatattcaaaatcaaattttactggtggttcgcctaatgtatagactaggatccggtaaacttcacttaaaaagcgtgactttgtagtggcaatttcttgttcactggctttgtcagcaaccatttgccgtaatgtaacggtatctttgcgcaacttcaagttaaggacactattaagttcgctagacttagaactgttataagtttctggcataacgtacttcggcacgatcccatatttgtcgatcaaggccgtcaacatatcccattgaccaccatcttgttgtggtgttgccaataagaaagcaactttacggctttctaaaggttctgttgcggttgctaagatattttcgtagaagtaatttgatttttcaaatttatcccaaaagttcgtataattctgtgataattcaaagtctttcaaattaaactgatcagcgatactgcggcgcatagtgtttaatgcggcaaacatccagcaacgaccactttgtttttggttagcaactttttctgcgcttagatcaacggagaaagtttggttcattgcaacttttgaatcagtgttttcactagccgctaggataccattattcatgaccgcccgtttgatcgtcgcggattgtggtaattgttgtaactgtgcctgatagtcggcaattgcagcagaggtaatttcttgactcaattcattcactccccattattaatgacgttgatacgtctgttcttattttagtacaagcagtagcgattagtaaataagcgtgacccaaaagtcggatcacgctcgtactttattcagccacgatatcagcatattcaggcttacgctggaaaaaagcctttgcgtacgtacagagtggcagaattttggcctgatgtttttgcgcgtgggtgatcattgtttcgatcaattgactagcgatgccctgaccacgatgatcttcgcgaacaaaagtatgatcaacggctagaacacgcccgttttgtaatgtttgaaaagtgacctcggcgacgagacgaccatcagcatcattgtgatagtaacggccgggttcataatcgaattccattagtggatcccccttagattgatggcaaagattactgaagttgtattgtctgattatttacggatgacaacaattaattctattgtaaagtttgaccgtataaaaggcaagaaaacgatttctgaccgttatagcaatattatatggtcagactaagttagttacccatttacatgaataaatgctatcattatagacaagaataagcgtgaaacaaaaataatttaatacaatgagctaacgataaaatagagtggcgttaggcattgttatgtgagtgttttacaagttaagattaattgtctttactattaggaatggagtttatttatgaaacgaggatttgaaacggttgatcggtaccgtgatgccggattacaattaccccagcgggcaacgcaacaagcagcaggctatgattttcaagctgcagaagattttactttaccatcgatttggcggggagattttttgcgactattatggcatgttcgtcatggtcagacattgaccgatgccgattatacagctgccagtaaaacattaaaaccatacttggtgccaacggggatcaaggcttatatgcagccggatgaatatttattgcttgcgaatcgttctagtgggccaatcaagcgcgggctgatcttaccgaatggtgttggtatcgttgatgctgattattataacaatccacaaaatgaaggcgagatttttttccagttggttaatctaggggtgcgcgacgtgacaatcaaaaaaggtgagcgtatcggccaaggtatctttatgccatttttacggagtgatgctgatcaaggtggcgtcgcgcaacgaacaggcggttttggttcttccgggcgttagttcagacttacggcggatttagtttggggtaaaaacgactaaactagggcatatcttgaaactggttgccaactaatcacgcgaataaaaattatagaaaaggatgtattttgtggcaaaagcaaaaacacagtttgtttgtcagaattgcggttataattcaccacgctatctaggccgttgtcctaattgtggggcttggaaccaaatggttgaagaaaagatcgcaactaaaaaagagaccactaatgcgcaggctaatatagccggccatgttgccaaaccagagttaatggcaaaagtcagtatcgaaaaggaaccgcgagtgcagacccagctagctgaattgaatcgagtgcttggcggcgggatcgttcctggttcgttagtcttgattggtggcgatccggggatcgggaaatcaacattgttactacaagtttctggtcagctcagccaaggcaaggaaaaagtactttacgtttctggtgaagaaagtgcgtcacaaatcaaaatgcgcgcaggacggcttggtgttgctggacaacaattgtacctttatccggaaaccgatatgggtagtattcgtcagcaaattgaaagtttaaaacctgattatgtggtcattgattcgatccaaacgatgcaggaacctgatttgagttcagcaattggtagtgtggcgcaggtacgggaagtaaccgcatcattaatgcggatcgcaaaacaaaatcagattacgatcttcattgttggtcatgtgaccaaaggtggtgccattgctggtccgaaaattcttgagcatatggtggataccgttttgtattttgaaggcgatcagcaacgaacttaccggatcttacgagcggtgaagaatcgttttggttcaactaatgaaattggtatttttgaaatgcgtgccggcggcctgcacgaagtggctaatccatccgagattttcttggaggagcgtttgactggggctactggttcggccgtagtggtttcgttagaaggtacgcggccaatcttggtggaaattcaagctttgatcacgccgaccgtttttggtaatgcccagcggacaactacggggatcgaccgtaatcgggctgctttgatcatggcagttctagaaaagcgggctaacttgatgttacagaaccaagatgcttatttgaaagctgctggtggcgttaaattggacgaaccggcaattgatttggcagtcgctgttagtattacttcgtcttatcgtgacaaaggaacccaagcgacggactgttttgtcggtgaaattggcttgactggtgaggtacgtagcgttaatcgtatcgaacaacggatcaacgaagcagctaagcttggtttcaagcgcgttttcattccgcataataaccttaaagggttagaagtgccgccaacaatcaaagtaattggcgtgactacggttgcggaagccttacaaaaggcatttaattgaaagaaggtgaactaaatgaaaaaaagaattaccacattactgatcgttttggttggggcgtcgttggcggtcacctttctaccaatgttgtggcgagtatctggtctaacagcgttacattacttaaataacttattcgttgatatcttacttggtgcaattatttcgtattttatttcgctatttttggctgggccaatcgtcagtttatttgatcgcttgatcaagcagacagaaacgatggtcagtaagcaatcgccgatctacctcttatttggtagtttagcaacgattattgggttgattttagccaatatcatttcaattccattgtaccggatgaactttttcttatttaataccttagcgccaattatcttaatggtgttattggggtatatcggatttcgggtcggcacaacacgaactgatgaatggcgccgtttgttccagttgcgtagtaagaaagccacggtggaaacgcctgaagagcaaggcaaagtccttgaacgcaaagtcgatgataatttccacaagtacaagatccttgatactagtgtgatcattgatgggcgcatctacgaaattgcccaaactggttttattgaaggcactttgttgatccctaactttgttttacatgaattacaattgatcgctgattcagctgattcgttgaaacgcacacgcggtcggcgtgggttagatattttaaatgacctacaaaaaaccgatgcaatgccagttgaaatgtacgaaggtgacttcgaggatttgacggaagttgacagtaagttgatcaaattggctaagttgttagatgggattgtagtgactaacgattttaatttgaataaggtcagtgaatttcaaaatgtgcctgtgctaaatatcaatgaattagcgaatacgttgaaacctgcggtgatcccaggtgatgggatgactgttacggtggttaaatctgggacagagcgtcaacagggcgttgcgtaccttgatgatgggaccatgatcgttgttgaagatggtcaatattatatgaataaatcgctggcggtcacagttactagcgccttacaaactgcggctgggcggatgatttttgctaaaccagcgcattcacagaaaagtttgcgcgaacataataaataatttagtcagttacctttacaagtttacttacgaccagtagaattagaattgctgtgtcaggtcttttgagctgacaatcaggattaaaaaaggaaaaaaattgaaagaggcggaatttaaattggcagataaaaaaattcgtgttcgttatgccccaagcccaaccggccatttgcatatcggtaacgcacggacggcattgttcaactatctttttgcgcggcataataaaggtgaatttgtgattcggatcgaagacaccgataccaaacgtaacgttgaaggtggcgaagaaagccaattaaccatgcttaaatggttagggatggattgggatgaaggtcccgataagcctggtgaagtgggcccataccggcagtcagaacgtggcgcaatttatggtccactgattcaacaattagttgatcagggtttggcctatgagtcttacattacggaagacgaattaatggcacaacgggaagcacaaaaagcacgccatgagatgcctcattatgaagatgaatttgctggtttaaacgctgaagaaaaagcagctaagatcgccgatgctaaagcaaagggaatcaagccagtcattcgtttccacgttccagtgcataagaaatatgaatttaatgatttagttaaaggccatattgaatttgattctgattcaatcggtggcgactttgtaatcatgaaacgtgacggtatgccaacgtataattttgccgttgtggttgatgatcatatgatgaaaatcacgcacgttttacgtggggatgatcatattgccaacacaccaaaacaattgatgatctatgaagctttcggctgggaaccgcctgtttttggccatatgacgttgatcatcaatacgcaaacgggtaagaagctatcgaagcgtgacgaaaatacgctacaattcatcgaacaatatcgtgaattaggctacttaccagaaggtatgttcaatttcattaccttgttaggttggtcaccagttggtgaagatgaaatcttcacacgtaagcagttgatcaagatatttgatcctaaacgcttaagcaagtcaccagctaagtttgatgctaagaagttggaatgggtcaataatcagtacatgaagcaaagcgacagtagtaaagtgactgatatgggcttataccaattgatcaaagcaggtcgtttaccagaagatcctgataataagacgatcgaatgggcacgtgcgctgatcagtttgtatcatgatcaaatgagttacgctgcccaagtggttgaagagtcagctgtcttctttactgaaccacctaagttagatgaagcggcgctggctgaattagcggttgatacagcaccactagttttgaataagtttgctgaattgatcaagcaagttaagatttttgatgcagtcgagatcaataatgcgattcaacaagttcgtgccatcgttggggttaagggtcgtaaattatacatgccaattcggatcggcacaacgcgggcaacgcatggtccagcaattgctgaatcaattgagttacttggccgtgagaagacgatgcatcatttggaagtcactttagccgaattaaatcattaatacgaagataggaataagtagatcgatcagttgaaacagggagcgcttggtgagtgaaaaagcgtcagtagatcaattgaaatgcctccttgagtgcgcatacgaaatcaagtagtgtgcgccggatatcattcacgttaatgaatgaaaaggaagttctttagcttcgaataaaagtggaaccacgtgtaaaacgtcttttgatcattctctgatcaaggggcgtttttcgtttgatttggaccggttttaagttagaataaagtaagattaaaaattacggaggtgcgcgtaatgattcaagtctataatacgttgacacgtaaaaaagaagtttttaaaccgttggtggcaggcaaggtaaatatgtacgtctgtggaccaactgtctataattatattcatattggtaatgcgcgttctgctattgcttttgatacgatccggcggtattttgagtttcgtgggttcaaagtgacttacgtctctaatttcactgatgtagatgataaaatgatcaagcaagcgcaacgtgacgggataacggtgccagaattagcggataagtttattgctgcgtttgaacaagatacgacagcgttaaatattgaaccggctacggctcatccacgggcaactgaaaatattcccgatattattgactttatccaagtgttgttggataaagggtatgcctatacagctgcaggggacgtttattatcgtgcgcgtaagtttactcactacggcgaattgtcggatcagaatattgatcagttagagcaaggtgctagtgaacatactgctgatgaagagacccagcgtaaagaagatccaatcgactttgcattgtggaaagcagctaaaccaggtgaaattgcctggactgcaccttggggtgaaggtcgtcctggttggcacattgaatgctcagtaatggcaactaagtatttaggtgatacatttgatatccatggcggtggccaagacttagaatttccccatcatgaaaatgaaattgcccagagtgaagctaaaactggtcaaaagtttgctaactactggctacacaatggttttgtgacgatcggtgatgatgatgaaaaaatgagtaagtcgctaggcaactttgtgaccgtccacgatttgattcagcaagttgatccacaaactttacgctttttcatggcaacgacgcagtaccgacggccgattcgttatagcgaatcaaccttaagtgaagcggcgaataatttacagaaattgcgaattgcttatgataatctcagttaccggcaaaaagacgtctccgccgggatcgatactgaagtagaacagcagttaactaagttgacgaaagcttttactacagcaatggacgatgattttaacgtccaaaacgggatgacggaaatctatgaattagcgaagctgatgaatatttatagtgaacaaaaaattgtccgcgaagcaacgcttaatcatttaatggacagttttaccacgtggttacaaatcttcggggttgattttaagccagctggtttgttagacgacgagatcgaacaattaatacaagagcgtattgacgcgcgcacaaataaagattatcaacgtagcgatgaaattcgtgacttattaaaagcgcaaggtattgtgttggaagataccgcgcaaggaacacgttggcggagggaataatgacagaagtagtagattatcggcaattgaatggtattgcgttggcttatatgggtgacgcaagttatgaggtttatattaggcggcatttgctgagtaaaggaatcaccaaaccaacgcgcctgcagcatcaagcaactcattttgtttcagccaaagcccaagctggcctgatcgaagcgatgctagcacaaaatattcttaatgaagcggaacttagtttttataaacgggggcgtaacgccaatagtcacacccatgcgaaaaatacgtcggtgacgacgtaccgaatctcaactggctttgaggcgttgatgggttatttagcgcttagtgatcagcaggaacggttggatgaattggcagcttggtgtattgcccaagtagaggaaggtaaaattaatgaacaaatcaaatgaaccgcagactgacgctaccgactttgtgatcggccgccacgctgcgcacgaaacgctgcagactgaaggagctaagcgggttaacaaagttttcattcaagaaggcttaaaatcggattcactgcatgcgttgcaacaattagctaaggctaaacgaatcccggtccagtcagcgcccaaaaataagttggatacgctaagtgatcatggcaatcatcaaggcgttgttttagcaatcacaccctatgcgtatgctgagctagacgatttatttgctcgtgctgaagcaaagcaacagccgccatttttcttgatgttagatggtattgaggatccacataacttaggatcgatcatgcggaccgcggatgctgttggggtacatggaatcattattcctaaacatcgggcggttggcttaaccagtaccgtggctaaaacctccactggtgcgatcgagcatatccccgttgtgcgggcaactaatttagttgcggttgcaaaggaattaaagcaacgcggtgtctggttatttggtactgacatggctgggactgattatcgcaaatggaacgctaaaggtgcgatcacattagttattggtaacgaaggcaagggaattgcacctttgttgaaacgggaaatggatgaagtggtgacgatcccaatgatcggtcatgttcaaagtttgaatgctagtgtggcgactggcttattgctttatcaggcctatgcggtaaagcaaggaagcggtgaattaccatgatgcacgaagtcctgattattgatggctacaatgtgatcggtaattggcctgaactggataaactaaagcaggatgataagttggctgatgctcgtgatgatttactggcgcagttggcggagtttcgtaaatacgaagatgcagaaattattttagtttttgatgctatgtatgtgccgggaattacgcaacggtatgatcaatataatttgcaagttgtttggactcaagaagatcaaacggcggacagttacattgaaaaactagccggtgacttacaaaatcgattaacacaagtcacggtcgtaactagtgatcaagccgagcagtggacgattttttctcgtggcgcggttcgaatctcatcacgggaatttaaaatggttattcagcgggctaaggcagaaattgcccgcgatgttcggcattatcgtgatacggatttacgccggcgttcaccgtgggattctaatcaattattatcgttagcaaaattacgcgatgatttaactaaaaatgattagcgataactaagggctgaataaacgttagttcgcttgtaaaacgttttcatggctgttatgctaaatctaaacatggcagccagtgaaaaaaatggataaaaatgaactttcaagattgatttcagcagcagcggccggagattctaacgcattcgagcatttattctatctctatcgacctatgttaaagaagatccagcaacaatattatctttatgaactagatgatgatgattgggatcaggaagcgcggatcgtttgttttcaagctgcgcaacattatcggcgtgatacgcggttaacttttggccgttattatcagcgttgtctgctgtgtcgggtttacactttaattcgccatcaaaatgctaagaaacgccaaattgatcgacataccgtatcattggaagttgacgatatcaagcaacgactggaagctgaaggaacgttgcagaccgttaattggtcaatgatccgtgctagtgcacctgattttatcagtcaattatcagagttagagcgttttgttttttatcgccaattaacagccggttttgaatggacatctaattctgatgataatgagatcacggaagtgcaagtacgcaacgcgcttgagcgctgtcgtcgtaagttgaagcgttacctagcagaccatgttttaatgtagtacttacagggatgaagcagaaattctgtttcatccctgtcgccatttagaactgaaaaaatacgcaactttaacttttataagttaaggctgcgtatttttgtttactctgctttgattgattcgatatcattagtgttgacaccgaataatagtgtggtgtcgtggaataaaatgtagcgccgtggttccttaacatcgagaaacttatctaatgggtaagcgttagaaccagttttggacatgaccacaacttgggtcgcatcggcgaaactgtgttgtttgccgtccttagttacgatggtaatcacatttttcacctcatttttggtgatatacactacttaactataacacttttagcccaataaagcttgtgtaagtttagccgggtgtgtcataaagtgagtgcaatttagcagttaatcagttgacaagtatcgattacaaacgtaaacttaagctgaaattaaaattatcagcgaaaggtgaggcaataatggaagttagtacagcgttaaatatttcagcggctgagtggcaagtaatgcgtgttgcctggaccttaggccaagtcagtagtcagacggtcagcgatgttttagcaacaaaaatggattggaaagcggcgacaatcaaaactttggttgggcggttagtcaaaaaaggggcgctaactgctgagcgtgatggcaaacggtacttatatcgcccgttaatttcagagcaacaggccatggatacagcgagtgaagtttttattgggcaattatgtcagcataaagttggtaaaaccttgttgaagatggttgaagatacgacgttgagccaagctgatattgcggtgttgatcacaacgttacaggaaaagcaaaaaacagcgcctaaagaagtggcttgtaattgtttaccagacaattgtcagtgtgcggatggcagctgtaattgctaacgaattaacctattaagtgaggtagagccatgtttcaacttggcaatttttgctgtagttgaatggacatcgtcacgaacatcaaaaatttattagtggttctactaataagttaacctattaagtgagatagagccatgtttcaacttggcgatcttttgccgtagttgaatggacatcgtcacgaacatcaaaaatttattagtggttctactaataaattaacctattaagtgagatagaggaggcaacatcatggcagcaaaagataaaatgaagatggatcatgatatggattcaatggaccacgatatgagtggtgatatgatgatgcacggtggtcatatgatgcatatggggaacctgaagcaaaaattttgggtagcactgatcttgacgatcccagttattctacttacgccaatgatgggattgcacttaccttttcagtttactttccccggttctgattggttagtgttgattgtggcctctttcctatttatttatgggggtaaaccatttttacagggtgcgcaaatggagctgactgagcgtaaaccagcgatgatgacgttgattgcgctaggcatctcagttgcttatatttatagtgtttgggcgtttattgctaatcacttcttaccaacggtgccccaccagatggactttttctgggagttagccactttgatcacgatcatgttgctgggccactggttagaaatgaatgcgatcagtagtgctggcagtgcggttgaaaaaatggcggctttattacctggtcaagcgcatgtcttacaagctgatggttccctccaggacatcgaacttgccgcattgcaggcccaacagcaagtcgttgttaaagcaggtgaaaaaattcctgctgacggtcgcgtcattgctggtcaatcggccgtcaatgaggcgttagttaccggtgaggcaaagcttgttgaaaaagcgcctggtgcacaagtgatcggcggcgcggtcaacggtacgggaacgttaaccatcgaagttactgggacaggtgagactggctatttgagtcaagtgatgaagttagtgcagcaggcccagcaacataaatcacaagctgaaaatttagccgataaagtagccggctggttattttatgccgcaacgattattggattagtcacgtttatcgtttggctgttgttaagtggactgaatgtggctttagagcgtacagtcacggtattagtcattgcttgtccgcatgcgcttggattagcgattccattagttgttgcgcgcagtacggctctaggtgcaacgcatggcttattattacgtaatcgtaacgccttggaagcggctaaacgaattgatacggttttaatggataaaactgggactttaacggaaggaaattttaaagttaaatcagtcgtcgcgtttggccaagaatcacaggacgacgttctaaggctgatggccgcactagaagcaaatgcgagccatccattagcggtgggaattttagcagcggccaaagctcaaaaattggttcttccaacggctacagatgtgaaacaattatctggcgttggcctgcaaggccgtattgatcaagttgattatgccattgtgactgctgcttatttacagcaaaaacagcttgattttgagcagaccgtttatgataatttggcagcacaaggtaattcaatcagcttcttattgcgtggagagcaggttttaggtttggtcgctcaaggagatcagatcaaactaaatgcagccgattttattcagcatctgaaagcccaggggattcggccagttatgttgaccggcgacaatcaggccgccgcagcgttagtggcacaacaattaggtattgacgatttccatgcacagttattaccggaggataaaaccaaaatggtggcgcaatatcaggcgcagggtcaacgcgtcttgatggtcggtgacggtgtcaatgatgcgcctagtttggctgctgccgagattggtgttgctatcggtgccggaacggatgtcgccattgattctgccgatgttgttctagttcgtagtgatccagctgatattataaactttttaaatttggcccagcgaacgatgcgtaaaatggttcaaaacttgtggtggggtgcgggctacaatattgtagctttaccattagccgcaggaatcttagcgccgatcggtgtgttgctcagcccagcagttggtgccgtgttgatgtcgttatcaacgatcgttgttgcaattaacgctttaacgttgaaattaaaataaaagttcaaatggcaggtcagagtgttttttcactggtggcctgttttttttgcgataaacttgaatttatttttaacgcgcttattaccacatactatatgtagctgtcaaatagaatattattttaatttaatccctatatattgatttacggtctgggaccaagtagtatggaatatatggttaaaatgttcacattgtgaaagggcgttgaaaatatgctagaaaccagaactaaccaaccaactaaaccgcaaactttaaaagtaactgaagtcattaaacgtgacggccgccgagtttcatttacggcggctaaaatttatcaagccttagttaaggctgaacaacatattcatggtgaactcgatcccttgaccaatcgtaaaattgaaacggtaactaataaagtggttgctgaagtgcaagaacgtttcactgatgcggttaagatttatgagattcagaatattgttgaacatattttattaggcgagcaccaatatgatttagcacaggaatacatcaattatcggacacaccgtgattttgcgcgcaatcaagcaacggatatcaattttacaatccagaaattgatgcaaaaagatgccacagtcgttcatgaaaatgccaataaggatagcaaagtcttcaacacacagcgtgatttaacggccggcaccgtcgctaaggcaatgggcttaaaattattaccgccacatgtggctaatgctcatctaaaaggcgatattcattggcacgatttagattaccaaccttacagtccaatgactaattgctgcttgatcgattttaaagagatgctgactaacggtttcaaaatcggtaatgctgaggttgaaagtccacattcgatccaaacggcaaccgcgcaaatggcgcagatcattgctaatgtggcttcatcacagtatggtggttgttccgctgatcgggtagatgagttattagcgccttttgctcagcttaattacgataagcaccttagtgatgtggcagattggatcgatggtacagaaaagcaacacgctttcgctaaaatgaaaactaagaaagacatctatgatgcgatgcaagcgctagaatacgaaatcaatacgttgtattcatcgcaagggcaaacgccgtttacaacgcttggctttggcttggggactagttggatcgaacgcgaaattcagcgttcaattctacaaattcggattcagggcttaggcaaggagcaacggaccgcaattttccctaaattagtttttagtattaagcggggcttgaatcttaatcctgatgaaccaaattatgacattaaacagttagcaatcgaatgtgcttcaaaacgaatgtaccccgacgttttgatgtacgataaattagtagagctgaccggctcgtttaaggcgccaatggggtgtcgcagtttcctgcaaggttggcaggatgagcatggacaggaagttaattctggacgaatgaatcttggtgtggtgaccttgaatttaccacggattgctttagaagccgctggtgatcaggacaagttctggactattttgaaagaaagactacagatctgtaaggatgctttagtgtttaaagtcgaacgggccaagcaagctgaaccagaaaacgccccgattttatacgaacatggtgcatttgggaagcgattgaagccagaagattctgttgatgaattattcaaaaataatcgggcaacggtttcattaggctatatcggtttatatgaggttggcgcagttttctatggtcatgcttgggagaaaaatccagctgctaaagactttaccttggcaatcgtcaaggaattagccgctaattgtgaagcctgggaaaaagaatatggctatcatttcagtgtttatggaacaccagcagaaagtctaactaatacgttctgtcaggctgatctaaagaaatttggcaaggtcaaggatgttacggataaagattactatacaaacagttttcattatgatgtgcgcaaagccccaacaccatttgaaaagctagattttgaaaaggattatcctaaatatagtgctggtggctttattcactattgcgagtatcctaacttaaagcaaaacccgaaagcgttggaagcagtttgggactatgcgtacgatcgagttgcttatttaggtacgaatacaccaattgatcaatgcttcgaatgtggtttcaaaggtgattttaaaccaactgagcgtggttttgaatgcccgcaatgtgggaatcataatccgcaaacctgtgacgtggtcaagcggacttgtggttatttaggcaacccattgcaacggccaatggtacatggccgccacaaagaaatttcggcgcgggtcaaacatttggttttaggcaatgatcaaaccactcaggcacggcaatagttatatttttgtgctgattcagactatacgactgtaagtcaaatttagcgcaagcgtgtgcagaagttttagtatcaaaataattacagtgaagaagaggcagggtgagtgagacggagaaattaccacagaatccgcagccgcaagaatggcagtcccaggaactaagtcagatgcggatcgctgattataagccgttcaattttgttgatggcgaaggtgttcgtaatagtctatacgtttctggctgtaagtttgcttgtcctggttgctataacaagatcgcccaaaattttaactacgggcaaccttatacacaagcgttagaagatcaaattatggctgatctggcccagccatatgtacagggcttgacgttgcttggtggtgaaccgtttcttaatacgcaggtttgtctagctttggttaaacgactacgcgttgaatttggtcacaccaaggacgtttggtcttggactggctatacttgggcggaattacaacaggaaacgccggataagttagcgttgttgcgcgaactagatgtgttggtcgatggtcgctttttacaagcgcagaaggatctgacattacaattccgtggtagcgctaatcaacgaattattgatgtgcaacagtcactgagccgtggcgaagtgacgttatgggctaatttaattaaataatgaacaggaataatgccatgaaatgggtgctttcgcaagtctggttaaagacccgcagaatacgttagattccattttgatggctgtaaattggacttaaaaccattttttgcgtagagacaggttcaaattcataatataaaaaacactgatgagaaagtgagttggatttcactattttcatcagtgttttttgttgatatacgattcaattttaaatttgcaaattacttaaatggtcgtttgtactaaactagcgaatcattaaggttcaagtattgctagaatagcccttaactaattttgtctgggtactcttaataaccgaacccatctcctggtttattttcaacgaacttgctgaccaaattcatcgttgtaatagcttaaaaatgggaaatgtagagtcattgtcgtaccttgaccgacgactgaagcaacgcttaattgatggcctagtttgatactcaattgttgggctaggtatagaccaaggccagttgcattgctattactttgccgaccattactgccggtaaagcctttggcgaaaatacgtgcttggtcttcttcaggaataccgatgccatcatcactgatttttaagttgacaccatgctggtcgtggcttagtttaactgtgatatgaccatcatctgcggtatattttaagctgttggcaatgatctggtttaaaataaaaactaaccagtttcatcagttaaaaccgtttcgtcggtgccaagcaattcaaaatgaatttttttatgctgaaaataggtagcattttcacgaataacttgcttgatcaacggtgttaaagcgtgttcctgaattaaataatcctgtgaaaaagcatctaaacgtgaataataaagaacttgttcaacgtaatgattgatccgtgttagctcatcggtcatttgataggcagctttttccggtaattgctcgcggtaagtttcgttaagcatctgtaaggcagccaatgggactttgatatcatggacccaaccggcaataaattccttttgatcttggttttgttggtgcagttgttctaagctttgttgatgataatcgagtagttggttaatataagttgctgtgtactgctcggcgtaggtcttagtttgatctaaacgccaatttaagctatccgcttgcgctgcccgtcgtaattgaatttcacgataccaataccgcttgcgccaataagtgctggcgaagtagagtccgaaaaacaggcaaagtagtagatcaaggtaaagtaaatcactagctgtgatcaactgttgtggttggagccataagatcaagttagtcagcgctaaacaaccaacgaagaaaagtaaatctaaataatggtcgcgcacgtatttaagaaaagtcatcaagcacctcgaattaaggaatcatatagccttgaccaattttagtttcaatataattggtcaaaccagcttgttcgatttttttgcgtagtcggttgatgtttacggtcagcgtattatcgtcgacgaaacgttcgtcatcccacaaagagcgtaataatttctcacgactgacgatttgtccgtgttggcggagcaaatattgcagcagtttatattcatttttggataggtcgatcgtttgctggtccacttgtgcactgccgttttttaaattcaatattaggccgttgtgacttaagttgtcattattaccagcggtgtaattataagtccgccgcaacaacgcgttgattttggcgatgagcacttccaatgaaaaaggtttggtcacataatcgtcgccacccatattcattgccatcactttatccatatttgtattgcgactggaaataaaaatgattggtaccttagaaacttcgcgaattttttggacccagtaaaagccgtcataaactggcagattgatgtccagcaagataagttgtggtttttcagctagaaattgttgaaaaacatggttaaaatcagtcacgccggtagcagttagttgccatttacttaagttgtctttgatcagtccaacgattgttggttcatcttcgacaatcaaaatattaaccattaatttaacctcgcatttttataatcttaaattctatcctactggttatacgaacgaaactcaaccgtcgcaagttgtaggtttagcgccgacaaatttggtatcatggaactaaagtgagtttttatgaagagcagcacaatttagcgtgagtgtttgtgcctaaaaattagcagtggccgtaactgtataattttttgatataaatcataacgattattgtaaagtagagcaggtgaatagtatgccattgatcgatgttcaagatgtacacaaagtctacggtcgtcggttaagtttagttaccgcggttgcgggtatcactttacaggtggagccgggggaatttgttgggatcatgggaccatctggcgcaggaaaaagtaccttactcaatttgatgtcgactattgatcgtcccaccagtggtcaaatttatttggccgggcaaaatgtcacttatttaaaggatcacgcattagcaaaatttcggcgtgaacagttagggtttatttttcaagattttaatttacttagtgccttaacggtgcgcgagaatatggttttacctctaactttggccggtcggtcagtgcctgagattgaaaaggcgttggaacaaacggcggcaattcttggtttagacacgttacttgattgttatccagatgagatctcgattgcgcaaaagcagcgagttgcttgcggtcgcgctatcattgatcggcccagcttactttttgctgacgagccgactggtagtttggactcgaaggcggcaacggaactattgcgctatttgactacgatcaatcaacaaatcgcaacgacgattgttttggtgactcatgacgcttttactgccagttattgcaaacgaatcttatttatcaaggatggcgctttgtttgcggaaatcgtccgccatggcagtcgccaagccttttttcagcaagtgatcgatatgcaggcaacgattggtggaggaggtagcgcgaatggtgcttttacgtctggcccttaaaaatgcgcgcattcattttagccgttatctggcgtatgtattagcttgtaccgtggcgatcataatttattttacgtttacggtgatggcaactacacctaagttattacaagacattgcgcaacagcaacaattgaaattagccttacagatcaccagtttcttcattgtgttatttattgccgcatttatggtctatgctaatttgttttttgtacagcaacgacgacaggaaattggcctctataatttattaggggtaacgcgccgccaaatcggcagtttgttctttttggaaaatttgatacttggtttggtggctttagtcttgggcttgctgtttggtgtcctactttccaaactttttgccatgcttttgctgcgtttaattgcggttgctgtgccgacgccgttgttgttctcctggtcggcagtggggcaaacggtgactatgttttcgctgatatttgtgggcttagcgttgttggatgccagtgtgatctatcgctatcggttaccagaattattccatcagccagtgttacatgtcggtgagcaattaaattatcgacattatttttggggtggctgcggcggattattattgatttatgcttattggtcagcccaaaattatgcgcaggcagttcggcaatatcatttctttggggtggccgcattccttatattaccgttattgattttagtggcggttttattaggaacttttctattttatcgtgcttctttggctttgattttacaatatttacgacgacgaaaatctttcagttatcaagggttacgtttgctgactttagctgacttaaatcaacgattacggcaaaacataaatatttcttggttagttacgatcttaacggcgatcactttaacggttcttggtagcattacgatggtttatgctggcgcgcaaagtatcttgaatgatgcacagccggtggcgctaacggtcgatcgacaattaagttcagtggttaaaaaagagttgtctcaggcgcagatcccaattcggcggacacaaacggcgactctaaaaattattgccgcacgatttaagattcattctgcaattggtttaaactatggtgctaatcgcgggccggtatcagtaatcagtcagaccgattatcaagcgatgcgccagattcaatctaatctgccagcgattaatttaggtgatcagcaggcaattctgttattgcgtaaagtcggttatgctggtcaggcagcggatcaaagtgggtttacagtctatttaaatacaccacaagtcaaggcattaaaagcacaacagattttgaatgcttttccttatgggtctagcaattacgtggatgaaactggtttagttgttagtgatcatacttttcaacgtctacaagcagatattcaaacccatccagtcgcttttgactttgcccatactaaacagagtgagcgggtcagtaatcagattatgcaacgttatggcgaacacaattatcagattcaatcgacgaaagtccgacctaaatttagtgaattacactttcatttagtccaaccacaacaaattactaacgagacctatgcgattacttggactaatgctcgttacccgcgggtgcggggattgcgtactttatttggattggatacttatattagtggtttcgtcagtttgatttttatcatggcaactggcagcattattatgttaaaacaattagcgaccgctgcggaaaatcgggaacagtatgtattgttgaccaagttaggcgtcagtctaaaggcgattcggcgctcaatttatgttcaaacggggatgacattcttactgccaattatattaggcatgatcaacgcgtactttgcgttacacattttaaatgtgtggcttaatcaacttgatctaacctttgcctacctgattggcctattttatttgttggtttacagtatttactgctggctcactgcacgcgtctattatcgcttgatcagaccaaaataaaagcttgtccactatattaacggtggacaagctttttgtttatcgttgtgctaaaacgtaattagcttgatggaattgttggacataatgaccagcacccatataaggttttatttgcttgaagtcggttgagttacgccaattaaagtaatcggcatcacgttgccaaactgaaaaaatcacgtattcaattttagcagcgtctaaacgcaataggaataaatcattgagaccgataaagttttcggcttgcttgcataattgatcaaattgcgccaaaaagacttttgctgcttcagtagttgcaaaggtcaaataggaaaagttaaaaaaaccagttaaatcatcgttgccagtatgatagcgtgtatcgtaacgtaatggattattaaaaaaagcaggctgatctgagagatctaatagttgaaaagcttcagtagcttcagctggttttaataatagcagtcgccgctggggttcccggtctaggtattgcgccaaaacgctttgtgaaccaaaagttgcaataattttatgaatcatgatttacaccccttaacgttattttcattcgcctacacctatagcataacgcaaattaccaattattggtaatgagagcgctgcgttttttgatatttaaaatgttagcttataatagatgagattagtcaagcaaagaacgaaactgttatactgaagatgatgaataattctaagaaagtgggttttgcgaatgaaattaactgttctaggaatgtatggtggctatccgtatcaagacgttggcaccagtgcttatttgattcaaaccgctgagtttaatttgttgctggattgtggtagcggggcacttttaagcttacaacattacttagaccccttacaattggatgctgtcctattgtcgcattatcatcatgatcacatggctgatattggtgttttgcagtattattggcaacttcaccagggaccgaagaaggaagcgcgcttaccgatttatggacacactgcagatcccttacattttgcttcactaacgatgcaaggaattaccgatggtgttgcctaccagccacagcgtaaaacaattttaggcccatttgatatcacctttttgccaactgttcatccagtaccggcctatgcggtccgaattgtggaacgtgcaactggtaaggtcttagtttatacagccgacactgcttattttgatcaattaccacagtttgcacgccacgcggatttattgatcaccgatactaattttctgaaaagtaaaacggggacgatcatgcatatgacgtcaacgcaatccggattgttggctaaggacgcggcagtcaagcaagtgctgatcagtcatttaccccaggatactgatctgaatcaattgcgccaagaaacagcaaccgcagctggaccgcaaattccggcgattttagccgagaaagatttacaaatggaaatttaatgaaatatagttaatttttttgaaaaataatatctaaaacagtttctgccattagaaatgatagtgcaactaaattaataaaatttgtgtatcttgtaaatgtggtttatataaaactgacaacatgatttatcctttatgtaaagcgattcacggcgaatttagtcattttgaatgaggtttgttaattcaaaatagcatgaaaattaatgaagtaatggtaattatgtcctaataaccttaaattacgtgtcataaaatactaaaaaattttaaattactatagactaaaaagtatgaaacggttacaatgggtttataagttattgacacccacgagtatttattgacgcggaaaggatgattgaatatggtaatactttatacttcaccaagctgtacctcctgccgtaaggctcgtgcgtggttgaaagaacacgatatcccatttgttgagcgtaacatttttgctgaaccactaactgttcctgaaattaaacagattttacggatgacagaaagtggcactgaggaaattatctcgacacgttcaaaaacattccaagatctgcatgttgacctggatagtctttcgttacgtagcctgtttgctctgattcagcaacatcctggcctagtcagacgaccaatcgtcctcgacgaaaaacgtctgcaagtaggatttaatgaagatgagattcgtcgtttcttgccacgccgagttcgggcattggaattacgtttaattaaaatgcgggcaggcgtctaacgcttaaatatcaataaattatatttgactttacttattgaatccgaaagggacttatttactgagattattccggtaaataggtctcttttcgccgacttacaatggatttataaaaaatagagtgccttgctttacaatcagcttaattcaggtacaatgtacttgtagagatgtacctgaattagaaaagcggggtgcaacagtcatggaaatggaacggattaacgataatacgattcgcgttttactggaaaataatgatttatccgagcggggcatcacggtgcttgatttgctcggtaaccataaacaaattgaaaatttcttctattcgatccttgaagaagtggatacggatcaccaatttcaatcaaatgatgcagtgacttttcaagtactgccgaacaagaatggtttagaattatttattagtaaaaatgcaccaaccagtggtttggatagcgaggactttaccgatgatgttgatgggaccgacgaagtttctgactttatcaagcaacagttattgagtagtgatgataaaggcagtcagcgtaaaaccacattgaaggcagcggacactgaagacgatgatgattttagcacttacttgaatgatcccgatacaccaactagggaagtcgtcctccaattaaatgagttcgaagatgtgattcagttagcaaagattttacgcttagatggagcggtttctaatctgtttagatataaggatgccttctttctacatctgattttcttcgtcaatgaaacttctgaggaatcgatcaaggacgagctagcgattgcaatggagtacgcgaaccgaactaatgtgactccggatgttttatctgaatatggtaagaaattgatggaaaagtcagcacttgaattattgcgttactattttaaataaccacaactaatcggcgatgatcgtttatcggcggttttttgtttgcggtaaaataaaaatccatgtcaactgcgacatggatttttgcgtatctattttgctttcggttcttttggtgcgccaatgttataatcgctgtcgtgcatcgcttcaacttcacctaagcgatagccattgccgacttgggagaagaaatcatgatttgcggtagaagtggagataccattcatgacgattggattcacatcgctttcggtatccgggaataaagcattttggcctaagttcatcagcgctttattggcattgtaacggacaaaagtcaatacttcctcagtccaaccgacttgatcatagagcagatgggtatatttttcttcattagcgtatagcttatataaaaagtcgaacaaccaatcttgtagttcttgctgctgattttgacctagttgattgaatcctaattgaaatttgtaaccaatataagtaccatgaacggattcgtcccggagaatcaatttaataatctcagcgacgttagcgagtttgttattgcccaaataataaagtggtgtgtagaaaccagaataaaatagacaagtttctaagaatacgttggcgatttttttctttaagggatcggtttcgtcgtgatagatttggttgatccattgtgctttgttttgcaggtattcttcgttgtcactccactgaaagatttcggtgatctcagtgtcagtatttaaggttgagaaaatcgttgaataacttttagcatggactgattccataaactgaatgttattcaaaacggcagtttcgtgcggggtacgcacatctttgcgtaaagccgctaaaccatcttgagactggagcgtgtccaataaagttaagccaccaaaaacgtggccaaccaaccattgatgagcgtcatctaaggtgcgccagtcgtctaaatcattggaaacggggattctggtatccaaccaaaattgttcagtcagtttttcccatgtggctttgtcaattgcgtctgaaatggcattccagttgaccgccgcgtagttatttgttgtcatttattgtcttcctttcgccaatgcacttttctattgaatgtatcaatatcggtaatgctaaatcacgcaactttcacaggcgtttgagccgatctcatcttcgtcatcggtgtatgtgcggatatagtaaattgacttgatacccttgttataagcataattacgcaaaatattgagatcacgcgtagtcattttatcagtttcaccatttttccattcgtacaagccagttggaatcgttgagcgcataaataaggtcatgctcattccttggtcaacgtgttgttgggcagtggcgtaaatgtcgatcacgtggcgcatatccatgtcataggccgaggtgtaataaggcatcgtatcattggacaaataaggtgccggataataaatggtgccgatcttcttttcttgacggtcttcgatccgattaacgatcggctgtaaactagccgaagtatcattaatgtaagagatcgaaccatttggggcaacggctaaacgattttggtggtaaagaccgtcgcgcataacgtccgcttttagcgcttgccagtcggcttgcgttgggataaaaatatctttgaatagtgccttgaccttagctgtttccggttgccaagtttggttgacgtattgatcaaagtaactgccatcagcgtattgactcttttcaaagttaacaaaagtttccttacgtttgcgggcaatctcattggaagctttcagtgaccagtagttaagcagcataaagtaaatattagtaaaatctaaactagcttggtcgccatacatcatatgttcctttgcaaaatagctgtgtaagcccattgcaccaaggccaatcgtatgtgcttggcggttaccgttttgtactgaagggaccacgtcgatgtttgaattatcagttacaaaagttaaagcacgaaccatcgttttaactgaatggccaaaatctggtgaatgcattaagttagggatgttagttgaacctaagttacagctaatatctgttcctagttcatcatagccttgttcattgttgacgatcgatggtcgctgtacttgtaaaacttcagaacacagattactcatgatgattttgccgtcaattgggttggcccgattggcaatatcgacgttgataatataagggtagccagattcttgttgtaacttactgatttcgttttctaaatcacgggccttgattttcttgtgatgaattgctgggttagcgaccatattatcgtattccgcagtaatatcaacataagagaatggggtgccataaacacgttcaacatcgtaaggactaaataagtacatatcggcattttgtcgggctaattcgtaaaacttatcagggacgatcacacctaaggacaacgtttttaaacgatatttttcgtcagcattttctttcttagcccctaaaaaggcaatgatatcgggatggaagacgtttagataaacgaccccagcaccttggcgctgacctagttggttggagtaactgaaggagtcctccaataatttcataaccggtaggacgccagacgctgcaccttcgacatgtttgattgggtcaccagcgccacgtaaattagagagtgtgatgccgacaccgccaccgatacgtgataattgcaaagcggaattgatcgtgcggccaattgagttcatatcgtcagtcgtttgcagcaagaagcaggaaactagttcgccacgacgcgcccgaccagcgttcaaaaagctaggggttgctggctggtatcgttggtggatcatttcactcgcaatatcgcgggcgatttgctcatcgccatcggcaaaatagagtgcattgaatagaacgcgatcagcgaaattttccaaatagtaggcattatcgtcagtttttaatgcgtattgagcataaaatttataagcagccataaatgatttaaactgaaaattagctgcggctaattcatcgtgcagtgcttccataaaagttagcgaatatttactaataaagtcgctttccaaataattatgttctagcaggtaatctaagcgtgctttaaaactgggaaatgtttttgtgttgggtttaacattttccgctaagaaggcttgtaacgcttcttgatccttattcagaggaatttgaccatcaacgggaatattgatctgattgtttagcgcgtaataagacacattttgactatcgatcgtttttaaagacaagatgattcctactttctataggggtgttgggggaaactatttgaccaaaaataaaaagcacaagatcaaagacaactcaacagatttagctgagtgtgctggatcatgtgctagcaagaacggagagtgatgacctaaactgctaattggcgcagttgatcaggccggaagccaaagaaactaacattaggtgcttcaaccactggcgttgcttgataacccttttcctttaaataatcaacatattcaggttcttgatcaatgttgtgttcggtaaagggaatattgtgttccttcaggaaacgttcagtcatgcggcattgaacacagccatttttggtatacacagttagtttattcattacgctcaatccttatctatattagttaaattatatttttgtttgtgttatcagtataaaggctcactaacaaaaaatcaataaaaaaacaccatattttgtgtttgtaatattatctaaacacaaaatatggtgtgtgattgtttgccgctatttttctgttaaaataagtttaacatagaattttatatacgggaaaacttttgttgtgcagttggcgctgtaaattgatgaaaacagattgcagcgccgctacaaaggaaggaaattaattttggcaaattattattattcgaaaaatccagacgtggttcatgatcagcaagaatggaactttaccttgcggggacaagcaatgacttttgtaactgataacggtgttttttctaagcgaaccgttgattttggtacgcgaacattactggatacttttagcttcgctgatttaccggcgggaccgttgttagacgttggggctggttatgggccaattggtttgacgttagcgaaagaacagccacaacgacaggtggatctggtggacgtcaatgaattggcgttgagtttagcacgtgaaaatgccacacgcaatcaaatcactaacgtcaaaattttttcatcagatcagtatgcagctgttactggtcagtacgcggccattttaactaatccgccaattcgagccggcaagtcagtagtacatggtattttaagcggcgcttatgcacatttagtccctaacggtgttctaactgtggtgatccagaaaaagcagggcgcgccatcagcacagcagaaaatggaagaagtttttggtaacgttgaagtgttggctaaaaacaagggttactttattttacaaagtcgacggctagctaattaatacggttacatgcgattttgtgttagactatagccatagcaggtatctgattattatgaggaggctcacccatgaaaacaggacaaaaacttttgcttggaattggtgttacagctgccgtagctgcggctggcgcgtatttagcggcggatgcattattggataaattgcagggttataagaatcgtaatcgggtcaaatcgtacgtcaaagataatttaaatggcaatcagcatgtgttagattttgttgatcgtttaaatgatgatgatattgatcatttactgcaaatggcagataagctcggcgatgtacgtgatcggatgagcgattactctgaacggtttcaagataaggccagtgattggcgtgaacttctaagtgattatatgaagaaaaaacaaagtgatgaataggcgatttgcctatttattattgaaataactgtaatatttattgtgacaatatgaggtgagattaaatgcagcaagttaaatttgatcaggtgcagctaccagcattgggtatgggtacttggcacatgggtgatcaagtggcaaaaagggatgctgaaatcaaggcattacgctatggtttagatcatggcttgcgtgtcattgatacagcggaaatgtatggttctggccgttcggaatcattagttggtgcggctattcaaccttattcacggcaagatctgtttattatttctaaattctacccccaaaatgccactaaacagcgaatgcagcaaagtctaacggctagtttacagcgtcttgggactgattatttagacttatacttgcttcattggcgcggccgtgtgccgttggcagaaacagttgctggtttggaagacttaaagcgggcaggtaaaattcgtcattggggagtttctaattttgatcaagctgatttattagagttgcagcagatcaatgccggcccaaacttagcggctaatgaagatctgtataacttaggtgcacgtggggttgaatttgatgttttaccctggcaacaacaacgacaaattccgttcatcgcttattcaccggttgcacaaggggataagcgtttcaataataatgcagttgtccaagcggttgcagcggcacataatttaagtgcacaacaagttttgttggcttggactttacggcaacctaatctgttggcgattccgcaaaccagtaattggcagcatatgcaggctaatattgcggctgcagatgttattttgacaacggctgaattaactgcgcttgatcgtgagtttccggcgccaacacgcaagcagcctttagaaattatttagtttttcgttgagtgaattatgctagactaaatagatagtagagcgagaggtgagctgatggttcaattcacagcagcagaaaaagaacaatatatgcgtgaagcgttatttgaggcacaatcagcggcccaaattggtgaggttccgatcggtgcagtggttgtgcgtcagggtgagattattggtcgcggacataatattcgtgagcatacccaagacgcaacgacccatgctgaaattctggcgatccaagaagcttgtttaaatttaaaaagttggcgtttagaggatgcagcgctttttgttacattggagccatgtccgatgtgtagtggcgcaattattaattcgcgaatcgcagcggtttactatggggccactgatcctaaggcggggacggccggtacttttatgaatttattgacggatacgcgttttaatcatcaagcaactgtggaatcgggtgtattagctgataaggcccaagcacaattgcaaaaatttttccgtggcattcgtgcgcggcggaaagcggccaaacaagcaactcgagaaaaattagcaaaagatgacgtaaaggactagcttttttgagccaggtctaatataataagtattgccgcaaggccttaaggcaatggtgtgcttacgaatcgtgtcaggttcggaagaaagcagcactaagtaggatacgtcatgtgccttttgtttatttgaattgagacagctcttagttgaccatagactaagagcttttattttgagctttgtggttattgatcgttaaatgagtgctggatttggcgatttgatcaatgaaccattttaattgtgaaaacgtgcaaaaaggcagattattgcggtacggtttttgccacaagaatggttatcgtccgtgacatcgcagtttattagcgtatttggctaataaactaccttaattgtgaagtagaaaggaagcatggggttggcttatcaagcattataccgagtttggcggccgcaacggtttgctgacattgttggacaagaaacgatcacgcagacattgcgtaatgcattagaggcgcatcaaactagccatgcttatctttttactggtccgcgagggaccggtaaaacatcggcggcgaaaatttttgccaaggcgatcaattgcccgaatttgaaagatggcgaaccctgcaatgaatgtccgacttgccaggcaatcaccgctggtactttaaatgatgtgatcgagatcgatgcggcatcgaataatggggtcgacgaaattcgtgatattcgtgataaagcaaagtatgcgccgactagtgcaccgttcaaagtgtacattattgacgaagtgcatatgctatcaactggtgccttcaatgctttactgaaaacattagaggaaccgccgattcatgtcgttttcattttggcaacaacggaaccacataaggtcccattgacgattatttcgcggacgcagcggtttgatttccaacggatctcggcacaggcaatttacagtcgtatgagctatattttgcaagaaaaggagatcacctttgaagaaccagcgttaaaaacaattgccaaagcggcagaaggcgggatgcgggacgcgttaagtgtgctggatcaggtattatcatttagtgataatcacgtgaccttggacaatgcgttgcaagtaactggtagtgcggcacagcaattgctggctgattatatgcaggcagttcaaagtcacgatacgccgcaatcattggagttgctgcaacaagttttggctgctggcaaagatgcgggacgcttcattgaagatttgatcgaatatagccgtgatctattgctttaccagcaggcgccagcaatggtggagaaaatcgaattaggtagtatcgacgatcagtttaagcaattaagtcaagcctttgctgccgatgaattatatcgggtaatcgatgtgctgaatgatagtcagcagcaattgcgctttaccaaccatcccgatatttatttggaagtggcgtcagtcaaattatgtcagacgccgacggttccggtggctgcggctgcaactccagaaacaaccgccgaactcagtcaactgcagcaagagttaaaaactttgcatcagcagttggctacgttacaaactaatggcgctgcgacgccacaaacaacggcaccagcgcagacgccaccacggcgggctagtaaacaacacaccaatgtggcggcaatttacccgattttggatcatgccactaaggatagcttgcaacaattgaagtcagtttgggccgagctattgcaaatgctgacggtacaacatcgagcgttaatgcacgcttcgaaaccggtggcggcaagtcacgatggtgtcgtcgtttcctttgatagtgactttttacttgatcgggctaatagcaatcaggctatggttgattcgttggaaaatggattggatcgtttggtcggttatacgccaaagatcatttttgtgccccaggatgaatggccgcaagtacgtaaatcctatattcaacaacatcagcgcaccaaacaaccgacagaacaagcggctgagacgaaagtagcgccagtggttagtcaagcagaagcactatttggtagtgaaaatattgaaattaaaaatgattaaattttatctcttgaaaggatgatcaactatgatgcgtggcggaaatatgcaaggtatgatgaagcaaatgaaaaaattacaaaaagaaatggctcaggcacaggaagagttaaatgcgcaagaatttaaaggtgctgctagcgatgacgcagttgtggtgacttttaacggcgaaaagaaaatgcaagatatccagatcaaagccgaagctatcgatccggaagatcctgacatgttacaagatttgatcattatggcggttaataatgcgttgacccaagttgatcaagaaactgaacaaaaaatgggtaaatacacccgcggtttaccaggaatgtagcttttagatatattttaaggtaggctggttaagtttgtgaagatgtgtttattagtataaacgtggtcgaaaaagcactgtcgctcattgttgggaacacttatttgttaaatagaacttacttctggacttattactccacagcagaggtagctataccgcataatttgagtgctttttcaatccactctaggaaggaacgttgcaatgcaatatcctgaaccaattgcaaaattgatcgaaagttatatgaaattgcctggaattggcagtaaaacggctactcggttagctttttatacgatcgacatgcaacaagatgatgtcactgactttgccaaagcattgatcgctgcacaacgagatttgcattactgcagtatttgcggcaatattacagaagaggatccttgtttgatctgcaccgataaaagtcgtgatcagagtactgttttagttgtcgaaggtcctaaagatattatgacgatggaacggatgcatgaatatcatggcttatatcatgtgttgcacggtgttttatcaccagtcgaaggtaaaggacctgaagatatcaatattgctagtttgctgaagcggctgcaaaatgatgtgatcaaagaagtaatcgttgctactaacgcaacgcccgaaggagaagccacagcaacttatttatcacgactgatcaaaccagctgggattaaagtgactcgtttagctcatggcttgtcagtgggtagtgacattgagtatgcggatgaaatgaccttactgaaagcagttgaaggtcggcaggaaatgtaaacaacattattgctcaatctgtttttaatgggcaatgatggataagtaattttgtggaaacgtgctaaaaaagtagattgttccacataactatgcttattaaacgagtcactgtgtgtctcttattagtaagccaggttacgttccataatctgagcgtcttttttagcactctctggaaagaggtatttagatgtttaagcgtaagcaggatcaacgttctaagctgcagaaaagttatgatgaaaaactactcagcgcgatttatgaagcgatgagtgattggaatcgggctaaagaaaccgtcatttcaattgacgatgcggacgaagaattgatttcacaaacgcaattagcacgggctaaatacttatttctgtaccatgaagctcgtattcgcggtacgaaaggtgatcatttgatgcctggagcggcgcgtagtgagcatgatttcttagaataagcggtgattagaaagtcgtggcgaaatttatttttcgttgcgactttttttgcgatattttcggtcgaaagacgttaattaagggaaattccgattagacagcaacgaagacttacagtagaataaaagtagttcaatcaggcgatagtaaacgttgatctattcagaaaagtgctagttccggataacggataaagcattaaagtagcgcaaaaataacgataagcgacaataagtatatatagaaatagaggaattaatgtggcgggtttattgattacatttgaaggtcctgatggcgctggcaaaaccagtgcgttgactgagttggtgccgcgtttgcagcaaattgtgcgacgaccgattgtggtgacacgtgagccggggggcaatccgatttcagaggcgattcgccagattattcttgatcctaaaaatacggcgatggacaagcggactgaagcgttactatacgcagcagcgagacgccagcatattgttgaaaaaattcgtccagccttagcagccgataaaatggtcctttgcgatcgttttgtggacagctcattagcttatcaaggcgctggccgtgatattggcgtgacggcggtgggtaagatgaatgagtttgcaactgaacagttggtgccagatctaaccttatatttggatgttccttcagaattagggttacagcggatcgcggcacatcgacaatcgcaaaatgatcgtttggatcaagaagctttatcgtttcatcaaaaggtccgtggcgagtatttagcattagctaaacaatacccgcagcgcatcaagacaatcgatgcaacgcagtcactagaacaagttatcgctgcgtgccagactataatcacaacaacctatcaggactggtttaattagttgtactgcggttagcagtcgatttaaccaagtcacatcgtttaatataggtaacgtctaaagttccatgaaacccaagttcaaaaccggatgttcaaggggggatgacgattaatatatggaatcaccgttcacggatgaatcgaacttaattcaggtgttgcttctcactggat

SEQ ID NO: 588 - DNA, 2868 bp, Unknown
  Metagenome-assembled genome
aaagctaatgtcgcactcgctcacaagttactgcgtattatttatgtgatgatccagactggcgcgacgtatcaagaatataaaaagagccaacgtactgaagatacgttgactcccaaaatataagttactagcgctagtataactacagtatagcagtttttttcggcatttgcacaccaaggggttactgcgcgctaaattgagtttggtttcatataaaaaacatcttccatttaaaaatatgtaattaagccttttaagcgttatcgtttggtcacgctgcttccttaacgtagccacttaaatgcagcgataaaatagctgtgcatctattccacgcacatttcttgcatgactcgcgccagcgctttatggtgggactaagtaggataacctaaactcgcctgactggagggattttatcgtgactgatcagcaattaggccagccagaaaacattatcactgggcaacactatcgctttaccgttttgacctcacgcatggtgcgcttggaatatagtatcaatgaacattttgaggatcacttaactcagatcgtacaaaatcgcaatcttggtgaacctgaatttgaagttttccgtcatcgcaatcaacacgaactagaaatcgtcactgactatttccacctctattatgaaggtggcccactaacgccagattcactttatatcgataccaaatatggttactcttcctataataatcgttggaattttggtcaacctgttgaaacccttaaaggtactgtacggacattagataaagctgatggtgcggtaccgttagaagaaggcttaatgagtcgaaatggttattcagtaatcaacgacagtcactcctttatcattgaaaacgacctgctccggccacgaaccgccgcgggtgacgattggtactacctcgcatacggccatgattttttctcctgtctgcaagactattaccgtctaactggctttccgccattattgccccgctatgccttaggtaactggtggagtcgctaccacgcctatactcaggccgaatatcaagaattattcgagaacttcaatcgtgctggcgtaccattttcaattgccgtcttggatattgactggcatttaacccgcgttccgcaccgctttggtagcggctggactggttacacgtggaatcggaaacttttccctcaaccggaaaaactactgacctggttgcacgaacatggtaaaaaagtcacgctcaacctgcatcccgctgatgggattcgtgcatttgaagaatggtaccccaccgtggctaaacggctgcagctagataccgcagccgaagaaccagcactatttaatttacgcgatgaaaccttccgtaaaagttactttgaagatgtccaccatccgctagaaaaaatgggcgttgatttttggtggatcgactggcagcaaggtaccaattttaccgaacaacaagtcgatccactgtggctactaaaccattatcactttaaagatagtcgcgaacgtcatggtgaaggcctcattctttcgcgttacgctggtctaggtagtcatcgttatccggttggcttttccggtgataccatcgtaacgtggaactcgctggcctttcagccacattttaccgctacggcaactaacatcggctatacttggtggagtcacgatatcggcggccatatgcacggtattcgtgacgatgaattggcgctacgttggctgcaattcggtgtcttcggtccgatcatgcgcctacattccagcggcaacttattcggcggtaaagaaccgcagaactataatcaagaaattgccgagatcatgcggtgtttcctacgtttacgccatgagctgatcccgtacttggactcagctaactttgagacccacacattcggtattccgttagtccggccaatgtattatcaccatgataaaccgaccgcctatgaattacgtaatcaagcaatgttcggctcagaactattggtggcaccgatcgtgaaacccaaaattgaacgtctcgatcaatcaaaagtcacgatgcggttccctgaaggccagtggttcgactttttcaccggactacgctatgaaggtaatgtgacgctcaatgtgttccgcgataatcaccgttacccagtattcgttcgtgccggtggtattgttcccatgaatccacacccactcgatgatgtgatgcggttgccgcaaacattagctgtaaaaatttatcctggtgcggacaataaatatcggatgtatgagcaccaagacgagcatactgcggttactactttcgtctggagttggcagcaccggcgtttcacgatcaaagtcgatgaccccggtaatattttgccaagtaaacgcgttttccagttaaacttcatcggtgtcactccgtttaaaacccacgtcgatgccgccgtcaaaaaatgtgtgacgacccacagtaatcgtattatttttgtacaaagtaattgtgctgaattcggcgccacgtttagccaaatggaattagtcgcacaacgcgatcaaatcgtcgaacgattgtttgataaattacggcgcgcgcagattgattttgataccaaagaattaatttggaaaaaatttctcgctgctgaaacaaaaattcagttcatcagtttcctgaatacactgactgatcaagaattagcaacattactctatgagatcgtttatctgctatctaaaccgtgaaagttcaaaacccagctaaacctgattgcactaagttattttagcccaagattaaacacaagcagctccttgaagtatacttgagtcgtctaaaccacgatacaaaggagtgcttg

SEQ ID NO: 589 - DNA, 6170 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttacgggtttttctgtccactaatatgttcaacttaaattttacaatctaccttatattcacattcgtgatttcgataaaaaaacctttaagacgtcaactttgtcttaaaggtttgctttaattaatctttatctgtcgatttttcagcagcttctttagctttaatggcatccataggtggaatcaccttagcagtttctttcatttgttgtaactcagtgatgtcccctgtaaagtcaaaacaaccaaggtatttaccattctcatcatgaactgcataaaaagaaatataaattttacgaccatcaagatctagtaaaaattcaaaattatcctttgtaccagcatgaaattgtttcaataattcttgaacctgtgggcgggcgccgccatgatgtaggcctaaaacgtttttaccaaaggtctctttaaaacgtttgtagacccgatgtccattatcagtgaaccattgaaattcatcattctcgtcacaaaatcccaattcaaagggaatcgtattcagaattgtttccaaaacaggtaaggcaatattaccagttttaaaatgtaacatatcttttatatcaacggtctttggttcttcagccatgttaatcacctcatataaatttagttgttccaattataaacacactaactaaatatatagaattttagcttaaatgtaaatagaaaattacgttggttgctgttttattctgaccttagggcaatggcagcatcctttttagctgccattctagcaggcacatggccacccaagacggttaatgctgtgctgatcagaattaaaattaccccatgcatgagattaagggcggctacgccacttaagccggtaattttctccaaaataatatttgctggaaaagtcaataaccacgcaattaagacacctaaaatacctgaaccaaaacctagtatagttgtttcagcgtcaaatacccgggtaatatccctttttcttgcacctaaagcttttaaaacaccgatctctttagtccgctccagtaccgaagtataggtaatgatggcaatcatgatcatgcttgtgattaacgaaatgcctgcaaaggccactaacacataagtgatcgcatccatcaagccaccggttaaattagaaacattccctgcaagatcagtataaaccaccttattgaccttacttttacctttattatatttatctaaatagctcaagatttgatctttatctttaaagcttgaaggataaatctgaatactagttggtacagcattgccaccaatcatggctaacatctgcggcttggcttctgctgataactcttgattggtcatgacattacgattactgttcttttgtgccttgacaatagccgaatcgcgattatcttccataacttgtttagtcaaccgatcactataagcaatcccactagctaaaataccatcgctatttttagacttaactcgcaaaattccgaccacttttaacgtcttggttttattggcttgagacattttttgatagtcatttcctggtaaaaaattacccgtcggtagggattgataaaaatcatcgttactaactaattgcatcgtcgtcccaattaattgatcaaaggtaaactttttattttctttaacagaaattcctaaattacggagagcattgatattaattgaattatctcgattaacgaccatcacaacatctgtcggtttatcaggataagccccagacaataatttatagttagactttaaaaaactttgaccgccattccggtcaatgggatatacagaaccacctacacctgtagtttgagccattaaggtcgcaaaatcggtttgaccactttgtttggtatttgaaaatttaacagcctgatatttaccgttaacacttctaatcaaattaagtccagtggcataggtcttactaatatttttagtgagcgaaggactaattttatccacatagtcaagataatttgacgtcaatttattttcatgctgagctttttcagctgcactagtagcggctgtaaccgaattacttttggaaaattcttgttttaaattttgctgctgcccggagccatcctgtcccacttgactaatagtcactggaaattgagatagagtctccttctgggtctgatcgatttgtctttggaacccatttgacagtgctagaaccaccgcaataccaataataccaatgctggacgcaaacatggtcaaaaaagtacgcccctttttggttcgaatattattaaaagataactttaatgcggtgaaaaaactcattttcgttcgtttcaaacgaaaacgtgtggtactgccattcccgttaaatggccgcgtatcttgctgaattttaccatctgcaaattcaataatgcggtcagcatacagtaacccacaacaattggacgttgctatgcctaatagctcaatcccaagctatggtgtcacttccgcaacagttcaagtattaaattaatttcatcccctatctgattgattatcctcccataatcatctatagataaaaagagcctggacgttaatgtccaggctctttttgcttatgcttttgctaatttaagtacttctgcttttagggcgctgatcaacttaggatcgtcattaggcatttgtagtcgggttaatttgccacccttagtttcaatagcctgctttaattcaatatccacatcatatagaatctctagattatcattgatgaaaccaacggatgcggaaataatatgtttgatattatcctgttcaattaagttttgtgccactgtaacaaaatctggtccgatccatttctgttctgtccgaccagcactttgccaagcaatggtatattgatttggcgttaatccagcagttttaaccacggtacgcatatttgcttcaacttcatcacgataactgtcacccccatcaatgatactcattggtaaactatgggcactgagaatgactttagtatcaggctggtcgatttgtggtttcaatgctaccaattgatcactccaaaaatgaatcaaatcatcattttgccaccagctctttgcttcaacataggttacatctccatggttaaccaacacttccttagctcgggcatgatagccacccgtgttaaaagctgagtagtgcggtgccaaaggaataccgtaaatagttttaatcccagcggctaaaatatctttaactgcatcttgaataaatggatgaatatatttataaccgacaaaaacttgatattcaccggggaactcttgatctaattgtgcttgcaatcctttcgcctgggcgtcagaaatcttagctaacggtgaagtcccgccaatggctttataacggcttaccaattcatcatacaatggctttggtggctcgtgatggttgcgaatattggtgtaatagcccataatatcgctaatttcatagggtgtaccataggacattaatagaactgcttttttattactcatagattttcttctttcgtaaagggaattaaactagtaacaatgatgctgatcactgcaatcactactaataggacaaaaataccacgataaacttgaatacccatgtggccattattcacatttaattgaataacggaggcgtagacaattggtgcaacggtggcaccaatttttttggtggtggataggccgccgattgcttggacacgattccccttaccagccatccgaccggcaataacttgcaatggtgcagacatgaagctacctaaaccaaggccgaggatgaaggagaatattgtgaagaggcgtaattggcttagaccaaaaataattaaaagaccggataagccaattgaagcggccgaaataattaatgttcttttattacctagtttatcgaccattaggccaccgatccaagaaccgatcacactccccaacccggtgacaactagagtcatccctgatagacgcattggtagatggaaaacagtatgaacataggtaggaatatagatgaatacggcgaaaagtgtaccgccgagtaaacctaataacagcgttaaactatatgcgggtttcttcaataaattaattggtaaaaatggcatcttattaggtgcaatattgcgttcaactctgatgaaggtccacaggctaattgctgcaactactattagagcaaagatgagatacttataagtgttgaattgttgaataaatgtcaggaagagcatgaatgaggtgataaagattgtaaaggcggttagacctggaaaatcagtttgccactgttcttctttcacttcgttatctaaaatccgccatactaataggaataaaatagcaataaatggcaataaactataataaaaggcacgccagttacctgtaaaggccagcgttaaccctacaaaaataggggcgaagattgaagctaaacctgaaacaacaccaacaacagagactttacggccttggcgttgatgtccagccgtatgtaacatgagattgatggataatacaataatgccacaatcccctaaagccagaataaaacgacctagtaggaataaaccgtatgttggcgcaataccggttaatagagcacccaggaaccaaatacctagttcacccataaatattttttttgcgccataaatatctgataaattagaagcgattggtgtaccgatcactagtcccaatgtataaatgcctgcaacccaggatgaattcactgaactcaagccaaaagtccgggttagtgctggaagcatcgttgacaccgtgcccccatctagttgcgaaataaaaactgcaattgcataaatccagaaatgcgagcgtactttctcaaccgtattaatcattaataacttaagcctcccaattttctaaaaacattttttgtaatccagcattgtccatgtgtgtgcccaccacaaaatatggaaactcaccatagacagaactggcttcataataacgcatctcagcaataatttttttgaacatcagtggtgtctctgcaaaaagagtcacgccccattcgaaatcgtccagaccaatggatccagtgatatattgccaaattttaccagcatatgtccgaccgactgtgccatgatcatgcatgaattgacggcgctcatcgtaagttagggtataccaattagcaccaggtattctaagcttggacatgggataaaaacagatataaggtttatcaggtaattcaggcttcagatgttgattcacataggcccaacctttatctgatttaggtttaccagtataagtacccacttcagtaacggaaacgtaggaagtccctcgctttaaatagtcaaacagtggcaacttcgttaactgaagctcaatttcatttaactcagccaatgtttcgcgaagtataatgaggcctagatcagccttgtgaccagatacattgaatacatagtgactaccattacccttagcttctgtctgcacaaaatcatccaaaagtaattgaaactggtggaccatttcttgttggtgctcaaaagtgactttacgccaactagcaccatcaatggaccaaagtaaatgcatacaataccaaccctcaagtgtctcaacaggttcctgcaaagtaattcctccttttctaaaaaacaaaataacaaccgtcattctatcattatagacattatgttagtatttacacaatataattttgcaataattaacttcagttaattccctaatttttagtaatcccatacaaaaaaatgcaccatctatgctaatatatggctatcaagatattactatttttaatactcattcaaattacctctggagtcgattggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 590 - DNA, 10158 bp, Unknown
  Metagenome-assembled genome
tttggattccgtaattaccatcatatgatttcacgtattaagttacggcaaatgagaacaaaaccaatgaaaaaaacagagttgaaagtcgcatgactttcaactctgtaaaagctattcatcaacaggatttgacaaagagccgaaaaatctgttttaagcttcagtattttccggtaattcaccagcatagtaaacttccgaaacgtcatcgtcgtcttctaaacgatcgatcattcgttcaaattgttcagctttttctgctggaattggtgtgatattttcaggaatcatagttagttcagccgttgctaatttgtaatctttagcttccaaagcatcgcgaacagctgccaattgcttaggatcagtatagatttcaaaagcttcgtcgctggtctgcatatcatcgccaccggcttcaagaacgtcttctaacatttgatcttcatcaatatctaagccttcacgttcaatcacgatcaaaccgcgacgatcaaacatgtaagccacagaaccagcagcgcccatcgtgccaccattacgagtgaaagccacccgtacactggatgaagtccgatttttattatccgttaaagcatgaactaaaactgcaacaccaccggggccatagccttcgtaagttacttcttcatagtttgctgtatctgagccggagcccttatcgacagcccgtttaacgttatctttaggcatattagctgctcgagctttatccatgatcaagcgtaattgggggttagatgaagggtcaggacccccagcttttacagccatgaataactcgcgagatattttttggaaaatttttccacgcttagcatcctgggcgtttttgcggccttggatattatgccattttgaatgtcctgacatgttatgtccctctttcctttatcttaaaaatagtgtgtctacttaaaagacacctaatatatagtagcagatgaacaagtcgcaatcaagcgcttaagcagcttttttacctcggtggcgccaaaatgttgttaccagccaagcaagaatgatcgctgtcaaagcaccactagcatccagtaaaacatcctggaacaatggcgtacggccaccagttaagctttgatgaaactcatctaacgccgcatagcctgtggccgctaaccagacaacgaccatagttaaacctgtctgcttgattcgttctttataccccatgtagccaccaagcccaattagaaagtaactgccaaaatgcgcacctttacggataaaaaactcaacaaatttaaaataaccactactagcaatactgactttttgatcgacataagtaaaggagatccccattaattgctgtttaaatggctcgttagccaaccatcgttctaaaaaaggtaccgaagtttgttgtttataagtttcgccagagctaataaatagtaagatcatgataactagtgataaaactaaccaccaatcattgcgtgaaaatcgtttaatactgaccactcctctattgcacaattacgattatcgctgaaatttaaataattgacctttaaagattataccttacttatcctatcaggctcaattatccggcaaattagtcaacaaaaaaatcgagcagtaacgctcgatttttgagtcataactattcaactgtaacagctttagccaagttacgtggtttatcaacatcgtaaccacgattcaagctcgtgtagtacgccaacaattgggttggtaccacgcttaataatggtgaaattaatgggtcaatattgtctaaaatgatgttatcgtctttttcagcaacatcttccatagcgatggtcagaacatgcgcaccacgggcccgcacttcttgtacgttaccgcgggtatggctggcaactcgtttatcggtgatgatcgccaagacaggcgtcccatcttcaatcaatgagatcgtaccatgtttcaactcagccccggcaaatccttctgcctgcacataagagatttctttcagctttaaagcagcttctaaggaaacagcataatcgtaaccacgaccgatataaaaagcgttccgcgtagtagctagataattttgcgccaactgattgatgaagtctttttcatcaataattgtttgcatcccattagcgaccaaacctaattgcgtccgcgcatcaaagtcgattgcagcttgcacgccccgcttttcacctaaagcctttgccaagatcgtttgtaaagcaatctgtgcagtatatgcttttgttgaggcaacggcgatttcagggccagcgttaagcagcatagtgtaagtcgcctcacgagatagtgtcgatccttgagcattggtcatggtcaagcttgggtaaccccattggttaactttgaccaatacttggcggctgtccgcagtttcaccactttgagataagaacaggaagaatggcttcttcgataatagcggtgtgttataaccaaattcactcgccagacctacttcaactgggatatgcgctagattttcaaataccgatttagcagccaaaccagcgttgtaactagtaccagcagctaaaatatataaccgatcagcttgatctaaggctgctaataaatcagcttcgatcactggcttaccggattcatctaaataatcctgaactaaacgccgtaatacagcaggttgttcattgatttcttttaacatataaaatgggaatggacctttttcggtatcgctagcatccatatcaacatggtatgacgcccgagtaaccgcttcaccagctaccgtctcgatggcgatatcatttttagtcactgtaaccatttcaccgtcatgtaattcaatgaaatctttggtttcagctaacatagccattgcatcggaacaaaccacgttgaaaccatcaccgacaccgatcaataatgggcttttatttttcgctacatataatttatcggcttgcgtgcgatcaaccagcaagaatgcatatgagccatcaagcaaagtcaatgtcttacgaaaagcttccttgccggatagattttctgttgccgcgaaatgagcgatcaattgcactacgacttcggtatccgtttggctaaccaaatcaacatcagataaatattgatcacgtaattgggcgaaattgttgatcacaccattatgaactaagaagaagcgcccatcagcggaaacatgaggatgggcatttgaatcgcttggtacaccatgtgtggcccaacgtgtatgaccaatgcccattgtccccttaacttcaggcccaattttttcttctagtgcagcgatccgacctttagttttaactaaatagtcatgaccgtcttgatcattcacgtatacaccggccgaatcataaccacgatattccagtttctttaaaccattgagtaaaatatcgaccgtattttctttaccaatgacaccaacaattccacacatatataacatccttctctcgttaaatttattagcggctaacacaatcacttgtgttgcacagcgacatttgccgcttagatcagatgtttccaactgcgtgaacgctgctctgttgcaagcttacacttgtttttaacagtcgctctgtagagtgcagaccctggagtcacccgccgattatcgatagactccatcctcgtcaaccacaaaaatggcccaggcgcttttccgattttaaattggtatagacttcctttcgaatattattattggaaacaggtataaatatagtcgattaaatagccattgtcaattgtttcactaattatttttataaattttataaattggtctaacaaagttccatttatataaaaacgtaaccatagacaaattaacgtaacacttattttacggttacataccacgccgctactcaacataaaagtccgataaaatttattcagaattatcaaaatacatgtcgtatcgcatggttaagaaaaaacgtagcactagaaaaataaagctctcacttttccagcgctacgtcttattttatatcatttataatcgggctatatcgatcaagcttgatacaattcgccagccttaggcccagcaccaagggtccaaattgtctcaatctcgataacaacagccgcttttggtgcagggtgattaccacttgtagcccattgctgagcattttcaaaatacttaccagcacgataaacggtagctttaccaccaaagcggtacccacgcatattatcaaggttggcaaaagcaactaatgccttgccagttgcttcgatgtcagccataatcgttttcccggtcatttcattgtaaatcaaatgctaatcatcgagaacacgaatactcatcttaggccccaaatctggctcaccattagcatcaacggttgcaatataacccaaattattgctgatataagccttcatttcgtcagtcaaagttgccattataatgtctccaatctataaatcatttgttcattagctatactaaagttagtatagctggaaagcctataaaagcaagcaaatagaactcaaactgactgattgcaccctgcctttttcactaatcaaaaaaagcggtgacaagtcaacacttgcaccacttcttctgcacctttttaaacaatctaaaattactttttctagctactcgttaattccaacccgctcacgaacgacggttgcaatgcgttcaacatattgatcgactttttcttgggttgccgcttcggccataacacgcaacaaaggttctgttccgcttggacgcacaagtacacgaccgtcaccgttcatttctttttccaccgtatcgatcactgatttgatttctggatcggctaaggcttgttttttatcgactactttgatgttgaccaaacgttgtggataagtcgtcaccggtgccgctaattcggataattttttaccagtttgtttcatcacattcaataactgaatcccggttaacaaaccgtcacccgttgtattgtaatcaaataatacgacgtgaccagattgttcgccacctagattatagccatgatcgcgcatttcttcgacgacgtaacgatcaccaactttagtttgctttgaagtcaaatttgctgcagctaaggccttgtacaatcctaaattactcatcacggtagttacaactgtatcttgtttcaagcgaccacgaccagcaaaatattgacctaagataaacatgatcttgtcaccatcgacgatattccctaactcatcaactgcgatacaacgatcgccatcgccatcgaaagctagaccaacctgagcctgttgctcaactaccgctgcggctaacttttctgggtgtgttgaaccgacaccgtcattaatattaacaccatttggtttagttgctaaagttgtaaaatctgtttctaaatcagcaaataaacgcgtcacaattccagaagttgcgccattagcggcatctagaacaacgtgaagtcctgataaatcttcttgcaaagtttgttctaagaactgcgtatattttaataagccttccggatagtcggctaaagttcccaagccatcagttgctggacgtggtaacttatcttctggtgcatccaacaaagcttcgatttgatcttcttgttcatccaataatttgaagccatcggggccaaagaacttgatgccattatactcagcaggattatgcgacgctgtgatctgtaccccagcggctgccccctggatacgtgttaaataagcaacggccggtgttgaaataatgccgagatccaacacttcgatcccaactgaaagtaagccggagatcagcgattgttgcaacaattgaccagaaatacgcgtatcgcgggaaactaatactaatggttttttatcttgatcttcttgggtttgggccaatacgtagccaccggtccgccccacgcgaaaagcaagttccggtgttaattcctgattagcaacgccacgtacgccatctgttccgaagtatttacccatgttaaaattcctcatttcatattcaaatatcagttactactcgatgaactagtagagctttcgctggtactagcgctacttgagcgatcactggcgctctcactattattgttattactgctactctcgctacttgcactagttgcctctgtactactctcactacttgattcagcttcgctatcactaactatgattttgacggatactgtgcttggatcagcctggacaccgtcgctagttggaactgtgattgttttagttgttgttttatcaacatcagcgattgaaacactaagctctaacgtcgaaattttatctaaactagcttgcgagccagttaaagtaacattatgcacatcactggagagatggtaagtcttatcatcttcaccttcgccggtttgcttcaagctgagcggcactttcttagttggccgcataactggaattgtgaccttaacggattgtggatctaataaagcattaacggtgttaccttgctgatctaaagcctgcaaagcagcttgttgcgtgatatcactggttaaattattctcagtgttcacattagccacaaccgaatcgattgccgcaatttctgcttttgatccggttacgacagctgtcgactgactcaattctggatcaccactagtatagccttgcgctaagttagctttattaaacttaacctgaatcgggaagcgttttattgcgcgtgtctggatattgactgtgattttactaggcacgatccgataaccaagttctttgtttaacccttcttggcgcaatcgtacagtgtgcttacccacacctaatttttctaaattagccatgatcttaaaattttgtgtatttgcagtagctgtaactaaggcgctgggaccttcaatattgattttaactttttcaggatacccagtgataaagtacttatcggtatcagcattgatctgtaacggtacttttaaggtccgacttttattagctaacatagttgtactgctagtcgttgcctgccgagttgaattaatccgatcaatattgacataaccaaataacatgattgcaaaacctagcgctaaaatgcggtagactaagggactgttaaagaacttgttgaacccgttcatttgcgagtcccccctttgataatgccgtcaataaattcttgaatgccatttcgctgtggtgtctctggctgaaccaaggctcgccgtaaatatttcaaataatcttcttgcgtcaattcttgaagcatttcactgttacgggtgatcatcacaccaccagtttcttcggacacaacgatcgttaaagcgtcagtaacctcactgatacccaccgctgctcggtgccgcgtgccatattccttcgggatcaaattactttccgaaagtggcagatacgcggcagccacggcgatcttaccatcctgaatgatcaccgccccatcatgcagcggcgtattcggaatgaaaatattgatcaataattcgccagttacatctgcattcaaatcgatccccgtctcaatatagtcttccagaccagtattcatttgaatggtgatcaacgccccaatgcgacgtttagacatatattgaatggccttatccaaggcagcaatcatctgattttctttttcattctggttgcgattacgggtaaaaatcgatccccgacccagatgttccaagccacgacgaatttctggttggaagatgatcacaattgcgatcacgccccagttgatgacttgatccataatgtacgacaccgtgcggaggccaatcccccagctgatcaatttgatcacgacgatgacgacgatccctttgagtaattggacggccttggtgccacgaaccagcatgatcaatttgtaaacaaaataccaaacgaccaaaatatcgagtacgttgacgaaattaccccaggtcagcaagtcactccaattaaaagacatgcaggctacctccatttttataaactcgcgtattattatagcacgaacggctgcccaatgctgagcaattatttgaatgcacactaagttagcataaagaaaaacacgccaatttggcattaaatcaagaaaactgcacaaacaacgctacgtcgctgaaaatttggtagaataagaataggtccattcatggaggtgatgatcgtatggcacaacggtatcaatggtttgtgcgcgcttcatttttactattttttatttatctctacttttttgcggtcgcaccgtttcgctttattttattaaatgtgtttctcggttatattccgattgaattggcgtttcattttgatcagcttaagccgcaatcagcaattttattctggctattagtcgtgctctggttacttttctatcccaacgcaccatatatgctgaccgatttatttcatttatctatgttgcgcccttatgacccggctaccggcttgatccgttttagtctacatatgtggctggcctacgcaaatttgattgtcgcggcgcttagctgtaccttgctgggcttttggagtatggcgcatacgattcaagcagtcgtcagtcgcttacaattacccgacaccaccttggttaaaaccagcctaaccattggcgtgacgatcttaacctcgatcggtatttttatcggtcgctttctgcgcatgcattcaatttacttaattctggagccaacgaagttcattaagcctttattggacatgtggcagccacgcatgttgatcttcgtctttttgatgaccttgattcagttgatcatttacgtttgtttacagttatttaaattaagtacaccaaacatgttagaaccaacaaagaagcagaccaccaaggactagccttgattgtctgcttcttttttctcaagcttaacttttttgtttattctttgccacaatgtttttgatccagagaattgaataaattgattagtgtacaaaaactgtcccgcacgccaccaaccaacaactgctaaaatgtagatcactggtaaaaattgaatcatgtagcgtgaacgccctccttcaaagaagagtaagaatattaataacccaaaaaaggtcatccgtaaaacacgaaatagaaaagtacgctctaagaaacttaacataacacctaataatattagaatccataacacctgatcgatagcacgatgaatagacagacgcgagccaaagttataaaagaaactacgcataaaagcgtgcttttttaaattatttttactgaaaaatttttcttccttcaaccaacctaaggtgccatcgctggtattagcataatttttaatcactaaaaatttcaagtagcctaaaacgccgaacttatccagacgctgcctgatccgctttaaattggctttttgctgacttgctttagtcgtatatttcgtactgtatagaaaatccgcttgagaatagctgccagtagtccccttattcatccccatcattatgtaatgactgggtagctcttgtaattctggattaatggaaataaaactctgttgtttaactgcgctttggctgactagttgacatccaccaaagacaaccgtaaaaagtacaacagtcagcaccatgttttttggatttaatttaacttgttttgctaataaaataagaccaagttcaactaaaaatgcaatcacaattattaatgcactgggttttaggcgataggcaatccaggtaactagtcctaataagcacgcctgttcagctaaattgaaattcagcttagtcccactttgccacaatttaaataaattagtgcccaataaaataattcctgcaataaaaggtaaaaccaaggtgtctgtataaacaattacgatccatggcgaaattaacaagattagcggtaatagtgaccaatacatagctctttgcaattgcttttgtaaaataataccaattaaaataagtgcaatatctacaaatatcatgttgataacatctaatacaattcccaaattgcaagaacaaattagccacacgataaatcctattaaatcagtattttcattaatattcatattttatggacttaacttaaccggcggaagcagcggagaaaagcgctttgggtgtttg

SEQ ID NO: 591 - DNA, 4183 bp, Unknown
  Metagenome-assembled genome
tcaacgttgcgccgctcaatgacgctacgcggacaataacgctgataaagcaatgaacataactggtaaaagtaatggaaactaacttgtaattcgtgacgattttgcttaaacttgaggtggttcaacacagttattactccttttaagttttgtcacttatgagtctaactgggttggacttttttgttaaatttctaaatgttacaaactagcaccacacgtagttaagtaattattttactatgtctcactaatggtggtttttttgtaatgttgtaatttgtttgggatgatatagtgtatcatttgtatatggtagtattgttcacttaaaaggtactatacacgtattactagtttacaagtgatctttagtgattaagtggagtggagttatacgaagaggttccttatcgaattaatgtctttcaataggtgctggctcattaactattattgtgaaaagtagtaagctgtgtttaaaagtgaatttggttaaaaaagggggataattcatgctgatacaacgtttagatatctatcaacgggaaacactgaaagacggggtaagccaaggtaaagagccgtatgccttaagcctatacgccactgagctaatgaacttttgggtcaatgatacatttagtctttattttgatttagacctagcaggcgacacctaccagactgaagatggttacttttatgaatttagtaagttcggtctaaccgctcgctattactttgtaaatagtccttacacgtgggaacctaagccccctaagatttgggcggctgatgatgccaaactaggctatataagctactatatagtcggtcccgatatcgtcaacagcggggacctgaaatggctagggctgaacactggtttgactttaggcaacactgatttagcacggttatacaaggatagtgaagcttatagctatccagtagacctcaaacgccaaaagctttattttggtaattacggctactatctaacaccggctaccgaaaaagaaaaggtcaccggcaagctgccagacttagaaaaagtcttcaacccgtcgactaccttaagccggccagacaacgattttcacgaaaattacttaaccatgactactaacacacgggtcaaaccacattatcagcctaatctgaatttgagtgacatgtggggcggcttctttggcggtgtctatctaggcggcggttttgatagtaaggataaatagtttggtcttaccaactaataatattttgtattcttgcaaataattactgttcggtagctatttttagttagtttcatcgaataatgtgtaagttatacaaccatggttctcaacgcaaagaagccacaccggctaaagtgtggcttctttgcatacagtaattattcggcaatcttagcttttggttcagattcagtttcaccgccaaaaattggtgtcactgtccgttcaatgtactgcgccttgattggcgttgcgtacggattaaccgcttccaactcaaacatcttcaaatcggcgatcgtttgcatcgctgttttgaccgtagtttcgtccagggtctgggaagcgtagttcaggcgcatgtgtttcgttttgccgatttcgttcttgaactccatatcaagttgtttcatgggaatgctcctctctgtggtggattgggtgtagtggtgtattgcgtagtagtagataattcagtggtgcggtatttccgcgatttagcgtcggggcgtacgcttggcggcggaaatggggcggtgcgcgttactcaggggtagtggaaacgtgataaattaggcaggatcttccgctcagctacgctatgagaacgcgccactgcgtgtctcttatctcctagctgggctgatactcaaatcctgagcgcctaatttaccactctaccctgcgtagtcatgtcgatcatatacaacggtgaccgcggcgctgtagccttcgttggctagtttagcgatggttttgccgaatgtgtccagttgttcaggggtggtgccttctttgacgttcatgaacttgtgcgtcgcttcgccgtcgatgttgtcgccgacggttttgatctgcaagtctgtttttaaaatagccatgggatgacctcctcgtcaattttagtgtgggtttctggagccagaaacccagtttttttgagggtcaatgcggccgtcatttagccctcacttatatatacgtttgagcctgccgttttgtcccgctgttttcaaataaagtggtgaattttcttaaaaagtttggcccggcgacgatagagggcgctgcgactgatttttaattgccggcaagtttcagtcacggaatcattttgtagatacaggtggttgaagatttggttttcgacgatcgacagttcagcaacgaggtcttctaagatcagatggttgatcaagtcggcgttagtcgttggttcaacggtggcctcgttgccgaaatatttgtgatagcattgatttttgcgccagtgatcatagatccgttggcacagcttggtatagagatagttattgcggctgatctgtggcgccggcaactgttcgtattggcagtaggcatcgacgtaagctagcaggcattcttgaaaaaaatcatcgtaatctgagcgttggcgggtgatgtggcagtgtttcagcgcaccaccgattagttttttatcgttgagtgcggcgttaaatgccgtattgatcaattgatttgtcattggatcacaacctttgcttgtagtgatcccagacgtctaggacgctatttagcataccggcttggccataaaaacgacaaacagcgcattttgtaaaaatgcagcgctggttaattgaaaatacaataagaaaaggctttcattacggcaatcgattttttctaatctagtcttcattaaatttttagtaaatagttaaccgcttccaactaaataagatttagcttatgctaatctgaaaaatggcgcgattgcagcgaccaattggaggggatcagatgggacaacgaccaaagggattgccaaataattgtttttattatgatttggcggatcagacgacgtatgcagaaacggcagaattatgcgctgattttgcgattcgcaagaccactatttttgttggcagcttggcggatgacttaaagcttggcaacgtgatctaccgcacggcggtgatcgatgtttctggtaaagtggtgctatgttcgcggacagcagtgcagttaatgaccgtgtacagtcagcataatttgttaacgtgtcgactatcacggtggatggccgatgagttggggctacagaactttccttattttcacggtgaaaattcatttattccggattctagtccacagcggcaacaggcggcttgggtgtgcagccgctggtattcaacgatgcgcgcatacgcaaatgcggtgctggtaacttttagtcaagcagatgagcgccagcccaaagtggtgattcgggtgcaacttagtgtgcgcagcttgaccacccaattaggtttggtgcgcgaatttctgctggcactgaccaatgtagttcagcaaggctttaaagaattgttgccgtcaagtacttgtgatctcatggtgccggccaatttaccgaagttgacggccttggatattccgcaagtacagccggcgcagctccggcaatttatttatgattgtttcagcgaagatgtttgtcagttggcagaagtgggacaaatgtcagtccgcgaagccactgcgtcggccgattatcatatacggccaccgcgcggtttgaagcaccggaaaagtaaggcggattagcgggtacgtggggtgaagtggctgtaactatgcgcgcaccgatatgattttagggtcgatctaagatcacttgaacttgatctaagatcacttgaactcgatctaagatcacctgaacttgatctaagatcacctgaacttgatctaagatcacctgaacttgatctaagatcaagtaaaaaataactaacatgagaaaaataaagttaagtaatgcgtactgaacaaatcgtattttaaatatttactaacttttgtcggtttttacagaaaatctgattgataaataccaaccagccaaaaataggccgcgaaaaattagccatcaacttggataa

SEQ ID NO: 592 - DNA, 5759 bp, Unknown
  Metagenome-assembled genome
ccaggcaatgttaaaatagccactcattggcaccacttgcgcggtcaccgccttaccatctacggttaccgttggtgtgccaacttgtttcaactgcgcggccaatggtaccacgacgatcggtgtgatgatcgtcgtacccttattggtaaactcgtcgaccatcgttacggtgtcgccggtttggccgttgctagccgtggggccgtgcacgtattgttgcgtcaattgattaccgttatttgaaatatacttctgtgcggtgacgtcatagttgaccgaatcatcgactacatagacgttgaccgttgccttagccgcggcgttggaagtgatcgtttcaccgttggctaatttcagcgtcggccgattgatcgttgcggtgatcgtatgcaagcccagcaaagtgctgtcagttcctagattcaacgctgaagtactggtgccgctggttatattcaagctaaaggttttactatcggttgcttccaccttggcaaagttgttcagcgtattgcctgatttattatcgctggcactgatcgtatcagcgttggcgtaatcgtccacccaggtccctttcagcgccaccgttttgccactggcgagctcgcttttcttgatataatacacgttatcgctgttccagttgatcgtcggtgcagcgggcgtgttggtttgattgaagaatagcggtgccccaagaatcggaatcgccgtacctgccgagctagcgctagtccccatatagtagagataacttttattcgccgttgtggtcaaagttggtaaggtcaaagtggcatccgtgctagggcagctttgccagccgtggccgccgtataagctttagtcgtcagcactgctttagtgttagttgttttgtcgatggccgcagtagtggcatcaccttttgtagtgtcaaaataattgacgactcgggcaaaacgactagtcccaactgcacctaatgttggcgccgtcgtgccagaataatcggtccccgctgcatcggtgcctttacctttggtcaccatcaccccatcagtcagtgtatttaacgtgaccgttcgatcagttaacgtgtccgtcagcgaaacgttattcaaccgcgttttatccccgccgaccgattcccaggctgaagtcgccgcattcagcgatttcttggtgtcccacgggctagcgtaggcgttccaagaagtcatattagtcgtaatcgtacttgataacggtgttgcagctgggatcaaccaatgcgtattccaatggcgttttcccagcagttgtccgactagcactactagagaagggatcctttaactggtttgtcccataaataccgatcttcatatcaaacaaaccatcggttcgtggagaaggtggtagcttaccagcagttaactgcttagaactatcggcaacgttaccttgatatttggccacatcaacatagaaattaatattagctgttccttgaatattactgaaaccaagtgagctaaaatttttgaccatcgctaagctccaaccaatatcgccctgtgcctgcatcgcactaccatagttgagcaaaccaggtgatgcattaggattatagaatatgctaaaaccgtaactattaccgccaaatactataccaaacagatcaccagaaccagccgtactggtagtgacaccattagcagctaatgctgtaggctttaactgactaccagatgaggtcatattattggctaagtcagtttgatcctgactacgcatcatttttaaataagccgttgagccactggtcacggcttgaaccggaattcctttaactttcaaataaaaaacatttttactatcaggatctaaataaacgtgatgatcaaattgcatcggaaaattaggtgtcccaatcaatccacttaatggtgggcttaacgttaaagagaagtacgctttatcccacttgattgcatcttgtaattgactggcatcaacatcagtgggcagggtaaccttgaccattacgccataattaccggcttcaacttccttgatatccaaatctgatttgatattcgctgtaaatcctaaagtacctgctactttaatgtagccgccagtataaggtgcatttccattagtcatcatgccgttagtaagattgagcttcgaccccgtaccactgcccgattctaagttattattactattgtaagttgcgtcggcgttatactgcgtggtaaaactggcactgttcactaccaagctaactcctgattcgttactcaacgacgtcccgccttgattagcgatcccagtcttcatcgtcatcccagtcgtactggtgtagttattattatcaaagccggcactggtgcccgtattatcatacacagtcactgccgcttgagccccaacgccagccaccaacagcgccacggtgccgaaaaagactagcagaccaaattttaatcgtggtttaattttcagcattgtcacaaccccctcgttacttttgccggtgccgcggtccgaagcggcggcctttgcggtacgcccagtaggttccaccggctgcaatgccaacgatcagtacaccgccggccacatacagccaccaattagtctgtttggtcgccagcggcgcgtcattttgcgtgctgatctgttgccctttatcaacgtggaactgcttggtcaatgtttgcgcgtagccgtcacgcccggtcagccgtaggtgcaaaacgtatttacccggttgtaaaactttggttggcatgaaatagttaaattctgaatacggcgccatttgtaattgctgttgctgatagcgcgcgcggactttgcgctggcctggtttggtcacggtgccggtaaaggtcatttgactgacaatgttgggcttggtgttgttcaaccgcacgtgtagccctgatttttctaaacgtacgcctggtaaaacgcgcttaagttgtacctgcggcatcacgggcgtcacattatgtcgtagcacaacacttaagttatacgccacttgattctgcacatgattgccatcgtcgccaaccgttgccaccgagcgaatgccaccaaggatcatgccgctaaagggtgcgtccggcattttaactttgaaagtgaccttggtcgattggccagcagcgactttgacggtttgcgtgcgctgaccctgaatcaagcgactaaactgcaatgactgcggggcactcagcgttttgaccgttgctcggtcgtaggcgatcagcccgctattggcggtataagcatcgttggcgctgacggttacttgcagcgcctgttgcgcatgattagtcacgatcacggttagcggctggacactattttcggctgcggtcagatcaaaataagtgactgccggattcgtttgggtggcgggtaattgcgcagtcagcgagtaactgctgctttttttcgccgccactggttggatcagcacggcaaaaatggcgaccaagcccagcattaacaagccgctgattttccattttcgctggttcactttgatcatcctttcataaaagcgccatttggtccgtttatcacacaaaggcgttcgaccgccagtgtgcgttatgttgcatttatttctgtttacgtttgcgcaggatcccgataacgatcacgacattcaccgcaaccagcacgccgaccactaaaagcaacacccaagtgtggtcttcgactagatcggtggctttggcgttagcttgtttggccgcagcgcgcggcaacacgacacgttgcttgatataccactgcttaccttggctggtgatcgtgccggtgatctgatagcggccacttcgaaccgggttattatcccgcccccacgtcagcggcaaccgcgaataaggagcaaaattctggtaagtttggacaaaagagttggtcgtgctgccgataccaagaaagccataatgtttgattttcaggtcgacggtcacgtttttcagcaacgcaccgcggcgattttccaaattgatcaacaggtatggctggccattataggtttgggccgtgacgccagccaacgctaatttaggcgctacactgcggttagtctcggtgagccaaactggaatatcaacggccatggcgctgttatttgccgtataaaaatgcaaaccgccgatcagtagaccgctaaatttttgcggtggcacctgtaccttgatcgtgaccagttttttagtgtgcgccgcgattttatactgccgcgccgtgaccatttgccgaaaatccggcgcaccgctgaccttgcctgtgcggttaaataagatcttgccttgggccgaggtcgtggcattgcgcggcgtcattgtgatcgtttggctagtcgccgcgaaattagtcagcgtgaccttcaactcgcgggtggcgccgggcttagcaatgatctgaaaccgttcggtgtgttcgccggaaatctgcggcaccaccgcaacattattgattgcagccagcgctggtttccctgtcaacaacagcacaaaggccagcaacgctaagaaccaatagttaagctttttcatctttatcatccgctttacgaccgcgccgccctagcaaataaccaccaagaaccaacaggataaagactagaacaccgatcacaatatacaaccacatgtaatttggcttgtaccccgcttgtttattgtatttagcagccgctgcggccgagatcgtaaagttacgggaaaatgccagcctagcgtcccgccagtcgccttagccgtgtaatccaaatggtacgtgcccgccgccaagcgctgcttattccaatcgatcgccaagttgtaatttgaattagctgacatcgacatactgttagccaccattttgtggaggaccttactgctaccttttttactgatctttgcggtcactgtcgcggccggtaacaaccacggtgcagtgttttgcgtgttcacgaaaaccgttgtccgccccgccttaacaccaggatagatctcgttcaactttaatttagcgttgccgacagtgtcacgaacgcgcagcaaaaccggcataccaaacgcgtatttgttgcgcatcaaggtctgcttctgcgtcgtcgtcacttcggccttttcgtgtagcggccacacgcggaccccaccggcgatcaatccggtaaagtttttgttgggcacattaacggtaaaagtgacgttggtgctgccattcgcagcgactttaacggtctgctttttcggctgctcagttagttggcgcaacgagtacgtcaacgtcgaatcgctggggatcttggccttatcgtaggcgatctgcccgttggcgttggtgtagccggtgtaaagcgccgccgcaaaagtacgctccttattcgttaaatttttgaccgcaaccgtgatcgtctgctgatcaccgggcgtcgctaacacgttgatgtaaccatcctgcgcccgctgattttccgagtattgtgggagcacggtgaagttactgttggtcgtggcttctactttttgcgctagcacgaacacacctaaaataagtgccagtaatgcggcccccagatcctgatttttttcatttgatcaactcccgacctttaaatttatgcttgggcagactagggactgtctgaaaactaaaaattcaggtataatctgaggaaaaacgaatcgaggcattccgatgacaacacctaaacgatacgaactggaagatgctcagtgggaccgaatcaaaggatactt

SEQ ID NO: 593 - DNA, 12449 bp, Unknown
  Metagenome-assembled genome
ccatcattgatgaactcttcgatcaatttatccgaacactgcccaataatctggcccaattattgggcaatggcgtgtaataactgaattaactaatttttagtcttcaaactcaggactagcaggattttgaagttatttgggtactttcaacctttagtaagaaatcatgaaaagtctgcttaatgtgtgagactctttctgaagtgtggttagggtgaaacagaattggttagatttcattccagcgcaagtggacggaacgagtggcggtttggcgagctaacttttccagttcaaagcaaaagcgggtggaaaagtggatctcgccaataccgcatagttgtaaatggtaaaacccaccattaacaactatcgacacatctggtccacttgcgcttccactccatctggccgcagtggcacatgtcagacttaattgtattgccgtcaattgtcattacacaattcaaaatagttcaagctgtacgcaaaaataccagtagaaacagttaaatctgtttttactggtattttgtttagaaataatttgcttgattctaaaattacgaattatcaagcttaaaggtaacatattagcacactaattaacgaccacgctggcgatgtcgttgcggtgcagtttggtgtggccacagctggaggtgatgatgtattgtttggccgcgccgatgttgaaaaagttgcgggcggtggtgttgatcacggcgtcatcggtgatcacttggacgttgtggacttgttctaaaattaattgttcgccggagtgcagcagtagcgttagtgttttgaccattttgtaagctccttcatttttgtcatatctataagataagccggatgaagttgataagcaaaaataacgcataggcagctccgtctcgatttgctttctcaatgtggttttttggcggctaagcggttagactaggagcatgcgtttaaactgatgaacggagatggtggatgacgatggataagcaagcaactttagcggcgatcacgcaggggtttgtgcaatcgcaaagtctgttattggctttaggggatgaaaatcggcagttgctcattattgccttattacgttttggctgtgatggcgcgcgggtcggggcactgacggcgcagacgcatttgtcacggccggcggtgtcgcatcatttaaaaatattgaaggacgctgacttagtgacgttacgcaaagaagggaccaagcattattatgcggtgaatcccaacggtaacttcgcggtgatccaatcaacaacagctatgatccaagctttagcacaggaggaaaattaatgacaaaaacaatgcaggccatgcaaatcaaacaatatggtcaggtaccagttagtgcaacacaagtgccgctgccagcggtaggggcgacggatgttttagtggcgattcgcgccgccggggtcaatccaatcgatactaagacccgcgatggtgaagtgaaactgttggtcgcgcaccaaatgccattgacactagggcacgaatttgccggcgtggtggcggcggttggtcgcgacgtgcagcaatttaaaattggtgatgaagtttatgggcggccccgtgatgcgcgtatcgggacgtttgcggaatacattgcggtggatgtcgctgatattgccttgaagccgcagtcgttatcctttgttgaagcggcgtcgttgccgttggtggggttgactagttatcaggcgttgatcgatttggtgcagctcaagccggggcagaaagtgttgatccaagctggtgccggcggtgtcggtacgatcgcgatccaattggcgaaatatttaggcgcgtacgtggcgaccactgccagtgccagcagcgcaccattagtcaaaaaattaggcgctgatctggtgatcgactatcatcagcagtcattcgacgaagtgctgcacgattatgatctggtgtttgataccctaggtggcgttaatttgcgcaaagcgttcacgattttaaaacccggtggtaacatcgtgtcggtcagtggcttaccgaacgggcaatttggccgccggcgtcactatagttggtggaaaacgtggctgttcagtttggcgacgctgaatttaactcggtgggcccacaaataccacgtgacctatcagtttttgttcatgcaagccaacggccgcgaattagccgaattgacggccttagttgaacagggcaaattacaaccgcagatcgaccgcgtttttccgttagcccaaacgcaggctgccttggactatgtggcccaggggcgtgctcacggtaaagtggtggtgacggtagccgcagagtaagcgggatgcgtgatcactgcggggacaccttttcatgcgggcgccgtttcctgttataataaattcattcagttataaagcaggtgaattgaagcatgatcaatttgttatttgccattgatgaccgcatgaccgcgcaattattgacgacgttgtattcaatcgtggtcaatacgccacaaaagcagtttactgtttacgtgatccagaaagaagtgctatcggccacgccgcagatcgaggctttttgtgcgcaaatggggctacgttatcggccgttggtggtgggggctacttttgtggctacggcaccggttacggagcgttatccggagacgatctattatcgcttgctggcgcaacgatatttgccggaatccgtgacgcgcatcttatatttggacgtggatatattggtgctcaacgatttgacgccgttatatgaatgtgatctgggcactgatttgtacgccgccgccagtcataatgcgttgagccgcaattcattcaatcagttgcgactgggcaactatgaagcagaaagttactttaactctggtgtgctgctatataatttgccagcagtccgggcacaagtcaaagttgcggcgatcgcagattacattcaaactaaaaaaatggcgctatttttgccagatcaagatattttgaacggtttgtacggacaccagatccaaaaaattcccgatgagttatataattttgatgcgcggcgtagtcgcttttattacgccttgagtagcggtcagtgggatctagattgggtgatcacaaatacggtgatcttgcatttctgtgggcgcgataagccgtggaaaaaagattaccacaatcgttatgctggcttgtataagcattatgcgctgcgagcccagcgcgtgctaaaaaggagtgatcatgatgatcaaagtagcccaattaaatgatttaccggcgctaatgacgttttataacgatttgatcgtggcgatggcgcagaccgcctttccgtccggctggcaaaaaggggtctatcccgatgaaaattatgtacgtacggcaattgtgcatggcgagttatttgtcaattggcaggacgacaaaatcgttagtgcgatggtgttgaacagcgtggcaaatgatggttacgcgcaagcagcgtgggcggtggcggataatggtgacaatattttgctgatccacaccctgggcgtcagtccagcgctgcaaggccgcggaattgcccaacaaatggttaattttgcgattgcttatgggcggaaaatgcacaaacgagcaattcatttggatgcgttagcgactaatctgccgccacaaaagctttatttgaaatgtggctttaattatattgcgacattgtcgctattttacgccgatactggttggactgatttcttactatatgagttggtgctgggatgaaacggttaaaaatttattttgcggccgcgattcgcggtggtcgcaccgatgcagcccggtatcagcagttgatcgcttttttgcagacgacacatcaagtgctaactgagcatattggcgcgacagacttgacggcgacaggtgagacggccttgactgacgccgaaatctatcagcgcgatcttcactggctaaccacctgcgatgtggtggtggcggaaacgccccaacctagtttaggcgtgggttatgaattggcttatgctgaaaaaatcggcaagccggtacttattttgcagcaacaagggccacaaaaactttcggcgatgatcagcggcgctccgtattttcagcgggtgtttacttatcgtaccgtggctcaggcgcagacgatccttcagcgcaaacttggcttcattagcggcactaaaccgccgaaaatgatagaataacagtaatgctattgaaatgagggatgaacttgaagcgaattgcagtttattgcggcgccgcagcgggtaatgaccccgcgtaccagcaggccacgctccagctggcggactggttagtggctaatcaattggagctggtctacggcggcggtggcgtcgggttgatggggctcttggccaatgaggtactgaccgctggtggcaaagtccatggcgtgatgcctaaggaactggctgaccgtggtgcggcgttgaccaaactgactgatttacagatcgtcgccaacatgtcggtacgcaaacaaacgatgttgacgctggccgatggctgcattgcgctccctggcggcccgggcacgttagaagagatcatcgaggccttttcctgggcgcagatcggcgacaacgataatccttgtgtgttctataatgtggccggctactacgatccgctgcggcaaatgtttgacgacatgacggcgaagggctttttaaccccagccgaccggcagaaattgcttttcagcgattcgttggcggaaatcttgccgttcatgaacagctacgtgccgccaaaagtacggacctatccgcaagctagtggcttgtaaaagcgcttggccctaaaatttagtactgctgactatgtggtcgacagtacttttttatggcaaatttacaggtctggggccatttgttagccgttttcaataaaatacgttaagctagttcttgtgtttataatcgaaagtaaagaatggggatgaaaacgatgaatctatttttaatgttactaccagcaattgcgtgggggatcttaccgttagcggtggccaaggtcaaagggcagccgatcaatcagatcttagggaccgccgtcgggacattgttggctagcgtggtggtttttctagtcatgcggccgtcgatctcaacgcttaattttattttagctatggtgaccggggcgttttgggtcatgggtcagttaggtcaatacactggcttccgtgagctgggcgtttcgcagacgatgccgatttccactggtttgcagttggtggggacgtcgctgatcggtgttttgatttttggcgagtgggccagcaccagcgctaaattatttggtgcgctgggtatcgtgcttttgatcgtcggcagtatttttaccgcggtgcatgatagtgggatccagcaggaaccgaatccgcggcgcaagagcactttagtcatgctggtattgacgacgattgggtttctcgtttttaacacgatccccaaagcaatgagttcgtctggcttggcgatctttctgccggaatcgatcggcatggtgatggcggtgttagcttacgtggcggtcacgcggcaaccgcaagtgctacgggctaaagccagctggcaaagtgtattggcggggttgattttttccgtagcgtcagtcagttacattttgtcggtgcgggccaacggggtcaactcggcgtttgtcgtctcacagctatcggtggtactgtccacgttaggcgggatgctgtttctgcatgaacataaaagtcgccgtgagttgatctttacctttctgggactggttttgatcgtcgccggcgcaatcacgaccaccatgttttagcggtgggtcaataaggggaggcaatcatggaaattcgactgttaaaatattttgtgaccatcgctgaggaagggacggtttcgcgggcggcgcaagtgctgcacatcacgcaaccaaccttgagtcgccagttgaaggaactggaagccgacctggataccgaactgttcacccgccagaaaaatcgcctgcaactgaccgaagcggggttatttttaaaaagtcgcgctgaagaaattcttgaattaacggcacagacgcagcaggaatttctcgaccgcaaaaagcagttattcagtggtcacattagtatcgggtgcgttgaagctgacaattcggatacgatgtcgctgatgctggaggaatttatcgccgattatccggcggtgaccttcaatatttatacggagaccagtgatgatatcgttgaacgcttggacaaaggcctgatcgatctggcgtttttgttggagccgatcaacacggaaaaataccataagatcgtgctgccgcgcaccgagcgttgggggctattggtgtccaacgagtcctttttggcggaaagtgcggcaattcagccatttgatctgatcggtacgccgctgttggtgtccaaccgcgccgacgtgcagcaattagtcgcggattgggcggggccgcccgctagacgagctgaatattatcggtaactttaacttaagtttcaatattatttcgttagttgaacgccaaatcggcgccgcagtctgcatcgaaggggcgcctggctacggtagcgccacgaaatttattccctttgcgccgactgtgcagaccaattgcgtcttagcctggcgccgtgaacgggaaacatcgccggtggtgcgcgaatttattcgttatttccggactgcatttgttaaataaacggaaaatcgactgaggctgtctttacatttttaacgggaatacctaaaatgaatgcacctgctcaattgggagcaggtgatactgagtttgacagaaaggatcgtgtcaatgacgtctcttgtaatggcggcggctttaagtaccaacgcaaaaattgggctcgcggtcggcgccgtcgtttttgtccttttgttctttaagttgatcgccggctttatccgcttttgtttccggcatccgtttatttttattttattgctactgtgcggcggcttaggctttatcttcaattttctgctggccggcgtggccattctggcagtagtcggcggtggcttggcgttttttgtactaaatgaatttaatggttgatttttggctaaacacttaccaaacagggtgccgactgtttgtgtaggtgttttttagttaacagtccacttgtggaaaaggcggtatagaaaaggtacaattaattttaccagagatatatacaaagtgtgaattggaggcgcatctagatgactgataaagaagaggccgatgcactaggccctgtcaagttgacaaatgaaataatataaagtttttggtcacttagatggcttcattccagtattcatccggggtgaggccatttctttgtgctgagcgattgtcatgattaaaatattcgattcctgattcaacgagcgttattaattcttgataggtctttgctcgcggatgacgcgccatccagcgaagtttaaattcattccaccagcgctccatcggggcgttatcatatggtgttcctggacgcgacatactgcgggtgatctcaaattgattgatgaaatgattgaacgctcttgaggtatacgccgaaccacgatcggtgtgaataagtgatgggaccttaccaactgcagtaaaggcacgctgaaaaacctggatctcagcggcactcgtttctgtggcgctgagattgtatgccaagagtcggcgaccgtataaatccaagacaccacttaagcggactttgtactcaccattaagcccataagttagttcagttgaatcagataaccaaactttattgggcgctgtcacttgaaagttttgctttaaaacattgtcgagtaaatattgttcagtttgtttggcccgtttatgcttctttggccgtacttgacagcgaatatcaagttcacgcatgacccggcgaacttgcttcaaagttaccggaaaatcaattagtttatccgcttgtaagttagtcagaagatttccagcaccgataccttggtggtgaaaatcaaaccaatattgggtgcgtgttttgagttgtttattgtgcttttcccatgttgtttcctgtcgtctaagccctttatgataagcttgtcggctgacgccgataacggttaaaagtttcgttacggcaccatgattaccttggctgactaccttgatagcgtggtaagccagccgatgtggtttgttcaccccctgcgctgaagttcctgaaatttttttatgaaggcctcgtagagttccttatctgccagttgtgcttttagttctcggatctggagattagccttatctagttcggttaattcatgattggcttttcgatgcccacggttatctacgagcgcttcatagccgccacttttagtcttgatcacccaagtacggacctgttggtaggagacttgaaagtgatccgcggcttcggtatatgagtgtttagctttagtcacatattcaacgatcttgatgcgttcttcaaaagttgtttgccgactcatggtagggacccgctttctagacggtctggccgtcaaggttttatccctattatacctggaaacccagttgtcgagttgtgttgatgaacgtaaaccaaattttgtggctaaatccagcagtgacccttcaccggccaaaaaagcctgaacagctttaagtttcaattcgttggaataatgattatttgtgtgcgcttccgtgagccctgccaacccatcacgttcaaggcgcgactgccaacgcatgagcgtttctcgatggataccatgttgtctggtaaaagtcccaattgataaacctgattgcttgaattcagctaacagcgccaacttttcatgaagcgtgtgtctcgatctaggcatacaaaaatccccctatgattagtcagatgaattatagtatttcatctgacaaccataaagggattatcgcacgagcgaatcatggccaaatatcaccgcgattttggcaccttttcgcaaaatgcgacccgcaaagagtatcggtttgtgctgcgttatgttgctggggaagccaaccgcaaacaacgtgaaattgctggtttgagtaatgacgtagatacaaataaggactagtgattcgcaattaaaatagccgtcacgcaactgattgttagttgggtggcggctgtttttagttaacagtccacttgtggaaaaagcggtatagaaaaggtacaattaattctaccagagatatatacaaagcgtgaattggaggcgcatctagatgactgataaagaagcggccgagcgaatcatggccaaatatcaccgcgattttggcaccttttcgcaaaatgcgacccgcaaagagtatcggtttgtgctgcgttatgttgctggggaagccaaccgcaagcaacgtgaaattgctggtttgagtaatgacgcagatacaaataaggactagtgattcgcaattaaaatagccatcacgcaactgattgttagttgggtgacggctgtttttagttcaataactttttatctgatcagcacaactttggcagaatctttcagcgattgttcaaactgatcgatagcgactgataaatcagtttgaattaaattattatttataggcgaacgctctaaaaaggcaaggttataggttgctggtgtggtcggttttgcaatgtaaaataaataataataatcgggatcaagcaataataattctggttttatgagcttatcatttaatctgatctgcgcatcttgatcgacaaaggtggttgcggttgttggtgttttgcgaacttgatctaaaaaacgcgtttccagccgcttgaaatctttattcttgaagtgatgcgtcattagcagaaatacgattatcaaatagatattaagatacaatcttagtgaaggggcaatcaagaaatactcgatcagggcagtcggaattaaaacgataattgcattagtaatgacaccatatcgccgtaccgttttaagatgatcaagcttattctgtttaagggcgtatttggcggcggcagtaagctgttcagtcgtaatctttgaagttatttcgacttgtttaatagctggcatgagttttcttcctagtctagttatttttaaggggacttagtacgtgcattcgggcattggcccaaccgacatttcaaaaaataaagaataattagattgtaccactctagttgcttggccacagtcgtattgggtgatgtttaatgaacagttgaattatttaggctaggaaacttgccgtggataaatggagatagactaaaaaacgaccgcattagcaacatacccaaccatttaatttcataaaatcatgaagtaactgtacaaccgaaacggttaattgttatactaaataagcaagaaagctagaaacaaagctggttgtctgtcactggaggtgttgccgatgagcaaactaaaaggtaaggaaaccacgcaatgtgctgaacgttctcgctttaatcatgctgttgacgttgttagtaaagtctttgaccaagctatttaacgctacaattaagctgattgaggctgttgccagattaaaaatggcaataaaaaagaaccgttcgatagcttgcaggcgtcaacggttcaaacgtaaaaattaaagccagcctaaatcttgctaacttgccacaacatcctgaaccggtgttgtgtctatttctatatctaaagtttaacacaaactaatcctaatgaaaaataaaaaacacgtttcatttaattgattgaattaaagctaaaaatccctataataagctcttttgataaatggtaaagcggaagtgactacacaacttgacgacatgattggtttgcatgcagcgactttatttggcataggcgataaaactggctaaagtatgtcatcaattttcatattcgaaagtaatcggttccatgctatatttaaatgagcaagaaagttgagacggttggcaaatccaagccgaaagaggatgatgcgcatgagcgtaattcaaaatctattaggaagcaggcgctgtgttgtctgtagtggatgcgttgatgatcatgttggcatttggtacgttcgttgtatcgcttgtcgcactgatcgttaccattatgaaattgattttagacaataaaaaataagccgtccaatatacttttcgacgagtatggacgacttgttctttaagttaacagaaagtcaaccgtcttaaatggttttgcgaggagcctattgcaagtgggctccgtttttgtatctttagtataacatgatttttctgtgctgtaattatttgacagccttgtgcagaaattccgccaagtaattttgaccgctcattcttctcttgcattcacaatatcattgatcgtttgtatgacttgtgttaaatttttagaactcgcgcgttctaaaaatttcatatcgcgacggttaaagtcaaatgtgtgaaattgtaacggattaatgtaaccattcactttttttgcatcgattgcaattaataatcccgagtcaagtaaccgattactctcggcatgggtaatcggacaaactaacgctaatcccgttaaccgtgcatacttttgattacttaccacaagcgctggtcggtacttattgatttcatgacccgtacttggattaaaattgataagtaccacgtcaccttttttgggcagatagttgttagttccactcactgtctatttcctccgcatcacttgtcacgtccgtttgtttaagatcagcgttgaaccaatctccttcaaatggattacgatgtttaggtttaaagacaattgaaccatcgcgctgctgatcgacttcaaactcggttcctggtgcaatgttgaaagctttaggaatcgttaaagtggttgaattgcctacagtccgaacctttactttcataatcgaatgctcctttctttgtgtatctgtagtatacacggaacagggacactaggtcaatcagattgcttgtaaatataaaggcgctatgcggttataagaatcttacatatggcatgtagaacagactttcatattcgatagcgaacggttttatgagcttatcatttaatctgatctgcgcattttgatcaaccaatgcggttgcggttgttggtgttttgcaaacttgatctaaaaaacgcgtctccaatcgcttaaaatctttattcttgaagtggtgcgtcattagcagaaatacaattattaaatagatatctaagtcgtgaaagttccaattcgagtaatcccttagtccaccaagctttacagcctaaaaattaaccttcaactattgctcatgctcagcgtgatcagcgccgaagtttgaatcgataagccatttaaaaattg

SEQ ID NO: 594 - DNA, 17386 bp, Unknown
  Metagenome-assembled genome
tgggacacacctgtattttgctcatccttatacgccgtcagaacgtggcagtaatgaacacctcaatgggttattaagagagtttattcctaaaggccgatccattggtgacttcagtgatgagtatctcaaacagatgactgctgccctaaatcaacggccacgtaaaatcttcggctagaaatcggctaatgaattcttagctgaacagttgcttgcatgaccaacacctagaccacttataagtgaaatctagaaagtgttgcacttgatttgacaattcgggactcattaaaagtcacctctatctcacaatttgggatggttttttagcaaagggcgctaagttgcaacatggctctagggtggtttcttagcaaaaacactaagaaactttggatgttcgtggtattgaagttacggttaaactaatgacctgcttatttatttttagcggtcgcggattgtttaatgttttctacttgtgctgccttcagatcaacttcaactgaagtgttttcttcaaaacgcttgtggtacttttcgggcacgattggcaaacctttacgccgcgcacgtttttcaaagtacatggtaacgatcggcgttaggattgaagaaactaaaacactagttgcgacgatggcggtggcagaggcagcagttccggcaaaatcaccgttggtcgaagcaattgcgtaaggtacggctactgcggcaccggcagtggaggaagcggcccagcctgcgacaccatcagatttggtgaagaaacgatcaacgaaggctagggcagcgccagaaactaagacgaccgcaaagcccataaaaataccgacgaagccggatttgaggatcataccaaagttgaggctgtagcctaaagtaaaggcgaagaaatgggactaatgccggtaccatcggtccaaataatttgcggaaactatggtccaatgaccctaaagcaatcccgacaacaaacggaatcaaggttgaaaccaaagcttgccatgggaacgaagcaattccagcgacgcccatggtgaccatcgtcataaaaggacctgattcaatactgataaacggaaaaccggcggcatcttctttacgccctaaggtagtcatcaaggccatatataggcccccgttagtttcgttaaatgaggcgatcacggctaaaacggacaagccagtgaatagaccagaggtaacgccacctttaggcagaaaagcgttcagcgtcacacctaataatgcggcgactaatactttggtgaccaatagtgacagaccttttttagcaatgtaaccagtttgcttcaagtcgatcgtggtacctaccgcgaagaaaaagatgaacaggatcactgaggtcccagttaagtaactgccggtaaagccgccgtaaaatttatcaacgccaggccaaagagtgttgactaaagtaccaagaaataggggagcgaccatcatgccgccggggattttttcaatactttttttgatttgcattatactatcctcctgaacttgttatttttaatttcacaataaatgcttaattatagtttttggctttattattcaatgcttctaaaagttaataaaatcacaagctgtattaaaaaaacacaataggactaaggctaaattacggtatcgaaatgaaaacaaaactgagcagtattagcgcagatcatgcatatcaacttcgtccatatcatcgtaggtttggttttcgccgcacattgcccagataaaagcgtaactagttgtgcctacaccacagtggatcgaccagctcggattgacgacggcttgttctggttcaacaaaaatatgtttactggcactgggttcgcctaaataatggatcacccgcgtatctggtgtggcaaattcgcagtacatataggtttccatccggcgcgcgtgggtgtgggctggcatagtgttccatgcgttgcccggttccagcacggtatagcccatttgtaattggcaggtatccatttgtgaagcatcgatatatttatgaatcgtccgcttattcatgtgtgcttggtcacccttaggcatggcgatcgcctcagcgaaggggggctttttattcggatagtttttatgggctggtgtggaaacgatgtagaatttagcaggatttgccggatcagtggattcaaaaataatctgtttggtgcccatgccaatataatagccgtcgtgggtggcaaccgtatccttgtgaccgtcaatggtgatcgtaccgctgccgccaatattaataaaaccgagttaacggcgttgcaggaagaaatcaacacctagttgctgatctaatttgatttctaagccagtcgttgtgggggtgacaccgccaaagatcatccgatcgttgtaagtataagttaataaaatatcggcaggactgaataacttttccatcagaaattggtcacgtaggtcagtagtactgtagtgctcaatatcttggggactatgtgcgtgattagtggtcatttgaaagctcatttgacttacctcctctattgcctaaaaagaaatgacgttgctagtttatgttgtaatcataaaatgattattaataaaagcacaagaaatatacttaattgtgataattttaaatacaattaactgaactttaaaagagtcttttatcgctgttgttttataaaaggcttgctaaaccgtattttaattaactgtagcggatgaaattggctttaaaaaagcataaaacttgctttgatttttgatagtattttattttgatattagagtaaacgctttcttaaactgcaatgactgagttataactagaggcgtttaatgacttgctactaacatttaatgaaagtgaggttgtttatatgcgtagttttagttatgttgggttacggcaatacttgttagcgctaggtgacgaatttcgtgaactggatgtgcttgtatttgaaagtcccagtcgctattatcaagtgtgtttacaccagctgcaggacttggagcgattgactaccaaggcaatttttaacgttgattgttaattttgaagtgcaactacatactatgaggataaggaaatgctgcggattaaaaaacgccaaccaagctaatttctcatgaaattaacatggtcgacgttttttaatcagttaaatagattttacgtagatcttgcagatcgtgatcggttaattgtaatccctcatgcaaatagttgttgaggtcgccagactcttgtttgacttgcttaagcgctgttgccaagtaatcggcatggacgctgagtaatgagcgaatattagcaatcgtatcggcagacgcgtgttgcgtttttaattcgtttaaccgtgcgttgatatgcggcgcggcaatcgtgttggttagcagatagtcggttttgatcgttttggcatcgacaccaagcgcggtcatgaagaaaacagctgccatcccagtccgatctttaccggcagtgcaatggaataaagtcgcagcgccgtcagcagaattacttaacaaaagctcgaagaactgatgatagatctgtttagcgtgaggatccgcaatcatattatgataaacagttttcatgtgttcatgaccatgattgggattaccttgatattcaagttctagttgctgtaatgtttgtgagttttgtgtttgatcgtagtcaaacactggtaaatatttgtaggtggcattggtgggcaccttgtctggagcttgtttgacttcatcggcggagcgcaagtcaacatcaattcgcacaccatagttgtcgaggtaggtgaggtcgtgttgattaagtggcgccaagcggccggaacgcagtactttatggtatttaatgtgctgaccattgatcgtttgatagccacctaattcgcgaaagttactgccgcttgtaattgggagtgcccgtaaatcagttacttctgtcgtcatcgattccaatcctttcaaagaactttaaagtgaattaaaaaagtgcccagattttgagcactagcttactaattcgcagcaatggtggatttattagcaaagaccgctaataatctttgatgctacgggtgttgaccattcttgtaacagctagatacataaatctgcttttttgaccacgtttccgctaaactttttgataaaaactaacttaacaacattttctaaacaagacttaccttaccacaaatcagcgctgaaagctgccgtgaaaactcgctaatcgtccagtacttcgatccctagaacggtcaggtgaccattaacgactagttgaatgactaacttagccatgtgctcaggtgaaaaatcactatcagcgcgtacccaccaattgacggtaccaataaaaattgaggtcatgtaagaaatgataaagtcggtgggaatctttttctggttgtgggtgatcaaaaggtgatcaaagatttccgcatagtgctgggctaataaatcgtgcaataattcggataaacgcatggcattagcaccatcaagtgccagcatatagaattgacggttagctttgatttcggtgaataaacgcgttaataagctagtaacggtttttaatttgatctgattgccgctgatcgtctcaccatcgagaatcttcagaaacggcaccatgctcgtcgtaaaaatctgatcgtacagatcttgtttatccttaaaatgggcataaaaagtggtccgattgatcatggctttatcggcaatttcttggatcgtcaccgcatcgaaaccttcttcctcaactagctgcatgaaggcggcaaatatcatttttttggtgcgcaagatgcgtagatccacttttttagccattttgattactccatttcttgaagcttattcagtgctcagtgagcgtgtttttcgtacaatagaaattaatcgacttcagcatctaattgagaatgattttcaattgtgaaaaatatcgttaacggtattttgtaatcggtctattttttaataatttagtcaacaattcggtttgatccgtttcttatcgcacaaactagtggaaattgctgattgaaatatttttgtgaagtcgtaaactaaacacaaatagtataacagacattctgttggatattcaacacgtgttcgctttctgtggtgaatagtgttggcatcgtgatggatgttttttagactgattgagcgtaaacgtgttggaacaagcagatttctgcgcctagctatgtaagtcaaacgtatcactgcgtgctacgtattgccttactaggctagtgctcagaatctgaacgcttttccaaacactctgagtgtaaacgtgttaaaaaagacagattattccacataactacgcttggcaaacgatcactgtgtgtatcttattgtcaagctaggttatgttccataatctaagcgtcttttttgacactctgatttaagggggatttcgcgatgacggagaaactttatggtggcattgacgtcggctcgacgacggttaagttggtcattatggacgcggcgcagcaaacaatatttgcccgttatgagcggcattattcggatgtaaaagcggcgagtaaacggatcttagaggaagcgattcaggaaattgcaccgacaacgccgattgcttttacgatcactggttctggtggtatggggctagccaacttgttacaattggaatttgtgcaggaagtgattgcttgtactaaaacggtcgaaacgttgattccgcaaactgacgttagtattgaactcggtggtgaggatgcgaagatcacgttcttcggcgcgtcgttagagcagcggatgaacggcagttgtgctggtggtactggggcatttatcgatcaaatggcaacactactaaaaacggatgctaacggtctgaatgaaatggccaaggattttgaaacgatttatccaatcgcatcacgttgtggggtgttcgctaaaactgacgtgcagcctttgatcaacgatggtgcacgtaaagctgatattgcagcaagtatttttcaagcggtggtcaatcagactatcgctggtttggcgtctggtcataaaattaaaggtaaggtcgcctttttaggtgggccactatactttatggatcagttgcgggcacggttcattgatacattgaatttggcgcctgaagatgtggtcttcccaagtgatccccagctgtttgttgccaaaggcgcagcactatatgctgaaaaacagccgcaaatcaacttggtgactttacttgatcgtttggaacatggtgacgatcgggtcatgcggccatcacggtcgttgacgccattatttaaagatgatgacgagttacaggaatttcgtaagcgccatgcccaagccaaagtcgaaacccgtgatttggctagttatcatggtgtggcttttctggggatcgatgctggctccacaacaactaaagttgctttaatgagcactgatcataaattgctgtacacttattacgataacaatgatggtgcgccgctagagaaaacagaagccattttgactgacttatacgccaaattaccggctgatgtcacgattggtaaagcttgtgtgactggctacggcgaacatttgatcaagaatgcgctaaaagttgatctcggtgaggtcgaaacagtggcccattatcgggctgcccatttcttccagcctgatgttgattttattttagatatcggcggccaggatatgaaggcaatgacagttaaaaataatgcgctgaccacgatcaagttaaatgaagcttgttcttctggttgtggctcgtttatcgaaacttttgccacttcgttgaaatatagtgtgaaggattttgcgcaggcagcgttattggctcaacacccagctgatcttggttcacgttgtaccgtcttcatgaactcaaaggttaagcaggtgcaaaaagaaggcgccacgatcggcgatatttcagctggtttatcgatgtcagtcatcaagaatgccttgtttaaagtcattaaattgcgtcgggccgaggatttaggcaaacacattgtctgccaaggtggcactttctataatgaagctgttttgcgtgcatttgaacagatctctggtcgtgaagtgatccggccgaatattgccggtttaatgggtgcttatggtgcagctttgattgctgaaactgcctatgaaacaggcgatgaaacgaccttacttgataccaaagacatgcaaaacttgacctttaaaaaggaattcatgcattgtggtttatgcgaaaataattgtgccttaacgatcacgatttgtagtgacggtcgtcgctttgtcaccggaaatcgctgtgaacgcggtgaagctcgtgggatgaagcagcgagtaccgaaggataacggtaaaattaatttagttcaagaaaaatataagctgttgttcggctatcgcccattacgtaaaaaggaagctcgcggcgtgattggtattccccgggtactaaatatgtatgaggattatccattatggcagactttctttactaaattagggattcgcgcagtattgtcaccaaagggcagcaaaaagcaatttgaatctgggatcgaaaccattcctagtgacactgtttgttatccagctaaacaggttcacggccatgtacaggctttgatcaataaaggtattcatacgattttctatcctgggatcgtctatgaacgtgtagaaaataaagacgcacagaaccattttaactgccccatcgtgcaatcctatcctgatgtgatccgcaataatgtggacgagattcgtgcgggtcaggttgattatcgtaatccatttttgaacttgggtgatcgtgagtcgactgcgcgcaacttgtatgaaacctttaaagattttggtgtgactgaagctgaagttaaggttgctttggatgctggttacgctgaattagcacatttcaaacaacagattcaagaccgtggcgaagatacactgcggatgttaaaacaaactggcgagcgtggaatcgttctagctggtcgcccttatcatttggatcccgagatcaatcatgggatcgcacagatcattacagcggaaggcttccatgtactaaccgaagattcgatcgcacatttaggtgatgtcaaaggcttacgcgtggttaatcagtgggtgtatcattcacggttgtacgctgcagcgcgggttgctgcccgggacccacagttggaatttgttcagttgaattcctttggctgtggcttggatgcgattgataccgatcaggtcgaagaaatcatgacccaatacaatcgtttgtacacttgtttgaaaattgatgaggggacaaacatgggcgctgtccggattcggttgcgctcattaaaggcagcagtcgctgaacggcgtcggcgtgcgatcatgcccgagaagttacatgaagatgaaaagcccgtacagtttaccaaagatatgcgtaaagataaatatacattgttaatgccgatgatgtcaccgatccatcagcaaggtttagttgatgtggccctgcaagcatctggttacaacgtagtcaatttgccagttgatgaccatcatgcgattgatgaaggccagaaattcgtcaataacgatgcgtgtttcccagccattatttccattggtcaaatgttagaggcactgcagagtggtaagtacgatcttgatcatactgccgtaatgatgacacaaactggtggtggctgccgggcgactaactacattccgttgattcgtaaagcattaaaggatgccggttttgcccaggtgccagtggtttccatgtcattaggtaatcagggtgttgaagaaacacctggcttcaaattgacgttaccattgttgaaacgagttgcgttagccttcttgtacggcgatttatttgaacgggtggtttatcgcacgcggccgtacgaaaaaacgcctggtgagattgataaaatgcatgatcagtggttgaagttagttcagccgagtgtgatcaaaggcaatttccacgaatttaaacgcaacgtgcaacaaatcgtccgtgatttcgacacggtaccattgcaacaattgaataagccgaaagtgggtatcgttggcgaaattttagttaaatactcaccaattgccaataataatattgtccgtttgcttgaacgcgaaggtgctgaagccgtcgttcccgatattgttggctttatgaactattcgttatacaatcagatctaccgttaccagcaattcggctttgctaaaaagtcagaagttttagctgaaatggcgttgaaactgatcaaatggtgtgaaaagccattgcaaaaagcgttgaccgcttctagtcgttttgagggtatcgccgcaatcgaaagtttagccgatgatgctagcaagattctttcattaggtaatcaaactggtgaaggctggttcttaaccggtgaaatgattgagttgctcaaaggcggagtggataacattatctgtatgcaacccttcggctgtttaccaaatcatgtcgtcggtaagggcgttgtcaaagaattacgtcaccagtacccacaggctaatattgcaccgatcgattatgatcctggtgtttcgattgttaatcagttgaaccgtatccgtttaatgttagcaactgccaacaaaaacttggccacacaacaaactgttgtcacaccggtgaatagtggccaaaaactctctacggttggttcacaagtttaaaaaatgaaagtaaacaaaaacgcccataattggacgttttttgtttgccttcatttagtggctaaatcaataaaactgcggtcatcctgcattaagggaattatcaattcatgacaacgcgaaagcttgtcgttggtaaaagtgaaaattgagatcacctcagctagtgcctgatggccattatgttgtgttgcggttagttggtaagctacggtgatcgtttgggtagcttcgtcaaaaaccacgtcatgaaaataactaaaaactaaatggtcgagattctgttgtaagttggctaagtgttgcttgacttggctgtaatttaattgttgaccattagtggtttgaagataattggaagtgaaatactggtctaatttatctaatgcaaagcggctcatgacatcacgataaagtaccgtcataaattgtgtagcttgtgctttgttcattgggttgacctgctttctaaattggcagagaaaacgttttcctaactaaattatacggtaaaagtttattgaagggtagtcaaaatttacatgatttcacaaattttcacattagattgatcacaaataaacgctaggtgattgacaacttaccaccaatagttatacttaaattgataagtgagtaatcactcactttaaattaggaggtgtcgttatgacaaattcaattattgatttagcgcatttagtgaaaaaatttggtgaacagactgttttaaaagatattaactttacggtcatgccaggtgagattgtcggtctgattggaccttctggtgctggcaaatcaacaatcatcaaattagcgttagggatggaagtggctgatggcggcagcgcagcggtatttaatcaaaaaatgcctaaccgcaaattattagcgcgaatcggctacatggcgcaaaccgatgcgttgtacgaggctttgtctggtcaagagaacctcgtgttctatgctaagatgaaaggtctgcctaaagctacttttgcagaagaaattgctcatgtggctgcagtggttgatttaactaaggcgctggacaagcgtgtggccggttattccggtggcatgaagcgccgtttatcattggcaatcgctttattaggacagccggaacttttagtgctggacgagccgaccgttgggattgatccggcgttgcggcgacaaatttggcgggaattaaataaaattcgcgatgccggtcgcagtattttgatcacgacacacgtaatggatgaggcagaactggcagaccgtgttgcgctattacttggtggtgcggtgatcgcctttgacacgccggaacaacttaagcaacaatatcaagttgcaacgatcgaggaggtctttttgaaggcggaaggggtgcaactatgagaacaattgccattgctacccgtgtgatcaaggaattactacgtgataagcgaacattagcactcatgttcttagcgccgatcttcattttgattttactgaattttgttttttccgccagtcaaactacggatgttaatgtcggaacagtcgcggtaacacaatcgttaaatcaggatcttgaccagagtaagcatgttacggttaaaacgtatgccaattatgctgccgcgaaaaaagcattaaataatgatcatctggatgcaatcattattcaaaaaaatcatgattatcgtttaacctatgccaacactgattctagcaaaacgacagcagttaaaatggcgtttcgtaatgctttgtcaacaagcacgctggcgaatttaaagggccaattggctagtactactgcggctttaattaagctccgtagtcaattacctaatacggccagtgtccctgaacagtctgcgaccaaagccacaacaccgcagatcacgaatcactacgtctatggtgatgcggacactggtttcttcgataaaattctaccgatcctaatgggctttttcgttttcttctttgttttcttgatctctgggatggcgttattgaaggaacgcactagcggaacgttggatcgcttgttggcaactccggtcaaacgtgctgagattgtttttggttatatgcttagttacggtattctcgccatttttcaaactgtgttgatcgtgttggtcacaatttggctgttaggcgttgaagtggtcggtaatttggcctatgtggtgttgatcaatttactgctggccctagtggcactggcgttcggtattttggtctccacctttgcgaactccgagtttcaaatgatgcaatttattcctattttagtgattccacaagtcttcttttcgggtattattccactggattcaatggccggctgggttaaagatatctcttatgtgatcccggtcaaatattcgggggatgccgcgacccaaattatcacccgcggcgtttctttgaccgatttgggtctggatattgggatattattattgttcttagtttgcttgacgctgctcaacattgtcggtttacgccgctaccgcaaagtttaattgattattttcagtaaaactaataggcttaaactaaagttccgtgtaaaagaggggtcgtatggaaactagtattttcaataattatcgcaactggatcgatgagcaaaaaatgcccaagggtaagcgggcggtgttgttggccggcctagatctgtttgcccaacaaggctataacggcacatcaactgctcagatcgccacgcaggctgcggtcagtcaggcaacgatttttaagtattttaaaaccaagcaggacctattattggcgattattcagccaattttggagaatttatttccacgttatcgggatgactttttgccggccttagatcagtttaaaacattgccggaagtggttcactttgttgtgcataaccgttaccaattttttaaggaaaatggtgatgcatttatgatcgtgctgaccgagttgttgacgaattcgacggtccgtcgtttatttttcaaggtgatccaggaatcacagccgatgatcattaaacatttcgcagcggcactaaataatgccggcgtgcgcgaggaattggatctattaacgattgctcgtatgatgattggtcaaattctaacttatttcatccaacaacgtttggtgccacaaattgcggctgatgagcagcgcgatctagaaatgattgaagtacagatcattcgcgcaatccaaaaataacgcctagtgttaggcgttattttgcttttcgacgtattcttttaatacaaccgcttgattatgttgttcatctttggcaccaaatagaaaaatcacgattgcatgctgtttcagcgtatttaaaaaatcagtagtcgctggattggctgctaattcggctagataacgtcggcgaaattcagggtatttagcaacatcatgattaaaccatttgcgtaagtcatttgagggtgcgatcgccttattccagtcatctactgcggcgttgactttactgattccacgcggccataatcggtcaactaaaagccgataaccggaatgatcagccggtttagtatagattcgttctaatttgatttgcatgaatgaactcctttcgttaaatagcaaacgtacgttctgaatatgctataataaataaaacaacaaaggtggttgccttgcatgagtgaaaagtatgaatggcgcaaacaagaaaaagcaatttatccgacacgacaaaaaccaagtatcgttgaacttagttcgcagaattttatcacaataactggtcagggtgatcccaatcaaccagaatttagccgccgaattgccgccttatatgcaatcagttataccattaaaatggcgccgaaaaaggcgatcaattttgcgggcgcatttgactataccgtgtttcctttggaagctttctggacattgccagctggctttagcggtgaggttaaggatcacaaagagatgctgcaatataaaatgatgctaaaacaacctgagtttgtgacgccaactgtttttgcgcaagctaaggagttagctgcagctaaaattccgactgatttggtgcccaaattgaatctagaaactatcagtgaaggactagtggcaatgcaattacacgtagggccatttgataatgaaccagccagcttcgctaaactgcaaacctacttagattcagccggctaccggcggaccagcttggcacataaagagatctatttatcggattttcggcgtaccgcgccggaaaaactgaaaactattttgcgggtctctgtggctaaagtggccgctccaactgcttaacgatcgatggtagttcagttggcgccgttgcaaaagcactcggtaccgctgcgcttagttcatcttgggagccaaagccataagtgacggcaatactttgcagaccatgatcatgggccccattaatgtcattttcgcgatcaccgaccatgaccaagttctggccatgcaccaagccagtttcggtttgggcataggcgatgatctcacttttaccagcgcgggtttcatccatgctggcgccataaatcgccgtgaaatattgactgagtgcaaagtgatcgctgatctgttgtgcgtataattctggctttgacgtggtgatataaagttgataattttgctgtagttgtgcaagtgcactagggattccagcataaactttattttccagaatgcctttatcggtgtaatactcgcggtacgctaataaagcttgttgcgcatcagcggcactgagaccacaatatttttggtaagaagccagtaatggtggtccaataaataactttaaagtcgcgtcatctaattctggtagctgtaatttatttaatgagtatttgattgaattaacgattcccaactgtgaatcagtgagggtaccgtcgagatcgaagaaaagtgcttgtagcatgcgaagcctcctaggtcatgatgagataattattacgtgtgtctagtttctattgatgaagtttacgcaggtaactaagcgcgtaatatatttttgtttgctataataagtatacgtgttttttcagaaattggcataatgtgttaaactaatgtagagaatattagatgcactgaattgaatgggtgaatgtatctaaagtaggtcaggctatagatgattgaccttaattgtggaataggagtttttttatgagtttaccaagtagaaatcaatcacggcggcagaatgtgattgcggcaccgccgaatcgtcatggtggtttggcggtactattgagtattttagcggtgatcagtttgttgttagctgtaggaactggcgtcgctaagcagcgtgtttttaacgctgattatttagtgaccgagttagataaaactgacgctggcaagcaactagccgaagtcgctaatgctgagttggctaatgtggtaactgataacggcctgccgagtagcattgcgccacaagtggtaaccgctaaagctgcgcagcaagatttggatcaaacggtgcgtaatctgttggcgggaacgagtcagccggtttcagtcagccatattgttgcgcacactaaaactaagttgacctcaagtttaagtcagcaaagtgccgctttagctgatctgggtacgactagcacagctgtcaatgcgctggctaatacattggagactcggttgactaaagagttgaatgttccgcaagtgactcaagcgacacaagaagttaagacagttcggagcctaatcaccggtgttttctggggtaccacgattttgacggttatactgctgcttgctttactatggttggatcacaacgttttccgttttgctaagcagtttggttggattgcgttggtcagcggcgtgatcgtctttatcggttactttggggtttccgctgccggaatcatagaaattgcggcgatcgcagctaaatcgtttagtactgcagcggcggcgatcggtaatgcggtattaaatagttatgccgtaccaagttatatcttgatgggactcggaattatcgctttgttgatcagtttgttaggccgtaaacggcgtaaaaattaaatagtttagacggttggagcagatgctttcaagacggtcccttctagggtgaggagggctggcttggcgtctgcttttttgttgattattagaggaggaagcgagtatggcatttttaggtattttatgtttgatcttggtcaccaccttattagccggacattttagtcgcaaaattggagtaccggcggtgattggccaattattagttggtatcgtcttagggccggcgatattaggctggatccagccaagtagttttatccatgatttttccgaaatcggtgtgatcttattgatgtttatggctggcctggaaagtgacatcggcttgttacgacggtatttacgaccgggcatctgggttgcactagttggtattgtatttccgttaagtctagtgactttagtcagtctttggttccatttttcgttattgctggcagttttcatgggtgtcatctttacggcaacctcggtttcgatctcggtggaagttctgcgcgaattgaaattgctggacagtaaggaaggaactacgatcttggcagcagcggtagtcgatgatgttttaagcgtggttattttaagtgtttttgttagcttgagcggtgaaaatactggcagcaatacgcctagcttgttagtgggcttcgctgaacagattctttactttattggtatttatttcgtggtcaaatggatcgcgccatttttgatgcatctgtcgcagcgctttttacttggctcagcagtgacgatcatgtcgctagtcatttgcttaagtatggcgtatttagcggatttgatcgggttatcagcagtagttggttcgtttttcgctggtattgcggttggacaaacaccttataaagctgagattgatcacaacgttgagccgatagggtatgctatttttattccggtattctttgttagcattggtttagagatggactttaaagggatgagctcggcgctgtggtttattgtcgcgctgacgattgtggcgattctgaccaaattaattggtggtggactaggcgcacggattgctggcttcgatcttgctagcagttatacggttggtgcggggatggtatcgcggggcgagatggccttgatcattgcacagatcggttatcaggctaaactgatcgttcctgagtattactcggcaacgatcattgttatcgtactgacaactttagcagcaccatttttactgaaacatgcggcggcacgacagctggcagcaagtaaatagagatacagatgataaaaaatcagctcaatttatgcgatgaagtgaacccccggtattggacgaaactttaagcaactttctgggtggtaagaacacggtatttaaccgggctcttaccacccagttttgttttgattctcgtgaaattataatattgaatccagttcgctacggcttgggttaattccgccaaggtatcgaactgtttttgatcataaacttctgcttttagaatgtgaaaaa

SEQ ID NO: 595 - DNA, 15143 bp, Unknown
  Metagenome-assembled genome
ttggccggattaatactgtgcgcgtacagaactaaccaactagaccactcaatccttaagtcgatttctacagttgcatctacaccaccttctgaaccacggttttcatagaacttttgacgttaccaaaataatagtctattagccatttgcatgacgttctgcacttaaaaattatgtatacgcgaaaaatttgtccataaaaaaagtaaatactcattccaaacgtatacgcgtcaggacgagtatttacccgtgttaccaccatcatttaccgctacttcacagtaacgacctcaatcagttcaccgccaacaactcaatgtcagccagtaaaccgtgccacgccaacaggtggctaccgatctatttttagctcaataggtttactccaagttcatcttcagcggtcaattctagtaccctttcaccaaccggtactcgcttaatagatcatcacgcttactcttctcttcatcgtaatattattcatttttaataattgtgccaactttaagccttttgctaaaaattgtcaagcccagattgaataatacagttttatgctgcatcgtattaattaagccaaatccgtacgtgatcatgacaaataaattttatttattttaattgccaaacgtaaaacatcccgtactgatttttcacagtacgggatgtttcatttgctcattcaatttcttttatccgactaagttacaataaatccagttaatccatttttaatcagtacactcgactaactaatatatcacaaattaggatccatcttaaacgtcagcttcgacaactccgccccttgcatcgttaaatcagctaacagcttcttcgtcgcttgattataatgagttgcgatctcatggttctgcttggtcaaatagtttgttaagtcagcgccagctagattttgagcttgttgatcgacttcacgaattttggttcgcgcccattgtgatagttctttttgataatccaaatcagcttggatgaattcagcataatgcgcttcgactaccattgccaaggcttcatatagccagtaagcactgtctaatgacatcgttgctggcaattcccgataagaagcatcagtatcagttgcgttggtaaagaatgggacatgcgggcaaaagctaggtacgccaaagccgatccactgtacgccagcggcaccattagtccggctgtctcgcatttggagaatgtgcgaattagcagttcgtgaaagtgagatcgcgcgataagtttttttgtcgtgttcactaccatggcctaagggatcatacttggtctcgttgtagtgtgacttcaaaatatactgaatatcttccactgaaattttacgactagctttgcggataaatggtaactctggtgattcaggatcttgttcaatttctggattcagataacgctgcgcaaaccaaacccgcggtgtgttgtagtgatgatccttttccgtatcagtaccgaaaatatgacggaaattccaccggtcagcatctggatttaattgattgttagcgacaaactcttgaatgccatcagcccacatataattatccggatcattaaaatcgatctcttcgattgcaatttggttggccgctacggcgtaacaatcatctggtatccgtactgcgacccattgatgtccggtaacgatctccatataccaaacttcatcggcatcgttgaactggacgccgttaccttcagcggaaccgtattttttaactaattcaccaagataacgcaccccgtcgcgcgccgaatcgataaatggtaaaactagggtcgtcattgaatcttcggctaagccatttttgacaaaaggatcgtaagccagtacacgttcattggcgtagacactttcagtcgcgctttcgcctacattcttttcgttgaaaccatcctcttcgtttggaccatcactctcatccccatttggcgttgaagtgtagcggtatcctttttcgggtaatggtacggttaagccgttatacggtgacgtgtagacttctttgcgcccagttacggctggttgcacgaggaaacgtttcggatggatcgccaccaagcgatcttcgttacgggaaatataagttgcaccatctaatgaagcttttttaccaaccaagatcgaggtgcaggctgataattcaattcgacctgtcatttaaatatcctcatttctatttcacacttaaggtttgctaatgattgctgctgttatagacgtacgaccaggacttgcttgcatttcgatattagtccaatcgacagcggcaagcgctatatccgaatccttacctaaacgaacaacaatcaccgcaaaaactcacatcttcactaacattataccgcgactgttttgaaaataataatcgatcgtagccgtaaataaatctcactttttaagttgtgcatatgatttaacacacaaaaatcaccgcgttataataaaagtggacgcaggaaagcgtactaattcaattatgaaaggaagtcttcttctatggctaatgaaatcacgaatgaagcgaatgatcgtcgtttggatccttttgatcgcttagcacggcaattttttggtaattacccatcaacttttaatgacaaagttttacggactgatatcaaagagcgtgagcatgattatgtggttgccattgatgttcccggcattgaaaagaaagacatccatttgaattatgacaatgatactttgagtattagcgttcgtaaagatagttttggtgatcacgaagacaaagatggtaacctactgatgtcagagcgccactatggccgcatgagcagaagctaccggctaccaaacgttgattccagcggcatcactgctaaaaacgataacgggattttaactattaccttaccaaaacgggcagatagtgcagctagccatattgaaattgaatagtcaatataggaacggccgttaacgtaaaattgcgttaacggccgttttaataatcattaaaaaaagctaccaaccgtaacaatcacggtcagtagcctccacgtttagatagctaaacgcgcacgaactttttccatttctaattgacgtgtcttgcgtggtaagaaacgccggatttcttcttcgttgtaaccaatctgtagtcgtttatcatcaaacatgatcggccgcttgagtaagtctgggtgttgcgcaattaatttgattaattcactagttgagatggtgtccaaatcgatatgcaatttgccgaaaatctttgcccgtgtagaaacaatatcctcggtaccattctcagtcagacgcaacaggcgtttaacttcatcctgacttagtggttgtgccatgatattacgttccataaatggaatctcatggtcacggaaccaagcgcaggccttacggctggatgcattacttgatgacgtataaagttgtacggtcatttaaaaacgcccctttgtcaaaaattttgtacgacgatacaaataactttataacttattatttgtaagtaaagtataccaattattagcacttattacaataggttgcgcaaaattttttaaacttttattctactacaactggtaaaaaacacagtttaatatgatcagtctagttagtttaacagcactagcttaactctaacttaaataataaattggtaccgtattcgatgaattccagttgcgtacgaattaaaatcaatgtatacactcggtttgacattaatttttgatcagcgtatcttaagcttatcggcttactttccgtaagctaatttaatttgtgtggaggccgttttatgagttcttttgatcaagctttaactttaccttctggggtcacgctaaaaattcggttaatgatgtcaccgatgacgacgcgccaaagtttctttaatggaacgattacgcaaaatgagatcaactattatgctgaacgtgctgccggcttaggtgctgtaatcaccggtgctgctaacgttgaagctggcggcaagggttggccaggtgagttaagtattgctgacgataaaaaattacctgagctgacccaattagccagtgcgattcagaccaaaggtgctaaagccatcgtccagattttccacggtggtcgaatgacgaacgcagcgactttatccggtgttcaaccagtttcggcaagtgcaattgctgcagaacggccagatgcagaaacaccacgggcaatgacaactgctgaaatccacgcgacgatcactgcttttggtgaagctacacggcgggcgattcaagcgggtttcgacggtgtcgaattgcacggtgcgaatacttatttaattcaacagttcttctctccacactctaaccgtcggactgacgaatatggtggtgaccgtgaacagcgctatacgtttatcgccgaacttttagattccgtttttaatgcggtcaaaaagtacgcgaccaaaccatttatcgttggttatcgtttctcacctgaagaattcgaaacgccagggatccgttttgctgacacgttgtggctattgacgaaactacgggaaactaaattagattacctacatttgtcattgaatagctacgaccgcgtggcgcgtggtaacgattatcacgacaaatcgctattagcctacgttcacgaagcaattcaaggtaaaatcccattagttggcgtcggtggtgtccgcacccgcgccgatgttgccaatgtgttaaatgacgctgaattagtcgctgtggggcaacaattattgtttgatccaacgtggccattgaagttagcttcaaataacgacgacgccatgtttagtggaaattttgctggcgcaatggcttacactccatttgaaacaccactttatgaatttttagctgaacgttatcattcatagttagaagcaaaaaacgaccttaaaaggtcgtttttatttaccaaaactttgattcaattgctgtaagatagctgctaaattagcgcgctgttctaccgaaagttgttgctgcatttgcagctctagctcttgaaaaatcggttgaatctgccgcacaatactctccccgggcatagtcaaataaagctgtttttgccgctcattttcggtgggaattttgcgggtgatatagcctttagtttctagccccttcaaaagattagttacagttgccgtttgcttacctagataacctgccaattctttttgaatggtgccattgtgactagcaatataagtcagcgttcgtgcttgatattcgttaaggttcaacttgcgcagccgctcaagaacgaataattgttgttgtgtgctcagttgatagaccgcttctgtcagacttattgtatctaaattcatagttaacatggctttcttttttgcttttagtttaaatcacaatagttgtgttaacaactatttatgctcaactatataactaaacgagatatttctatgtctttgaccgtagaaaacagcaaataaatattactaatttaaaaagaacctgacactttcgtgcttaataacacattgacattatattattatcttgcacatttatttgttaatgtaaaacaacactatctagccttagttggtaattgtcatggttattagttttttgactgctaagaaaattgagcgcaaattattaaacagaaacagtcgattcaactgtgaatcgactgtttctgtttaatcaaattacacttttttacaccatttattccaaaagatagcgcctacaccaatcgaaccagccacgacggttaaccccaagctaaaaagtttagcatcaacttgttgggttaaaaagttatgcagccacggtagcggtaatcgtaccataattcctaaaagcgcttgaacgatgaccattaaatagactggaaaataaactatgctccccttttcgtgaatcaatatacctgtaactaataacaatagtaggacgatcacaccaatgcccgaataaccagttaaatgaacttttagattagtctctagaaaagcggataatacaaccacggtaatcgtcgcaacgacaatcagtccatgtacaaaaatcgttagccacgtttggacttgataaatcaatgtacttgccattaaaatccaaacaatcacaatgacgattgtaatactgcccataatgagaatattgcccacatcaaaagcacgatcgacatcgatcatcaacggcaataaatagtatgaactgtagacaagtaacatgtagccaaccaactttatcgatgctaaaaaatcattcggtaatacttttaaaatatcccgtacaatttgttgtggctccttgccaaaataatcggctgcattttgcccattttcttgcgccgctatcatatcatttagaatatctaataatgtcgcttcaacatctctatcccgtttcatccaagaatgtccacgcatatagagcaaaatattttcgtagtagcgccggtttactgcggtcaactgctgacgaagctgctcattttgctgaaccatttgatttactttcatttagccctcctgcttaagtagtgcggtaacaccatttgctaaaataccccaatccgtaataaaaatttgtttagcctgtaatcccaatgacgtcgtatgataatatttgcgcatcggcccctctgctgacgcgcgccgttcactggtgatcaacccctttttttccatattcagcaacaatggatagatcgtacctttaggaatatcagcaaaaccatattgagctagtgcctgactaatcgcataaccgtaaagttccttctgactcaataaaatcagcaaacatccttgtaaaattccctttaacatttgacttgatgcttcacgcgcaataattatcaccaccttactagtatgctttacaagttatagtatattgtaaagcatactagccgtcaaatcattaatgaataaaacaaaaaagctaagacttatagaaactaatcttagctttgctataccatattatgctttaataacctattcctcgatcaacaccgcttcgatcccatttcccgccagaattcgtgctgcattatacggattcaagcctttgcggaacgtaatatagactttacgctccattggaatttcggccagccgctcacgtaactcacttagcggaatatttttagttgctttgactgtacccattgttggtcgatcagcttcgcgtatatcgaggaaaaaggcagtcgcaaaatcagtcgttggaatatcgctaactttgatcgtcaatgcagttcgcttcagttgattaatagccacataaccggccgtgtttattggatcacgagtggttgaatatggtggtgagtatggtaactctaaattgggtagatcgaataccgttagtcgcccggtaatagcagttgatagctcaccaatgcgtttatcaacaccgcgttcaccaaccgcctgtgcacccaatattttgccagtttccacctcaaaaatcagttttaaattaagccgcttggcatcggggtagaaatacgaatgatcaaaaggcgtgatcaaaatcgttttataattcgtgatgcctgcggctttgagcatgtgctcggtgtaaccaacaaaactaaccgttaaatcaaaaatttttgcgatccccgtgccaatataaccgtgataggtccaatcggcaccgttaatgatgtcagctagcaaatggccctgacgattagctgcgctagccaacagactaggcactgctagtcctgtgatataacttttagtttcgatcacatccccgattgcataaatatctggtgcactcgtagctaacttctcatcgacaataatgcgtcggtttgtggctagtttgagaccagctgtcgccgccaattcactatttggtctaaccccagttgcaaagatcaatagatcagtcggcaaaaccgtcccatcattcaaacgcagcgtttgaccagcgtcttgaatctcaaccaccgttttacctaacaacaatttaagtcctttttcagttaaatgtgcctcaacgatagctgctaattcaggatcatacggaaaagcaacctgtgtcaattgatcgaccacagtaaccgtcatccccagcgcgtgtaaattttccgccagttccaatccagctggaccagcaccaatgactgtcgctttttttggtctttgtgttgcaataaatgatttgattcgcgccgcatcagttacattacgtaaaacgcgaccattagccacggtttcaatacctttgatcggcggtaacagtgctcgtgttccagtagaaagtaccaacttgtcgtatttctcctgaaaaacttcgccagtagtcaaatttttaacagttaccgatttagttgctggatcaattgcggtcacctcatgacgtaccagcacatcaatattatttttacttttaaaaacttcgggtgtccgttcgactaatgaatcaagatccgtgatcacatcgcctaaataataaggcagcgcacagctagcataggaaatataatcgccacgttcgatcaacaaaatctccgcctgctcatttagtcggcgcaagcgagtcgcaaatgatggatcgcctgccactccaccgatcacaataactttcatcgaatctgcccccttgcaaaagtaattcagtaacgggcctactttgcttaggcctagtttagcatggaacggcagccgaccgaaagcgatatcattttagtcgaacttaatcttggtccgaatagcggaaatggttggcaagtacattgataccagtgactatcgtggcgatgatcagaccactgccgagtgccaccaataaatgcttgccgtgtaacagccacaaaaaggatcctgcggcgatcacaaaaacgattaagccgagcaacaataatttccctagtttcacttttgccttatcttccattgatgtgctgacggtaaccgacaacacgatcattgtccagcaaccgaccatcaaggctaaaaacaacatattatcgtaagcaaccacctgatcaagtggcgttccttgaaaaatctgataagctaacacacagagaataaagccattttccactaaaaaagcggtgcgctgattttttaaattacgtacgatcaagcgctcatcagtaattttcttcattttcgttcctcccaaaaaacttcatccaatgttcgccccaacacataacagatattcaaacacaacttcagcgaaggattgtacgcaaacttctcgatcaagctgagcgtttgccgcgtgatcccgactttctccgctacctctttttgcgataaatgttgttctaaacgaaattgccgcactttatttggtatattgatcacctgctttttgtaatatatatcttccttatgtgtaaattatatattactttaatgggaaacgcaatcactaaaaaagcccgcattatctgcgagctcacacttaactattcgatatttaagatccacatgaaacctaagaaaacgaagaataacgcgtacatcagcggatgcacttctttaccccgtttagccgctaacatggtgatcggataagtgataaagcctaatgcgatcccatcagagatactgtaagtcaaaggcatgccgatcacaatcaagaatgacggaatggcaatttccattttatcccaggaaatatacttcaacgattgcgccatcagcacgccaacaatgatcaaagcaggcgcagtcacctggttagtgacgaccgccaacaatggcgagaagaacatgcccaaaatgaagaatacgccggtaacgactgccgtcaagcctgagcgaccaccaacggcgatcccagctgaagattcgacataagcgccaactggggaagtcccaaagatcgaaccagctaacatagccgttgaatcagacatcaatgccttgccgacccgcggcattttgttatccttcataaagccagcttgttgcgctaacccaactaacgtgcccgcagtatcaaagaaagtcaccaacaggaaggttaggacaacgacccataactgaatagtattgatatcaccgatatgcatgatgccaacaccaaaagttggtgctaagctaggtgcactggcgatccagtgactaggcattggaatcaaaccagtgagcaaacctaaaatcactgataaaaccatcccaataaagataccgccgggtacctttttgaccattaagatcgcagttactagcaagccaaaaacggtcaaccaagtggtgccggtaaatgaacctaagccaatcagcgtcgatttgttagcgacgatcaagccgccattggttaggcccagaaaagcgataaacaggccgatcccactagaaatcgcatatttcaaatcactaggaatcgcatcaatgatcaactcacgcagtttgaagatcgtgatcaccatgaaaatcaacgaagccacgaagacgccggctaaagccgtttgccatggtactttcattccaataaccactgaataagcgaaaaaggcattgatccctaacgctggtgccgtggcgattggatatttagctaatatgcccatcagcaagcagcctagtgcactggccaaagctgtcgccgtaaatactgcccctttattcatccctgaagcgccaagcacgctaggattaacaaataatatgtaggccattgaaatgaatgtggtaaaaccggctaaaatttcccgccggactgttgtatttaactcatctaactgaaaatactttttaatcgctgtcactaagccatcccatctctcttattataatcacaacaagctaaatcatataatagcattttctgaaagtaaatagctagctgcctgaaaaatgattttctccgcatcattaccagtatgaaccactaaatttacaagacttaaaatcaattaaggcaactgcacaaccaatattaggccaactaacgaatcagacattcttacatcgaaatataaagcgctttccaaaaactccagtataatgagtttagttttaagggaagaaggatggcaaatggccaaaattttatgtgttttatatccagatccagttgatggctacccaaccgagtatgcgcgcgattcagtacctaaaatcacgcactatcccgatggcagcaccgttcctactccaagtgcaatcgattataaatattattgaacatgtgatattgacctgcattcactctaccagaatcagttcgtgcgcctaaataatttctatctatcagaaacaaaaataattgcctacttccagataaaatcgttatactttatacagcaggtgagcatatgaaaaaagaaaagaagtatgccaaaatggctgatggcagtcaaatttattacgaaaaaagcgggcacggcttaccgctatttttattacatggtaacgatggtagtgggcgctttttctccaaacaagtagcaatattccagcgctactacacggtctatcaaatcgacagccgcgggcacggccggtcaactaatgcagctaatgtactgagttttcatttaatggcaaaagatttaaacacgattatgcggctagaaaaaattgagcaggcagattttctcgggtttagcgatggcgcaaatttagccttggtcttcaccgacagtttcccgaaaaaagtacaccacttgattctaaattctggcaataccttggttactggcgtccgcttttccgctagggtcgctactaactgccactacaccttgatctggctgctagcctggatctatcccaagttacggcaaaaactattagtcattcagctattattgcacgacattggtttatcgaaaaatgatctcaaacggatcaaagcaccgaccttgatcatcgtgggtgaaaaagatgtgatcaaaatttcccattcacgttatattgcccaaaccattcctcacgctacatttgtgttagtgagcaagcaagggcaccaattggccaggaaagatcctaaacgattcaaccgcgaagtactgcagtttctggccataaactaaactagaaggtgaacgatttgctaaatcaaaccctgcaatggctgaaaaaccatctggggcttttcaaaacaatttttttaatttccgttgttgtgatcatcgtcagcgagctaatggccattggaaaaacattatcggcggctcaattggcaacaacgctgaccacgattccgttctggaagacaggaacaatgttgttaattggtcttattgcggtgctaccaatgcttggttatgatattattttgaatcaattactcgaacaaaaacagaaaccacgctatttattcgaaacgagttggctgatcaatacgctcaataatatcgtcggtttcggtggctttatcagtatcggcttgcgctcagaattatacggtcaaaagaaagatagtcgacgtgtgatccaagccttgtccaaaattttcttgttcttactggctggactttccgtttacagtttaatctcgcttctattgatcacgttgacgccagtcgcaccatttctgaaacagtattggatctggctggtcggtggtagtctgtattttcccgccattttactgttcactacgtttaaaaagcacggtttgatcggcggtctcacacttaaaacgcgtggtcagttactgctggtttccgttctggaatggtctggcgtacttgttagttttatttcaattggttatttaatggagatccacgttgatctatggcagacgattcccttatttgtcgccgcatcagtgattgggatcgtttcgatgattcctggtgagattggtagttttgatgtcatgatgatcatcggcttgtcggcgatcggtatcccgcgggaaaccgtcgtgatctggatattgctttatcgtttattttattatattgtgccctttttgatcgggctcgtctttttctttaaaaatatgggtgcaacgtttgatcaacaatattctggcattccaaagcaattagcgaccgaaattgctcatcgcatcgttgtcacacttttatatttttctgggatcatgttggtactgtcagccacgattccacaagctttcatggaatggcagtggctacatcgattaaatcccttgaattttcacattattatccaatttcctagtattttattaggctttctcctaatcgttatggggcgtgggatcgcagcgcgagtcaaacgggcatattcgccgacaatcattttgatcgtactagccctactttacgtgctgctcagcgactttagctttaccgctgctatttttctgacgatcctacttctaagtatcattgcatctaagaatgaattatttcgtgaacaattggtttatgcttgggaatggcgtacgatcgatggtattctgatcggcacattatcgctactttacatcattatcggtgtttataatctacctaatttcccacatcgccatcatcactttatcgccttctttttgtttccttctgaaaagatttggttctcaggcttactagcaattattgtggttagtttcgtgatcgttctttttgttcattttcttcaaggtgctaaaaaacaagttggtgaagcgttcaatgaagccaaagccttacaaattttaacgacttacggtggaaactctactagccaattgatctttttaagagataagcgcatgtttacctatgaaaaagatggcgtcgcaactgtgctattgcaatttgcctgttacaataacaaatgtatcgtaatgggcgatccttctggcaaaaaagcagattttccagcagcaattgaggcctttattgccgagaccgaccgtctttgctacttaccagttttttatgaaaccagcgaagaaatcgtcatgattttacatgaatttggctatgattttattaaaatgggggaagaagcttacgtcgatctcaataactttacaactgcagggaagaaaatgaaaagtacacgcgccgtgatcaaccgcattgagcgtgaaggtttcacttttgacgtgctacaaccaccgttttccactgaacaaatggccacttttaaaaatatttccgataactggttgggagctagaaaagaaaaaggtttttctttaggtttcttttctgccgattatttgcaacgcacgccgattgctgttgtgaaagacacacatgatacggtcgttgcttttgcgacgatcatgcccacatacactgataaccaagtcggcaccattgatctgatgcgctacgatccggcaaccgcgccgtctggtagtatggacttcttgtttttaaacttatttaactatatgcaagcagaaaagattcagtggtttaatctgggcatggcgcccttagctaatgtgggcacttcccgaaaaagttttctacaggaacggatcgcctacttggtctatgaatttggttcacacttctattccttccatggtttaaaggcgtacaagagtaaatacgcaaccaattgggtggcgcgctatacattatattcacgcacaagctggattacttacgtcatgattgcgatattgatcattgataatgcgccagtcgaacgcacgtcaaaatttcacagtttgaaaaaatggctgcggcggaagtattaactgacgattattaaataacaccattctgaaattatctgatttcagaatggtgttatttaaatttcggtcatggcgcgctattgatcaaaagactattaataaagctgatagtggtagctaccatcaatcgttttgatcgcaaaatccgaaatgaggattgcgctaactctgcctatatataacgacatcgttttgccaaaagtgttttattaatatctgtggtcaaaattagttttccccataccggtacacttaaatatcaatcgcgcgttttataatcaagttagccaaatacttttagctaattgataaaataaaaaataccaagacaaatctctgttatcattgatgttcctacacaaacaatgaaagaggttattgtcttgatgcaagaacagaataccacagtcagaaaaaaaggtcagcacctaacttcgtttgaacgaggcagaattgctacgctgcacagccaaggctat

SEQ ID NO: 596 - DNA, 21670 bp, Unknown
  Metagenome-assembled genome
agatggaccaattttgaaaaatgagcaaaagaatgatgaatatcagtgtcattgtattgtatagtagacataggcatgaaactcctctgtatggtttttgtttagacgctttaagtatacagatgtggatggtttcatgtctatttttgtagcaaaaaagccctaacagatcagggcttaagtggaaatattaactttcaacctttagttctttatttaaaactttgcaacagaaccctgttgtaccactaaaatttttataaatttttagcgtattttctatccccacaatttcagcaagttcttggtaaatattttgccattcgtctacattactcatgtttattccaactttctatttagaattaaacctagttcagttttagtaactgaactgggtttatatcgccgatcaatagttattacaactattgatcaaaaaaataatatatattcataattccatttaaaacgttttttggcaaagaaattcactaagttataaataataggcagacaactctcactgaacaatgaaagttgcctgcctatatctaactatttatgtctctaactaatttagcgcgctggaattcacctcatcacttatgatacggatttccattattgatcataaagccccgataaacctgctcgatcagcactaaccgcatcaactgatggggcaatgtcaattttccgaaactgagttgatcgtcgctacgcttcatcacggccggcgccaaaccaagcgagccaccgatgacaaaggtgattgctgagtgcccatacgttgccaaatgatctagttcagccgcaaattcttcagaagcacgctgcttaccttcgatggctagcgcataaacgtattcgcgctccttaattttcgcgaggatccgcgcaccctctttttctttgactgtagccatttcagcggcgcttaatttttctggcgccttttcgtcggcgacttcaactaattccaatttacaaaaagtatcgagccgtttggcgtattcggcaataccttgtttcagatatttttcctttaatttacccacgccaattatctttatattcagcataaaattcctccattattttcagcgcgctaactcacaaaaattaattcacagtaatgcaccaaaattcacaacttatccacaggatttattaacatgttgacaactccgacagctaaatatggtggcgaactttttttcgcgtactaaatcctgtgagttaaaaaaactactatttttttatttaaaagttatccacattttatttattgttcgcaaaagcgcgcttattcattcatgattcctattatatcagactttcatggcaaaataagcagtttaattataaagttacgcacagatcatctttcaacatgtggataactttaaccagctaattttgcgttattccggcaatttaaagttatccacagctgtgcaaaaagctgttcacaacttttataaacattgacaatgctatttcttaacattaccgtttatttttggtttggtcgtctcagccaataaacaggcaattattggtggcttatccgcttacgttttactagaccattattttagttaccgaacgttcaggttctcctaccagaaatcgacctgagctacgctgaatttgcgcgctaaattcaataaaaaaagaacccaccttaatgcggtgagttctccagattgatttagtcagtgactttgagctgactagtattttcatttaatgtgatcgtcgccgatttcttagtgccattacgataatattcaactgccactttatcgccgacgttgtgattgtacaattctgtccgtagatctgcactatctgtaacctttttaccacctaatgaagtgatgacatcatacttcttcaagccagcattggctgctggtgcgttgctagtgacggacattagaacgaccccgccagtaacactcgacggtaattcaaggatcgatttttgttgggctgcggaaatgttagatagatcagccatcgaaacgcctaaagctggtcgtacgatcttaccgttagtaactaattgatcgatgatcttgacgacttcgttacttggaatggcaaagcccatcccttcgactgtagcgctactagaactaccagaactgcttaatttcattgagttgatcccgataatttgtccttggatatttagcagtgggccaccagaattacctgagttaatcgcggcatcggtttggataaccgttgcttccccagtctcctgaccagtagtttcatcagttacggctaccgtccgattcttcgcggaaatgattccctgagtgactgaagttgcatattctgaacctaaaggtgagccgatcgcaatggctggttcaccaactttgatgctgtcagaatcgccgaagctcgctacctgtgtaaccttatcggcatcaatactcaataccgccaaatcagtcactgaatcggtaccgacttttttagcagttaacttagtaccgtcactcaagataacctctagcttctgtgaaccagaaaccacgtgattattggttacaatataggctttgccatcagactttttatagataacgcctgaaccttcactatattcttccaaattactgctggaactgccagacgaacttgatgatgaatctgagctgctaccgccgaaaaattcacttaagccaccatcatcactactactttgactttgtaaattaattacagaaacaacggcatttttcgtatgtttaaacacattggaaacttgtgaattcgtactaactttaacgttactaacctcagtcgtgcctgatttttttgtgttaacgacgcttccattggaactgctatcgccgatcaagtttacgccgccataaacgacgcccccaccaataaccgccgctactaccgccacgattgctgtcttaactaaactatttgactgtctcataacaaacctccagtttttttcagttttttcttatacaactagaatagcgtaaattcttgaaaaaatattgaaaaagttgcgattaaataacactcaaattagaggcttaacaacggcaaagccgcatccggctccgtatcgtataaattaaaatcatgaccaacaccaaagtcatgttgcttcaacattgatgccacagttaaatggcaaagttctttcatgttattatgcaaactgcggtgacctaaaaagacatttttcgttcgattaccaatgacatccattagcccatcggcaccagcttcattactcaaatgccctttatcaccaaggatacgctgcttcaatggccaagggtacattcccatccgcagcatttccacatcatgattgcattcaaataagtacgcatcggcatcgctgatctgcgcgcttaagcgttcagaaacgtagccggtatcagttaaaataacaaaggtcttgccattatgttggaactcgtagaactgcggtgcagccgcatcatgggaaacgccgaagctttgaatatctaaatcagcaaagcttttcagcgcgcccatttcaaaaatatgttgctgcgcgacgggaactttaccgatcgttggtagcatcgcatcccaagttggctggttagcataaacattgagctgcggatagcgccgcgccaaaataccgacactcttaatgtgatcggtgtgctcatgagtaactaataaatcgtcaacatcagtcatatcgcggccgatcgactgcatcaggccctcaatttttttgccactcaagccggcatcgactaacactttacgctgcggcgtttcaatgtacgtcacattgccggtgctaccactacttaaaatactgatcttcatctgatcgtcattttgcaccatgcttgttctccattccagagtgcgcgaaaaacagcttaatagcttgtctttcacgcacatttactcttatatctactgtaagtttcatcacttaattaagtctattatacttacttttacgcataatgccacactctagctactggtcgaactggataaattcgcatcatcagtagctttcatcaatacactagaaaaggcattgatgcgtttgatctgtacattaccactgtttttattttccacggcaatgaaccaagttggaatgtaaactgaactattatttgcatccagtaatcgtgaataacctaatgtcgtccactgaatagtggccccgttagcgatcgcattgttactgtaaagtgccaatactgcttgtttttcagtgatcgttgcttctttttcacgtaaagtggcaactttattgatataggtttgctcgtaactgacaatttgtttgccagagatttggaaaatgatttcaccatgggcatcatacaaattaccttccggcagcttttgcgtgtacacgatgcgatcagttgtcgagaataatttagaatatcgatagtgtttgccaaaagcaatcatccgtggattagccaggatctcttttagttcttccgtatatttgccatttttggcattgatcggccgtactagccggctgtataagcgatcgttactgaagctataccgctgattttgcaacttttggctcgcattttgcaaagtttcattaggttggctggataaatagtagcctgaatgcactttagttgctaacttagggatcgtgatctgatcctcatgcatttcccgtaaaatcatcgtactttgactaacatcgtcattattgactgtttcaacgtgctgattctgcttatacgacgtgaacaggaaaatgttcaaacagacaaaaacgatcaagaaaataacttcgatccgtttaaaatccattagctcgcactcccctcatccgtacttggtgtcgtgtttaataactgttcgtaactctgccacttgccattatatttgaaataataagtcggtgtcaggtcaatgactgaagctgaactagaattgactgaccaatgataacctagtttaaacgaactaatatcgtgcatatcgtaaccggcggccgctaaattatccagcgctgtttgtgtcgttggtaagggcgtcacggtggaatctgctggtaatggtacctgcaaggtgtacactgagaaattcaatttgaccccagttgacagtaattgaacttttactgcgccaaaatcagtttggttgaacaccggtaagccttccacataactccgataaatcacggtacgtgtcttatgctcataatcaaagtaacgcatattgcctggcgcattaccgattttagccaaggttttgtagccaccgttaaggatcgccgttggtgtcgctgccgaaacgtcgctggaataatcctcgaattcaatcgttgcattttgatgatcgacctgcaaactcttgtacgtcccatcattataggtcgtgatgtgcccttgttctttagtttcaagcgcgcttggatcactgccacttaacaatgaagtcacaaaatcagttggattttgcttactgaccaagtagctgtactgggtaacttgaacggcactggtgtaataaagttgcggttgattattaaatagcttttctgtcactggtaagcgcattgttgcgtcgtttaagcgcgctcgaagtgccgctagattttcttttttgactttaacgctaaaaccagttttatgctgatcatctagaaaataagccacactagaatgtttggtgggaataataattcgattgaacagccgctgccgatcagctttagcgaccttttgtttaaaagtcttagcgaagatcgaatacgtaatattacgcggataaactaaactcaatgcgcttgactgattgaccgtcgtcaaataatttttgctattgatcgtcattttatgcggatctgatagctgccattgcgaaatttgcttatgcatggcatcgatcaagttttccttgttgttataaaccacgtattgttcaccattagcgttgctagtgatgatctgcgttggcaaataaacttcttccacatttttcgtttctgtctgcgtttttggcgtcattacatcagtggtattacgctgaaaacgagcattattagtccaaattaaccatgaaagtacgaggctgactgcgatcatcgccattaagctgattttcagtaataaatgactaattttcatcccaaagatcatcctcctcgtaggcttcttggtacggcaaggaaatgtagaacgttgatcctttgccttctttactatccacccagattcgaccgttgagtttctcgatcacttctttagagatcgcaaggcccaggccagtaccgccttgcgcccgtgaccgcgccttatctacacggtagaaacgatcaaagacatggggtagatccttcttcggaatccctagtccttggtcagaaatgctgagaatgacgtgattgttggtctccaacagccgacaggtgatcacaccaccatccggcgaatatttgatcgcgttattgatgatattatctacgacttgcataaacttatcagtatcgatctcaacccacagatcgcgtttggtaaattcacgttttaaggaatatttcttagttgtattggtttccgttcggttattatcgccactagccgcgtctgacttgatcatcatatcgaaacgatccaacgtgtaattgaataattcatttaagttgaccaattccatatctagcttaaccgtacctgaatccatccgtgacaaactgagtaaatcattgatcatccgaatcatccgctcggtctcttcctgagtcacatgcaaaaagtctggcgctacttcaggatctttccaggcaccatcagtcaaagcttccaaataactgcgcatcgacgttaatggtgttcttaattcatgagaaacgttggaaacaaattgtcgccgctcacgctcatttttctgttgctcagttacatcatgtaatacgcagacgatcccactgataaagccagtttcacgctggatcaatgaaaattcggcatgcaagatcaagctgtgctcaggaacagaaaagtccagcattagctcagtttgattttccaatagatcacgaatagtatgatcagcttcgatctttaaaatcttcaaaatcgattgaccaataacttcttcatcattaagatttaaaaaatcagccgctgcttcgttgataatgatcacgttgccgcgccgatcagtggaaataaccccatcggtcatgtgcgataacacgctatccagccgccgccgctccgcttcagaagcttcttgtgcttcttcgactcgtacggataaattattgaccgccactgctaactgacctaactcatcacgaccatagattcgtacttgccccgaataatcgccgcgggccatccgaattgcctgctttttcatttcatcgattggccgcgtgatcgcccgggaaataaccaccgcaataatcgatgaaaacagcgctgctaccagtgaggcagttaagaagatcaacgtaatattattaatgtttcggtaaacgctttgcatatttgcgcgcacataaatgacgccaacaatactgctgctatcactacttggattaactagcggcacaatgctgacgtaataactgtcgtgacttttttcatcataagataacgtctcataagaacgattattatacaaaacgtttttaatattattatccgtggtcttctggccgatgattcgctgatcgtttaaattactggtcccgcgcaccgtccccttgctatcgacgacccggatatcagcagaattatttaagtccgacaaaatattagcgatcgccttattcgccgtggcggtatcgctttttaaaagttggttactcaattgattgttgacgtaaaccggcgtctgcacctgttgtttgaacgtctcaatattctgttcttccaattgcttcacaaaataagcgccaataatttccaacgtgatcattaatagtaaaataaaaacgatcgcaatcttgaaattgatcgactgaaagaaacgaattttcttattcattacaaatatccccatgtttaatcaagataaaccacataacctaaaaaaatcacgcgactagttgcgttgttagttatcaaaccgctagctaacaaaataccgcaaaactaatgtcgcgcgattcttattgacaacgtgtattgaacaagcgggcgaattatggaataccctgcttattcaaccatgtttagaccaatgacttcttttaccatcgtgcacaataaacgtaaacgagcctattcctgatcagggttacgtaaatagtaaccgacaccacgccgtgtaactaaccactcgggatgactaggattatcctcgatcttctcgcgtaaccgtcggacagtgacatcgaccgtccgcacatcaccaaaataatcatagccccataccgtctgtagcagatgttctcgggtcattacttgcccgatatgctgcgccaaataatgcaacaattcaaactcacgatgagtcaattcaattttatcgccgcgcttagatacgatataagcatcgggatggatcgttaaatcaccgatctcgatctcactattttcatcttcttcgggttgggcgttattgatcgttccttggcggcgtaaattagctttgacccgcgcaactaattcccgattagagaatggtttggtcacataatcatcggcacccatttccaagcccaaaactttatcgatctcggaatctttggcggttaacatgatgatcggcatatcatgatccttacgcacttctcgcgcaacttctaagccatcgatcttaggtaacattagatccaacaaaatcaaatcaggattgacttcattgaccttggttagtgcttcttcaccatcatatgcggtgaccacatcgtaaccttccttagtcaaattaaatttaacaatgtccgaaatcggtttttcatcatctacaactaatattttttttgccataaatcggtcgttcctccctcgtgaagctattaatagcacttcactgactcatttatgcctaaaatagcagacataacttttttcacagccggcacaaataaattatgcctacagaacctatttaattagccatgtatcgaaaaaaatatttttccaaatacactaccctattcgttccactagagctgatcgattctaagtttgtcatcaacaaggatgcactttgtttcaattatactcattccgaacaaaattcgcaaagaccgctatgaaaacgcacccgtcagcaacaattacattaaaaatccatattgttaaaaaaactcacaaaaaagcgttgcacgtcatctgtatttttgctatactaatattcgttgatgacatggagcgctagctcagctggcagagcaacggactcttaatccgtgggtccagggttcgatcccctggcgctccatcttagtaaataccttaattcacgctgtgagttaaggtatttttttattacctactaaggaaatcagtttaccataaattatggtaaatgtaacgattgtaaccaactagcaacaaccttttacaatttcttaagcaaatgaacaagtcgcttgctaaatcaactattatgctttatagtgtgcctattattaaatttatatgagaggggactcattcatgagaccaagaatcgcaatacctgccgatacgctaaccgaagccactaaggtgatcaacgaacgaaacgctgactttgcgccacgaatggcagtcaatgcggttttaaagtctggtgggatcccaataattctacctaatagcgcgccagaaaacgtaactgattatattgatacttttgatggggttttgttcctaggcggctttgatgttgatccaactttctaccatgaagaaccacatatgaatttgggtcaaacttacatcccccgcgatcgtttcgagatcgaattagttaagcaatcattattggctggtaaaagtattttcggtatctgccgtggcatgcaagtgatcaatgtcgctctcggtggcaccttgtatcaagatctttccgaagatcctgcagcgcagatgaagcactcacagacatcaccgggtaatttaccaacgcatcatgttaacgttgagtctgattctcgcttatttacgcttttaggcgagcggccgtatgttaactcccgccatcatgaagcggtcaaagaattagcgcctagtctccgcagtgtagcttacgcagacgatcatgtgatcgaagcaattgaatcgatcgatagtgatcaaattatggccgttcaatggcatccagaaaacatgtataagcattacactgagatgcaagatcttttccgtgactttgttaaacgtagcgaaaagttagcaacacaagcaccacaacaacctctaaaaatcgtgcataaaattggcgaagcctatccaaaggaatacttcggctaaccaactgcttaatacgccggcaagtttaattttgtcggcgtattttttattgccaaaaaagattgccacatactgtccaatcatcgggccgcacaatcgagcgtgtgacataaggtaacttttcccgcttagctatattgttcagaaggataaagaaggagttgagcataaattgtttatgtcacaactgcgtttacggaaagtagtttggaattacgagtacaaaaaaagtcggcgtatttaaacgtcgactttttggttatgcttcttgccaaatatcagctaaaacattggtttgatcacgatctggaccaacggagaacgtggcaatattgacgccaactaaggcagcgacacgttcaacataatggcgggcattctcaggtaattcagctagtgttttcacaccagtaatatcttcttgccagccaggcatttcttcatagatcggcttgcattgcgctaattcgtctaggctagcgggataatggtaaatcgtttcgccattgcgttcataagcggtacaaattttaaccgtttctaaaccagtgagtacgtcaattgaatttaagcacagatcagttaagccggaaacgcgcttagcgtggcgcataacaactgaatcaaaccagccgatccgccgtggccgcttagtaacggtcccatattcatggccagcttcacgtaaaaagtcaccagtttcatccaacaattcagttgggaatggcccatcaccgactcgtgaggtgtaagctttgcagacaccgacaacccggttgatctgagttgggccaaccccattaccgactgttacaccaccggcaactggattggacgaagtgacaaatggatacgtgccttggtcaatatccagcatgaccccttgggcaccttcaaataatacttttttaccattatctaaggcgtcattcaaaagtactgaagtatcagttacaaactgcttcaaacgttggccataagcataaaatggttcaaaaatatcatcaaaattcagggccttgccgccataaattttagtgaataattggttcttaaagtcgagattttctcgtaatttagctgcgaaaatgtccttatcgagtagatcgaccatccggatcccagtacgcgctgctttatccatataagccgggccgataccgcgattggtggtgccgattttttgatcgcctttacttacttcttgcaggcggtcaagttcgatatggtagggtaagattacgtgggcgcggtcagaaatccgtagattatccgccgttaccccattctcagctaagtagtccaattctgctaccaacgactctgggttgaccaccacaccgttaccgatgatcgagagtttgtcgggatacagaataccggatggaatcaagcgaagtttcaagactttgccttgcgcgtggatcgtatgtccagcattgtcgccgccttgtgaccgagcaataacatcggcactttcgcctaagaaatcggtgatttttccttttccttcatcgccccattgggatcctactacaacaactgatgccatataataacacctcattgaattagtgtatgccttgctgcaatgcaacaacacaccaaagcccattctaacaataaaagggctccgtcgcaagttaaatccgaatgaaatttttattttatcaaaattatcgattaaaagacgaacattatttcaaattttattctcttattgtaaaaatcactaatcttccgtaaaatagtagcagttcaacttaaagtcggaggtcccttatttgtctaaatttttaaactcaattccgctaccaatttgcggcttaattttagctttggtgtcactaggtaacttatttaaagactaccagcatttattactcggaaattttttcggtataattggaatcgctttaattactctgatcgtactcaaatttatgcttgctccgcgagaaaccatggtaatgttacgtgatccgatcattgcgtccgtatttcccaacttttccatggctttactagtggcggcaacttttttcactacttatccgctgctaactaacttgatttggtacactggcgtgattttacagtatagcctgttaggttattttacttggtattttgtcggcagaacgcatctacgcttaacacagctctatcctagttggtttatcgtctatgtcggtattggcgtcattcctttgaccgctgcacattttaatccactgttaggccaagtcactttttggttggcgctaggtacttatttagttttactaccgttagttttgtggcgtattttgatcgtacgccagatgcctgaagcgacgttgccgctaatcaccgtgctagccgcacctggttcgctttgccttgccggctatctgcgtgattttgcacatccccagacaaatttactctggtcgctagttatattagcacagctcgcctatctatttgtattggtgctaatgccacgattggcgcgaattcccttttacccgagctacgctgcctttacctttcctttggtgatcagcgcgctgggactgacttatttagtcgattacctgcagcaagccggccagcatatattctggctacaagtagccgctcgtggtgaaagtttgatcgcattagtcgtcgtcagctgtatttccttgcgttatttaaattatttatggcagcaaaatttacccgttgatccggcaacgagcaaataaaaataggacgttgtgaccataatcatgccacgacgtcctattttagtactcgcattattctaaattggtattatcctgataagttgccggatcaaaatctaaagtcgcgctatcgaccataatcccattaaaagcgaactttgttccgcttgtggtcaccgtcaattccagtgaggcggcttgatcgatcaacggcaactgatcagtcgcttttaattgcttatagatttgcttagctaatttatctgcatttttagtagttagtttggagctacttaatggcagtaaacatgcttgctggtaaagtggtcgtgcggttgcagtatcagtatccgccagtgtagttgcgctagcagcggttcgcgccacaaaattaaccgccacttgatctgtagccgccgctaacttagccgtcagcttagcttgcagtgctgcagaaaacgccgctgtatctaatcctgtagctgaccgtgctttaatggccaccgctgtattacttgtcgcactgctaccagtactggcagtcgccaacgttgtttgatttaaaaataataaaacgccagccagcacgattatcgtttgttgcttaaatttcattgagcctcccaattgatttaaaacacaccatcgtccgacttactatgataatcgttgccgattaataactcaaattaaatatgactattgtgacatgatttcccgtcataacagtcatattttaaagtcgcgattaatttaccttttcaaaaaccgttttgcttttgacttgtccttgcccagcctgagcgatctggtacgtaaaactccgagcagtaaacttactgttagttgctagaatcttattatactgccactgcgataccttattatttttgatctgggccaaagttagcgtaccgccttcagctttatagttccaagtgatttctttagattgtgcagcgtattctttggcaaatgcactttgacttttggccgcattaagcgcggtatttttgtcttgattaaccacaattttgttaccactctgcgcaaaggtcacataaagcgacttatccttagacacactttgatagcggtaagtattgccggggatacgctgcgccaccgaatgactcatcttccaataaaagccgccgccaactgctaaaacaataacgaccaacacacccaaaattacccgtatttttttcttcatcagctactaattcctttcacttaattacgattaaccgctgtacttgcactattcatcaacatcagtgctggtgtcctcgttagaactagttgtaacagctgtattactagcctcagtatcactttcatcagagctgtcttcctcaaattcagtatcatcatcgttatcttccgtctctgaatcagaatcatcactagattcatcagtattcgctgctgaatctgaactatcatcgtccgttggtaaagcaacattaaagtcaaagccatcatcagtcgcaataacgatcacttcgatgtcgtcaacgtcagtgatatcacttagcttattatcttcttttaattgccgataaattttcttagctaatttattagcgtttttagttgtttgcttcgtgttgctagtcacgattggttgatcttcatcataaagtgtttcggtttcagaatcagaatcctcattagcttcatcactagactcatcatccactgattcagcatcttcatcttcggtatcgctactttcactatctgtagcggtatcttcatcttgttccgtaaagtcgaccgataatgcagattcatcttcgagtcctaatttatcggctaacttatcactgatagcgtcagcaaattcatcatcatccaatgttgcactagtcgtacttgaggtatcatcgctactttcatttgcggtgtcgctatctgaatcagctgcttcatgcttagaagatgctgccgcagacttagtactgctgctgtcagtactactagaagttgtcgtcgcggtgtcttcatcagctgcagcagttgatggttctgatccagagttagcgtcagaatcagccggcgacgcataaacattcgtggacttatcggtactattatcatttacggtcacaggtgaaacgttgatattaacagaattatcactattatcgataaaattgttgatcgtcactttcgtgttagcgacccaagtaccatcgccctgataataccaatcagccggtacataaccgtcacgatttaaaatcgaagtatcaccagcataaatcaaatcaacatttttaatattattatcgtaggctaatttacgtaccgagatccccgtcgcagctgaaataccggataaagtatccccccactgaataatgtatttgctctggtctaagttattaacatcaatatgctgtgaactgatattgctgctgatctgttccgtatcgttagcaacccaattggtaatgtccgcccgttctgcatttgtttgattggcgtaaaaactattcgccaatactgatgatgtttggcccaaaaaaggtgcaaataaaagcgcactagccaatgcggcgctaaggatccgttttctattcataatcatttatccttcaaattaaaaagttagaaccccgaatatatcttaaatataatcgctttacagaggtaactcaagtatttattagaaatttagtatagaaaataaattaaatagttataacggcattatctgacgcacaaaaataacccaccgattttacggtgggttacttactagttattattgatgacgtcgtggttcaaaaccgcgttgccgtgattgttgcagccataaggctagtgttgcatcagaaataccaaacttctgctgtacctggtgagaaaaattctgccaggcggctttttgttctgctgattccttaccggcgcgacgtgcttggcgcgtatagtccaacaatagacgtttgaattgccgctggtcactgtgggacatttccaataagccatggcgcccctgcacgtccattttcgccacctcatccatttcttcacgctccgcactatcactaatgaaggagcgaatcggcataataatgtagagcaccaaggctactcgtggccaaaaatagcctagcaccataattcctaagtaaagtaagcctgattcaaggtagctatcgccatagatcacattatagaccttgcgcatatcctttttatcagtgtacttttcatggatgatcgttttagcaatccagcgaaataatagcgagatcaccaaactcaaaccaccatacattaacaccgttacttgggtcgtggcttccgtcattaaccgcgtaaatgtcggcatcagtgacagcaagaataaaaataacagatccaatacgacgatccggttaggtacggttttagcctcattgaagatcaccgcgtgctgataccataaattagcgatgaaacagaaactaactaaatagatccccactgcatgaaaaagttgcgcataatggacgctttggccgtgaatctccaccggcaactccagcaccatgattgtgatcaagattgcaatgatcgcatcactaaaaacatctaaacgttcttttaactttgctttcatactaattacctacctattgagcttctggtacataggcgatcgaagaaaacttattgtactgtttaacaaacaataatttaaccgttccccgggcaccactacggtttttctcaatgatgacttcaacttcaccgacttcttgatcttcggcacgctcgcccccggccgcactattctgggcaaagttactgttatcatcatcctcgccgccatcttcatcacgatagtaatcgtcacgatataagaaagcaacgatatcggcatcctgttcaattgaccctgattcacgaatatcagacagcactggccgcttatcttgccgttgctcaacgccacgggaaagctgggatagcgcgattaccggaactcgtaattctttagctaattttttcaactgccgcgaaatgccagaaacttcttgctggcgactttctttgttgctaccttcgatcagctgtagataatcgactaccactaagccgaggttacccttttctttagctagccgccgacatttagcccgaatttctgacatcttattccctggggtatcatcaatatagatcgatgccttggacaagctacccatggcgatgatcaagttctgccattcttcttccgataattgccccgtccgcaaatggccagcatcaatactgccttctgcgcacaacatccggttaactagcgattcagcgctcatttccaaactaaatattgccaccgttttatcggttttagtgccgacattttgggcaatattcagggcaaaggccgttttaccaacggctggccgggcagcgaggatgatcaattcatcttcctgcaatccagccgtcattttatctagatcacgataaccagttggtaaaccagtgatatcatcattattttggtataactgatcaatttgttcaattgtgctattcaaaacatcagcgattggcttaaaacccgttgaattacgctgctccgagacattcataatgtcttgttcagcttcatccagaatcgctgttacatcatcttcggtataacttttagtcacaatattggtcgcggcttggatcaggcgacgcaagattgatttttcctgcacgattttagcataatgagccacgttcgccgcagtcggtaccgctaccgctaaatcagctaagtaaggcaagccgccaatatcttccaactgaccttgtccttctaagcgatcttttaacgttaccacgtcgattgcttcggaaacgtcatttagatccatcattgcttggaagatcagctgatgagctcgccgataaaaatccgccgccgtaacaaattccatcgcttcaaccaacgcatcaggatttagaaaaaccgcaccgagaaccgcttgttcggcctcaatattctgtggcggtgtttgatcgattaattcattcacgcaaaaaatcctctcttaaaaaacaactggcaaataatccgccttaaacgacaaaacactgccattattatacgttgttcgaattaacattaacagtcccttgaccatccaaaaagacggcaggcgtttcttccgctttactgattactgcagttgaatgcctgtcgtctctaagttacattttgtttaaattagctatttttcagtgatgtgtacccgaatttttgctgttacatcgccgtataattttacgggtacattgcgatagcctaacgcacgaattggttctggtaattcgatcttacgtttgtcgacttcaatctgatattgctgcttcaaagcttgagcgatctgtttgcttggtactgagccaaacaaacgactatctgcgcccgcttttgatttgatcacaacgaccgtatcatcagcttcgatcacttgctttaattttttagcttcagctaattcttcctcagcacgccgttcttctgcccgttgttgaccgtgcagttgactcattgcttgcttagttgctgatttggctttaccgtttttgatcaaaaagttttgtgcgtagccgtcgggtacctctttgatctccccacgtttgcctttaccgcgtacatcttctaagaaaataactttcattattagttccccctctaattaggataattaactgccattatccatcttgtagtctcaagtacactactctgctgtgtcttgctcaattttagtgatgacttgctccaattgatcgcgtgctgctgccaccgtcgaatcttgcaattgtgttgctgcattggataagtgaccaccgccgccgagttgctccatgatcacctgcacgttgacctcacctaggctacgcgcggagattccaatatcgccgccaggccgccgggtaatgacaaaggaagcgtcgatccccgacaatgataacagcgtatcggccgcttgtgccgcgataactggatcgtaggtctcatcttcctcacctaaacataatgccatatttgggcggataaattcaatcgactcgatcaaatgatttttctgaatataattatcgacattttctttcagcagccgttgaaccataaccgcatcggcaccaactgaacgcaagtaactggccgcatcaaaagtccgtgtccctgtccgtaacgagaaggacttcgtatcaacggtaataccggctaacatcgccgttgcttctagcttgttgatagcttcagtttccttaggttggtactcgaacatttcagtgattaattcacaagttgatgacgcatacggttcgatataaaccaacatcgggttttctgggaactcttcaccacgacgatgatggtcaataataatcgttcggttagctaaacgatggtataaaatcgggctagttgagatcgatggcttcgaatgatcaaccatcactaacaaactgtgattagttgctaactccggcgcctgatctggtgtcaaaatatcgggcccaatttcaggatcagcttgtaactgagctaataaacgttggatgtccgtatgcacatgctcttgattgaccacgatcgagcatttcttgccgttcatcgctgcgatccggcgaatccctaggcaagcccctaacgagtccatatcgggctgtgcgtggcccataacgaagacttgatcgacctgattcatcacttcttgtaatgcttggctgatcatccgtgctcgcacccgtgtccgcttttccatcgggttagttttaccaccatagaatcgtgcttgaccattttccgccttaacgacgacttgatcgccaccacgacctaaagctaaatcaagattactttgcgaaacagtggctaacttagccaaatccgtatcgccattcgcgatcccaaccgacaaggttaatggataattctgtttggaagttcgatcacgaatccgatcaaggatcttgaagttatccgcctcaatttctttcaacgccttagcataagtcagtaggaagaaatgatcgtcatcgacccgctttagaaacatcccataatgccgtgcccagttacttaattcattagtcacgtaattatttagattcgaaatacttttatcggtcattgtttgcgtgatctcatcataattatccaagaagatctggccgatcgctaattgttcctcattataccgttcttcgatctttgcgtaccgcgtaatgtccaataaataaacaacgcgaataccttcttgaatgatgatctcaaattgattatcaccccagcgtaccgtttttggctcgttggttgcttcattttcagcgatcaatttggctagttcaggatcgattgtcgcaatcggctcacctagcacttcttttttacccagatattcctgtaggtaagggttggtccactcgatttcattttcttcgctatataacaaaattccgatcggcatcttgatcagcgcttcttgttcaccacgcttgattcgatacgacagatccgaaatatatttattagtgttcttcgtcactgtctccaatgcataaaaaacggttcccactaaagctgcgaacaatactaataagaagattcctaatataaaattaataaagaaagctaggataaccccaaacatcgctaagacaaccagtccgatcgcggttaagcgtaatcgatcattttgcaagaatgctggtaaatggtcctttgaaaacaattttttcataataactccttttgaccaagctcctaaaatgataaccctattttatcacaatcactttattgattcagcgctgatttaaaatggcacttttatcacgttaactacctaaacaaaaaaggccccagcataattcattatgccacgaccccaactaaaatttcatgcttcttgatcaattgccatctgcgcaacctgatttaaataattcaccggttgatcgtaaaatgaattaaacaacatatccgtataggctagatcctcgatcgtattatggattgaagtcaatatttgagacagattttaagagacattcagaaccgcgtttaccttccacagctcaaataaatcattaatcgtgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacattcctttttgagggaagcgtgaaaggattccattggcgcattaatcgcgattaataacttatttgaaccctggaaagcattaaatcaggcggccatttggctcgtaagtgttgcaatttcaacttgtaagggggtctggtagcccagtgaactatgaattctcttcctattgtag

SEQ ID NO: 597 - DNA, 31238 bp, Unknown
  Metagenome-assembled genome
tgttggttatgttgggaaaaaactcaagaccagttttagggccctaggctataacttatggacgccttatcgttctaatatgaaaggtgctaaacagcataataagcgtcaactcaaggcgttacggcggacaatagagtcacgcttttcaattttagcccagcaatttgggattgaaaccaatctcacccgtagtttatttggttttcaattaaagattgaattgacgatattggtatacaatttaggcttttttgattttatgacgaactagcaccacgcgtatcatgatattactgagggtagtgctactgccaacttagtggatggtaacgttaatcgtgatgcaacgcaaaattctgatcagagaatcaatttgaccgatacgcgtagcactgatcgtaattggcaattaaaagctgtaatgactgactttgaaaatggaaatgatacgattacagttggtcttggtagtgggattggcttggatatagaaaatggtggtgctgcagttgtaaacccgattaatagtagcggcgcccgggttgtcattagttccgaaaatgccatccatcatcgtgacactaatcaacagtatagcttaactactaatactgatttaacattagatcgtaatgagttgttgccaactactgctgctggtacgacattccaatctgatattacttggacattggaagatgggttaacattttaaaatagattaatttgaatagctggtagtacacattttataaggacgttactttcattaagaaaaatctagaaattaatattcctgtgataaagtgaacctccaaggctggatttggtgtctaaccttggaggttttactatctccagatctttgttcttgaatttgattattttaagttaatatttcttaaaaaacgttgctttttctcattgctacattctactatagattcaatgagtctaattgtatcaaggagaaaattaaaaatgggtaaaacgattctattggtcgaagatgaagatagtttaatttcttttttaaaaactgaactaaagtttgaagattatacgataattgtaactaaagatggtcaggaggcgttaactagctatgctagtaaccagcagcagattgatttgattatattggattggatgttgcctaaattagatggactggaagtaatgcggcgcattcgccgccacgatgatgtaccgatcattatgatgacggcgcgtgactatattggcgataaggtagccgggttagataatggggccgatgattacattacgaaaccgtttgaaattgaagagttattagcgcgcattcgtgtcattattcggcgggagcaaaggcatgatgagcagacacaagccaattatcaaattgctgacttagcattagataccaagtcgcggcaggtgcaccgagccggtaaaataattcagttaacgcaacgcgaatataatttattgctgatattgatcaaacacatcggagaaactttaacacgtgatgagttattggatctggtgtggggcgttgattttgaaggccagctaaatattgttgatgtctatattcgctatttacggcacaaagttgattttgaaagccagccgttgatccataccgtacggggtgtgggctatacgctgagggatgataacgatcatgcgaaaaaagcagaataatactaatacgagcgcagcacagatcactaaggcatacgccataattttaattttaattacgttactgatgagcggttcaattatcacggtggttggttatcggctagttacaaataagcgtgaagaagcgcagtcactgatgaggattttaaagcaatccttggttggggaccaaccagattgggtacgctggcggggtgagactaccttcgatactagtaacacgtttgtaaaagtaaaagtagatccgcctacgcgcacacaagctgtcttttattcgccgcgcaccaaaggctttttgaatgaaaattatcacgcatggccactttttaaagatgttcagtatcgctctaaacagggggtctactatcatattattgattacgatcatgctagtgagggccccaataaaaagccagaaattaagtacgaaatttggttaagtttaaataatatggtccatatatttaaaacgatcttagaaacaattagtttaatcaccatatttagtttcttaattggcttatggtttatttctaagttagcgcggcggttgaatcaaccattggtagatttaaccaaggcaacccatgaaataaataaggctgagaatattacctatcatgaatctttaccaatttctggtaatccacaagaagtgcatgaattgagtattgaatttaatcggttgttaagttcgctcaaccagcaaatattacgtgagcatcagtttgtttccgatgcttcacacgaattaagaacgccgttagccggtgtacggggtcatataagtttaattcgccgacatggtcaagcgcatccagatattgtgccgacctcactagattatattgattccgaatcgctacggatgcaacacttaattgaaagcctattgcaactatcacgtatggatcatgctgaattaaccttggaatattttaatttaagtgatttattagccaagatttgtgcgcgctatcagcaacaaattccccagcaattatgcttaaaaattctaccgactacaattgtttatgctaactgtgatagtgttgaacagatcataacggcattattagataatgcacataaatactcacctaccgctgcgactattacgcttgaagtaacgactgatcctaatgatattgcggtgaaggtttttgatgaaggtaacggaatcagtgatcaggataaaccgcatatttttgatcgtttttatcgtgctgatcaatctcgttcccaaaaaatcactggttctggtctcgggctagcaattgccgcccgcttggttgatttgaatcatggtaagattgcggtgcaagataatgtaccgcacggtagttgttttgttgtcattctgaaaaaaactaaaccttaattctgagaaatttaaagaatttattcagaaattattagtagacccgatttaaatagctaactacaattcctattgtgatcaattattcaattgtcggtataagctattttgattgagctagagcatagttaattaagcagcaattttacaccatgtgctaaataatcgcgcttctaaactgaatattggctttactgataatttctaaggaaaggagtaacactaatggcgactatgtcactggttatcccatgctataacaatgaaaagatgattccgttattctatgccgcggctgcagaagtggttaatacgattcaacagacttggaaaaatattgatgttgagtattggtttattgatgatggctcgtgcgatcgaactttagatcaattgcagcagctgcaggctagagcaaaatttgtgcattatatttctttctcacgtaattttggtcaagaagcggcaatctatgctggcttgcaacaggccactggtaaatacgtggctttaatggcgggtgatccacagatactacctaatttattgccacaaatgctatctgccattattgaagaacattacgatatcgttgttggcactagacaagcagccagaacagaagtgcctaatttacgggcctggtttataaaaaaaatcaaccattttactaaagtgaaagttaatgtgcctgttggggattgtcggctgatgactaggcaagtgcttgatgctgtgatgtcattgcctgaatataatcgattttcattaggaattttcaattgggtcggcttcacaacaaagtatttagcctatcaaaatgatgaagacggcgatgggcagcccactagaggattttggcaagtgatcagtgattcagtgaatggaatcagtggctttttgagcgggccattagctttagttttttatgttggcttaacttcttttattgcggcgctgattgtgctagtagtcattgttatgcggctattagtgcttaatgatccggccaatggttggctagcacttatttcaatcatcctgttgcttggcgggattcagctattatgtttgggcatcgttagtaagtatattgctgaaatttatttagaaacgaaacattggcctatttacattgctaaagaaattaaatagttcaaataaatacttagtcagaaatgatcgtaactagtgactgagtgaaagggggcggactgaatggaacgcttaaaagcgattatagcacggccaggtgttaagtttattttacaaactattttttatttttttatcttgttaattctggtttatttgtatagttatagcggaatcagcaatagcaagtttatttacaatgaattttagataccatgtttttgggggtaaaagaacgatgatagcagatattattaaggcaatcgatatggttgccatacaaacacctagtgcagtagcttataattatttaggtcaaactaatacgtatgctgaactaaaacacttttccgattcactagctaattacattgatcatctggatttaccggcgggctcaccaatcatagtttacggtgatcagactttttcgatgatcgcggtttttttgggctgtgttaaatcaggtcacgcctacatcccagtagatctgcattcaccaaatgatcggttgacgatgattcaggcgattgcccaaccacagctggttattgccgtaaaaccattaccagtgaaattactggtggctaatactattgaagcaccgcaactacaagctatttttcgccaagctaatccgtaccaattaacccatgcggtgaaggatactgataatttctatattattttcacttctggaactactggtaagcccaagggcgtgcagatcagtcatcaaaatctacttagttttgtcaattggatcttgactgattttgggctgccagaaaaaccgaccagcttagcgcaagcaccatattcatttgatttatcggtgatggatctctatcccaccttggtcatgggcggtcagctgcaagtgttgcctaaggcgataactgataatttcaagaccttgtttgccaccttacctagtttatctttaaatatctgggtatcaaccccttcgttgatcgatatttgcctgttagagccaaactttaaacaatcaaagtatccccaattgtcgcattttatgttttgtggtgaagaattaacgcatcagaccgctgctaaattaaagcaacgcttcccagccgccaaaatttttaacacttatggtcccaccgagaccacggtggctgtgactggtattgaaattacgactgcgatacttaatgattaccaacgcttgcccattggttacgctaaagcagacactacggttaaaattgatccgataacaccgacaaagcaatctggcgagcttattattagtggtcccagtgtttcaaagggttaccttaattcaccagaaaaaaccaaacaagctttttctgaaaaaggttatcgtagcggcgatttagtgacgatgactgcgtccggtttaattttttatcgcgggagaaccgattttcaaattaaattaaatggttaccgaattgaattagaggaagttaatcattatctaagtcagcagaaactgatcaagcaagcggtggccgtaccaaaatataatcaacaacacaaagttaccgcattgttggcttatgttgttttacagactgcgacggatcgacctgcatttgaagttaccaaaattttgaagcagcaattgcagcgggaaatgatggcctacatgattccgcaacgatttatctatcgttcctcattgccactgactattaatggcaaaattgatgttaaagccatgattaaagaggccaatacaaatgattaatttacagccatatagtaacccgatgtattttgtttggctcttagtgagcctattgccattgatgattgggttatattttggtaagcggtttgtggcctatcaaacgattatttctgggatatttttattattgatttttggtggctcaaagtggcaacaaggcttagcgctaattggctatattatttttcagtttatagttgttggtggctatgtgcgctataaaaagcgggccaaccagacctgggtatttgttgttgccgtgttactaagtatattgccactggttattgtcaaaatcacgccggcagttcaagtgggccggcagtctttggttgggtttttaggaatcagctatttaacctttaaatcagtccaaatgattatggaaacacgtgatgggaccattaaaaaatttgatccgatcatgtttgctcggttcttactattttttcccaccgtttcatcaggtccaattgatcggtatcgtcgctttcagcatgattatttaaaaataccggatcgggaacgttatttagaaatgttaggtaaagcggtgcactatatttttctaggtttcttatataaatttatactgagctatttatttggtactgttatgttgccgcacatagcccatattgccatcatgcaccgggccgcatttttccatacgggaatttcactagccttagttggctacatgtatacgtacagtatgtatttattttttgattttgccggttacagcctatttgcggtagccgccagttacttgatgggtattgaaacaccgatgaactttaaccaaccttttaaggcgcataatattaaggatttttgggatcgttggcatatgacgttgtcattttggtttcgtgattttatttttatgcgtttaacgttctttatcatgaaacatcatttgcttaaaaaacgcgttcgtatttcacaggtcacttatctagccaacttcttaattatgggcttttggcatggtgtgacctggtattatatcgtttatgggcttttccatgcgagtgcaatcatcactaatgattattggttagcgtttaagaaaaaacatcgccgattgccgcataatcggttgactgaaggtatcgcgatttttatcacgtttaacgtcgtttgttttagttttttaattttttcaggttttttgaacacgctttggtttcaggcacattaaattatataaataaggggtaatcaagatggatacaaaacaagcagtagtcgctattttaaaagaattaactggcaccgatgtcagtaataatttagatgataatttatttgattccgggatgatcgactccatggcaacagttgaaatgttattggagttgcaagaaaaatttgggatcgacgtacctgtatctgaatttgatcgcagtgaatgggatacgcctaataaagttattgcgaaggtggaatcaatgaaatgaaggttaagggtagtcaactatggttgatatttggaccggtgatcgttgctgctagtttattggttttatttttatcactaccacttggactgggtcattttagtgcgcaaacccaaaaaaaggctgcagtttcactatcatccaaggtttttcggggtcgtaaaattaaacagcaggcactgcaaaatggttatgtacccttttttggctcatcagagttatcacggctggatgcgtttcatccagctgttttggctgccaagtaccaccgagcttaccgaccatttctgttaggtgccgcggggtcacagtcattgactcattattttataatgcaaaatttaggccgtcagttagaggggaaaaaggcagttttcattatttcacctcaatggtttactaagtcaggacagcggcctgatgcttttgacttttattattcacccttgcaaacaactgattggattattaatgccaaaaacaatattgctgatcgttatacagctaagcgcttgctccagatgccatcaggccgtgctagccaagtcactgcagcagcgcttaaaaatattgtaaatggtaaaccaatttcaaattttcaaaaaatttttctacaaggtaaagagacgattctattaaatgaagattcattattttcacggtttcaagcgaataaaaacctagctgaagtccaaaaaggtgaaaaatttttacccccgcattattcagttagtcaactaaatcgtctggccataaaagtggggcaccatgaaaccaatagcaatcaactaggcattaaaaattcgttttataaaacgcgattaagtggtgatcgaatcaaagtattaaaaaattcgcagaataatttcgattatcgccagtctccagaatatagtgattttgaacttgtactaaatcaatttgctaaatggcacgttaaggttcagtttattattccaccggttaatgcgcgctgggcgaagtatactggtttgtctatgccaatgatccgacaaactgatcaaaaaattgaatatcagttacgacaacaaggttttaataatgtgttggacttaaccaataacggtagcgaaaagtattttatggaagatacgatccatttaggctggcgcggctgggtaaaggtcgatcaaaccgttgatccattcttaaccaagcagcaaccgcaaccaaattataatattcaaaatagattcttcactaaaaagtggcaaacagccacgaaaatcgaataaaggggctgtttgccttgctaaatcgatcccggatggtcaaagtcttatttattgtcggttttgttttgctggggctggttttaatcagatttgttgccagtgggtcgcgccaaagtgttacgccaacgcatagaattgccgcagccagcgttgaaccaacacaccaaaataccgcagttaaacgggcaattaattctaagtttcaaactaagctagttcaaaccctaaaacaagataattattctggatcggccattatttatgataatggacagcaagtagctagttataatgccggctacgctaactatttaagccgaattaaaaatcaagctaacacaatgtatgagatcaattcaattcaaaaatcaattacgggtgtgttagtcatgcagcaagtggccaaacgtcaactagcattatccgaccggctaaataagttctacccgaatgttcctggtagccaaaatattacaattcgacaaatgttaaatatgacttctgggttgattatgactggtccagttgggcctatggtagccaaaacagatacacagattattcagagtgatatttcacgggtacattatcttcgtgtaatgcacggtcgttggaattatcaggcgattaattttaatttgttatgtggtattttagaaaaaatcactcatcaaagctaccaacaactgttttatgagcaaattattgaacggctccatttgcaacgcacggcctttgcctataaattacctaacagtacgatagccgcaaccggatacgatggcctgatcggtacgaatcaaaaactaatttataccaagcctagtgttagaaatcaagcattagagcaagatgagttgggcaccggtcaagtttacatgagtgtcggtgatctttatcgagttgaaagcgcaattgtgtctggtaaaatagttccattgcaattgctgcaacagctttatcaaggtggctcatatagtaaatatgaagctggtttttacacccataagcaggtcaaatcagctaatggtgccggatatggttttgaatcttccattcacatcagtcctaatggtaaaaatgccgttattttactcagtaattatcaagaaccattgtttagagtcagaagcttagcacaaaaatttgattatttattgtttaattagagcgtatctcaaagggcgctcagtctgctagccacggctacgctgattggctatcaatcaataacttttagttgcaagctaccttaggaggtcactttgttacgattaaaacatcaatgggccaatgacttggttaattttagtcagtggttaagtgaacgtaaattttatcaagtaatcctaatgtcattgacgactatctttccaatcgccgctgtaggtgcatttattactttgattgataaaataatttttattcccaccggagtgtttaatcaattttatcaggttagtaaatggctaccattttatgctgaatgtagtaatttctggtcgagcctagatattttaatcaataatttagttgttatttggttggcctttttagtggcagccaacgcggctaagttgaagcagcaaaatgaacagttaaccggaattgtcagcggtacatttttgtggctaggtaatcaatcactattcatgagtgccactaagcatggcatgctgcagttaacattaaattttagtggtttggcaatgcacggtgtttttgcagcaattatggttggcttcttcgttagctggttgctagggcgctgccctaaacaccagctgttagcgatgacctttttaattttaattggcgctgccaccgcagccggctttcatacattcattcctgatagttttacgggaatgctaatgtcaaagttaacgcaagtcactgctaactggggaaccaatatttttctaatggtcttgatcgttctaattagtaatttattgatgattttcggtataatagggccgcttaattcgggtgatggatataatgatgcagtattttcaatccagaatttgaattacgctttacagtatcatcacctaggcaatataccataccccattaatttacatgctatttatgatacctatgcttttgtcgggggtagcggcatgctgctggcactattaattgctattttgtggcgcgcgcgtgatcaacgagtacaacaaactgcaaaaataagttttttaccggtcctttttaatttgaattcgccgatgtttgtgggattgccggttctatttaacccactattagtgattccttttattgtgaccccgatcgtagcgtgtttagttgcttggctatttgttagtttacatttgatgccaactgccgtttatccagtaccgctgaccacaccaggatttttgaaaggctttttagcaaccggtggtaattgggtatccctattggtcggcatccttaatctgctgattgccacaattatttatttaccgtttgtcaccttgaatgataaatatgacttagttagtaaagttggtgaaaaatgagtaaaaagagaatcttgtatagttcattaattttattaattacggcagtcgttggattgtcaggctaccagtggcaaaagcaagcgattggtttacagcaaagacagtttcgctcaccaatggatccaattttcttagtgcctggtagttcggccaatcaaaatcgatttgattcgttagtaacgttactaaatagaggtcgttctaagcgtagccttttaaaagtaacggtccaaacgaatgatcaattgaaatttagtggtcatttacagccgggggacaaacatccttttattgtcgttggttttcagaataatcgtgatggttacgccaatattgaacgccaagcacgatggttcggcattgcttatcgaaaattagctacgatctatcatttcaaccatttttcgggaatgggtcattcaaatggtggcttagtactgacctttttcttggaaaagtatttgcctaaaaacaataccgtcgatcggttaatgacgatcgcctcaccatttaatttagaaagaaatacaacaaaaaaaacgccgatgttgaagaatttgattgcacataaggctaacttacccaaaaagatgaaagtctattcaattgcaggaactgaaaattataaggatgatgggatcgttcccttcgttagtgttgatagtggtaagtatatttttcaagatcaagtcgccggctatacagaaataattgtgaccggggcaaataccacacattccaatttaccaaaaaaccgccaaattgttcatatgatgcgtcaatatattttgcaggaagacaattcaaaaacagtaaggcataagcaaatgcggacaccatagaatacgtgaatgagtagaaagctgatctcgataaggctcgtctttgtcggggtcggctttttgccacccctgcctaaaagcggtaaaataggcaagaatacaatgtaatagtagaggggatatttaaatggcacaatatgaacgcgcgtgcacgtcgattttggtcggtaaaaacgcgagcttagatggctcaacactgattgcacgtaacgatgatacttttttgcccaaaacaccacagcgtttcttggtccatccagcggtcaaaggccagaaaaagacgctgacgtcttatttgaatggcttcaaagccgaattacccgctgacgcctaccgctaccaagcggtacctaacgttgacctgaataaggaaggcgtgtacgacgaaagtggcttcaacgagaagaacgttgccatgagtgcgactgagagtacttatggtaatgaacggactttggcctatgatcctttggtggttgatggcatggacgaagatacgatgcaaacgatggttttgccttatatcgattccgccgttgatggggttaagcgtttaggcgcgctgatcaaacaatacggctcaccggctggtaacagtgtgctgttcagcgataaggacgacgtttggtatatggagatcgtcaccggccatttgtgggtcgcccaacggatccctgatgacgcctacgctgtcgcagccaatcaggtggcgatccagcaagtcgattttaacgatccagctaactttatgtgggcggacggcatccaagactttgttgaaagtcatcatttgaatccagacaaaaccggctggaatttccgccacatttttggcacagacacggaaaaagatcgccattacaatacaccgcgggtctggtttgcccaacgttatttcaatccggagatcgaacaaaatccggaaagctctgaattaccatttatttgtcatactgaccgcaaaattggtgtcgaagatatcgaatatattctcggctcccactataatgaaacgccatttgatccgttgggtcatggcagtgacgctgacaaataccgttaccggccgatcggcttgaaccgcacgcaaaattcgcacgttttgcaaattcgcaatgacgtaccagaagcacaagcggcgatcatgtggatggcgtttggttatccggcattcaccccgtacgtaccgttctacggtaacgccaacgatacggatcctagctatagcgaaaccccattgaaatttgatttcaagagtgcttactggatgtaccgtgcgacttctgttttagtcgaaagccaccacagcaagttcattgaagccaacaatgcttacctaaaggatgcccgcgaacaacaacggcgtttaattgctgcgacggatgccgcggcaaagcagttaagtggtgcggcattaactgactatttaacgaagcaaaactacgccatggttgcggatatgcgccagcggacgatggacttcttcggtgaactgatcattgctgggttagatctgtccaagttaacgtttgatattgataagaatctatagatttaggaaagagtcgcattttttgtggctctttttttcgcggcattttttagaagtttgtttctaagttaaaggggtatactggctaaatttccgagcgctttttgtaaacgcttgaaaaatagttggaactcctttagaattaagcgtatgatctgcgcagacgcgcgcgacaagtttcacgaagatggaggaaattcggatggcaaaagtattggcaatcaacgccggcagctcaacgcttaaatggaagttgtttgagatgccagctgaaaccgttgtggcttcggggatgatcgatcgcttgggtttggctgactcggtattcaccgcaaaatatggtgacgggcaaaagtttaaacttactcgcgacatcaagtctcacgatttggcagcaacgttattattagaagaattaaaggatctcggtattattgatcattttgaagaaatcaccgggatcggccatcgcgtggttgctggtggtgaagattttaaggattctgtggttatcactgagcaaacgctgagccgtattgaagcgctggccgaatatgcaccattacataatccaacgcaagcttattatattcgtgtgttccaaaaattattaccgcgggtcattcaagtggccgtttttgatacttcattatttgccgggatgccgaaagaaaactatttgtacagtattccctatgaatactatcaaaaatttggcgcacgtaaatatggcgctcacggcacgagtcatcgttatgtggcggcccgagcggcggaattattaggcaagccgctaagcgaattgaagctgattacgctacatttaggtagtgggtcatcgatcaccgcctttaatcacggtcaagcagtggatacgtcgatgggtttcacgccactggctgggatcacgatggcgacccgctccggtgacattgacgtttcattgttaccctacttgatgcgtaaattaaacattaccgatatggcggaaatgatcgatattctgaatcataaatccggcttgctgggcttgtcgcagctgtcgccggatcaacgtgacctggaagaagctgccgcgactaataaattggcgcagcaggcgttagctatttttatcaaccgggttgtcaaatacgttggttcttacgtggcaacgatgaacggtctggatgcactagtgttcaccgcgggtagtggcgagaatggcattgagttgcgcgaaaacatcgccgcacaattacactatttcggggttaaattagatccagaaaagaaccacgtacgcggtaaagaacgtgatatcagtgcagctgatgcgagtgtgaccaccttattgattccaactaatgaagaattaatgatcgcgcgtgacgtcatgcgcgtgggccataatgatacggcgttataaaccagtttggatcgtacttcaaggtacgatctttttttgtgattaaatctaacattaaacgtaactgaacgaatgactatttacagcgctgttaagccggattgtgcttatttacaatcaacacgataaaagcgtttccaccactttatttgaactaacattaaaaaaacgccactaaaagattaatttgatgttataatttctaacataaaattcattcagcatttaaatgaagtggaggagatctaatgagtacagcaaacacagcttttattctggtcgccagcattttggttttattcatgacccccggcttagcctttttctatggtggcttagtttcacggcgcaatgtagtcaatacaatgttgtcggttttcttcatttgcgggatcgcaattttattgtgggtcgcgattggctatgaattagcgttcaacggtgatattggtggtgtgatcggtaccgtacatcactttttcttaaccaatcttaatttaaaccatgtgatggccaatgggctgccgactggggtgtacttattatttcaaatgatgtttgcgattattacaccagcattgtttgttggtgcgatagtcggtcggactcggtttaaatttttgctgtggttcatcgttttgtggtcagtactgctttattatccgatggtacacatggtttggagtgcaaatggactcttagcgcatatcgggatgatcgattttgctggcggcacggtggtgcatattaatgctgggatcacagcgtttgtactttctgcttttctgggccggcggcataattacgggcaagaactgcaacattataatttgccgtgggtgttactgggaacgacgattttgtggatcggctggtatgggttcaatgccggtagtgctttagcgatgaattcggtggcgttgcaagcagcgctgacgacaacggtagcgacagccacttcaatgattgcgtggatgattttagatatcatgatcgtgggtaaaccgaccttggtcggcgtctgtacggggacactgtgcggcttggtcggaattacgcctggtgccggttacgtcacgttggcaggttcattttggatcggcattttagccgtggcggctagttacacttttatcacgttattgaagccgcgaatcggtgtcgatgatgcgctggatgcttttggttgtcacggcgttagcggcatcatgggcagtattgtgactgggttattcgcgacaaaaacggtcaatgagacgattccggaaaatggtttgttttacggtggcggctttaaattattgggcgcgcagttatttggcaccgtggcaacaattatttttgtcgccgtgttgtgcgtcattttgatcagtttattgcggttagtcgtcccgatgcgagtggatgcggccgaggaagatctaggcttagatcaaggcgagcacggtgaaagtgtcgattatattgttaaaggtgatcgcgatatccttaatcatcaggccgaattccaagggcagatggcgcggttgcaacagcggcataagtagctgtggtaaaatgaaaataaaaaaggatactgactaatgcaattaaatcaactacaccatatcgcaatcatctgttccgactacactgccagtaaacatttttactgcgatctattaggttttaccccgctgcacgaagttaagcgcgctgacaaaggtgacgttaagttagatgttaccaatggtgatttgcaactggaattatttattaaagccgccgcgccgcaacgaatcagttacccggaagcgcaagggttacgccacattgcctttaaagttgccgacgttgcggccaccgttgcggaattaaatcagcgcggcattaaaactgagccgatccgccaagatagcgagacgggcgcggcgatgactttctttttcgacccggatggtttgccgctagaattgcatgaatgatcttatagatactgtaaactagctgcgtaaacgtggttaaaaaagcagattatgggcatataacaacgctagtcgaacgagccactgtgtgtctcttatcgtctagctaagctatacgtcataatctgggcgcttctaactgtactctgaatatttttgatggtcattccccgcgactgtcggtataatcataggtgttaccaaagtttaagatctgctgatttggctgataaaattagtcgaatgttgtaaacttaaatcaggtgatgatcgaagttagatgacctatagtaacgaggggggaaaaacgtggcactagtgaacatacttggtattgtgttatggctgatcgtgttggcctttatctggtacacaatccacaatattcgtagacgtcgtctgcggcgtttagttaaacaccaacggaattttagcggtaaagacttcaccatatccacgattttggtgcttgtagcagctttattgctgggaacggccagttatttaacgttcttccgcgacgttgatctagaagatcaatcagcggtaacactgaaatacagttatgaaccgttagtgatgactgaggtcggcgggaagttctatgacgttaaggtcgaaaacggcaatggcaagcagccgcagcagcattacacgtactgggtaaaaggcgcacgttaccaaattaccagtaacaatgcgacggtggcagccggcgctaaaccaatcaacctcacggcagcgaattatccatggccccgtaaagaattagcacgcaaagataagcaatacgaacagacctttgcggccactttacaagctacgtataaggaaacttggttaaacggtcttggcctacgcgctggtcgtacggcgacgcactttaccattattcgcgtaccaaactcatcagtaatttatatgaaaccagtaaaatagataataaaaaagttgccggcattgtacggcaactttttttaacgccaatgaattcgctggatcacaaaatgttccattaagacttgtagaccgcgaaacagcgggtagctcgcgcagatcagtggcaagtaaatcaacgccagagaccagttgaacaatgagatcaacgagaaaaactggccggctagcgggaacattaaaataaatgcagtgatcaggctaccaacgagtagacttttccaacgattaaacggtcgggtgatcgaaatcagcgcactgaagctgacagtgccggttagcagcacgcttaaggtcgaagtttgcgcgtggttaagctgcagctgaccacctaacaggtgaacgaataaaatgtaactgacgatcaacgctgcagcgggtactgcggtgcgcatgactttcgccataaaatagccggtgatccgctgataatttggcgccatcgctaggaagaatgaggggattcccaccgtcaacgcggcgatcggggttaattggatcggcgcaaacggataatcttggttaagaaagataaaaacgaagcccagcaccacggagtaaatggttttgatcaagtatagtgccgccacctgttcaatgttgttgatcacgcggcgaccttcgtttaatacatgcaccatggcgtcaaagttagagtctagcaggacaaaatcagcaacacttttgggtgcttcgctgccactggccaaagccacgccgcagtcagcttggcgtaacgctaaaacatcattaacgccatcgccggtcatcgcgactgtatggccagcagcttgataagcacggatcagctgttgcttttgtgttggcgatacccgaccaaaaaccgtgtaatcacgaatcaattgatcgaagtcagccgtttcgccttgggtgtgcatgtcgataaaatgggtactatcggcgattccagcacgttgggcaatattagccaccgttgttggattatcaccggaaatcaccttgatcgcaatatcttgagtcgcaaaatagctgaacattttgactgcggtcggtcggatttcgtcgcgtagcaaaatgagtccccaaaattcaattgcagccggtaaatcagcggtcaagcgcgcttgactacgcgctagacataaaacacgttctccttttgctgtgtgttgagcgatcaattcttgttgtgccggcgtcagttggggcaggacatattcaggggcaccgataataaaactgccttgctcggcaaaggtgacgccactccatttacgtgccgaagaaaaaggcatcgtttgtactttctgccaggtggccggttgcggtaaagcggcttgcaaggcagcggcagtgggattatcttcatttaatgtattgacggtttgtgccaatgcttgttccagctgcgttttggtgtgtggagctactggcaacaaatcgctcatggtaagtgcgccgctggtgatcgtgcccgttttatcaagacacaaaacgtcaacgcgggctagtgcttcgatcgctggtaaggtgcggactaagacttgccggcggcctaaggtgagcgcacttacggctaaggccactgatgtcaaaagaaccaagccttcaggaatcatgccgatcgtcgctgcggcggtgcctaaaatagcatgattgaggtggccccgttgccaataggcagaaatgaatagcgctatacctaagggcacaataataaaggtcagtactttaatgatgcgattgatcgtatctaaaaggacgctggtcagctttttttcctgtttggccgcatgggctaacttagcgacaaagctttgctgaccaactgcagtgacttgaactaatgcttgaccactaacgataaagctacctgataataacttagaatcgatggttttattgatcggtttggcttcgccagtcaactgtgactcatcgacttcgaggccatcagtttggcgtacacggctatcggctggcacctgatcgccgcgggataaaaataaaatatcatcacggacaatatcagcctgtacgatggcctgtttttgctgctgccggatcacggttagtggcgattccgccagtagtgaaagttgatcgattttgtgcttctcgcgcagttcttgaacgatcccaattatcgtattaaaggtcgccacgccgagaaaaagtagattacgataactaccagtggtgacgatcaacgcgcctaaaatgaggttgatcagattaaatagcgttaacgtattatcgcgcaaaatttgttgcgtactccgcgtcaatgaaggtggcggtgtatttttttgcccagtagcgatccgctgttcaacttcagcggtcgtcaagccagtttttagatcaattttcgtctgcaaaatcgtcacctccgagccggaattacttttgtaatagcacgttttagttctattaaaagtataacatggactattttgtctaacattaaaacagaattggcgaattacgtggcaagacttgcaaaaccgttttcataacgacataataaaagaaaaagactagtgaggcgtttttaatggatgaacaagcaatcaaacaggctagttggaagattagttttaagaagcagccgcaggaacaaaaatatagtggcgatgtcgactttaatggcggtgcactagcagcagcggtggtctatattcagttgatgacgacgatcgccaaaaaaacgcaagtggtcagtgataagcgtaaattttatttagcaactaaagaaattgggctacgcgatggctttgcggccgatcaatataagattcaatacattcaaagtgcgttattagatagtggctttgattttactttagaaaaggcggttggcgctgaacttgatgacagtacggcaacgattcattttgcggctgatccaatgagctgtgtttggccaactgaaattattggtaaagcattggcggcacaattgactgatacggagcgcgctagctttaatcaagcggtgacgactgccgccgacacacaaatggcgtcattggagcagttaaaatgagcagcggaacgattggcaaccccgatgcccaagtggttaagttatttggcttagatcgtttggccaaaaagaaaaaagttgtgaaaactcaacaaaataagtctaaaaaaagcaaatgattttagcgctaattgctaaaatcacttgcttttagtgtgtaaaatgctactattttcttgatagataattcctaaaaaatggaggaccagcatgacagaacataatttggacccggaactcaagctaatcgctttaaatgctaaccgaccattggcagataagattgctgcagcgactggtgttcaattagcaaaaacatcagttaagcaatttagtgatggtgagatccagatcaatcttgaagaaagcattcggggcgacgaagtgtttgtcattcagtcaatttccgatccaatcaacaaaagtttgatggaacttatgatcatgatcgatgcgctgcgccgtgctagtgcaaaattcattaatgtcgtgattccatattacggctattcacggcaggatcgtaaagcacgttcccgcgaaccgatcaccgctaaattgatcgccaatttattacaaatggatggcgcaacacgggtgatcgctttagatctacacgctgcacagctacagggtttcttcgatattccagttgatcatttacaggcagcccctttgctggctaattatttcaaagcgtgcggcttaactgatgtggtggtggtttcaccggatcatagtagcgttgcgcgggcacggcaaatggcaaccttattaggcggtgcgccaattgcgatcattgatcgacgccagtcaacgacaaccggcgaaaatctcagtattatcggcgatgtggcgggtaaaaaagcaatcgtggttgacgatatgatcgatactgggcatcgaatcatcagctcaacagaagcgttgaagcgcgctggtgcaactaaagtttatgctgctggaacccatgccgtgttttccgacaatgcgaccgctaagctgcaggcatcagcagttgaacaagtggttgtcaccgattcgatcaatattcctgatgaaaaacattttgccaaattggcagtggtttcggttggtgaattgatcggtaaagcaattcaattgatccatgacgataaaccaatcgatgttttgttccataccgtagctgataaaaacgaagattaagcgtttgaagacagtgaacctttttacaggtcactgtctttttttaaataaaaatggcaatttgatgaataatcgattaaaattaactttataaaatttaaaaagggtggtcatttatgcgtgcagtattaaccgttgtcgggcgagataaggtcggaatcgttgccggagttagtcaaaccttggccgaattgaagtttaatatcgtcgacatgagccaaacgatcatgcaagggagttttaccatgatgctgatgtgtgagttacccgccactgacgttgattttgaacaaatccgtagtcaattaaatgaactgggacagcaactaggcgtccaaattcggatccaacgtgaagaaatttttgacacgatgtacaaaatttaaggaggtgccgcagcttggaaactagtcagatcttagaaacgatccgtatgatcgatgaagaaaatttagatattcggacgatcacgatgggcatttcgctactcgactgtatcgatccagatattgagcgggcctgtgataaaatctatcaaaaaatcactaccaaagcggtacatttggttgaggtagcggctgccatcgaagctgaatacggggtgccaatcattcacaagcgaatcgcggtaacaccgatcagtatcatcggtgccgccacggcggccatcgattacctaccgtttgcacaagctttggatcgggcggcaaaaaaagtaggcgttaactttatcggcggtttttccgcgctggtgcaaaaagggtaccaaaagggcgatgagattttaattcactcgcttccccaagcgttgagccaaaccgaatttgtgtgcggctcggtcaacgttggttccagtaaatcaggcatcaacatggacgctgttcgcgatatgggcgaagcggttaaagcggccgccgcactttcgccgctagcgccggctaagttagtcgttttcgctaatgcggtggaagacaatccctttatggctggcgcctttcatggtgtcggtgaagcggatgtggtgatcaatgtcggcgtcagcggccctggcgtggtcaagcgcgcgctggaaaaggttaaaggcgaaccctttgatgtggtcgccgaaacgatcaagaaaaccgcctttaagatcacgcgtgtcggccaattagtcggccatatcgctgctgaacggcttgatgtaccgtttggtatcgtcgatctttcgttggcgccaacgccgaaagttggcgactcggtggcccgtatcctagaagagatcggcttggaaactgttggtacgcacggcacaaccgctgctttagcaatgctaaacgatgcagtcaaaaaaggtggcgtgatggcctgcaaccaagttggcggcttatcaggtgcttttatccctgtttctgaggatgaagggatgattgctgccgccactagtggggcgctgaatttggagaagttagaggccatgacggcggtttgctcggtggggctggatatgatcgccattccgggggataccccggcaacaacgatcgctgccatgatcgccgatgaagccgcaatcggcatgatcaacaacaaaaccactgctgtccgggttattccggcggttggcgctaaggtcggcgacaacgtcgaatttggtggcttattagggcgctcgccggtgatgccagttaatactgcctcgtcggcggactttattgcccgcggcggccatattccagcaccaattcattcgtttaaaaactaaagtcggcaaaaagagagtgtgacataaggcgctcagctactacttcacaggagcagttgattttcgtaccgaaaatcttcgatgtttcggacgttgaccattcttatggcaaaaatcttgccgcaagaaacatggctttgagtattagcctagagcggcgaataattcacgtagtggattatttgacgatcgtagctaaacggaaaaagtttccttatggaacacgttttaactatattgttcggaagtacaaaagaggagttgtgacataaattatttatgtcacaacccttttttagtcctttccagtgcgcttgatcaactgggctagaacgatgattccctggcgaaattctgccggtgttacgtaagcaaatgataggcgtagcgcctggttagtgccataaatcgtccccggattaaacaaaatatgccgcttaagcgccgcttgaaatagccgttcaacattgatcgttggggctaatttgagccaaatataaaagccaccgcgaggggtctgccaagtggcaacgtcagctaaatagtcttgcaaactagcgagggcagcgtcacggcgttggcgcagttgctggcgtaattcagtcaggtaagcgtcataagctggatcagttagtagcgccgctaacagttgttgcgccagtgaacttgcaccataatcggtttgcattttgacgtcacttaagcggcggacgactgcagcggggccgactagccagcctatgcgtaagccgggggccagcgtttttgagatcgtacctagatataacacgttgttggcgcgatccagtgcttttaatggcagtggcggtggagtttctaaccagagttcctggtaggcggtgtcctcgatgatcggcaattgatgtttctgggcaaattgcagcagttgctggcggcgttgcaatgacatcacgctgccagttggattttggaagctggggatcgtgtaaagcaattgttgggtcgtgctgtgcggcggaatttgccaataacagagaccagcgtcatcttgggggatgccggttaaagtagcagccgccgactggaaaacttgcaatgacttcagatacgtggcggcttcggtataaacggttgcgccgggtttaagtagcgcgactgaaattaaatccagcgcctgtagcgagcccgtggtgatcaaaatgttttccggttggacgtcgatgtgccagcgttgtagccgtttcgccagtgcttggcgtaaatttagcgcgcctaatggttccaaatagttcatctgcgtaatttgcggcgtgatcgcctgtaatttagcttgcaccaatttttgaggaaataattctggcgctaattcaccggtgctcaagcgtaagtaactttcgccttctagtcgattgatcgtttggatcgttggtaaattcgcgttgaattgcccgtgtaaatagggctgccaatctagcgctaacgaccaagtgttactggcaacgcgggtaccgtcaccgtacgcactgcttaaaacgccatcggcttgtagatcgtttaatgcggtgacgattgtgctccggttaacgttaaattgagcggctaactggcgctgagccggtaatttttcaccgactaaccagttgccttgttggatctgttggcggcagtaagcgctgatttgttgatatagtggtgtggtgacctgcggatcgggttgccaattaatttccatcgtttgttcgcctcttttgtaatggttgggaaatttttttgaatttggttgggtgcaacgcttgaatttaactctataataaccacctattagcgaaaataaaagtttaattagtaaaggttggttggtatggcacattatttacagggattattatttggtttagcttacattgcgccgatcgggctacagaatttatttgtgatcaatacggccctagcccaaccacggcggcgggcgttacgggtggcaatgatcgtcactttcttcgacattagtttggcgctagcaactttttacggcgtcggtaaattgttaacttggttaccgtggttgaaaatggtcgtgttaggtattggcagcctgatcgtgctctacatcggtatcagtttattgcgtgcgcaggcaccacaactggaaaaaagcgccccaacgcaatttagttattggcgggcaacgctggcggcctttgcgattgcttggctgaatccgcaagcacttttggatgggatgttactattaggggcgttccgtgcttcgatggcgccgttagcagccaatttttttattgttggcgttataacggcgtcggctgtttggttcactggtttgacgctactgattgcctggttacgcgaccgtttcaggactaaatttctattgttgctcaaccgaatctgcggcgtagtcattattttatacgccttgaagctgatcagcgaattttgccagttagtttggtaaaattatcaaaaaggagtgagtgattatgcggtatttgatcttgttgcgtggcgtcaatgttggcggtaatcatcgggtagtcatggccgaattgcgtcagcagctgactgatttgggtttcagtgaagtacgttcgtatatcgatagtggcaatttgctggttgatagcccattagcactggctgaagttcaggcggcggtgaccacgcttttagcgacccagtatgattttccggtggctgcgctggttattgaaaaggaagcttacttgactgacttggcgcaagtgcctgaatggtggggcgccgctggcgatttgcggcacaatgcattgttctttttgccgacctttacggcggcgatgctggaatcactacgccaaaaaataaccacatatgatcaaattcactacggccagcacgcgctattttggacggcgcccgccaaacagaattactcccgcagcctgtacgccaaattattaccaatggccttatactcggcagtgacgatccgcaatcgcaatacagcgctgaagctggctatgttgctgcagaaataatgcattctataaggtgtgtagtataatgaaagtagataaatagttttcattttacgcaaaggaaggacttctgaatgtataaagctgttgttttttttgatttagatgggactttatttgacaacgataaacaggtgacgccggccagtattaaggcgatcgcacagttaaaagccaataacatcttaccggtgatcgcaacgggacgaagtttatttgaaattaccgacacattggcgcaggcgggaattgattcctgtgtttgtgcggatggtagctatattcaagttgctgggcggccgctgaaaacggagtatctgaaaacggctgatattacggcaattactgagtacgcacaaaagacgaatttggcggtttcttactataatcctaatgggtttgtcgtcagccatgaaaataagctggtgcgagccaattatcatgaactaaaagaacggatcacggtggcgccagaagcgtatttgacgactaaggtcaacatgttatttgtatttagtcaggaaacggataagcaggatgatgtctatcgcaagcaatttgatgggacgtttagtttttaccgcaataattggcgcggccttgatgtggtcaagtatggggtgtccaagcgttcaggaatcgaatatttactgaaccacaccgatttagaacacgtgccaacatacggtttcggtgatttttataacgacttgccgatgttcgacgtggtcaaaacaccgatcgccatgggcaatgccgttccagaaatgaaagccaaagccgcctgggtcactaccagcaacatggatgatggtatcgttaatggcttaaagcactacaatctaatttaaggtaaacaaaaagtttagccaacacgtcgtcggctaaactttttttagtgcttagatcataggaaaaatacgatatttattttttcaatccccattaatcttcgtcgtcatcgtcttcttcaactaagccttcccaagctgttttgcctaaaacagcttgcaagcggcggatcgcacggttattttggccccgtaagtcagttaagaaggcggccattgctgggcgttcttccttagcggctaaggcaatggcgcggtcgataaacatattctgcgttgcgtaatcatgcgccgtgatgtccactaattccgcgttgctgcggtatttgttgcgaccatcttcttcaagcatgctgtattgtgtgtattcagctaaggttgaaggtggtaactcgttttcgtccaacaatacttcagctaaagcgtcaaagctcttgcgaccagcgctgatcaattcagtgtaaagtggccgtaatgcttcagcggcaaaaccatctaaaaaccagctagtttgatgaagcttgatgttgtttacgtggagattagccaaaatatggcccgtcattgcaccggcagttggtgtgtggtgatcaatgtcggcttgtttgatttcagtttggtaacgtgcttcgatttcttctttactcataggtttattcctccaaatttgaatggctaagtttttatttattgtgctagtcgtagaaaaaattaagccttaactttaactttttctacggtgtagcctagtttagtcacgacgtcggctagagcttcagcgctggtttgttcgtcgttgaagtcggctttgactttgctggcgttgaacaaaactttcacgttttcaacaccgtcatggttcttgacagcattttcgattttttgcatgcatgatgggcaagttaatgcgcctaattgtaaaactgcttttttagtcatatagaatgcaactcctttgtttaactttacttgatggttatagtttactgccgagcgaaggtagcggaattgacggtggtcaagttttggttacttttttgaaattaaccgaataagatagtcattgtgatagtgaaaacgcgtgttgtaagatacttgaaatctctacaacacgcgcttttttgtctatttcactgccgataactcagctgctgagtcagctttttcatggccgtaattgatcaagcgcattgcgttgaagatcacgacgaggatgctgatttcatggacgaacattccactagccatgtagatgaagccggcaactaagcctagtagtaagaaagcaacgacgccgatggcgatgacgatgttttctttggtgttaagaacagtctttttcgctaagccgtaagcatgaactaaagcgtggaagctggattgcattaggacaacatcggaagtttcgatggcaacgtcggtgccgctacccatggcgatcccgatgtttgcagtggccagtgaggggctgtcattgataccatcgccgacgaaagcaaccgtgcggccgtcttgctggaattgtttcacgaactcgactttttgttctggcattaattcggcgtgcacttcgtcgataccaacttgttgagcgacgtaatcggcggtggcctggttatcgccagtcagcatcactaaatgtttagcgcctttttcccgtaaatgttgtaattcagctgcaacttctgggcgaatgatgtcagcgatgccgagcattaattcaagtttgccgtcaacggcgactaatacgatcgagctgccggtggttttcaattcagcgagatcttcctgttgactggcgcttaagtgaacattgttagcagcgagtaatttatgattaccggctaaaaccgcatgaccgtcgatggtagcaacgaggccttgccctttaatggtttgattgtcggtgatggtcagctcttgatagtgataatcgttttggtccgcgtaactgacaacggcgcggcctaaaggatgatcggataagctttcgatcttcgcagtcaaggcaaaagcttgttcgaggggtaagtcgtagttattgactttggcgacggaagtattgcctttagtcagtgtgccggttttatcgaagacgaaggtatcgacttttgagaaggtgtccatcgcgtcgccacctttgatcaagataccacgtttggcgccattaccgatgccggcaacgttagagacgggggcaccaataaccaaggcaccggggcaacctagcactaagacggtgattgccagtttgaagtcacgggagaaaatgaagactaatagggcaatgatcaaaacggctggtgtgtagtattgggcgaaacgatcgataaatttttcagcgtgggacttagtgtcttgggcgtcttcaactaattcgatgatcttagcaaaagtggtgtcatcgccgactttagtggcgcgcacttttaaatagccgtcgctgagcatggtgccggagaagacgttgtcgtcaacctgtttagtgatttcccgtgattcaccagttacggcggattcgtcggtatagccgtggccatcaacgatcacaccatcgactggaatcgaggcaccagttttgactaaaacgatatcgtcttcttcgacgtcatctacgtcaacttcttcagtggtaccatcgtcgtggaccaatgtggcggtggtcggtgccatttctgttagtgatttgatcgattcacgggttttggataaggtccgtgcttctaagtaactaccgaacaagaataagaaggtcacgatcgcggattcattgtattcaccaatgatgaaggcaccgatcacggcgatactgactaacaattcaatactgatgacttttgcccgtaaggcttggtaggcgtggatcatgatcggcacagcggcgatgatcgaagcaacggccaacacaatgttgtaagtgagtaggctgccagcaaatttaccggcgtagcctaagacgatcaagacggcggacagtaacgtgatttggttgatgtgattttgaatccagttttgaaatttcattttcccgcactccttttaattgagagtgtgttcggaaaagcggttagattctgagcactagcctaactgggcaatagcagcacgaagtgatgcgtttgaccagtgtagctaggcgcaggaagctgctttttcaaccacgtttctactaaactaattataaaaattaacttagtggtgatttccggacacaccttgtttcaacttgatgactctactataagcgctagggggtgtgcaggaattgataagggtcaagttttgcaaaaagtttgcgtttagcgctatttttttcgccccgaattgtcaaatcaagtgcaacactttctagatttcacttataagtggtctaggtgttggtcatgcaagcaactgttcagctaagaattcattagccgatttgtagccgaagattttacgtgg

SEQ ID NO: 598 - DNA, 1175 bp, Unknown
  Metagenome-assembled genome
ggcttcattaaccaatacaagctgtactgcacggcaatcgtaacgattgaaattcctaataggacgactaaagattggcggagctttgtccaataaacccgctgacgtgaaaaaccactggtaaataagaactggttaaagttatcctttaagtcctgattcattagcagcaatcccgctaaccaataaacgaagattagccagtaggaataagctgtaaagtagtcacccttataggtcgcccaatgatgaatacttgcgcatgtatgcaacactacggtttgcatacaagattgttagacgttacgtcttgtctttttgtggccttatattttgcaacgtgtagtgattcgtctgactttacaaaattatttacagaatgcttgtttgtaactccttcccaaatcaatccccgaattaaagcacaacatggttatttcatgtttcagccctttcctgaaacaacttctatttctataattcaaaatatgataactcagcaatacgaacctcaaaaaataattctcaccaagagctttacggccactagggtataccctagtggccaggttcttacttatacacgactttaaaagtttcacagatacatggaattcgatctgtgaatacttttccagcctgataatattccttttcaaaaaaatctttatgaacctttcgccaatattctaagcttcgatttccttcaccttcaaggtaagcatgatcagctgtaactttgttaaggtttttgatttcaactcgctctgtctgtgtaatacatacaggtgctcctgaaccgtctaaaacaatactgtaagtacctactttgggtttaggctcattttttcgtacaattccagagcagaagtagtggctatttttttaccgattctgattaactcggccgactcatcacctacttgtttgccatagccaaattgctctgccagataatgttctcctgttacaccactcactttttgaaatgcttcccaataacgtaaaatccttgattctttcataaggacttcctccctctgtattcggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 599 - DNA, 6784 bp, Unknown
  Metagenome-assembled genome
aaaagtacttcaatcgtagccatcgcggatttggtcaagtcaaagacacgttagaatcacttttcgattaatacattattttgccaggagaagggattttcatttacacaaacttcttgacactcccgaatgcttgatatttggtgcccaaaagatttagatataggtgtgaatagtaaaaacaaatagattaatttgcgtatattaagagtagcacctaatttaataatggagggacatgaaatgactcagaaaaatttaaaaatcgcacagcgggcggcgacggtagccttatctagcattcttttaagctcgacgattttggcagcggttccgccactagttcatgcgacagcaacgactagtaccgaacagacgaccactaaaaatgccgcacaattagctgcgcagcaagatgttttagccgataaggccagtggcaccagcagtgatccagccggtgatgcgacatatcaagctgactatcaagcagagtttactcgtggcagtcaagaagtcgcacaaggaaaagcagcggccgattctgatgtaacaagtcagaagacgcaaaatacgagcaaaccagcaggtagtagtgtttattacgcacatggttatgatacagaatttgtagcggctactgcgacctttaaaactggtgttaccgctggtcaagcggctggctatgcacaaaagcctagtcagccagacgcacaattaggcaatatttatgcggctggttatgcggtcggttacgcacaaggaaaagcacaacagtcggctgaagccagtacggctgccagtcaagctgctgcggcgagtcaagcagcagctaaaccggcaacgagtaccgcagccagtggtgcaaatagcacaaatagccaagccacaactaaaccggcagcgagtcaggctaagccagctacaagtagtcaggcacagcaaccaactgctagccaggcgacgagtgcagcgactaccaatgcggctaagccagccgctgcatccaaagtcaatgccgcaactgaatctagtacagctactgcggccattgcagtgacaccagttttacagccagctccagcacccggtgacaataacggatttagcaataatgtgacgaacagtgatgatggttggctttataccaccggaacgccagtggcttcgcacgaagaattcatcaagctttttgctaaggacgcccagaaaattgcacaaaataagggcttatacgcatcagttatgattgcgcaggctgcattagaaagtagctgggggactagtacattatcgctggcgcctaattataatttatttggggtcaagggcagctttgacgggcagagtgccttaatggcgacgcaagaagataatggttttggtcaactatatacgatcaaatcaagcttcaagcgctaccataattataaagattcattgactgattatgctgatttgctccgagacggtcctggtttagcatctaattattatgcaggtgcgtggaaacaaaacgctaaggattaccaagcagcaaccaaggctttaactggtcgctacgctacagatactaaatataatttgaagttgaatcaaattattgccacttatcatttaaccaaatacgatcaagccccaacgacgcaatcaacgaccgccagtgctaaacaagttgatttcacagcaacattgaagcaaaagccacaattaaaacaagttttacatgggtattttcttacgaataaccaccccgcttatttgatcacgaagaccaatttgttgcggacgccaattatttggcatttataagccggtaataaaaaagcgcaccgacaaagtcagtccgcttgatgaaccggtgaacaaacagcttacgggggacgtaatctgagctttaccggtatcattaataatggtaccattaatgccgcccaaatcaagctgaaaatgcatatttatacccagttaaggattcctaatttatggggatcctttttggttcgattgcatcctctgataatttttaaaataacaattttacttggaaaatagctggtatacttgaagttaatggttattagcacaagagatgcttaaagtggatgacagttatagttggtgatgtttttaggcatattaagtagaattaattacggttttctaactaacattgataatttctgtacgcacttatttttctacgcgacgaaaaagctaatcactaggtatcagtataattcggtgcagtaaattaaggcaaaaattgcagatgagtatgggctagttgtttacttctaggtggttttaccgctatctgtgtattgttccatatgaaacaatacgtatattttccgtcaagttatacaaaatataacgattaactatggtatatttaaagaaactaggcaggaatttatacaataattgtgaagtaagatcatattccttgcggcatgaattatgttacaagaatggatacggtcgcttgttcttaataacacttttaagcaagtattgaatttggggcttactcgttagacagagtagactaatgctgtagtacgacaagcccaagtggcatcgtccgtaacatctgagttaattagtaggaggctttgaaatgactgaattttacattgtgcgtcatggacagacgcaggcaaatacacaagatattaaacaaggtacgatcaatacgccagcaacttatttgaacgataccggcaaggcacaagcacaaacgctgcatgataattttgatttaagttttgctgatcgaatgattgccagtccattagagcgcaccaaacagacggccgcaattctgaatagcgggtacgatctaccattaagctacgatcagcggttgattgaaatttcttatggccgctgggatggtcagacgaatgcccagctgcgcaaaacttatccggaattatttaatccgatcactggtgaagtttatccagattatgccattccagctaaaggtgaagaatttaatgcggttgaaacacgggtgcgtgcatttactgaagagatgacccagcgttatccgaaagaaaaaatcgtgatcgtttcgcatggttttacggtacgcagttttgcggtcaatgcagtacagccgcaagatccgatgagtatgccagagccagagaataccagtgtaaccaaaataatctgtgcaccagggaccttacaacaatatttgatttactataatcgacgttattagcttcaatttgtgctatagtcaaattgatggggatgatcatatggctgaagttgaagtagctgatttggaaaaaattaagcaacggctaagaaagttagcagcgcagatgcgtaaattaggtggtaaaactagtggtttaagccagcgctggacacaggatcgagcaattcgtgaagtgaacgcgatcgtaagtgaaactaaaaaggcgaccgctactgggcaacccttaactacagctgagcgcaagtcactcgagtatattgaaactgaatttgttgatcttgacgatgcactcgttaatttacccgattctgcggataaattaaaaacaactatgctgaagcaggaagctttgaaagctgttcgtcagcgattaacactaaaataagcgttaggcaatttttgcctaacgcttattttagtaaagtcccactatccggcgttaatgcgcgccgctttaatttgccattgccggtacgcggaaaatcagtaaccaaataaaaagcatggggaactttgtaatgcgctaaatgactgcggccataatcgcgtagctccgctgcactgatcggtgtttttaactgaagataggctaatggaacgctgccccagatggcatcagcatgaccggcaacaacgatctgcttgaccgctgggtgctgctgataaacagcttcgatctcgccaggaaaaatattttcgccgccagaattgatcatatcgccgctacgaccttggacaaacaggaagctttcgtcatccagatagccaatatcgtcggtgtcaaaccaaccgtcatgtagttgacggttaaatgctgctggctgatttaagtagccggcggccagcgttggtgttttaaccaaaatatgttgatcagtggcgatcttaatttgaacagggaacagtggttgcccagctgagcctaatttacgagcggcgttagcgaaatctagcgccacgatctgcgaggcagtttcggtcatgccatatgactgaatcacaggaatctgtcgttgttgacactcattcagtgtcgcccgatcaatcgggccgccgccgaggagcatacagcggaacgcagcctgataatattggtctgttggcagcgtctgcagtaatttttgtagcatgtacgggacgactgaaatcgttgtgatcggctgtgtgcagagtaggtggttgatcagcggggcatcaaaatgatcgaccaatacaacggtcatgccgtagatcaagccgcgtaacatgatcgataagccactgatatgaaatagcggcacacaacataaccaactatcggcggcagtcaagccgagatttagaaccgaaccgattgccgaataaaaatgattgctgtaagtttgcagcacgccttttgcgtggcctgaagtaccagaagtaaacataatgctcgccactgccgctggttcgaattcaactggcgggattatgggcaagggagcctgctgggctaactgactaaagctgaccactttaactggcagtggccgcaccaattgatcggcggccaaacaaagagtgactgcagcgtcagttaattgctgacttaactcgtcaacgctcagtcgctgattgagcaaaacaggggtaaaacccaattgctgcaacgctaaaatggtcaaataaccaggtagcgtgttatcagttaaaatggcgatgcgccccgttggctgcaattgtttgatccggccagcttgttgtagaacttgttgctgcaattcagcaaaggtcaacttttcgtgtttggtccgcacggcacagcgttgcggtgacagccgtgcgcgcttacttaaccaattttccatcgttaagggaacttcgggaactgatcgaaatcaggtttgcgcttctcattgaaggcatcccgaccttccttaccttcgtcggtggtgtaaaatagcattgtggcatcgccagcgaattgttgtaatccagctaaaccatctgtgtctgcgttcattgcggctttgatgaaacgtaaggcggtcggtgatttagtcaaaatctcattacaccaatctaaagtaactgattcaacttcagctaatggggcaactttgttgatccaattcatttggtaggcttcttcagcgctataaaaatgattcaagaaccaaacttctttagcgcgcttatgaccgatcacgcgggctaaatagccagaaccgtagccggcgtcaaaactgccgactttaggcccggtttgaccgaattgcgcgttatcagcggcgatcgtcaagtcacagatcagctggagaatattgccaccaccgactgaccaacctttgaccattgcgataaccggcttagggatgatccgaatcaaatgttgcagatctaatacattgaggcgggcaattttatcgggacccacatagccaccattaccgcgaataccttgatcaccgccggaagaaaaggctttgtcaccagcacccgttaaaataattacgccaatacttgcatcatcacgacagatcgtgaaggcctcgatcatttcctggatcgttactggggtaaaggcattcagcttttccggacggttcatcgtaatttttgcgattttatcggcccgttcaaaaatgatttctgagtagtctttgacgttttgccaagttacactagtcataaatacaacttctttctatatggaggtcaaaatgaatttacttgaattgttgggcgttaaaacagtacgcgctactgctactgaggcgatcgtcgaagtcgcagtgactgaccaattaaaacagccatttggcattgtccatggcggcatcaataccattctagcggaaaccgcggctagcttaggggctaacgctggcctggacacaacgcaacaagtggcagtaggcgtcaatgtggaaacgcaccacctttatactgtagcacaaggacgtctgcgcgccaacgccaaaccactccacgcaggcaagcgattacaaacctggcaggttgaagtttacgaacaagccagcgcacggctaactagtgtcagtacggttacgttgatgatcacagcacgtcagtagtaaaaaagaattttacggccgtgattctagcacgtttatcaggcacgtctatgtgtaaaagtccttcgtcagaactaacaccgagcttgcctttatcgatcatttcaggatcacattgtcatcaatgcccatatttttgtttgtcatatatatcatcttttcatgctagtatatcgaataatgattattaaaagcatatatgtactgggtgaggctaatttggaagttctttagatttagatctgtattttattggatgtaaggcagattgcaagaaataacttgaacaaatttagtaacgcagattacgcaaaaagatctcaatcggtgttcgccaatttaaacatttgagtggtcgggaattcaaataccagttaatttgaatcaattcatcatcggtaatctcatcaatcggttgacctttgggaatgaagcggcgtagtactcggttgcgattttcattactgcctcgttcatgtggcgaata

SEQ ID NO: 600 - DNA, 69787 bp, Unknown
  Metagenome-assembled genome
cagtcactgtggattcaaatcaccaaagcaacttgaagatgagtatcaaactcaaattcaaaatttagtcgtggcataggacaaaaaagtctctatttaaattgtctattttattgacaggggaccacgatcaaattagcgccactggtgatcaagctgaagccgataccgagcgcaaacaacgcttttttcggattgacactgttgatcaagtggagaaaatcatgtaatttaaatttatttttagcagcaggtaagtctgccattaatgctggattacgcatgttaactgccttcttccgtctttaaaaatctttccaatcgtcttcgttagttttttcgccatcggggcgttgattccagaaaccagcgcgcggatcgcggcggaaaccgtggtgatggtcccgctgaaagtgggggccaccaaagccaggcataccgcgctgaccggcaaacggcatctcccgcatagcttgctgcatacgtgctttcaaatccttcatttccgcaaccgataagttctggcgttcaccgtactgggttataaaattgtcccgcatagtttgcatcatttgtagacggtctaacgggtcgataaaacgacgcgcttcctgctgaaaatcgtcgggccagccagctgtgattttggctaaataatcgccaaattgtttttgttgatcctcatctagccctttaaaaaagatctcactgtagtcggctgttttttggtcggcatttttttgtgctttttgacggccttgttcagtcaaagccacttgtttactccgcttgtcggtggcgtcctccgtccgaacaatatcgccgttttgctccattttttttaataattcggctagcgagctgggacgcaggtctaaaatcgccgctaaataactttggtttaagttatcggcatgtgccagcacggctaacacgcgttgttggccggtcaacttttgtttatggtcacgcataaaagcgttactggattggctgataaagtgtaactgcttcattaaatcatcggtaaattcactcattatctctgcctcatttcagttttttaagaaatagttcggtacctaactttatttcgttttgtatcatagttcggtaccgaactaattgccaactagttggttcaaacttttttggtgggtacccccaagttggggtaaaaagtccccaacttggcaaaaatacccccacagaagggtgcggtaagccccaacttggcaaaaaataaaagtaaaaaaacagatctcgttctttttgcgtaatttatatacagaaaggggtgattgtgcatggtgaaaatatccgaaagctgttgtttttgtgatccatttcgaccgattattgtcgaaaacgccacagtatgtatttaagcattaaggatttaaaagattagggattaacgcattaggaacttaagccgcaactagttttaactcaaggagggtgcaatcatgcagcaaaataaattacgacaaatgtcagaagcggaacatgcgcattggagcaaatattatggtattaagccaatcgatcttggttcagttaattttccgcgtacgattttcacgttggctgagctagatgcacttacattagctgtttacggtgggatcacgttatttcaattacctgggagccaaaagtatgaacatcaaagtgtgattagaacacgggcaatttcggttgatttgttgtgtaccagtttaggtttagattcacgtaagaaagtcgcggtccgccaagcgttgcaaaaaatggtcaccgcccagatcattgcagtaacgccaatcgagccagctatggattggttgcaagggtggttctgctgccagctgccgatcaattttgacggtgtcggctatctgcaaggctttagtcggatcaatattattgattgggagcggatcaaattacgcttaatcaaaccggctgataaaataaaggggtacgccgcatatttggccgtccaacaaaatatctaccatcatacagatgcgtttcgtgtttgttatcaaagccaatcagccttgggtgcaacttatgggcgtagttgttattcagtggcacggactttgcggcaattggaagccaacggtgttttagcgatcaataaagttttatgggtacatcgacgggaattgttggaacgtaacatcatcagttgcgcgcaagattacgagcaattggcgacttttgtacacgcgcaatacatcaatggtaattacgcggccatcctagcatgaatatagctaaaactttttttgcttaaataaaaatatagcaagcaaggggctgtattcgtttgcaattcgtgttataattgagaagtaatatcagttacaaagtaaaacgcttaattcattgggttttaagcgtttagactgatcaaaaaattagtgtgacgtggctatagatacatagtgtgatagccgtggttagttgctaacaaccaatcaatttgtgaagtagaaaggacgatccatatgattgatttacatcttcaccgcactcaaactaagccgtcattgcgtttgtcagagtggctgaatgttttgcgagccggtgttttgggtatgaatgatggtattatttcaactgctgggatcgttctcggcgtggctggcgcacaacagagttcgtttgccttgtttatcgccggtatttcggggatgttagcaggggccttttcgatgggcggcggcgaatttgtctccgtcagtcagcagcgcgatatgcagaaaacagcggcacaaaagcaacaacaggcaatcgcggaacattatccccaagaattggccgagttgacccaggtttacgttgataaggggatttcggtggaattagcgcatcaagttgccgctgaattgatggttaaggatggtctaggcgcgacttgtcgtgaaaaatataatattgaattaggcaattattttaatccgtggcacgctgcggtttcgtcgttttgttctttctttgtgggggccattttaccgttactgacgatcacgttggtgcccgcacggtggaaagttcaagtgacttttgttgcggtggcttgtgccttgttattgaccggctacgttagtgccactttaggacagactaggcggcgcaaagccgtttggcgcaacttagtggttggtttactgacaatgatcgtcacctacgcggttgggcatttatttgcgatttaattttgcaggcttgaattcattagccaaatcaggtatagtaactagcgaagtcgctccagtgagaaaaataatcaaccagaaaaatgcacagcgaatctagatttggtgggagctagatgatcaagcggttgagtcgtccttttgaggagcaagcaattaaataattgagtggatattttatcaaaaagagtggtaccgcgggcaaagctcgtctcttacaggttaactgtagggatggactttacccgcggtttttgttgttaagggtggtttaaaaagcacctgtcatattcaaataaaggagtctattatgaacgaacaaaatcttgttattgcggcattaaagcctttattggcggaacatttagatgaagcaacgatcagtcaattgatcgaaaccccgaaaacgtctgatctcggtgattatgcttttcctgttttccgtttagctaaagttttccgtaaagcaccacaacagatcgccgctgatttagtggcacagatcgaccaaagtaattttgaaaaagttgttgcggttggcccgtacatcaactttttcttggacaaacctaaattcagtcataacttgctgcaaactattttaacggcggccgatcactacggtgatgctgatcttggtcaccaaggccaagtgccgatcgatatgtctagtccaaatattgctaagccaatctcaatgggccatttgcgctcaaccgtgatcggaaatgccatcgccaacattttaaccaaggttggttacaaaccagttaagatcaatcatttaggcgattggggcacccaattcggtaaattgatcgttggctacaaaaaatggggtagcgaagctgcggtcaaagcggatccgatcactaatttattgaagtactacgttaaattccatcaagaagacgttgaacatcctgaacttgatgaagaagcgcgggaatggttcgttaagttggaagccggcgacgaagaagcaactaagctatggtcatggttccgtgaagtctccttgcaggaattcatgaagatctatgacatgttaggcatcacgtttgattcctacaatggcgaagcgttctataatgataaaatggctgaagttgtccaaatgttggaagataaagagctattaaaagaaagtcgcggcgctgaaatcgttgatttgtcggcttacgacttgaatcccgctttgatcaagaagagtgatggtgcgactttatacatcacccgtgatctagcggcagcaatttatcgtaaacggacctatgattttgtgcagtcactatatgtagtcggtaacgaacaacgtgatcatttcaagcaattgaaggctgttttgaaagaaatgggctttgcttggtctgacgatattcatcatatcccgtttggtttgatcacacaggggggcaaaaagttatcgacccgccaaggccgtgtgatcttgttggaaaaagtcttgaacgatgcagttgatttggcgcaaaaagaaatcgacgctaagaatcctagtttggctaacaaagaacaagttgctaaagaagttggtatcggcgcggttattttccacgatctgaaaaatgatcgcttgaacaactttgatttcaatctggaagaagttgttcgttttgaaggcgaaactggtccttacgtgcagtacacgaacgcgcgggcacaaagtattttacgcaaggctgcggttgaattaaatgccgacgctgactacacgatcactgatgcagcagcgtgggatgtgttgaagcaattggctgagttccctgacgtgatcgtccgcgccagcaaagaatacgaaccatccgtgatcgctaaatatgcattacgcttagcgaagaacttcaacaagtactacgctaacactaaagtccttgttgacgacggtgaaaagacggcccgcttagcaatggttgctagtgtgagccaagtcttgacccaaagcttagccttgctcggcgtccaagcaccaaaagaaatgtaaagtgaagcagtaaataacgaaggctggcgcattatggctagccttttttgtatacggctaactaaaatacagcaacagttgatttttgactacgggaaagtgtaaaatgggaaaagaattttatttattagatttttttaattgatttttcatgcaatttaactatatgatagcaattgtaatgtaaaaagtgaggttgagagaatgagtgaaaagttaaaagttggtgtgattggcgcgactggtatggtgggtcaacgttacgtcacgttattagccgatcatccttggtttgaagtggcggttgttgccgcaagcgcccatagtgccggcaaaacgtatgcagaagccgttaatggtcgctggaagatgcaagccccaattcctgatggtgtcaaagagttgcctgttttagatgccaacgacattgaagcagtcactagccaagtcgattttgttttctctgcggtcagcatgtccaaagacgaaatccgtaaaattgaagaagactacgctaaaacggaaacgccagttgtttccaataatagtgcccatcgctggacccctgatgtaccaatgatcgtacccgaaatcaatcctgagcattctgatgtgatcaaatatcagcgtgaacgtttaggcacaaaacgcggctttattgcggtcaagcctaactgctcgattcaaagttacacgccagcgttagccgcttggcaacaatttgaaccgactcaagtgatcgctacgacttaccaagcaatttctggtgccggtaaaacgttagaagatgcgccagagatcgtcggcaacgtgattccttacattcccggcgaagaagctaagtccgaagacgaaccacttaagatttttggccacgttgatgccgcaactgggacgatcgtatccgcagatgcgccaacaatcactagccaatgcttgcgggtgccggttttatacggccataccgcagccgcttttgtcaacttcaaacaaaagccaactaaggaagaattagtggctgctttggaaagttatagtggcgagccacaaaaattgggtttacctagtgcgcccaagcaatttattcagtatatgactgacgatttccggccacaagtgcgttacgacgttaactttgaaaatggcatgggtatttcaatcggtcgcttgcggccagacaaaattttcgattggaaatttgtcggcttatcgcataatactgcacgtggcgccgctggtggcgcgatcctgtgtgctgaattattgaaggcccaaggctacattactaaaaaataaagtcattaaaaaagtcgtggaaatttttccacggctttttttaatcactgacataagcgtgtcacttagattgcctaaagctgcgccaaacaatggcaattcatggctttgtcagcagcagttagaactgcaaattggcaagtaatatttttgctgttcgggaggcgtaacgcatttttattcgtaaaattgagtaaagtgcgctgacttttgttataatcaaggtaatcggtaaagtatgggcttgcaaactggagtatccggctgtgtgctgagtaaagtccgccgatagtaaccttaattgcggcgaattttcttggcgtcgttgtgcagttagcctagttaaaattctgccttcaaaaagcagcgcgtttcctattttttggcctatattttggtcataagtatggttagtgttgtctgcaagtaaacacattacttgcggtatggttttggcatcagaattaactactattgtggagcagaggtgactattttgaaaaaagtagatcggcaagcaaaaattgaagagatcatcaaggaacatacgattgcgactcaggaagccttgttagtggcattggaagctgaaggtattccggcaacgcaggcgacgatctcacgggatattcgcgagatgcaagtcgttaaagagcgcgatcaagatgggactttacgctatacaatttatcataatggtgaaaaaacggtggctgagcggttggatgagtcgattgccgaagtggtggtagccgtcaaattagtggagtttgtgaatgtgatccacaccgcaccaggcaacggtaattctttggcagcaatcattgacgatctcgcttttccgcaggtagccggtacattggcggggcacgatacgattttgatcatcagccctgatcgggacagtgcgcaatacgtacacgattatttcgctgaacgaatggtcgttgaataaatcatataatgaataagcggctcatttgagcggcttttttttgtgcctcaaaaaccgcctagaataaaaataggcggttagcagtttattcaatatccaaaaaactttccggtaacggcgctgtcacttcgatcggcgcgaagctaaacggtagcagtaagcgcattttggcggaatgtaaaaataagcgcgaatagtggctagcttggggatcgtacaacatatcaccaactaagggatgacctaagtagctaaagtgaacgcggatctggtgggtgcggccagtttccaactggatcgccagtaaagatttagtggccgtctgctgtaaaacgcgatagtgggtgatcgccgccaccgcgcccggaccgtcgacttgccgtttacgtttatccagtggatcacggccgatcggcaaactgatcgtcccgctagccggtaaatgaccgtggacccaagcgcggtattggcgagtgattcgcttgctactgattaagcgattgagaatcggcagcaccactggatttttggcgatcacgatggcgccactggtatcacgatctagccggtgaacaacataggctggggaacctaaataagcggtcacgtggttcatcaagctatcctgctcgtctggccgattagggtgggttttagtgccgatcggcttgtcgacgaccaacagatcactattctcatataaaacgtgaacttgactggcatcgccgccttgatattgtggttcaggggtactaaaatcgctagcgtaaaaagtgaattggacgtcatcgccggtggcaacagtggtatggacagattgatagtgcccgtttaaagtcaccgcgtgatgaatccgcagttcatgatagatcgttttcgggatcaataaatcaccgcgcaaatattgtttgaggcggtgcccagcttgtgcggtgttaacggtacaatgatattgccatttttgcatgaaattcttccttcgattattagactgttaccattctaactaaaaaaggcggccgtgccaaattagtttggtcgttgacgctggtgacacgctaaactacgaccatagcagctgatttttccgtctaaagtcggtggtacattacgaccacttcacctaaacttaaatcaggcttaagttttctttttatggaagtatgctacaatataatggcgctttggccattgaatgaggtggcgtgatttacgacgctattcagtcagcatttttaagctggattttaagcgcacttgttaattagtacgatgttatttttgatttagtatcaacgtggttgtaaaagtaggctatattctataagttgggcgctttttcaactcactctctagtaaatgaggatttttatgcaaaaatttttaacaaatttacgacgcttttttgccgcgatcgggcattttttagcccccatactacattttattgcgccatattggcttagcttttggcatgcggtgcggcatttttggcggcgttttttaatgactcgctggttgattttggtgctaatgctgatttttctcggcgccagcacctacttaacttttttggcgaaaacgtcagatgtggagcatttgaaagctaatttgcagacgtcaacgacgatctatgactataagcagcaaaaggcgggttcattgtacgcacaaaagggcacttatgtcagctatagcaaaatttcgccacaaattcaaaatgcggtgacttccactgaagatcggactttttggaccaatccggggttcagtatcaaaggttacgcgcgggcggcagttagctatgtgatccatcacggccagatcagcggtggtgggagtaccttgacccagcagctggccaaaaacgcgttattgactcaacagcaaacttttgttcgtaaggccgaagagctgtttttagcgatcgagatcaacaaagtttatagtaaaaaagatattatcacgatgtatttaaacaacgcttactttggtaacggcgtttggggcgtacaagatgcggccgagaagtacttcggtaaaagtgcggctgagatcgattcggcggaagcagctagtatggcggcgatgttgcgtagccctagtttctacaatccaattgatcatccgcagtacaatatttcacgacgtaatttgattttagatctgatggtcgataataataagttgaccaccagtcaagctaatgctgccaagcaagaggcgttaaacttacaggataattacaattcaactaacggttaccgctatccgtactattttgacgcggtgatcaacgaggccatcagtcgttacggtttatccgaagaggatatcttgaataagggctacaagatctacacctcgttaaaccaaacctatcagcaaaagatgacggcttccttcgctaatagtatgatctttccagctaatgcggcggatggaaccaaagttgaaggggcgtcggtagcgatggacccacaaacgggtggcgtcgcggcaattgttggcgggcggaatacggagccagtgttccgcggttacaaccgagcgacccagatcaaacgccagccggggtcaacgatgaagcccctggcggtgtacacgccggcgctggaaaatggctatcattatgactcgcagctgaccgataaaaaattgtcctacggctcgaatcactacacaccaaccgattatggcaacaattatcaaggtaaagtaccgatgtacagtgccttggctcagagtctaaacgcgccggctgtctggttattagatcagatcggcgttcaaaaaggcgttcaatcggtaaaagattttggcattacattaccaaaaagtgatcagaatttggcgatggctttaggtggcttaaacgtgggcgtgtcgccgtaccaaatggcgggggcttacgcgacgtttgctaatcaaggtaaacgtccggaaagtcatttcatcaccaaaatcgttgatgccagcggcaatgtgatcgtcgacaataccgaaaccaagtccaaacgagtgatgtcggcaaaaacagctaaagaaatgaccagcatgatgcttggcgttttcgattacggcactggaacttcggcgaagccaaccggttatgacgttgctggtaaaaccgggagtactgaagtgcccgatagctacggctttggcaccaaagatcagtggattgtcggttacacgccagatgtggtcgtggcaacgtggatcggctttgatagcaccgacagtagccatttcttacagggcattagtgaagagggcgtggctaaagtttggcggtcagaaatggctaatattttaccaacgactgcagaaaccaaatttggcactaaagatgcgaagactcgggctagcgcggaacaaacgacgaattcatcggatgtctggagtcaggtcaaagatggcgcgaccaaggccaaagaaaatcttgattcagctaccagcaaggcgaagaattggatcgattcggtcaaaggactttttggtggtaattaagcgtacaaacgttcgtttccaactaggaaaacggttagaaacatgctatactggaagctataatgtttagcgtgaattggcaaagtgattagcactttttcaaccaatttagcgtaaacgtggtcgaaaaacagcttcttgtgcctagcgacgtcgggcaaacgtatcactacgtgctgtttattgcccaacttggctagtactcagaaactaagcgttttttcaaccactctaaacataatttaaatcaacggaggcacaacatggcagtcaatgtgtacgatacagcaaacaaattagaaggcgaactacggcagatcgatgaatttgttgccctacaggcagcctatgatgcgatgaaacaaaataaaaccgcctatgacatgtttaaacaattccaaaaaatcaacattgaattacaacaaaaacaaatgcaaggccaagaattagccgatgccgagatcgaaaaagcacatgatctagctggtaaagtgggcgaatttaaagaagtccaagcgttgatggaaaaagaaaaggccatgagccaaatcatggacgacttgaaccaaatcattacgaaaccagttcaagaattgtacgcaaattagagtgtgtcgaaaaagcgtccagattatggcatgtagccgactactttgcgttattagccaaggtcgctaataatctttgacgctacggacgttgaccattcttgtggcagctaggcaataagatacacgtggtggatcgtttagctagcgtagctatatggcgttatgccacgtttacgaacaagcgccactgtacgtttggataaacaacaaaaattagcgcatttaggtcggtcgcgcgggacgaatggtcggggcagtatactgactggaagcctgcgtggccgatttttgcgttgtaaaactagaaggaggccccagcaccgatgaaatttattcatgcggcggatctacatttagatacgccatttctcggcttacgcacagcaccggcggcgttgtggcaacagatctatgacgcgacgtttacagcttttgctaagatcgttgacgcggccttagcggaacaggtggactttgtttgtttggtcggtgatctatacgaccgtgctgaacgcagcattcaggctcaattatttttacaaaagcagctccagcgcttggctgatgcggctatccctgtttatttgagttacgggaaccatgattacgtcagtgacgctgccgctgagttaccattaccggaaaatacgcatatttttcccagtactggtgcaacctttaccttgaccaccaaagacgggcaatcagtggcattaagcgggtttagctatgcccagcgttgggtggaaaccgatatgacgccgcaatttccagtcaagaccaatacggattggcacattgggttattgcacggtagtcaaagtggtgtgaccagtgcccacgcggtttatgccccatttacgttaacagaattgaatcaaaaacgttacgattactgggctttaggtcatattcatcagcatcaacttttacaggaacagccgccgatcgtctacgctggcaatccgcaaggccgcaatcctaatgaagctggtgcccggggttattatttggtcagtcaaaaggggacgcaactgcagccagaatttcacgcagtggcgccgatccaatggcaaacgtgtaccgtttcggtggctggtgctgttcgcttgacaacggtgatcaacgcgatcgaacaggccgtggctaaattaaaacagccagaagcattactattgcaagtgaacttgactgcagcggagacgctgagcccagcgctattgcaacgaattgaaagtggcgagttattaagctacttgcaaaaacagcgacaacagcagccgtggcgctggatctatgcattacggccgcagatgaccgctacactgaactttaatcaattagatcaagcttactggcaagccagcgcaaaaaaaatatttacggcgcaaaatattgcccaagtagcgcagccactgacgcagccggacttcctagcagcagcattacaacaagctgatttaccggcaactttgcaggcacaagtgctgaatttattgcgtgaaaataaagcattggcaggtgattcagatgcgaattgaagcagttgatatttttggctttggtaaatggtatgatcagcattttgactttgatccgcagctgcaagtgtttcaaggagccaacgaagccggtaagtcaacgctaagtgcctttattgacggggttttatttggttttgcgactaaaaagaaaccctacgcgcagtatattccgaaaactggccacagttatggtggtcagttgactttggtgcaagccgaccagcgttatgtagttaagcgcgttgccggtcgagctggtggggacgtcacggtgacaactgctgatggtcagcaacatgatgaggcttttttgcagcaattgctggcaccaatcgatggacaactgttccggcaaatttttcggtttggccaacaggatctgatggcgatttttcaattgcagcaagcggatctcagtcggcatttattgacagtgggtgcggccggtagtcaagattggttgaacttagcgcaaaaatatcggcgtgaagccgcacgactgtataaaccacggggccgtgtgtggccactgaatcaggctttaagccagctggacgatttaaatgctaaattagccgatgcgcaagcaactttgccagcttatttggcccagcaacaaaaggtccaacgacagcaggcagctgtggcgacgttaggccaacagcttaataccgagcgtgacttggtcaatcagttaagccaattagtggcggcctggcctaactatcaagcttggcaggaggtcagccagcaattggctcaacagccggctagcttagccccacaagtctaccaagactaccaagagttgcaacaaaaacgcagtagcaaaaatgctgaattacagcaattggcggctaaattaaatgcaaccaccgatgaacagcagttagcgccagcctttttattttatcagcaacatcaagctgaatttgacgctcagatcgcgcaagtggctgacattcaagccgcggtgcaagtcagtgcacaattacagcagcaaagccaagctctgcaacaagaaagtcagcaacttcagcaaagcttaggtgtgaccaccgcggtgcaacccttaagtgagctcgatttgacccaagcgcgcaataatcaacagcaacggcagaagctgcaagttcaagcgcaacaacagcaacaagccttacaacagcaacaagcgcaaagtcagcagttagagcaacaagttgtacagttggaaaatcagttacaacaaccaacaagccgcagtcagcggcagcataagcagtctaattatttaatttggggtgtagtggctgtgattgggctattgttgccaagttgggctaaattaattggtttggtcggcctagctggtggcgcgtggcaattttaccgccagcaacagacgatgacgccgtcaactgatccggtgcagcaacagtggcaacaagcgttggctgaattagatcagcaacaagcccagatcgcggcactgactcagcaacaaacgacgacccaggccaatttagcagcttatactgcagcgtgggagtcgttgaagacgcgttacgcttatgatgcactaagtgatgatgtaattttaaatcatcaacacgacctgcagcgtttattagcttgccagcaacagatcagtcaggtaaaacaacgccaaagcgcaacggatcagcaaattcagcagtggctggccggctttgattttgctcgcgattggctgccgttagctaatgctgaaccggcagcagcgatcgaacaggtcacgacttttgtcactaatcagcagcaacaattagcaacgttacgtgatggtaaccaaaattatgcttactatcagcaacaaacgacgcgcgtgcaacaagaactggccacgctggatcaagccttacatgatttactagcgcaacatcatttagtgagtgaacatgaactgaagcagcgccaccaggctgatcaggcccaaaatcaattgctggaacgacaacaagtactgcacagtcagctcgatgcattgttgccagcgttaaaaaagtatcctgatcaagcagttttacaaactgagttgcacacgcggcaagccgagttacaacagcggcaagcacaactggatacagcgcaacgccaattaacaacggatcaaaccgaattaacgcagttggccagcgacggcagttaccgggtattgcggcaacaagtcgcgcaacaagaagcagagatcaccgagttgacgcaacgttggttaagctaccaattagctgcccagtggatcgaacaaaccttaagtcaagcctcacaacaacgtttgccggcgatgctgactttggcggaacaatattttgccattttaacccagcagcgatatgttaaaataaagctgacacctgaccaaattacggtggtacgacaagatcgtcaacaatttgcggtcggtgagttatcacaaggaacggcggaacaattatacgtagcgttgcgtttagcctttgcacaaacgatcagtgacgttcaacaaattccgctggtgatcgatgatagtttcgttaattttgatgcgccgcgccaacaacaagtgctaaccttattaactgaattaagtcgtaccaatcaggtcatctatttcacggcccgcactgtacaagttaccagcggtcaagtgacccagcttcaggcgtaatcagttgctggatgagcgaacagttaggggctagtgtccattactaaaatagttagagacccctgcagaacaattggcccctaactataaacgtggttgaaaaagctttttcaacgcactcttaagaaaaggaggccctcgctgtggccgataaacagttgtatgattaccaaaataatgaagaagttgcgctgttcgtgctggtcaaaggcgctgaagttcgcgtagccaaaaacggcaagaagtttatcgcttttactttccaggatacttctggctcgatcaccggtaaattctgggacgcgagtgatgctgatattgaactttatcaagccggtgagatcgtctttttaagcggcaaacgtgagctgtatcaaggcaagccacagatcaagattcataaattacgcttagctacccctgatgaaaatgaacacgtcgccgactatttacctaaggcgccggtcagtgctagcaccttacgtgaagagttgaatcaagctatttttgagatcaccaatgccaattggaatcgggtggtgcgttggatcatggcgcggcatcaagaagagtttcttgaatacccggcggctaaaactaaccaccatgcctttaaaggtggcttggcttaccatacgatcacgatgttgcatttagcaaaagcagcgtgtgacgagtatcccgagatcaagcggccactactatatgccggtgtcattttgcacgatatcggtaaaaccgttgagctaacggggccggtggcaacacagtatacggtagctggtaatttattggggcatatcgtgatcgttgatgaagaaatcgtccgtgcctgtatagcgttgaaaatcgatgctgccagtgaagatatattgctgttgcggcacgtgatcttagcgcatcatgggttacgcgaatacggttcgccagtcgagccggagttgatcgaagctgaagtgctccatcaattggataatttggatgcgtcgatgcaaatgatgaccaccacgttgcgccacaccgaaccaggtggtttctccgagcgcatctttgggatgaataatcgcaacttctatcaacctaaagaagaatagtaccgaaaaatggttctctttctcaagtctggtaatacgccagcatttttattccaccgtgaatgttagtccaattgggtatgaacgccaaatttggtaattcgcaaatttaaaaattgaatcgtctataccagcgaaaaacattgatgaaaacagtgagaaagaacgcaaaaagcccagaaaaaattctgggctttttgcataccattttgtttgttccgcataatctggagctttttaacacatttttttatgcccaaccaagggcacgtactagggccatggcagcgataccgacgacaacgatggctaataaacttttagtaatgatcgcagtgactaatgccggcagagtggctagggtgttgccgacgtccagactgggtaggtgaccggggtgagcgacaaacaagttttccaccaccaaggcggtcatgatcgctactgggacgaaggagagaaactccaccaaccagcggggcaattcaaattgcttaaccagaataaatggtaacacgcgggataaccaagtgactaagccacaaccaatgatcgtccaaaaaacgtaaccagttaacgccattttgtcacccccatcccgaataagcagcctaagatcgtcccacctaaaagggcaaaattagctgataagaaaatcaacagcacataaaccgccaccaccacaaaagcgatcactgacaattgtaagcttaactttttgctacgatcactgaccatctgcaagtagagcaggcccaagaacatagcgactaaagcgaaatccaggccaaatgttttcggatcagtgatcaaattaccgatcaacgcaccagcaaccgtagccactgcccaaaccaaataggcgaccacgttcgcggtatggaaccaaactggcgttaatttacggccagtatcgtttaacttattcatccccagcgcaaaggtttcatcagtcaacaatgagccaatgccaatattagtggctaaggaatattttttaaaatattgcgccatcgacgtactcattaaaatcatccgcgaattaactaaaaaagcggaaaaaacaattgctgagatcgggctaccagctaacagcatgctggtgataataaattgcgcggaaccggcgtagaccaccaacgacatcaacaacacggtccatagagataaattgctggtccgactgacaacaccgaaagcaagcccaacgccgatatagccaaaagtggttggcaatacatcgtgcagaccactgcgaaaagttaattctgaacccattaggtcactccctttatgcgatattccaggttaaatggtactgaaaatagggcgagctggaataaataattaatatctagtttaaactaaattagaaaatgattaaagaactaaatgatcattgctcataaaaatagagtagccacaaaaaaacgctccgaacattttgttcggaacgttttttaaatgagtttattcagtagcgctagatgatgagctagtagcagcacttgagcttgattcgcttgcggcactggaactagattcactagaactatctgatgagcttgattcagaagatgacgcttcagttgcagaatcactgcttgaagttgcacttgcgctagatgagctagctttagtggtcttagtgtagccagacaaaacatccttcaaatcattatccttgatctgaacgttacccttcttcaagactttaacgatcacgttatgcagaacggtactgtcttgcatatcagcagcataaatttgtgctttcaatgttgcttcgtgtgacttcattgtgcctttaccagggttcttgatcatacggataacatggtagccgtattgggtcttgactggcgtggttgtatagtcgttagtcttaagcttgaaggcagcctttttgaaagttgaatccaagctagtatcagttgaatcaaaggcaggtaacttacctgcatcagatttggtgctggtatcagttgaatatttcttagctaatttcttgaagttagctgcagaattatccttcttcaattcagaaatgatcgtttcagcagtatctttcttagcaactaaaatgtgttgaacggtcacttttggttcgtatgacttccattgcttcttcaaatcagcgttagagatcttaacgttatctttaacggcttgttctaataataagttagaacgtagattttgtttgaagctggaagcagtcatatcattttgtgatagaactgagctaaatgatgaaccgtattggctcttatatgaattgtattgtttgttgactttagccttggagaccttatcgccgtattctttttccaatactttattcaagatcaattgctgtaaaacttgtttaccactagatgatttcttcatttcattgtaataatcatcctgtgttacattaccaccagaggtcgttgcaactgttttgttaccacagcccgcaagagtgacggctagtaaaacgcccacaatggacaatagccattttttccgcatgcatagcacatccttataaattatatttttctgaaactcacaagccctaatataccataacgtaagcgagatttgaaatatcgattgatttcttcatgaaaacttcaataaatctaaggacgtgaatgtaaaagcgtttagattttacgcacgcttaggctaaattagttagcggttaaaaaaacggccaccagtaactggtgaccgtgagtcagagctagttttctgaatggtgatcaaagtcgccgagatctttttgcagttgctcgctggcgtctttggctcgtttgatccgtgattcagtttggaaattaaaatcatcaaataattgttgtagctcttggacggtttgtgcggcgttaccgctgccttccttagctaaaacttgtgctgcttgccgcaatctagctaaactatcgttgactgctagtgcgccttcagtgacatcatctaagtaatgtttgattcgggcctgagtttcgcgaccactgcgtttagcggtgaacagggcgtacacactgcccacggtggcgccaagcaataaaccagtgctgaaatgtttcatagcataacctccatcgagttaaaacttttccaactaagccgggatatgtgacactaatcagcgtttaattgtgcgctgatttttgcggcaacttgttgtaatttttctggggtgtagtcggcactgttatcagtaaatttcagtccaaagccgtccgtgtcgctataacgcggaatcaaatggaaatgtgaatggaagactgattgtgaagcgactttaccattattattgatgatattcatgccgacgattgcagggtcactagccttgatggcacgggcaattttgggaatacggctaaaaacttgtgcggccaagtcagcatcatacgcaaaaatatcagcgacgtgagttttaggtacgactaaagtgtggcccggtgtcgtttgcgttaaatcgaggaacgctttgacaacgtcgtcctcgtaaacgaccgtactaggaatttcgttctgaataattttacaaaaaatacaatctgcatcatatgccatagggcagacccttctttctatgtttacttcatgctaccatattaggcacctaaattgaaccaataccactagtggggtatgttataattatcggtaaataaaggctgatttaacgcttaaacaaaggagccaaataattttatgagcttagaagttgaacatttaaccgggggctattcacacgttcccgttctgaaagatttaaactttacgatccctgaacaaacggttgttggcttgattggcctaaatggtgccggtaaatcaacgacgatcaaacatattattggcattttgaccccacaaaaagggacgatcaaattaaatggggtgaccttagccaatgatccggaaacttatcgtaaatcgttggcatttgtgccggaaacgcctgtcttatatccagcactaacactgcgtgagcacattgaattgacgatcatggcgtacgatcttgatcatgaaaaagcttggcagcaggcgggtgatcttttggtccgttttcgtttagacaaacgcctggattggttcccagctaatttctccaaagggatgcagcaaaaggtcatgatcgtctgtgcctttattgtgccggccgatttgtacattattgacgaaccatttaccggactagatccgttggcgattcgtgatttattacaagtaatcgagcaacaaaaagcgcgcggtgcagccgttttaatgtcgactcacgtgctggctactgcccaaaagtacgccgatcgttttattttgcttagcgatggcgaaattcgtgcgcaagggaccttaaccgaattgaagcaacaattcggcatgactgatgctaatttggacgatatttacttcaagatgatcgacgaggtagcaaaatgaaacagttatggcaacaacgattacgccagcatcataaggaaatgctgaagtactcgcgttacgtgttcaatgaattctttatgatcgctgtgtttatttttattggggcgctggcttatagctacgccaatttactggatacgattcacacccagctttggtgggctaagccactgattttaattttattattagccgtactcagctttggtcgctgggcaaccttattacaagatgccgatacgctgtttttattgccgaaagaacgggctttactcagttatttgttggcggcgcggcgctatagtctatggttgccagccggaatctttgcgctgtgtttaggcgcgttattaccgtttcaagtggtggcaactaatttgacccccactagcagcatcgggctgttcgtggtcctagtggcgttaaaagacagtcagttgtggctacaattgttggccagttacgatgaccaaccccagcacatcacccaaatacgctggttattttacttggtagcagcgttaattttagcggtgagtctgtgggtaacgccgttggttggcattttgttagtcgtgatcgctgaatttgcgttacgctggtacattccgcgtcaactgactacggcagtttttcaatggcgtgcggcggtgaaaaacgaaaattcgcggatgctgcagctttaccggttgatcaacctatttaccgaagtgccgcaattaagtggcaaggttcatcggcgggcttatttagatccattattaaatttgtttaaaggtagtcagcaacgtacatttggttatttgtatttacgcgaatttttccgcggtaccgaatatttaggcctgtacctacgcttgttggtgctgggggcagtgattttatggtttattccgctatggtgggtcgcagcaataactggggcgattttcctctatctagtcggttttcagctactaccgttttaccaaatttttaatgaaaatttattggcacatttgtaccccgtcccgcaagttagtaaaatgcgttcatttcagcatttagtgcaaggtttgttgctagtgcaagcaattgtttttgcggtggtgatcttattcaatagtacattgagtcagtggggcttgttcgtagtcgttgaattggcggcagttttccttttgacgcagctgtatttcccccggcgtttacgcgcagaaaaataagggtggatagttgcttgacgttagttttctcgaccagtaaaatagtgagtggagttattatgaatgagtgcggtaattgactcgatcacaaagcggtgtcgcaaaatatttttgcggcacacactaatttaagggggtgtggcgatggattttgatttagatgctggttggcagattcagccggcgggcggtagtaccggagccgccttcgtggggactagggcgcaagagaaagtattcctcaagcgcaatacgtcaccatttctcgctgcgttgtcgatggaaggaatttcgccgcgattgatctggactaagcggatctcaagcggtgatgttttgaccgcgcaagaatggctgaatggtcgtaccttatcgcgtaaagagatggcggataccgcagtggctaagttattagcccgcgtccatcattcgaagttattgaagaaaatgttacagcgagtcggcgggatgaccgtcacctcggatcacttcttacaacaatattatttaaatctatcctcggatcttcgcagtcatccgcttttgaagcaggtgctgacttatttgatccagaacaaaccagtatttgatccagaacagctggaagtctgccatggggatttgaatcacaaaaattggttattatcagagcaacaacgcctttacattgttgattgggatgacgcgatgttcgctgatgcggcgtttgatctaagtaccgtattgtgccagtacgtaccacgtgatcagtggaatcggtggctgcgcgattacggcatcagtagcgataacggcatcattcaacgcatcgaatggtatggctttttaaatttattactgatcgttaagcgtttctattcggagcaacgttatcatgaaatgaatcaggcactactccaactacgtgagctattcacctcacgatcaggacaataagggacagatagggccggagcggtaacaaggttacgttccagcctttttatgtgaatagatattatgattgcattcagaaagcaaaagcgttttgagcgctatttaggctaaacgtagttgaaaaatatcaatcgcacgtcatttaagctacaattaaaatacaccagaaaaagaaaatgaggtcaagtatgcgtttaagaaacaagccgcgggctgctggcgaaattgcagctaattcacaatatatcacgaccacaccggctgaatttaagggccaatggcaaagtaaattcgcccaagcccaaccgttgagtattgaagttggctcaggtaagggccgctttatcgttgaaatggctaaggctcatcccgaacgtaattttatcggaattgaaatacaaccgtcagtggcgatcatgatcttagaaaaacaattggtcgctaagctaccaaatttgtacttgatccaagctgatggtggcgatttgactgacttctttgctgaaaacgaagtggcccagatctatttgaacttttccgatccatggcccaaatcacgccacgcaaaacggcggttgacgcatcgactatttttagccatgtatcaacaaattttacagcctgaaggtagcttacaattcaagactgataatcggggtttgtttgaattttcgctgatcagcttcaatcagtttggcatgcaatttaaggaattatcgttggatctacatgcagatgatgtgccggaaaatattgaaacggaatatgaacaacgtttcagtcaaatgggccatccgatctatttgatcgaggcacaatttaatgcgtcaacggctgccaatgtccaaccagatgctgaccgttagccgctacaataaagcgatactcccggttctgttggcgaatgccgccacggtaagcccagcgcttttgatagcggaaaggttgaaaatcgatccatgagccagtgattggttgtgtgtcgaattcctgtttgatctggtgcaataatttgtcaggttgggcaccacgataacgccgccacagcagggcgctaagtgcgctgccggctgctaatagtagtagaccacttgataagttagttgttgatttctgcgacataatgaagacctccattgattgaagtaatgatcgttgatcgtgaagtagtttagtcaaagtataggctggagatgaatgcggtgcaacactatcacgttattttggttgggcttgacggtagtcgcccagcagcagcggcgcttcaaaaagccattgagttggctcaaagtgaccacgctgcattgcagttagtccatgtgatcgaatattcaccccaagttggtagtacagcagaattagtcgcacaagcccatgaaaaagaacaagccacttttaccactgaactagccgctgcccggcagcaagcattggctgcgggtatcgaaaaagtaaccacaactattttaaccggaactgcccgaacattgctagaaacacaatcggcggatctgctcgtggtggggcaatcgggccaatcagcgctggatcatttcatgctcggatcattcgcggaaacgatcgtgcgcgaagcgactggtgatgtcctagtggttcgtaatgaaaaggtataaacgagaggaagagttatgttaatttcaagtttgaattcagcatcatttgctgatacgttaattttgatcgtcgccgctgatacggctaacttgcaagccaccaagcagcaaggggatgtggtgcgcatttatgatcaggccactgaccaaacgctaggtttcaatatttttcacgttagccaatatttacctgatctaaccggtaacggtcaagttttcttaactgaagatcaagtgactaaattaaatcaattgttgacggataatggttttgctggcgaattggcggcggacctaagtcctaaatttgtgatcggctacgttaaaagtttagttgcccatcctgattctgatcatttatcagtgaccgaagttgaagtcgaccatgggcaaactctgcagatcgtctgcggtgctcccaatgtggcgcaaggccaaaaagtggttgtcgctaaggttggtgcaatgatgcctaatggccagattatttggccaggagcgctccgcggcgtatccagtgatggtatgatcagctcagcacgtgaattagctgtgccgaatgcgccacaaaagcggggtattttggttatgccggctgatattcctgccggcacaccatttgatcttgaaaaggcagcacaagtggtggcagcgcaaaacgcagccgaatagtagcagcgcgcgggacttgtttaaagtgtcgcgcatacatagtaaatagtgaagtagagggggtagttgtgtggaacattatgatggacctgtatttttgcggcgtcagcagcataaacctgtagctaagccaacaccggctcggcggcaggttgtgccagaagcaccagcgccggtaccgactgcaacggccacaccgaagcggcggccacagcaaccagtagcagctaagcggccctcggttaacagcacacatcggtttacaccgaagtatattccacagtcgcaacaacaccaacaacatagtgacgagcaggtacgcttagctcgttatgtccaagcactaaataaaaccaacgatagtgttcttttgttcagtacggcagcagatgaaccagcagctgcgtttgaagaagccccaactttcttgcccgataacgcggcaacagctagtacgtcaacggtagtcggcgctgaaagcgtagcggatagcacggctgcggcagtagctactgctgttgaaccaacggattcggtggcagcacaagtatcaggcagcattgaagcagctaccgctaccagcacaactgcgacagctgatcgttcaggcgaacagcctgcagttgtagtttctgcacagtcagacaatgaaagcagtgcgaccacagttacgactacagcggcaacaagtgcggttgaaccaacgtccaccgcggcagctactgatgaaaatgggtcaagcgattcagtagctgacgtggttgaagaaacaagtaccgccccaacgtccgttgcaccagaatcggcagcagatgtggccgattcaaatactgcggtaactagtgtagtggagaacgaagaggtagtaagtgcggcggacgagcaaatgcagcagtctgacgcgcaagcattgtcaaaggaggatgcagttagtgccgcgacagcagtcactgtacaagtagaagcagctgaatcagcggcggtagtggcagaagaaacgccaagtgctgacgatagtaccgcaactacggagcagccaacttggcgtaaagtagtggcggcagtagcggcccatacaccaagtgcggtgcccgtgacggttgaatcggcggcaccgatcagtgcaacaccagttagcgagtcagccagtcagcgcccgccgagtatgcatcaagccgtgaatacagtcggtgatagccacgatgcaaagccacaattgactatcaaaacacaggcaccgttagatgatcagcactatcaattgccaccattttcactattgccagaaccaatcaaagataatagtagtgaaatgaaggcctgggtcgagcagcagcgagtcgttttgaatgaaacgcttaaagcttttaacgtgcaggcaacggtcagtcgctggagtattggtccggcggtcacccagtttgaagttagcttagcccgcggtgtcaaagtcagcaagatcactaacttaagcgatgatctgaagttggctttagcggcgaaggatatccgtatcgaggcgccgatccctggtaaatcaacagtggggatcgagatccctaatttgaagtcacgaccggtgatgttatctgaagttgtggaatcagctaagtttcaggaaagcaagtcaccattgaccgtggctttaggggtcgatctatttgggcaaccgatgatcaccaatgtggcgaaaatgccccacggtctgatcgctggggccacgggttccggtaaaagtgtcttcatcaatagcttgttgctatcgattttatttaaagccaagccaagtgaagtcaaattactactgatcgatcctaaggcggtcgaattagcaccatacaatggcttaccgcatctgttgtcgccggtgatctctgatccaaaagcggcggcggcagcgttgaagtgggcggtcgatgaaatggaaaatcgctaccataaactggctgctgctggcgtgcgtaacctcgaacagttcaacgccaaggccaccgcacataaggattttggcttgaaaatgccatatattgtgatcattattgatgaattagctgatttaatgatgatcgcctccagcgaagttcaggattacatcgtgcggataacgcaaaaggcgcgtgctgccgggattcatttgttggtagcgacccagcggcctagtgtcgatgtcatcaccgggacgatcaagaataatattccaacgcggatcgcctttatggtctccagccagatcgattcgcggacgatcattgatcaaagtggtgccgagcgactattagggcgtggcgatatgctttatttaggcaacggtcaaagtcagccgattcgaatccaagggacctacgcggaaagcgagatcgatccgatcgtcgactttgttaaacaacaattgcctccgcattatttatttgagccagaaggcttgttagaaaaagtggaagcaactgaaaaccaggatgaacttttcccggaagtgttggcttacatcgctgatgaagcccaggtttcgacctctaaattacagcgcgtgttctcgattggctataatcgtgctgctaatttgatcgacactttggaacaacgaaaattgatctcaccggctagtgggtctaaaccacgggatgtttatttcacgccggaagatctagcgcaatatcaagagagtaaacacatgaattaaagttgatcatgatgaaaaaaggggatttttgtagtggataacaatacgatctatcattttgttggaattaaaggctcaggtatgagtgcgttagcgatgatcttgcacgatcaaggctaccgcgttcaaggttcagatattgaacaatatacatttacccaacgtgatctggaaaaagccggcgtcaagatcatgccatttgctgcggaaaatattcacgctggtttgaccattgtagccggtaattctttcccagacactcatcccgaaattcaagcggctaaagccttggacttaaaggtattacgctacccagacttgcttggtgaattattagctgggcacactagtatcggtgttgccggtgcccacggtaaaaccagtaccactggcttattggcccacgtactcggtggcattgccccaactagctttttagtcggtgatggtaccggtaaaggcatcaaaaactcacaatttttcgtttttgaagctgacgaatatcgccgtcacttcttagcgcaagcacctgattacatgatcatgaccaatatcgattttgatcatcctgattattatcatggtatcgatgacgtgtttgatgctttccagacggaagccaatcaagtcaaaaaaggcatcttcgcttggggcgatgatcctgaattacgtaaattaaaagccaacgtacccgtttattattatggcaccagcgaccgtgatgatttccaagcgcgcaacattttgcggacggtcaacggttctgaattcgacgtttactatcatgacgaaaacttgggccactatgtgatccatttatttggtgaacataacgtactgaatagcttagccgtgatcgcagttagccatatggaaaaaatccctcacgccgaagttgcgcgtgaacttttgactttccaaggggtcaaacgccgcttctccgaacggaaaatggctgatatgacgatcatagacgattacgcccatcatccatctgaaatcaaagcgaccttggatgcagcacggcagaaataccccgataagaaaattatcgccgtcttccaaccgcataccttctcacggacgatcgcctatatggacgattttgcaaagagcttgagcttagctgatgtggtttatttgactgagatctttagctccgcccgtgaacatgacggcaaagtttccagcgctgacctcggtgctaaaatcagcaaaggtggcacggtgttgcatttaaataacatgtcggccttgttggaataccataatgacgtggtcgtgtttatgggggccggtgacgttcaaaagtacgaaaaagcttacgaagcgttgttaagtgattctagtttgaaaaataactagcactactcaccaataagtgagctggcagtctccggaaaaatgggatgtaagctgatgactaaatagttgccaactatcggtaatttgttacaatacgaagtaagtagaagtaggagaggaagtatacaatgcaagaacaaccaagaaatatgattgttaatgaagctagcctcggtcaatatttgactaaagtttatggttatatgagcttaggcgtagccgtttccgcattagtttcgtttttagcgctgaccatttatcgggttcaatttgccactttgatcggcaataatccaatcatgttgtacgcgctgattttccttgaattagcttttgtcatggggactagttttaaagccagccgcggtggtgccttgtcatttgtgctgtttatgggttttgcggtgatcaatgggctgacgttggcgttaacgttatccttttatagtgtagccaatatcacgactgcctttgtggccgcaaccggaacgtttggcgcgatggcgctatatggctcactaaccaagcgtaacttggctggtatcggtcaaatggctttcgctgcgttgatcggcttgttagttgccacgctggttaacttgttcctgcgtaacccgatggttgattacattttctcctttattggggtaatcattttcatcggtttgaccgcttgggatagccaacgaattaaaatgatgtacgtgcaaaatgctggtcgtgccgatctaaatggtttagcgatcatgggtgctttacagctgtaccttgatttcgttaacttattcttattcttcttacggatattcggtattggcggcagcagtaacgattaaaaatttgtaggggcttgtgactgttcaatggttctttctgaaacagggttagagttaaacagaaaaagttagattccattccagttggccacggtagtgcaccctgaatttagggtcattgcaccactcaaaacagtataagttgtacacaaaaataccagtaaaaacagtgaaatctgtttttactggtattttgtttacttaaaaatgcgaattattcagctacaagcacactaactgagtatttagctgtgctaatgattcaatgttcagttattgtcggaatggaaccttgcactgttcctatgcactcaataaccatacttcaaaataaatctgatcagttgcaagcttctttttgtgtccaagacactttgtttgaagcaaagtgctgcgttttttgttagaatataaggtagtgtaaacgtaaattaattgtggctgcaggaagcgtaatttgcgtatttaatttgttaatagctaattttaaggagcttaatatggccgacgataaacatttattattaattgacggtaatagcgtcgcttttcgggcgttttttgccttacattcacagatcaacacgttcgttaatcacaatgggctgcacacgaatgccatctatgctttcaacacgatgttagatattgtgttaaaaagctttgcccccagccatgtgctggtagctttcgatgccggtaagacgacttttaggacggctaaatttgatgattacaaggggcaacgggataaaacacctagtgagctttcggaacagttaccgcatttgcgcgatttattgacggcttacggcattcgttcttacgaattggctaactatgaggccgacgatattatcgggacgttagcgcaagaggcagcagcgcagggttttaaagtcgatgtggtcactggtgatcgcgatttgacgcaactggcaaccgaaagcgtcaccgtcaacgtgacggtcaaaggggtgaaccagttagaagcctacacgccggcgcacgttgctgaaaaatacgaactaacgccgcggcagatcattgacatgaaaggcttggctggtgatacttctgataattatcctggggtcaccaaagttggtgaaaaaacagcgatcaagttattgaaacaatttgatagcgtcgaaggcatctacgaaaatctggatcagctgaaagctagcaaaatgaaggaacatttagttgctgatcgcgcgcaggcctttttaagtaaggatttagcgacgattcgtcaagatgcaccactgacgatcggtttggctgatctagtttatcaagggcgtgatgtcgctgctttgcgtgaattttatcaggaaatggatttcaactcatttcttagtaaattggcagatccagaaacggaacaggcccgggcagccatcgaatttcaggaactgacggcagaagcggtgccagcagttctggctagtttcaccggcccagtaactttttatttagaaatgctggatacgaattaccatacggcaccgtttgctggctttgtgatcggccaaaagggtcagtggtatgtgagccgcgaggttgaattattgaagttaccagcttttactaagttttttgccgacccccagcaagctaagttggttttcgatgccaagcgcacctatgttggtctgaaccggctaggcatcactttggcggggatcagctttgatctattactggtttcttatttgctcaaccccaacgatagcggcaatgacttaggcaagatcgcccagttacaccaatatcgcgatgtggccactgatgaagaagtctatggtaaaggcgttaaacgcgcaattcccgatgattcggcagtctttttccagcatttagcccaaaaggcacaagcaattgaacaattacaggctaagctagaccaacaattggttgaaaatgaacaagatggtttgttcaaggaaatggaactacccttggccattgttttagcacaaatggagatcgctggtattcgggttgatcctgaccgcttaaatcagttacgtaaaaactttgcccaacgcattgatgagctaactaaaaaaatctacgccgaagcggaagaagaatttaacatcaattcgtctaagcaactaggcgaaattttatttgagaaaatgaatctgccggtgatcaagaaaacgaaaaccggttattcaacggcagttggcgtgttggaacaattaaaagcgatcgcaccgattgccagtgatgtgcttgattatcgtggcttgaccaagctgcaatcaacctacattgatggcttattgaaggtgatccatccagatgatggtaagatccacaccacttatttacagaccttgacggctacaggtcgtttatcgtcaattgatccgaatttacaaaatatcccagttcgtgatgaagatggccgccaaattcgtcaagcctttgtgccgcggaaagccggttggcaaatctttgccgctgattattcacaaatcgaattgagggtcttagcccacatttcccatgatcagaatttacaggcggcctttagtgaaggggcggatattcacgctagcacggcgatgcggatctttggcctagaaagtgcggcggaagtaacgcctaatatgcgccggcaagctaaagcggtcaattttgggatcgtctatggcatcagtgattacggcttgtcgcaaaacttaggtatcacccgtaagcaagctaaaacgtatattgatagttatttccgcgaatatcccaacgttaagcaatacatggaagatattgtggcggcggccaaaaaatatggttacgtcgaaacgttattccatcggcgccgttatttaccggatatccactcgaagaatttcaatttacggtcatttgctgaacggacagcgatgaatacgccgattcaaggtagcgcggctgatatcatcaaagtggcgatgttaaatatgcaaaaggcgttaaaggaacagcagttacaagcaaccatgttattgcaggtccatgatgaattaatttttgaggcaccagaagcggagatcgccactttagaaaaattggtgccacaagtaatggatgccgcagttaagttggaagtgccaatgaaggtcggctacggcagcggcccaacttggtacgatgttaaaaaaggttaggtgaacacatgccagaattaccagaagttgaaaccgtccgccaaggattgcgcggcttgattttaaataaaacgatcgctaacgtggaagtccgctggggtaagatcatcaatggtgatagtgcccagtttgccaatgatttagttggtttaacttttcaggagatcgatcgtcgcggcaaatatttattatttcggctcagtgacgagttgacgatcgtttcgcatttgcggatggagggcaagtaccgcgtcacgccgcaagcgcaagaagtgaccaagcatactcacgttattttcaattttactgatggcactgcgttgcgctatttggatacgcgtaagtttggccgaatgaccttgatcaaaacgggcactgaagatcaggttggcggcttgaaaacgttgggtcctgagccgaccgcaactgatttcactgtggctgattttacgcagcggttacgcaagcataaaaaggcgatcaaaccgaccttgctagatcaaaatgtggtcgctggtttaggtaatatttacgcggatgaggtgttatggttaagccagattcacccattacagccagctaacacgttgactggcgcacagatccaggcattgcacgacaatattattgccgaattggctaaagcaatcaaagccaaaggcacgacgattcgcagctataccgatgcctatggcgctaccggcggttttcaattgtcattgcatgcgtacggtcgcgaaggtgagccctgtgaacgttgcggcgtgaccatcgaaaaaatcaaagttgcccaacgcgggacccatttttgcccgcactgtcaggtattgccggaaagccaggtcagtgcctcatgagtctagttttaggtttaactgggggaatcgctagtggtaaatcgacggttagtcattggctagctgaatatggttatccgatcgttgacgcagatgtgatcgcccggcaagtcgttgccccggggacgatcgggttacgccaattggccaccctattttcaccggcaattttaacggctgacggtgcacttgatcggcaaaagttaggtcgaatcgtgttcgccgatcgccgccagctggcacaattaacggcgatcacgggacccttgatccgccaagagatcaaccgccaattagtggcgctgaagcacgctaaaaaagaattgatcgttttagatgttccattattattcgaaggccactatcagcaaaacgctgatttgactatggtggtctacgttgatggttccacgcagttacaacgtctgatgattcgcaatcatttagatgaagttgcggctaaacagcgcatcgccagtcaatggccgttgattgctaagcggcaaatggctgacatcgtgatcgataataacgattcacttgcggcaactaagcaacaagtggtaaaatttttaacacaatatggtttacagaaataaggtggggcgttggcctgaccttatttctttatgaagttgattgataagatcacgttttaatcaattgaatggtataatttctgtaagtagtccagtttggtatattcttgcactgagatactacgtgattttttgatgggtacaaaaaactaggttccgtccgcgcgtaccggaatggaatctagctagcctagtttcgcttaaatttaaatctgaacgctatacaatgtttaatttgataaataaaacttggaacttacttgccgaggtcgattggatcaaactataattcggcaagttctctggaacgtctaaatttattagcagtttgtgctaataaacaattttaattgtgaaatggagtgtctaacatgcaatgtccgcgttgccatcataatggttcccgcgtcgtcgattcgcgcccaactgatgagggtcgcgttattcggcggcggcgtgaatgcgaaaattgtaattttcgctttacgacctttgaacgcgttgaacaaacaccgctattagtcattaagaaaaatggcacccgtgaagaatttaaccgcgagaaaattttacgtggtttgattcgctcggcggaaaagcggcccgtgacgatggagcaaatgactcaaatcgttgatgaggtcgaaaataaaattcgggcattaggtgaaaatgaagtggcttcacaggtcatcggtgaatacgtcatgacgttattagcggatgtcgatgaaatcacctatattcgttttgccagtgtttaccggcaattcaaagacgtcaatgtgtttttgaaagaattaaatgatatggttgaccgggataaacgtgccggtaagtctgatcacgagcagccatcatagtgacgagcagcttgaatgattttgactatccggttaattttgcaattttggctaaaaaagtacatttagaaggaggtattgatgatgcaagacgcattttttaaattagatccccgtgatgggtttgtggtcaccgatgccaattatctttctgattttgatcggcaagtgctaacgtacttatatcagccattaatggggaccggcgcttatagtttgtatttgttactgtggacgcagcagtcagtggcgcaaaaagcacagccgcacagtacgttattagcgttattgaatgttgatttgccgactttatatgaaagtcgaattcgtttggaagctttaggcctgatcaaaacttatcagcaggttaatgcggctggccgaacttttacctatgaattatatgcaccgcaggcacctaatgcgtttttcaatgatgatctattaagtttattgttgtacgatgcggtgggtgaggatcgtttcacccaattaaaaacacagttccgattgcatccagttcaccctagtgcagatttagaagaggtcagcctgaacttcctcgatgttttccatgtgaattcacagttgttgaatcacttaccggcaacgattgcggaggctaaatccgaatttaaaacgcagccacaaacaacgcaaccgcagttggatcaacgggcaaccgcggatttcgattggccatttttcaagcaacaactgcatgctagctttgtttcggatcgtgaattggatcagtatcatgatcagttattgacgttacacgccttatatggcctaaatgagctggaactggcgcaatacgtgaatgaaagcattaatattacgacgaataaattggattttccggcgttgaaacgtttggtagcgcggcagccagcgaaagtagcaccaacaacagcgtcgacggccgttccaacgccagcaccgccgacggctactaaagatgcagcgctgtcgaaaaatgatcagcagttgatcgctgtcagtaagcaattagcaccggtgacttttttaacgcagttgaagcagcaacaaggtggctacgtgactgatagcgaacagcgggtgctggagcggctgatgagtcgtcatgttttcgctgacgccagtatcatcaatattttaagccactatgtgatcagtgtacgcaaaatgccgacgttgacccaagcgtatgtcgatggggtggccaatggttggttgcagcataacgtgacgacagcagaagcggcaatgcaggaagttaagtcattttaccggcaaaagcagacgcctaagcgcaatacgcgcagtaaacagccaattcgcaaagaaacattgccagattgggctaaagacggttataaagcgccgaaacagcaagtcactgcggaacaacgagcggcggtacagaagcgcttagcggcattgcaggacaataaggatggtgagtaacgatggaagatatgggtaaaaacctgcggatcctgatggataaacgcaacttaaatcaacactacgatgaactaatggccaaagtcatgcgcgatccagcggttcaacagtttattgccgccaatcgtgcggccattgaccaaccgatgctggatcgtagtgccgctaaactatacgagtttgtgaccgaaaatcataaatttcaggccaaacaaacttcattggcaccgggttaccaaccacggctgatcctgaatcatcattttattgatgtgacctacgaaccgactgctgaattagttgcggcagaagaagcgaaggcattacaatcacgggtgcgttcgatcaatatgccgaaaaatattcgcgaggcgcgtttgggtcaattttatcaagatgatgatcgtttcgctgcgttagatgcggtgaccctttttctggatgattacactaaagcaccaaaaaaattccatcaagggttatatctgtatggtaattttggtgtcggcaagacttatttgttaggtgcattggcgcatgaattagcggtgcgcggttttcaaaccacgttagtgcattttccaacttttgccgtggaaatgaaaaatgccatcggccaaaatgatttgacgccgaaattggaggccattaagcgctcacgaattctaatgatcgatgatattggcgctgattcaatgtctagttggatccgggatgacgttttaggcgtgatcttgcaataccggatgcaggaagaattagcgacgttcttctcgtcgaatttttctatgcagcaactggagcgagagcatttaagcgtgacccaacgtggcgagcaggaaccattaaaagccaaacgaattatggaacgtgtgcgttttctcagtcgtgaagtcgaattactcggaaaaaatcggcggctacaaccgtaaaaattaagtatccgacttgaattttacttagagatatggttcaattgggttatcgaagcggaaagataccgtcgactaagttagcttttcagagaggcaagggtgctgtgacttgctaggccaatagttgatgaccactttccaagaactctatgcaaagtagggtcggtccgttaccgttaataacgctaatgaggaagtgtgcatgcactttaaatctgggtggaaccgcgaaattatcgtccctgaggtctatttgatctcagggactttttatttgcggttaatattttaaggaggccaaattcatggcagaactcaagttaacgttccccgatggcgcagtcaaagacttcgctgcaggaacaaccgttgctgatgtggcaaaatcaatcagcacgagtttaggtaagaaggcaattgcaggtaagttggatgggcaattagttgatttaactgcaccattgactaaagacggtaaaatcgaaatcgtgactgctaaagatgaagctggattacaagttttgtggaacaccgcaagcttagctttaggtgccgcattgcatgatttattcccagcaatgacttttggcgaacatgctttgacggaacacggtttctattacgacactgataacgatgctaagccagtttcagttgatgacttagttgcgatcaatgatcatatggctaaaatcgtcgctgatggtgatgtgatcgaacgcgaagttgtttctaaagcagatgctttggctaaatttgctgctgatccttacaagactagcttgttaaatgacttagatgctgatgaagtcgtgctttatcatttaggcgacttcactgattttggtgaacaaggcgtgttgccaaatacgaaattattgaaagtttccaagttattgtccgttgccggcgcatactggcaaggtaaatccagtaacaagatgttgcaacgggtttacgggacagctttcttcagtcaaaaggaaatggatgctgacgatgcacggcggcaagaagcccatgatcgtgatcatcgggtgatcggtaaccagttggatctattcttcgttgatcctaaagttggcgctggcttaccttactggatgccaaaaggggcaacgattcggcggacgatcgaacgttatattatcgataaagaagtagcaaatggttacaaacacgtttatacaccagttctgatgaacttagatgcttataagacatctggtcattgggatcattatcgtgaagacatgttcccaccaatggacatgggtgatggcgaacaattggaattacggccaatgaattgcccaagccatattcagatttataatcatcatatccgcagctaccgtgaattaccattgcggatcgctgaattagggatgatgcatcgttatgaaaaatctggtgcactttctgggttacaacgtgttcgggaaatgactttaaacgatggtcatacctttgttacgttagaccaaattgaagatgaatttaaacgcatcttgaagttgatgatcgaagtttacgctgattttgacattagcgactattccttccgcttaagctatcgtgatccacaaaatactgaaaagtactttgacgataacgaaatgtggaatcgtgcgcaaacgatgttgaaggcggctatggatgacatgggccttgactacactgaagcagaaggcgaagctgctttctacggtcctaagttggacgtccaaacgaagactgctttaggtaacgaagaaacactatcaacgattcaattagacttcatgttaccagaacgctttgacttgaagtacgttggtagcgacggtgaagaacatcggccagttatgatccatcgtggcttggtttcaacaatggaacgcttcactgcttacttgactgaaatttacaaaggtgctttcccaacttggttagctccagtccaagcagtgatcattccagttaagaatgaattgcatttggactatgctgaacagatcaagtcacggatgtctgctcgtggtttacgggttgagatcgatgatcgtaacgaaaagatgggctacaagatccgcgaagcccaaacgcaaaagattccgtacaccttggtaattggtgatgaagaaaagagtcacgccagcatttctgtccgccattacggtgaggacaaaggaatcgcccaagatgccaatatttatattgacgccatggttgccgaagttggtaactacagtcgcaccggtaaattaaagggtaccgaagcaaatgtagcccaaaagcttgacaagaatcagaaataaccgtatactttagcgtattgagaattaaagcagaagcagcccgcttctcgcctaagctgactaaatgtctctgggcagataatgaacggatcaaaccaggttactggtttgtggcggggtctgcggaagcgggctccgtttttttctgcaaatttctcgaaatttttggaggtgaatagccatagcaaaagacatgatggtcaatgatgggattcgcgcacgtgaggttcgcttgatcgctgaaaatggtgaccaattaggcgttcagagtaaaactgaagcattgcggattgctgaccaagctaatttggatgttgttctcgttgccccaaacgctaagccaccggtagcgcggatcatggattacggtaagtatcgctttgaattgcaaaagaaacaacgtgatgcccgtaagaaacaaaaaatcgttagcatcaaagaagtccgtttgagtcctacgatcgacgaaaatgactttaataccaagcttaagaatgcacgtaagtttttagctaagggtgacaaagttaaagcatcaattcgtttccgtggccgggcaattacccataaggaaattggccgtgaagtactcaagcacttggccgatgagactaaggacattgcaacggttatcgcgcaacccaagatggacgggcgtagcatgtcgatgatgttacaaccaatcgccgagaagcagtagtattttatactacaaggtgcgatcagtaatgaacgcacaactattaatattgtttggaaagactgtgacggcagtttttcgccacagtcttctgtagggaggaagattaattatgccaaagcaaaaaacacatcgtgcatcagcaaaacgtttcaagaaaaccggtaacggcggattgttacgtcatcacgcttacacgagccaccgtttccatggtaaaactaagaaacaacgtcgtttcttggctaagccaggcatggtttccgctagcgatatgaagcggatcaaacaaatgctatcccaaatgaagtaaggtagcatcgatcgattaaatttttaggtaacttcgtgctcctaagttttcacaatagtgaaacgccgaagtatttgaggaggaatttcaatgccacgtgttaaaggtggaacagtgacgcgcaaacgtcgtaaaaaggttttaaaattagctaaaggttatcgcggttcaaaacatcgtttgttcaaaacagcaaacactcaagtaatggtttcataccgttatgctttccgtgatcgtcgtcaggttaaacgtgatttccgtaaattatggatcgctcgtattaacgcagcagcacgtttgaatgacattagctacagcaaattgatgcacggtttgaaagttgctggcatcgacattaaccgcaagatgttagcagaacttgccgttagtgacgctaaagcattttctgacttagcagaacaagcaaaatcagctattgccaaataataatttggtttaaaaaaagttgtgctcagcgcgagcacaacttttttatttcattacgataattttgccaggttgatgatgttgttcaagtaattgatgtgcggctcgtacgcccgccacatcaaaggtaaattttgctgccactggcagctgcaattgttggtgggtataaagttctagtagataggttagtgctgggcgatcacggaagcctttttctggttggaaagccagggtttcgatgttgtcgctagttggtggtaccgcgtttaaactgacgtaacggccattttcggcaacatgggctagcccctgagcctgatcacgaccaccactaacggcgttgatcacgatatcagcatgaacgttactagcagcgagatcggtcgtactgatgaattgatcaacgcctaattgttgtacgtactcagcatttgttgcactggcaacgccggtaacgtaggcgccttgtgctttagcaatttgtaccagcatactgccaacaccaccagctgcgccctcaactagcagactttggccggtctgtaattgcaatttcaccagtaataaattataagccgtaataccgactgaaggtaaaccaacgagcgcacttagcggtgtgttagctggcactttggcaattttattatgtgagagcgccacttgctcagcataagcgcctaagttactgtgaccgacgacaagatcacccacttcgtaatcagtgacttgttcgccaactgcacgaatggtgccaatgacatctgtgccgggaacgattggaaaggccaatggtcgatctacagcatgttcgccgcgacgtagtgcagcatcataaggattcagggcaaatccggccacatcgagcaaaactcgaatcggcgacaatgtcggtgtaggctgttcgatcgtttcgaaaacagtggcatcgccaaaatgattaaaaccaaaactttgcataaactcagtcctttcgtcgagcagttaaaaatgatttttatgcggcttgctcctaaattttatatgggccaagcgcgtaggtgggttacgtctcatcttgatgacgattgagcagcgatagtcagtataatcagggatgcacaatggtttcaagatgattaccacgtagactttagttgtagcatacggcaaatttagctaactgcaaagtaattggcttttaggctaaatggtggcaaaagctaagattactttttcaaacacgatctaggcgggtgcaatttgtcgggctttcccttataatggaatgttgagatgtaaaacgatatagatgttgagaggttattatgtttttaaactataaaccgacttggatggtggccaaaatcacccagctgacagcagccgatttacggcgtcagggaatcaaggcaattctaactgatttggataatacgttgattgcttgggataatcctactgggacaccagaactgcgtacatggatcaagacaatgcaggacagcggtatgccagtggttgtcgtttccaataatagtgctgcgcggatcagtcgggcagtcgctagtatgaagctaccatttatcgcgcgggcgttgaagccattatcgatcggcattcgccgggctaaggtacaattaaatctatccagtgatgaactagtcatggtcggcgatcaactgatcaccgatatgatcgcggctaatagcagtcatatccggactgttttggtgcggccattgatcgagacggatgcgtggaatacacggatcaatcgcttttttgaaaaatttttaatgcgtcgcttacggcggcgccatcctgagttacagtggaaggagcgtttagatggctgaaacagagacagagccattatattgtattggttgtggggcccagattcagacgacagaccccgatgctgctggctatacaccagcgtcagcattagaaaaaggtttagcggctggcgaggtttattgtcagcggtgtttccggttacggcattataacgagatctccgacgtccgcttaactgacgatgatttcttgaagttattgacccagatcggtgatactgacgctttgatcgtcaacgtgatcgatatcttcgatttttccggtagtattattcctggcttacaccgttttgtcggtaaaaatccagtgctattggtcggtaacaaggtcgacgtcttacctaagtcagttaaacgtggtaaggtccgtcattggctgcaagagcaggcgcatgccgttggtttgcggccattagatgtgttattgaccagcgctaaaagtggttacgagctggatgaattgttagcggcgattgataaatatcgtgctggtcgcgatgtttatgtcgttggtgtgaccaacgttgggaaatcaacgttgatcaatcagatcattaagcgtactaccggtactcaagatttgatcacgacttcacgttttccaggcacgaccttagataagatcgagattccattagatgatggccatcagctgatcgacacaccagggatcattcaccgggaacaaatggcttattatttaggcccgaaagatctgcgcttagtcgcaccacaaaagccgatcaaaccgaaaacgttccaattaaatagtgaacaaacactatttttaggtggtttggcccgctttgattatgaacgcggtccgcacactggctttactttgtatttggataataatttattggttcaccgtactaagttaagcaacgccgatgatttttatgaccgccaagctggtaaattattacagccgccgcggcctaatgaattggctgatttcccaccactagcacggatccaatttacgcctaaggtcaaaagcgacttagtattcgctggcttaggctggatcactgtaccagcaggtatcacagttagtggctgggcaccagaaggcgttgccgttacgatgcggcccgctttgatctagaacttaaaattagggaaacgtgctaaaaagggtagattataaacttttagcgttaatttagcctagacgtcgttgtaaaagcagctttttcaacggacgttgcacatttgaaaggatactttatgactttaactgggaaacaaaaaagatttttacgggcgcgggctaatcggcttcgtccggagttccatgttggtaaaaacggcattaatactgcctttttaacgcagatcgatgatagtattgcgcgtcatgagttattgaaaattaatttattacaaaatacagatttaacacctgctgaagtagcagctgaactaaccagccaaattccaggattagaagtgccgcaaattattggtcgtgtagtcttgttgtaccggccagcacttaaagaaaaataccggcggttatcgctacaagtggcagcgttgtaaaataaagaggtgacattgaaacggtgagaacgttaacgcaaccagtgatcacagtagaaatgaaggaagaaattctcgggagtcagcataaaaagcaagttggcattatgggtggtacctttaatccgccacatttaggccatttagtgatggctgaatcagtcggttcccagttaggtctggaaaaagtcttatttatgccggatgcacaaccaccacatcaagcgactaaaaccactattgcagctaaacatcggctggccatggtggaacgcgcgatcgatggcaattcacgttttgaattggaacgtgctgagatcgatcgtggtggtgtcagttacacctatgatacgatggtcacgcttaagcagcagcatcccgatactgatttttattttatcattggcgccgatatggtgaaggacttgcctaattggcaccgtatcgacgatttattgaagttagttcaatttgtcggcgtgaaacggcctgaatttccggcggaaagtcgttatcctgttttgtgggtcgacgcccccttactagatatcagctcatcgttgattcggcagcggatcagccagaattgctccgtgcgttatctggtgccggacgctgttttagattatattgaagaagaaggtctgtaccgtgaaaaagactaaccaagattactcagcgtttgttgcgctgtcacgggatgaattattggcacggctggaggcacaattaagtgccggacgttttgcccatgtgcagcgggtcgaacaaacggcgatcagattagcccagcagtatggtgctgacgttcagcgagcaggattagctggtttagtgcacgattacgccaagcaacgctcagacgccgaatttaagcaaattattcgccagcagcaatttgatcctgaactattgacggcgaataacggtatctggcacggcgttgtcggtgcttacctaatcgagcacgaactcggtattcatgaccagcaagtcctcaatgcggttcgccgtcacacgattggcgccgttgaaatgactgacttagataaaattatttttgtagcggattttattgaaccaggacgtgattttccgaatgtggaacaagcgcgtgcagctgccaatgaaagtttagacgtcggtgtacgttttgagatcattaataccctgaagttcttaattgcaaaacaagttaatatttaccccaagactatcgatacctataacgcttgggtcgctggtcgagcataagataaagggccatgtttcaacttggcgaactaggccatagttgaatagtcactgtcactcattttttgacaaccttaattaggttagtatttaatattaagaatattcgctaactagaacttaccctaccgatgttgattggactaagccataacccggcaagtccaagtcgcaccgcctggaacatccggatttattagcggttgatgctaataaataaccttaatcgtagaatagggccatgtttcaacttggcgaattaagccgtaattgaatggtcactgtcgctcgttttttgaaaaccttaattaggttaatatttaatattaagaatattcgctaactagaacttacctgccgatgtcgattggactaagccataacccggcaagtccaagtcgcaccgtctggaacatctggatttattagcggttgatgctaataaataaccttaatcgtagaataggagcactattttgaacagtaaagaaattttagagatcgctgtccgtgcggcagatagtaaacgcgcagaagatattattgccttagacgtccgtgaggtcagtttattggctgactattttgttgtcatgcaaggtgggtccaaacgccaaatggacgccattttagaagaaattatggaaaaagaagaggacgcgggcatcacggtcaaacgagttgaaggtaagaattccgataaatgggttctgcttgacctcggtgatgtggtcgttaatatcttcaatcctgaagaacgggcttattataatttggaaaaattatgggccaacgctgagaatgttgatttaacggcgtggatcgaagcatgatctatcaaacatttgccactttatatgatgaaatgatggacactgatctttatgatcagtggctttcttttgttgcgcagaatgctggccggccgcagccgcgaaccttagagttagcctgcggtacggggattttagccactaaattggcccaagccggttatgacgttaccggttttgatttatcaatggatatgttaacggtggcgcaacaaaatgcaactgaggcggatgtctcaatggctctggtacaaggcgatatgcgtgaactcgatggcttggacgattacgaattggtgacttgcttagatgattcattgtgctatatgcctaatttggcagatgtcacaactgtttttcagcaagtcgcgcaacatttagttagcggcggccgctttttatttgatatgcattcactgtaccaaatggatgaactattcccgggctatatgtacaattacaaaaatgaaacgactgcgtttatgtgggccagttatttaggcgaacagccgcattcgattgaacatgatctaacattctttgtttgggatgagtcgattcaaggctatcaggcattaagcgaattacatcgtgagcggacttatccattggctgatatcaagcaggcactgcaggatagcggctttaaaaacgtacaggtcagtgctgattttggtaaaagtgcggttgcggccgacagcgttcgctggttctttaccgcggaaaaagcttaggcaattaaggtgttgcaacgattaagtgggaggtaaggtaaatgcgcgcggttggattagtggttgaatataatccgttgcacaatggacatttataccatttacaggctgcacggcagctttcaggcgctgaagtcgtcgtcgcggtgatgagtggtaattttttgcagcgcggtgaaccggcgatcctcgataaatggacgcgggcacaggcggcattagcccatggtgtcgatttgatcgtcgaattgccgtttgctaatgcggtcgccccggcggatcgttttgccagtggtgccctaaatttactagcgaccttgcagtgtgatagtctggtttttggtactgaaaatacaacgatcgattatcaaagtgttggccgtcaattggcgatattacctgatctgcatgagtattttcgcgattatcagcaaacctacgccacccaactaaatcacttttaccaagaaactctgcacttaaatattgatgcacccaatcaactattagggctaagctacgcaacagctaatgcacgattaaagcgaccactgcggttattaccgctggcgcgtaagaatgctcagtatcaggatcaagaactgaatggctcaacgattgccagtgccactgcgatccggcgcttagctttggggcaaaccacggcggagcaaagtttggctaccgtagtaccggcggatattcttcaggcactgcagcagcaaaaattgttgacgtgggcagatttttttccgtatctccgttatcgtattttaagtacgccacttgctgagctgggccagatctaccaaatgactgaaggcttagagcatcgttttcacagtgtgatcaagcaagttaatgattttcccagcttattgcgggcattgaagacgaaacgctatacgtatacgcggctgcagcgtttatgcttgtatgttttattaaatattcgtgaaccagctattcggcaagttgagcagcaaccgtacgttcatttactcggttttagccagcgcgggcaggcttatttgcatcagatcaaggaacaattagatttgccactaatcgcccgggtcagtcaaaaaattgggcacgagcagggcttattaggcttggaagtacgagtggacgatatttatgcccaattaaatgggcacgagcagaattttaatcgcccgccattacgggtaaaataaaaggccgcgacaaaagtaagcttgtcgtgaccttattttgtttgctggcatttatttgcgccaaaaactcgtggtgttagctttatcctgtaagttaaagcggatgatctgttccaaaagggtgtagttgactgggctcgtccacggcagctggatcagttgcttggtgtgctggtagccggcagctttgattgccgcagaaaattggttgataccggcggcttcaggggcaacggctagatgctttttagaattactgaagccgataataaacgtgtcatggtcggtgaaaattggctgattccaagcgatccgcggagccaattgagggaaagtcgtgctgacccaagtgaggacttcttgtgtgcgttcacgttgttccggcgcggttttagccagatgatcggtgaaaatttcggttgtcatggtttagctcctctactccataatagtggataatatttgtaaccagaatctcagctgctacaggcgatggaacttggccttaccggcgttttgttgagtaagttcaatatcgcatgcttgctagaaatcaagtaccactgcaagaaacaggcgttattccgcttggttttgaggccaccgtgtacttggacgtgacggcagtaaggtgaggataaagaaccaaattgttccaatgattggaatcagttcgatcaagatccagccagcactacggtcggtatcatgtaaccgccgtgcttttaaagtgaaagttgcgatccagactagtagcaggatcacgttgccagcagtgttagcgcctaaatcagtccaggtgtaaatttccgaccacggatggccaagaattacttgtaaaagtgccgttaaaataatacctagaaaataatttatgatgactggccaccaatattgccggcgtgttgctgttttgttccaagtcagaatattttgccagaattcacgataactagtgaacatgatgatcaactcctttatttagttactataattattatataaaaacagccatgctagacgccagttttctgattgcaaactttttcagaaaaaattaacaaatcgctagtaagttggccgggtatcgactataatcaattctgcgcctaattgcagtgttttgtgattttaaaggtgagcataagttcgttaaagcgcgtcgtaccggcgctgacttctgtaaagtaaattaggttgacaaagattttcgggaaagttataattattctcgttgcattaggaggaaacttcaatgaaatggtctttacttgaattagaaaagtatcggcaagagcctttaccacttgcagacacgcttgatttaaaggcaactttgatcgaacgtgatccgcagattatcgacgtgagtccgattcaggtttctggtttgatctcattggatcaggaaacgatcacgacctacgtcaaggtgaagggaacattaacattgccatcgacacgttcgcttaagccagttgcgttaccattagattttgactttacggaattttatgtaccagctgatcagcgcaagcgagcagagcttgatcaagaggacaccgtgatcgttttagagaacgcgaccttagatctcgatcaggcaattgttgataatatcttgctgaatatcccaatgcaggtgttgactcctcatgaacgtgaggatgaagcggatatgcctaaaggtaatgattggcaggttatctctgaagatgcctacgatcagttactggaagcgcgtaaacaacaagttgatccacgttttgctcaactaaaaggtttattcgacgaatcaaccgataagtaatgtaaaacgaaaatattttaaggaggtggaatttaatggctgtaccagcaagaagaacctcaaagacgaagaaacgtatgcgtcggggacacattaaattagcaacgcctaacttaagcccatgcccaaactgtggtgaattacgcgtatctcatcacgtttgcccaagctgtggcttctacgatggcaaacaagttgtcaatacaggtaacactgcaaactaagacagacctgtttaaaaagcattagcggccatggcgctaatgctttttgcttactcaaaattatttatagcggataattcaagagcagtttgccttttatttagtaagtttttttgataggatagaagttgttaaatagatacaagggggcacaaagaaatatggaaaagcaaacaccacaaattggtgtcgttggtatggcggtcatgggcaaaaacttggctttgaacattgaaagccgtggttacaccgtcgccatctacaaccggacaagttctaaaaccgaaacggtggctaaggaacacgccgataaaaaattagtgccaagttacagcattcaagatttcgtggcttcattagaaaagccacggcggatcattttgatggtcaaagcaggtgctgggactgacgcagtcattcaagaattattgccattattggataaaggtgatgtcttgatcgacggcgggaataccttcttcaaagatacaatgcggcgcaatgctgaattagataaatctggcatcaacttcattggtatgggcgtttctggtggcgaacttggtgcgctacaaggcccttcaatgatgcctggtggtcaaaaagaagcttatgatctcgttgcaccaatcttcgaacaaatggctgctaaagctactgatggtgcaccttgtgtcacttacattgggccaaacggtgccggccattacgtgaagatgatccataatggtatcgaatacggcgatgaagaattgattgctgaaagttaccacgtcttgcatgaattggttggtctgtctgttgatgaaattgcagccatttttgatgactggaataaaggcgaacttgacagttacttgatcgacattacagcggatattttgacgcgtaaagacgatctaggtactggtaagccgatcgttgatgtcatcttagatcggacagctaacaaaggcaccggtaaatggagttctgctaatgcccttgaattagaaattccgcaatccttgatcacagaatccgtttatgcacgttatatttctatgatgaaagacgaacgggtcaaggctagcaaagtattacctaagccagttggtaaggttgactttgataaaactgaagtggttgaaatgattcgtaaggcattatacttcagcaagatcatgagttacgcacaaggtttcgaacaaatgcggatcgcttctgatcattatgattggaatttagactacgctaatattgcgcggatctggcgtgcgggttgtatcattcgggcgcaattcttgcagaacatcactgatgcttacgaaaatgatccccaattgcaaaacttgatgttagatgattatttcttgaacatcactaagcaatatcaagaatcagtacgtgatttagttggtttagcggttaaagccggcgttcctgtccctggttttgctgctgcaatctcttacttcgattcttatcgttccgaacgcttgcctgctaatatcatccaagctgagcgtgactacttcggtgcccacacttacgaacggactgaccgtgaaggtagtttccattacccatggtacgaagaacaataattggtttttacgaacacaaagtcgatttggctttgtgtttttttattaatgagaatttgctaaatgcgcgggatgaaagcattagtagctttttttacaaaagaatggtaaaatacttagctgtatgagtattgttattaggcgattttaagtgtaaatataattaaatgcgaattaactaaatgttctttgaggagttgtcaaactgaatgagtaaagttctaattattgaagatgaaaaaaatctagcccgcttcgttgaacttgaattgaaacacgagggctacgaaacaacagtccactataatggtcggactggtttagatactgctttaagtagtgactgggatgctattttacttgatttaatgttgcctgaattaaatgggttggaagtctgccgtcgtgtacgccaagtcaaaaacacaccgatcatcatgatgaccgcccgtgattcagtgattgatcgtgtttctgggcttgatcatggggctgatgattacatcgttaaaccatttgcaattgaagaattactggcacgtttacgggctttattacgccgcatcgatatcgaaggcgaacagaataacgcaaagcaaactactgtttcttaccgtgacttaacgattgaaaaagaaaatcgcgtggttaagcggggtaacgaaacgattgatttgactaagcgggaatatgaattacttttgactttgatggaaaatgtcaacgtggtcttaggccgtgacgttttacttaacaaagtttggggctacgaaagcgaagttgaaaccaacgttgtcgatgtttatattcgttatttgcgtaacaagatcgaccgtaaaggtgaagaaagttacattcagacggttcgtggcactgggtatgtgatgcgctcgtgatgacaaaccaagaaagtgatccgaatcaagtaaagcgggctcgacgcttctccttaaagttgaagtgggcgttgggtgccgcttttggtatattcattgtctttgcggtgtttgcgattctattatttagtcgctttactgcgatcatgatgaatcaagaggaaactaatctaaaagatacgatgactttggtggttgaacggctgaataatcagtctaatacgctgacacgcaaaacggttttaccgtatttacggcctgatctagccacaacctcggatccggtaccgaaccgcgatgctaacgctaaagataatatctatacagattcgatcatcgttaaattagcgcgtgaagacgttaccgttagtatttataacccgcaaggcaaggaagtttatgcttcccggaatatcaatactaagttcaaacggacagcggcaatcaaaatctcacgggaaaaggtcggcacgcaggatgggtttattgggcggcggccgattcattcacggactagtggtcgggtgatcggctatgtccaggtaactagccaacttggtactttgcgcaaagatcaacatcagttattagtcgctttttacattttaggggcgtttgcctttttcgttagtggattgatcggctatttattggcggtttatttcttgaagccactgaaggcgatgacagaaacgattgatattatcaatcgcgaaccacaatcggttgaacggatcgcgaaaacgcagcgtaacgatgaactagctgatttaactgatctattcaatgatatgctggatcgtatgcagcgctacattgagcagcaagaagaattcgttgaagatgtttctcacgaattgcggacaccggtggcgatcattgaaggtcatatgcaaatgcttaatcgctgggggaaagatgacccagaaattttgagtgagtcgatcagcgcctcgttgcaggaaattacacggatgaagagtttagtgcaggaaatgctggatctatcgcgggcagaacaggttgatgttcattatcctaacgcattgacggacgctaaagaagtcgccaatcaggtttttggtaattttaaactgatccatccggagtttacttttacgctggatgatgatttaaagactcccaccgtgattaaaatttatcgggatcattttgaacagatcttaattattttgatggataacgcggtgaaatactcgcaaaagcgtcaggaagtacatttatcgatctcgcgcaatgaacgtaatgttgaaattgcggtgcaggactttggtgaggggatcgcaccggaaaatatcgatcgtgtctttaatcgcttttaccgcgtggacaaagctcgtagtcgcgacaagggcggcaacgggttaggcctatcgattgctcaacatttagttgaaagctatcacggtgacattcgtgtcgaaagtgtgcttggcagtgggacgatttttcgagtaacgttcccaattgttagaacattggcgccaggtgagtcattgctcgatctagaaaataaaactggtgcgaccactacgccaactgagtaaattaaaaagcattgtcaattgagtttagcgctcaactggcaatgcttttattttattatttatgatgttgttgcttgccggcattccgattgcgtttaggtttgctttcagttgcctgaataggtttcggtttcggcgtgatcacggtcttagctactggcttaggcggatttttcttaagatctgccgccacctcagctttgatccgtggcatatagtagaagttggtgatcagggtttggaaaatcgccaagatcccaccggcaaagaagtagaggcctaagccagctggggaaactaatgcgatgaagaaggtcatcacgggactcatcatcatcattgtttgcatctgcttcttctggctagccggtaagccaactaaggagagataaccctgcaagacgtaggttaatccagctagaatggcaatgatcaggttggtatgtcccaaactaattcctaagaacgtacttttgaaaatggctggactgtattggatcgccatatacaaggccgagaatacaggcaactggataagtaatggtaaacagccaataccaccagtcatgctgacgccattttctttcatagttgtcatcatttcttgacttaaagcagctttttcttcgggcgttgttgccgccgcttgccgtttttgaatattgtctaattgcggcttaatggcttcgcgccggtgttgctgccttaacgtactctttgattggctgagcatcagtggtaacaagactaaacgcacgatcaaggtgatcaataagatcgcccaaccgtagttaggtggattaccaaataatttagcaatccaagtgatcaagtgttgcattggtaagcctaaccaatgatagattggcccataaagaaagccagttggtggtgttcgatgggtttgtgtgttcgtacaagcagacaataatagcgctaataccgtgaaaagtccaccgtaactgagcagacgtttaattcgcttcatgttcgtggtttagttcctttctacttcacaattaaggttgatttattagcaaagagcgctaataaatactgatgttacgagcgctgaccattcaactaaggtgcagcccgccaaggtgaaacatggctaatgttacctttgtggtacacaaaagccttgatattaagatttctgactttattcgtgacgaaaccaaataaagcctcttactactatacttgaagcgacggtatttttcaatcagtctttagactggtgtagcaaatgatttgagcgttatcactagattatttaattcgtcaccgcaaaatcgcggtaaactttgtcgtcacttagttcaactaagtcaacgcgggtcactttggcgtatggtgaggggccttttttgacggcttgaatgaaatcactcacttcgcggtcagtgccacgagcttcgatgtagactgtgccatctaataaattacgtactaaaccagtaaccccaactttatcggcgaccattttggtggcgtaacgaaagccgacgccttgtacgcgaccaaagaccgttaaacttactcgacgcatattgattcctcctagctcaaaatgatagttttttttgtgttttattttaacgttgattttgttatggttaaatactgacgcatacttattatatgaaattttggcggctagtaccagtctatcgcagtgtcgctacgttaagcgtgctatacttaattaaaatagaattagatgtaaaaggagatctagcatgaccttaatcaccagttcaaaaaatgatttgatcaaaacattacgtaagttgacccgtaagaaaaatcgcgaagagcagcaacgctatttattggagggcgttcatttagtgcgggaagcattgagtgctcagcagccgatcactatgattttagccacagaggattttcaagcagcagcgtggctacctaatgatgtcccgacctattggctaaaaccagaggtggcccacacgctgagcgcaactgtgaccactcagggtatctttgcggtactgccattgcctgaggttaaattaccccagactttcactggtagttggctattattagatggtgtacaagatcctggcaatatcgggacgatggtacgaactgctgatgctgccggtttaacgggtgttgtgttaggcgaaggtagcgctgatctttttagtgccaaagtgttacgttcaatgcagggtagccacttccatattccaatttatcaaggcgatttagcggattgggtcacggaattaaaggcagcacaagtgccagtttatggcagtgaactcaatccagcggccgtcgattttcatcaaattcccgcacagcctaattttgctttgatcatgggcaatgagggcaacgggatgcaagctgagttattagcgcaaaccgatcagaatttgtatatcccgatccaaggtcgtgctgaatcgctaaacgtggcgattgctgccggtatattactgtttcaactcaaaaattaagaataggttacgttgtaggtaaatttctagccaatacggaataaatgggttatgctagcggtgttagaagttgagatcacattttaatgtttagtcagtctgtcgttacgctaagtcttaacttagctgattttatataagaaaggcagccattgcatgaccaaaaaacttaactggcaagatgatcaagcctacgttgatgaaattgcggatttattagcaactgacgcggttcagcgtttagccgattatacgcagcaccatttttccaatcgcttggagcattcgttgaatgtttcttatcgtagctatttgattgcaaaaaaaatgcatttagatacgcgagcgactgcacgtggtgggctactgcatgatctattttattatgattggcggacgactaagttcgatatgggcacgcacgcctatgttcatccgcggattgcattacgtaatgctgaaaaattaaccgaattatctaaaaaagaaaaagacattattattaagcacatgtggggagcaactattgcgccaccacgctacatggaaagcatgatcgtgtcgttggtcgatgattattgcgccattgatgaatatgctttaccagaattgcaaaaatctagccatggtttaaagcaacgaatcatgaaattaaccgcaaaaattggcgaataaaaaagttatggcataattgtcataacttttttattttggttattattaaagtggtcgattgcccaaatcagttcggatcgtaagtacatcggttttagcattacgggtgacgtagtcggtaacggatccagtcaaagtccgcgtcagtgcatttttaccagttgcggctaaaataatcaaatcaacttggtgatcacattgaaactcgtaagcgatgattttgcgcggattgccaaaacgaatgtgaatgtcacagtcggtgacaccaagttgtttagcctcttgctgtaaaactttaagataattttctgtttgagcgaaaattttttgggtaaagtcatcgtcatctggtattggccggaaatcataatttttattccaaatatccaacacgtttagcagtagtaggtgcccgtggttaagtttagcgattcgcagtgcctttgcaaaagcctgttgtgcttgtgcagagccatcgacggcaactaaaatatcatgataattttgtaacattcacatatccctcctagcaagcaatagaatataaaatgagtttataaagcagcctgacttattagatagtcgctgattttgttttaagtataacatttttcagaaaagtagcgaaaattttgtcatgacttgttctttcactttacttacatcaagtaagtgtgctaaactatctgcgaggtgagaactatgacagaaaaagcggtaactgactgtcagaccaagcaatttcaattatgtccaaaatttcaaaagacgttcacaattttaggcaaaaaatggaatggtttgatcgttgatgtcttgttagaagagggaacgcaacgctttaaggacttggcacaaaaggtaccaaagtgttccgatcgtgtcctagttgagcgcttgaaagaattagaactggaaggcattgttgagcggcgaacttatgctgattcagctttgatcgaatatgctttgaccgaacaaggtcaagatcttaaacaagtgatggatgccgttcatggctgggcggatacttggttggacgcagaagaatgcgttaaggaattagcctaaactattgacgaaaaagtcgggtatgttagaatataccaagaaagacgttgatggaaaatagtaaacgttccggctcaggacagaaaatcgtttaaatgttggaaaaacgatcacggctaaacgttgaattcacttccggagtcgactttgggcgtaaatacaaaaaaagttccggcacagaccgttaccctgactgagtgtataagtgatttcgattgcttatgaactagggtggtaacgcgatgcctcgtcccttgaatttagggatggggctttttttataccccaatatataaattatccactatttgtggagtagaggagtttaatttatgagtagtttacaagataagttagttgccttgcaaaagcagggtatcaaagaaatcgaaaaaagtgacgacttaaagcaattaaatgatattcgggttaatttgcttggtaaaaaaggaccaatcaccgaagttttacgcggtatgcgtgatttagctaaggaagaacgtcctgctgttggtagttttgctaataaagtgcgcgatgcgttgactgaatcgattgaaacacgcaaacaagcattagaaacagccaagattgaacatcaattagctcaagaaaaattggatgttactttaccaggtaccccagttaaacaaggcacgcaccatgtgatcatgcaaacggtggaaactttggaatcagttttcttagggatgggctttaaagtcgtcttaggttatgaagtcgaagaagaaaaatataattttgaaaagctgaatatgccgaaagatcatcccgctcgcgatatgcaagatacattctacatcaataaagatattttaatgcggacgcatatgtcaccagatgaagcgcggacgttggaacaacatgacttcagtacaggcccaatgaaaatgatcggccctgggcgcgtttaccgccgcgacactgatgatgctacccattcacatcaattcttccaaatggaaggccaatatattggcgaacatgtgacaatggctgatttgaagggtactttgtcctttgccattcgccaattctttggtgccgaacgaaaaattcgtttccgaccaagttatttcccattcacggaaccatcagtagaagttgatatttcctgcttcaaatgtaacggcgtgggctgtgatgtctgcaaacattctggttggatcgaagtattaggtgcgggtatgactcatccgaacgtattgaaggcagcgggcgttgatccagttaagtacggcggttttgcttttggtctggggatcgatcgttttgcaatgttgaaatacggcatcgacgatattcggcaattctatcaaaatgatattcgcttcctcagtcaatttactgaagcataacggctattaaaaatagtacacgagttattagaaaccatccttaattgtgaagtagaaaggaatttgctcctcatgaaaatttcatataattggttaaaagaatatgttgatctaaatatgtcggcggaagagctggctaataaagtcaccttaactgggatcgaagttgatggtgtgattcatcctgatgctggtttgaaaaaaattgtggttggttatgttgaatcaactaagccacatccagattctgatcatttacagttgtgtcaagtccagatcagtccagaagaaacggtacagatcgtttgtggtgcgcctaacgtggctgctggtcaaaaagtgatcgttgccttacctggttcacgaatcgccaacaatgaaaaaattaaaaaaggtaaattacgtggtgaaatttctaacggtatgatctgtgccttacaggaaattggtttcagcgatgatgtgacaccacaggcgtacgcggatggtatctacgttttacccgctgatgctgaagttggtcagccagtttatgcttacttgggtatggacgacgctattttagacttggagatcacgcctaatcgggctgatgctttaagcatgcgcggggttgcctatgaagttgcggctatttatgatgaaccagtccattttcctgcggttgacttaaaggaaagtgaaaagcaagctagttcagttttacaagcgaaggttgctgatccaactgatgcacctagttacaatctacgggtgatcgaaaatgtgacgatcaaacctagcccattgtggttacaacgacgattatggaatgctggtattcggccaatcaataacgtagttgatattaccaatttgatcatgatcgattatgggcagccactacacgcttttgattacgccaaaattggtgggcaaacgatcgaagtgcggcgggcgcaagctgacgaatcattgataacactagatggtaatgaccatgatttgaccacggatgacatcgtgatcaccaatggcgctgatgtattgaacttagctggggtcatgggtggcttagagtctgagattaccactgaaactaaaaccgtgatcttagaagccgctgtttttgaaccaacgcacatccgtaaaacggcgcagcgttttaatttacgtagtgaagcttcttcgcgttttgaaaaaggtgtcaacactggggctgtgttagcagcgctagatgaagctgcaaacttgatggctgaattagctgatgcgactgttttagccggccgcgtatcgccgacggttttagaaccaaaggagacagtggttaatgtatcgacccagcgaatcaatcaagtgttaggaacaacaatcagcactgctgaagtgcaagcaatttttgtacgtctcggttttggggtcactgaagctgacggtaaatttacggttagtgttccagctcggcgttgggatattgctatcgaagcagatttgatcgaggaagttgcccgtctttatggctatgatcgcttgccagaaactttgacggctagtgcgtcaactcctggtttattaacgccacggcagcaattgatccgccggttggaaagtaaattggaagctaatgggttaagtcaggccttaagttatgcgttaaccaccgccgataaagcggctgcgttccggttgactaatagtgaaccgactagtgtggattggccgatgacggttgaccacgcgacattgcgaatgaacttggtcagtggtttgttggacgatttagcttataatgctgcacgcaaacaacaaaatgtcgcgttatacgaacaaggtcgtgtgttcttgaagcaacatgctaccactgtacgcccacacgagttggagtatttggctggagcgatcaccggtgattggcaaacggcagcgtggaatcaaaccgcgcaaccaattgatttttatcaattaaaagggatcgttgaagctgaattagcagaatttaatttaaatgaagcgccagaatttgtggccacggcacgccattcagatatgcatccaggacggacggctgatattttggttggcagtcaaatcgttggtttcttaggtcaaattcatccacgagtggctaaacaatatcgtttaccggccacgtacgtcttccaattagatttagaacaattactaggtttagatagccaagccgttgtttaccagccagttccacgttatccagcaattacccgtgatgttgcgctagttgttaatgaaacgacgactaatgcagcactagaagcgacaatccaagcacatggtggggcttatttgactaaggttcagctatttgatgtttacgctggacatcatattgaagccggcaagaagtcattggcctacacattgacttatcagaatccggctgatacactgaccgatgatcaagttaatgatgcttttgccaaagtcgtcagtgccttgcaagacgaacatgatgcaacaattcgttaagtggatgcttagcagtaattgctaatgtggtgggagtttccagcacacgctaaatttagcgattttattaatttcacgatggacaggtgcatttaactagatttttttgtataatgtttaaggcattgtacaaaaatgtcgggcaagtttgtttgcgcggaaagcacagccagcaacttatcaggcttgtattagtaaataagggaggttttgctttggctaaacgtagcgggaatcagcctgaccatcaaagcaaagataaacagcaactcgaatctgacgctgaacaattagcggaggaacgcgtggctgaaaaaaaagttgtcgataaaatcgtttattggatcgttggcattttggtattattagtggtgattattggtttattgggctttaattacgtccattcatcactacagccttacgataaagataataataaaacggtagttgttaaaattccaatcggtgcgactaataagcagattggtgcaattctggccaatgaaaaagtgatcaaaagtgccatggtctttaactattatgttaaatcgcacaatttttccgaatttcaaaccggtttttataatttgaaaccgtcaatgtcgttagccgaggttactaagaagttggctgacggcgggagccaaaccagtcagtatcgtgtcctgatcaaagaaggggcgacggtggagcaagttggtaccgcagtggctaaagccacacatttttctaagcaggattttcttaagttaatgaaagatcaaacttacatgaagcaattggcaaagaaatatccgaagttgttaagctcatcaatggcgcaaaaggacgttcggtaccacttagaaggttacttatatcccgcaacctatgattattatcaagggatgagcttaaaggaattagtgaatgcgatggtcgagaagactgatttggtcatgcagtcgtactataagcagatcaacgccaaagatctcaccgtgcaaaaagttttgacactggcttcattggttgaacgtgaaggtaataactcaactgatcgggctaagatcgccggagtcttcttcaaccggatcgatgctgggatgccattgcaatcagatatttctgtgatgtacgctttaaatacgcataagaaacatttgtataacaatgatctagcggttaaatcgccgtataacttgtataagaataaaggttatggccctggaccgtttaataatccaagtaaggattcgattcaagcagtcttgaacccgacggatcgggcccaagattatctctactttgttgcggatctgaagacgggtaaagtttactactcacaaacatttgaagagcatacttctaccaatagtgggattcagactaaaaacggcgataataattaggcttaaaacagtcaggaatattcttggctgttttttgcaacgtagttagagcaaattttaagattaatcttttttggaggatgaataatgacggaagcacaaccagctaagccgatcgttattggggttaccggcggaactgcctcgggcaaaaccactgtttctcatgcgatctttgatcattttgcggataattcggttttattattagaacaggatgcttattataatgatcagtcggaaatgactatggcacagcgtaaggcggtcaactatgaccatccgttggcttttgatacaccacgtttgatcagtgatctaaagaaattattgcagtatcaatcgattgaaaagccagtttatgactataaattatttaatcgtagcagcgaaactattctacaagaacctaaagacgtgatcattcttgaaggagttttgattttagatgatccgcggttgcgtgatttaatggatattaaggtcttcgtggatactgacgatgatgtacgggttatccgccggatcgaacgagatatcaaagagcgcggtcgtactttagaaagtgtgatcacacagtatttgacgacggtcaaaccaatgtatcatcagtttgtggagccaactaagcggtatgccgatctgatcgtacctgaaggcggcgaaaaccaagtggcgatcgatctgttagtgacaaaagtacgttcaatcttgatgcagcgcggtaaataatttcctgttaggttatttacaagttgaaagtagcgtggtacgcttgttggcgtaaaaaaatttgtctgtgggaagtgcaccagacaaatattcaggaccgttgcgttaccggtacctgataattaggaggaataaagcatggcagaacaagaatttcaaatgactgcagaaggtaaagcaaaacttgaagcagaattagaagacctaaaagttaataaacggcctgaaatcgttgagcgtatcaaaattgcccgcggttttggtgacttatcagaaaattctgagtatgaatcagctaaggatgaacaaagtttacttgaaggccaaattgcgtcgatcgaaaatcaattacattatgcagttgtggttgacagtaatgcaatcgctgatgatgaagtcgctgttggtaagacggtttcgttcgtcgaagttggcgatgatgaagaagaaagctatacgatcgttggtgcagccgaatcagatccatttgctggcaaaatcagtaacgattccccaattgccaaagcgttgatcggcaaacataccggtgatcaagtgacgatctcaacaccaggtggcgacatgcaggttaagatcactaaagtgactaagtagtagatgtttgaatagggcgcgatgcggtggtatcaactatcacacatcgcgtttttttgtttgcttattttgagaaaagctgaaattcagtctaaagactgattggatttgcgactaaagcgaagcgctaaaataatcatttccgtgtatactaagtttattccaacagatcgacataaatgacaataaaaataaaaaattctggtgccaaggtggcgggctttttagtaccgttgttctagtaggtagtatgcgcccggataagcagagaaaaataatccaccatatgtggcgtagggccatgtttcttgcgacagaattttgccacaagaatggtcaccgtccggaacatcagaaattttttgaaacaaaaaataatccactatatgtggcgtaggagggtgcaatttgcgacgacttggaccttggcgtattttcttgatcgttgaagctattttattgatcactttgggctggcaacttttctcccatgtgccatcgctggtttttttagttctcggcggtttaagcttgcatattgcgattaaaagcaagcagcggcgctttttaactagtttttttgggttgttcggtattttatcgattgcaatcacgttgttgactaacccaacgatctggctgatggtgatcgttgcaatcttttttgccctgacgcaaggttatgattggcacgcgcaggaaaaacatttacgctggttaccgtggcataaaaaagcattccatgccgtcaagacttgcgaacctgaaatgcatgccggtgatgtggctcaaactagttggttcggtaatcaaacgatcggtaatgatgtttttgaatggaatgatattaatcttgtgttagcggctggtgatacgatcgttgatctagggaatactttgttaccgaaagctgataatacaatcgtaattcgtaagggtatcgggcgcacgcgtatcttagtgccgatcggtacggcggtgatgttagatcacaccgccttggttggtagtgtgacgtttaataataaacaatataaaatgggtaatactgcactgaaactttatagcaaagattatgacgaaaatccacggcggatcaaactgctgaccaatgtattaattggtgatttagaggtgatctttgtatgagtaggtggtcacagagctttttatttgcgataacaagtttgttatcgtttattttgctgaatgcactatttttctcttatttctatgctgttgatcaatcggattggttgatcacattatttacggcgcaattaatgtacatccccctgtacgtttatttgatcgtaggttcgttgctggtcggtgcagcgatcacgatgatcttttatttgctgatgcaccaacaattacggcgaatcgaatccaagttggctttattgggtaacggacagtatgaggcggatgtttttcaaacggtcgtcccaacggcaaatgcgtttgatttggatgctagtgttgaacgactacggcaaaaaatgatcagtttacaacaagaaattcaaacctatagtgatcggccacagttagtggatggtgttaataaggaagaaatcttgactcaagagcggcatcgtttagcgcgtgaattacatgattcagtcagtcagcagttatttgcagccatgatgatgctttcagcattaaacgaaattgcgggtaaaccagaaaaagcggctcagttgaataaacaacttaaattagttgaaaaaattatcaacgaagctcaatctgaaatgcgggcattattgttacatttgcggccgatcagcttggaaggcaagtcgttgcgccaaggtatcgtgcaactgcttaaggaattaaaaacgaagatccaattgaacatgcaatgggatattagtgacgtccagctttccagtggcgtggaagataatttgtttcggatcgttcaagaattgctatcgaacacattacgtcattcccaagccaagtcacttgaagtatacttaaagcaagttgaacagatggtggtcttaaaggtagtcgatgatggcattggttttgatatgcaaaaaagtaataacgccggcagttacggtttaaataatattcgcgaacggactgctagtattggtggcaccgcgaagatcatcagttttcctgatcaaggtactagtgtagaaattcgtgttccgttaattcgtgccgaagaaataacggctccccaagtgtaaatgtattgcaaaatagcggttgaccttcaatctgaaataggaagtggattttgttgataaaagtattgttggtagatgatcatgaaatggtgcggatcggtgttgccagttatttagctgttcaagatgacattgaagttattggcgaagcagaaaatggcaaagtcggttttgaaaaagcattagaattgcggccagatgtgatcatgatggacttagtcatggatgtgatggatggcattgaatcgactaaaaaaataatggcagcttggccggaagcgcgaattttgatcgtaaccagctttattgatgacgagaaggtttatccggcaatcgaagcaggtgctaaaagctatattcttaaaacgtcaacggctgccgaaattgctgatgccattcgggcaacaaacaaaggcgagtctgtgctggaaccagaagtgacgaccaaaatgatgcatcgtttgacgcagcgaccagagcctaatttatatgaagatctgacgaaacgggaaaccgaagtacttaagttaattgcccaaggcaaaagtaatcaagaaattgctgatgaactatttattaccttgaaaaccgtcaaaacccacgtttcgaacattctttcgaagttacaggtggaggatcgtactcaagctgcaatttatgcattgaaacataaaatagctgaataaagtaattaaaatgaccgccaagtgcactaggccctgtcaagttgacaaatgaaataatataaagttgaatctgtttctaagcggcttcactccagtattcatctggggtgaggccgtttctttgtgctgagcgattgtggtgattgaaatattcgattccttcctcaaccagtctcacaagctcttcgcaagtctttgctagtggatggcga

SEQ ID NO: 601 - DNA, 1835 bp, Unknown
  Metagenome-assembled genome
tcgttcggaataggttatactagacaaaagatcagctcctaaaagatgggtttgtggtaaacaccattttaaaggaagctgatcttttttgtccgaacagcgttcggattaattttacaatctaccgaatactatctagtggctggtgaaagcagcataactgcaagctttattggcatcaaagaatagtaaagattataattagtgcaaagtaaacatgggctaacgcctgttttccttgcactttttatttttcctggaggaaaccatcatggcttatcgacatcgtgctacccaattgtcatttcaatcctttaacaacggccttggtgtgccactttcttccgacaatgagtgggttcaattagccgacatgctcccgtggcaacagctcgatgaagcctatcaacttctttttactgagatgggtgggcgcgctgctaaaccctttcgtctgctttacggtgccagtttgatcaagcaagcagaacatctaaccgaccgttcggtcgttaccgctattcgtgataccccggcttaccagtactttatcgggctagacacctacacaaccgacctgccgttcaaccactcaaccttggtttattttagacgacgcatgggtcaaataacggaactagtgcgaaatatcatcagtgataccttgcgcgaacaaatccaaagcttattgccagatgatgagctccgtgtcttgatcacagacgctactgcggtgccaattgaaattcgttttccacaagatacttcgctgctaaatcaagctcggctcaatctagaagaaatgttattagacatggctcatcagttgcaaatcaagcctccacgaacctacaaacgtgaagcaaaagctaagtggaccgcttttgctagaaaaccgcggcgttgggctaaggaaacacgcaagcagatcaaagtacagctccagtatgtccgacgtgatctacgttatatcgatgtgctgttggcccacggtgcctctcttaacgaaaggcaaaccaaacgattggctgtgattcgtgaactttttgaccagcaaatgttcatgtatgaaaatcggacccatcgggtcccaggacggattgttagcttggcacaaccgtggattcgcccgattaaccgtggtaaagccaaacaacgaaccgaatttggtcccaagattgatgcttcaattgccgatggcatgatcgatatcgaacgatttgattttaaggcgttcaatgaaagccaagatttagcaacaaccatcgatcattattttgacgtgcatggttattatcccgatgaaatcttagctgacacactttatcgtacccgcgagaatcgtcagctctgtcaacgactaggcattaggttgtcgggaccacgtttaggacgtaagcctaaaaagatggatgctaagcagcggcaagttgatcgtaacgcagagaagcggcgcgggaaaattgaacgcggttttgccttcatgaaaggccctttgggcctttcattggtgcggactaaaacggtagccagcatcgcagtgacgattgatattgcgatcaatctagccaatctaaagatgctactaaggctttttaatggaccaattttgattttcgtaaaatataagcaggaatccatcttaattcactatcaaattcacgtttcaggtagccggaatgttgcctaattcaccagccactatctaagaacctgtctagtatcttttaagaactatcttcaggaaggccaatacaaccatttgaagactgctgttaagggcacgttcacagtttttccaaagtcgccgacatttgtctagccaactccatgaa

SEQ ID NO: 602 - DNA, 1820 bp, Unknown
  Metagenome-assembled genome
cgttagccaaaaaatccatcaaacttgaggtaactaaagcggccaaagattggctgatggaacaaggctatgatgaagcaatgggtgcgcggccattacggcgagtaattgaacaacaaattcgtgataaggtaacggatttctaccttgaccacttagatgtcaaaaacttgaaggctgatttagtggatggtgagattgtgatatcggcagcttagcttaaatcagtgttcataaataactttatgtaagaggagatttattgggcaggagatcgcttgatagatctccttttttcgttgattttcaccatttgatattaatctattgagtaaatatggatatcgtcaagaatcttgtgtaaatgaaatacctccgtacatataatatgtagttaatttaaataaaggatgattccagggtgtcctgaagtccgttgaatctgcgatggattcgcttcatggacttctcgttatagacgttaaactgagaaaccaggaatcgattcagtgaatcttccgttggaaattgttctttgtggttggggttgcgtttgagatgcttgttaaagttcgcaatcaagttggttgaatacaatgaaccgcttctttttggacggtgtcccgctttaaaggcaggtaattggcatctaagaagatggccgcatattgcgaaggcagtcgccgttgctggaaagcttgaacttgttcatcaacgactttggtcgtgttggaaaccgtggctttggagtaatgagcaccgtacattttctcaatgagttaggcgatctcggtggtggtaattcccttggtgtatagctgaataaccgttgtttccaagatgtcactgtgccgaccgtaggctggcaagatgtggttgtggaaaataccattgcgatcctgcggaatggttaagttgagttgaccatacttcgtatcaaacgagcgttcataactgccattgcggttatttctagtgttaatttcagcatacgagtggcgctcatagcctaaaaaagctgccagttcggtttgaagcagctggttaatcgcaatttcgaggtggtgccgaaaaacttcgtctaaatcttgtttttggactagcgtagcgataatttctgtggtaagttcattccctagttctatacaatttagaaatctttttatgcgtttacacaagttattttacgctctctgttatcgagcttgcaactttgtattatcaaaatagaggagtattaacgaccgtaaaggacttcccgtattcattgcgtgttttgattaatcaagttaaaatataatcaacttctatttatttggtattggcacatatatcagaaagacgtcattcttaattgagtggcgttttttttgtgtatctaataaaatttcgattttataacgtgacaatctcgtgactttattttcagacgtaatataaacgcattctcgtgcattgtttgcttatacgtgtatataggttgtcaaatgcgtgctatgattgtatcaataacttagcatatacttgaaagggtggtagatctgacgagagtataaaatagtttgtgtaaatgaataaaaatcctattgaaaagggaatcccttccccgtatgattaaatcgtcaaaccaaaccaaaacggagggattccccatggatcagtttaccaaaaatctaaccaaaactctattgtcaaatggcgatgttaaagaactttttcgtcaacaactcgaaacggctattaatcacatcttgcaagctgaactaactgccttacttggttatgatccttatgaccgcagtggctttaatactggcaat

SEQ ID NO: 603 - DNA, 3530 bp, Unknown
  Metagenome-assembled genome
atagccttggctgtgcagcgtagcaattctgcctcgttcaaacgaagttaggtgctgacctttttttctgactgtggtattctgttcttgcatcaagacaataacctctttcattgtttgtgtaggaacatcaatgataacagagatttgtcttggtattttttattttatcaattagctaaaagtatttggctaacttgattataaaacgcgcggaattaattttaatggattttccaacaatatttaattaaattcgatttactaatcaaattcattatctctcatggtattattaacattattaaaaagtaaaggaactatttaacaatgaatagtgaagatacagatattaaagcattaattcaagagttagaaacttgcaaacaaaataatgaattcaataaatatatcgacgaaatttattttcccttctataaaaattttaccgaatttagtaaaataagttttgactttccactaactgttctagttggaaaaaatggcagcggaaaaagttctattcttcatgctttatatggctgtcccaaagataaaacgccctcatatttttggttttccacagctactgacccgattaaggaaggtaatggaaaaaataaagttcactgctttgtctactcatatcagagtaatggcaaactaaatcaagtggtcatgaaaagatcaccgcgtccaggcacctctactaaaagaaaagatcccgattattgggaaacggataaaccctatcgtaaatatcgaacgcaagttacaagacgctgtccaccactgaatgaaagtgtaatttatattgactttcgtcaagaactgagtgcctttgaaagattcttctattttgggaatattgacgacttaaaagctccgactaaacaggattttattagacaagcctctcccaaactaaataacgctttaaataacaatcgtatctataaacaaggcacaaaacaacaaagtaagaagtatattcgattagacgaccacgaattacattgcatttcagaaatacttggtgttaaatattcagctggaaagattttagaacatgacttctttagaatttggggtagctcagcgttaatagagaagaataatttatcctatactgaagctcatgctggtagcggtgaatttgcagttattaatttagtgcatcgactaatatcacttaaaaaagatgaatcaaatttaatacttcttgatgagccagaaacatcactttatcctggcgctcaaaaacgcctattaaagttccttctatcagagataaaacgtactaaaagccaaattataatggccactcattcggaaaaattcatctcgcagttaccaaattcagctatcaaatcaattcattatgatgagaacaccgaaaaagcaattataagaaatggttgttctccgagtaccgtcttctctgagttagaaataccgataaaatatcaatgtaatatttttgttgaagatgaagctgcacaaattattatcgaacgtgtcattactcaagaaaaaatgactaacttatcagttcaatactcaccagtgggtgcagataagctgaaatatacatcaattttggaaagctgtcatcataaaagacaagatgatttttatatacttgacggtgatcaaagaacacctaaacctgacttagatatgtttccttcaaaagatacctcagatcctaattttattgatcaattaataaaaagtattggaactagattttcttttccaacatctagaagtcgccacacggtcacaaatgatcagccggatcctatacgactaaaagctcagaaagactttttacgtttttatttaaatcacatgtttttcttgcctaagcaaacgcctgaagatattatttgggatgaagagtttcttacaaaatatatattaaatcctctgcaactaaaaatagacctcaattccaaaacgaaaaaagatatttttcatgagattgctggtgcacgaatgggaactacaactccaaatagagatgaatattatgcccttataaaagaactaacgcagaattgggtaactaattatcccaataatgaggtatattctaaaataaaaaaaattcttgaaaatatcagtaatatgtatgaagataatcacaggtgatatatatgaaaacactaagtgcaattgatttattctcaggttgtggcggcttgtccgaagggctcaaacaagcaagaatcaaagtaaagtatgctgtagaattagatagtaaaattgcagctatctaccaaattaatcatccgaagaccacaatgatcaattcggatattaaaagtattccagatgattcatttttaaacatggggagaatagatatagttgctggttgtccgccatgtcagggatttacgcaaatgaacagaaataacaaacgattagcgtataacgacgcgcgaaatgaactaattttagaatatttaagagttataaagttaatctctcctgaatttattatgatggaaaatgttccagagatcgttcactatgataaatttaacaatatgctagatagcctttacacattaggctatcacttagattataaagttgttaacgtaaagaactttgggataccgcaaagcaggaaaaggcttgtgctgattggatctaaatcttattctgttaaatttccaataaaatccttaaataaaatcgaaacagtaagggactgcataggaaaactccctaatccaagtaacagtagtgacccaattcatagaatacattcgaatcatactccgcgtattcaagaaatcatcgagttgattcctaaaaacggtggcaatcgtaaagatttaccagaaaagtattggttagaatgccacaaaaaaaataatattggatattccgatgtctatggtcgaatgtattgggacaaaccgtctccaacaattactggaggatgcttatccccttcaaaaggacgttttttacatcctgaacaaaatcgcagtatcagtgttcgagaagcatcattattacaaacttttcctatagactataaatttaatgaaaaatattcaaaatctcttttggcacaaatgattggcaatgcgataccacctgcttttgctaaaatacaaggagaatacattaaagatgttataacaggtacaaaaaccgcgtcagattaatttctgcgcggtttttacttataccaaaaaacatcaaacattcactgtaagcggtaaataatcacccgttttaaaaagacaaccaaacttctcgattttgagaaatctggttgtcttttgttaggcggcatttttagcttgatgcttgtccgttgtttttttattttgatgccgagcacctggataatgccatggtaaataaaccgctaactgtgatgacggcattcccatttacccccttcggcataaaattttaccccattaagcgaagaaattgaccaagttctgcaaaagagattgaccagccctaaggtacctcttgtataatgtgatagcgca

SEQ ID NO: 604 - DNA, 20589 bp, Unknown
  Metagenome-assembled genome
tgatggtatctttaaattgggtcatgaagtccgtcctaacttattggtttcgtcgcttataagtttaaggcttcatggcctttttggtctagttgtttcggtgttgcacttacattgtaaatccggcttaaagaaaaatcagtttctaaagccaaattttgtttcgcccactggcttaaaactaaatgcgtttcaacatccgggatctgcgctagtttttgcaatagatcgatcgcataaattgtccctgaagcacccgtaacaccaataataatacgccgcatgttaaagcctccgttttttatttttatcgtttcgttagtctaattgcgtttaaaaaaagttgcctattatttactgtttattgtctgccataactgaatttgcgcaaacatgttaaaaaagcatgattgcgcttcttcaacactctctagtttaccagcgtcaataattgcgaacaaatcgggttaggcttattattattcctaaatggactattagcacatatcttcaacgctgcccaaaacagttcgcgtttagacaagttagttgtccttatgacctacgcctactaaatcaagaacaaacaatcgtgaaattttatttgtagaacagggggaacaaggtgatgaatctcgcagacctacaagctttcatccagatttaccaaacgaaaaatatttcccgcgccgctgagcaactaaatatgactcaatcagcgttatccaagcgtttgcacaccattcaaaatatcgttggggtcactttggtcagcacacaaaatcggcgtcagcttgagatcacggaggcaggcgaatccttttatcgctatgctaagctgatcacgacacagtacagcctgatgcaaactgaattgcaggaatatcaaaaacttaagcgaggtagtttactgatcggcacagtccctattctctcgcaatacgggctaatgcaggcattaacgaaattcatggctgattatccccagatcaatttacgcttacaagaattagagggtgatcagttggttgaaaaattacagacgaacagctttgatatcgccattgttcgcgacctgcaaacggaacacttaaataagtcctaccaaagtgaaaatctttatcgcgaccagttgatggttatttcaccggtcactcatcccttagcgcaaaaaaaaaagaaatcagcatgactgaattagctgatttcgagtttactttattaccgcctggttctggtgtttatgagcaagtgatcagtttgtgcgagcacgctggtttcacacccaatgtgcgctttgaaagcactcatattgaaacgatcctaagtgtcgttgaaaattcgcaacaagtcacgctactatttcaacgttcagctgcacctttcatgacgactaagctaaatttgcggccgttaacgacacctatttttagcgaactacaattgatctcaccacgccagccgcaaaatgcggccatcaatcagttcctacgctacctacgcgcggcaatccaatgatgttagtcgtgagcatattgttgaataattcggttgagccagtttgccgcttccggtgaatgagcgccctcattatagtattttgcaaaccgtggatcattgatatacatttcgcccaatccccgatgagctgcagcagaataagtggaccaagagtagctgagccattttttatggcgcgtaaaaacacgccttgctgctggactattaagctgctgactagcgatcacttcagccaacgttaccattagttccgcatcaatgcgttccatcgcgcccatttcagcggcggttaagttcaaatatcgctgattactttgcgcgaccgcttcttcaccatacttagctctaatttctttaccatagttattttcatttgttgcgacctgttcggctttaaacgccgcaaatttttcttgatcagtcattttggtgactcctttctctgtgtccaatacctgatccagcgtctgcagtaaacgtgctaaacgcgcctgctcatgcataattttggtacgctgttgccgcagggcttgcatgcgcatcgctgctggctgctgaatgatctgctggatctggtctaatttcagttcaaacaaacggagaaaacagatctcctgcagacgatcaacctcggtttcaccatataaccggtagcctaaccggtagccgtttgtatcacgcggtgctttaagcaagccaatttgatcatagtagcgtaaggtgcgcgtgctaaccccagctaaccgtgctaattgttgaatcgtatacacttgaatacctccatttgtatttattccgtaaatcacttgcttataagttagcttacaggttaacgtaacgtcaaggtcaagactttttccagttacgcaaaaaagtttttatgtcagcgttaccatgataaactaaaaataaaataagttatttaaggaagtgtatttgcatggaacaagatcggccaatttcattttttagtttccccggcaccgctgcagccgctgtgaatttttatgtgcaactttttcccaatagcgaattgatcgaactaacttatttcggtgacgagcaaccagaattgaccggtaaagtttacaacgccagctttacactcatggggcaatcattttacgccctcgacttcactccaaaagaagcgccgcctgccagctggcagacgtcacaattcattgaatttagtgacactcacctatttgaccgcattttcacaacattggctagttctggtcacgttttgatgggacctgaaccaatcgctcaatttgataaagccgcctgggtcactgatcaattcggcattacgtggcaattagttcatcgcgctgcataatcttcttatcgtagtcaatttgactacgatatttttttatttaaatgagttgacaacatagctacctcgttatactatgtagcagtactcattaatacaaagtagtgggggttatcaaaagatgaaaatttcgacggaaatgctaaaaggtgttctcgaaggtatcgttctgcaaaaaatcagcaccggcgaaacctacggctacgagatcaccaaataccttaatgatcacggctttgaagatgtcgtcgaaggaactgtttatactattttaatgcgtttggaaaaacatcaactggtcacagtcgaaaagaaaaagtctagtctagggcctgcacgtaagttttatcgcttaaatgccgctggtgaaactaccctagccactttttggcagcattgggcttttctatccgcgcaaatggctaaattacaaggggaggatgattaatatgatcaattatttaaaaaaaatgcgggcagaaaagaaaacttatcgtgattatcgcaaacgagtcaacgctttaccaccagagttcaaacaagcacaggatgctttagaaaagtatctaatgaattgggctaaaggcagtggtatttacgatatattaggctcagtcctggaaatgttcgaagcggcagctgctgatggctccagcgttgaagatgtcgtcggtgctgatatcgccgactttgctgataatctactcagcgaataccctgaagaaacttggatcgataaaaaacgtaatcaattgcgtaaaagttataaaaaaaatagttaggaggacccaccatgcctaaaatcatcaccattgaacgaattcaaaaacagttcaaagaacaaaaagtcttaactggggtcagcctcgatgtcactcgtggcagtatctacgccttacttggtgccaacgggagtggtaaaagcactttactaaaaatcattacaggattacttgatgcagatgcgggtgcagtcactgttaaccaactagatgtcaaaacagatttacgtaagatccaacgtttattcagttttagtgcacaaaattcaacggtcgacgatgttttgaccggtagcgaaaatttagttttgattgccaagctacggcatatcaaacagccgcaacaagttgctaacgatcttttagcacaatttaaattgaccgctgcggctaataaacgagttgctgattattctggcggaatgcggcggcgactagatctggcgatgagtttagtcggcgatccggagattctttttctcgatgaaccaaccaccggcctggatccgactagtcgcaacgatctatggcaagcaattcgtggtctaaaacagcaaggcaaaacgattttcttgaccacacaatatctagaggaagctgaccaattggctgatgaaattggttttcttggtcaaggtacgatcattgctaccggcacaccaacagaaatgaaacatttagcgggaccagaaaaaatgctactgacctttgtaacaccggacaaattacaattagcgttaccgctactcaaaaattcccaaccacaaacgactgacgaggtcacaatgacagtggtgctgcccgatagtgttaccactgcattagaagttctttctcttttaacaaaaaacgatttgcaaccgacaaacttccaagtcaccgcaccaacattggatgatgttttcttgcaattaaccaaggaggcttaagtgatgacttttattagcgatactttcacactggctggacggctgatcaaacataatctacgcagtctggatacgatcatcaccgttgttttgatgccaatcgctttattgctattaatggtttatatttttggtggcgcaattcagatcgatggcatcagccacgcgcaatacgtcaactatgtattaccgggcatcttgctaatgacagtcgccactggctctgcttatactgcactacggatcaatatggacaaaacttccggtatgtttgaccgcttcaaaacactaccaatctcaaaatcagctgtgctcaacggtcaagcagtagcttcagtcgtttttatgatgacttcaactttgattgttttagcagttgggttcatagtcggctttcgtagcgatgcttccttaggtgaatggctgctggtactattactgctaattggttttgcaattgctgtcacttggttatcagtcccctttgccttggcagccaacagtattgacggcgccagtgccttctcttacttagtgttgttactgttatttatcagttcggcctttgtacccgtgacggggatgcccaagttcgtccgtatttttgcggaaaaccaaccaatgacccatgtgatccaagcactccggcaattactggcggcccagccgatcggtgatcatggctggattgcattagcttggttagtcggtatcactattgtttcttacttgcttggtacacgaatctaccgccacgcataactttaaaacgcgagtaggaagtaattgattagttcaattaccgtcctctcacaccatcgtacgtacggttccgtatacggcggttcaatagtttgagtaaatgtgctcgtactgttgggcgatatcttgatatccccaacgggcgagcacttcgtttttcatcgaatagttgacgacaccgtgaccacttatggcccaagtagcccttacgggtattggcccaaatccaggtatcgtgtctggaaatatctagatcaaattgacgattttcgtgccaatcttcttccactgtttccagacatattgacgcaatcggtgcttgagccactgattcagctcatggataaacttcttcatgtgaccaatgccataatagttgagccagccagtcattacttggcgaatttcgtgcataatcaggtcaagactacgaccgcgattacgtttggtgatttgctttagtttagccttgattcgtaatttggcttgatcgcagctgcgatcatcacttattttgttcaggcagccgcggtttaaccgtcgcaactaaggatcaagagtacaccggtaaataatacgctggtggtgctaccctttaatctaaaaataataaaagtaaaaaactagtggcgctgaattaaacctcagcgctactagtttttttgtcaaccatgctcaattttattattatcaacattaaaaatagcttgtcgtgtcagttgctctagatcttgtaactgatggacatacacatggtagcaccgactaggcgtttccatcacataaacatcgatttcactaaaatcgcctaacgttgttaagtaactttttagacctttgtaactaaaacttcgcacttgcttgacctccctgctcaagcgactgtccttatctacttatgtccggtaaccgattgaactgcagtgacccgtgacagcccgctaataccataatgctttaaacgcttaaaagtatgtccatcaaagaagccaatgaacgtcccctgaaaaaacaaacaaaccacagtgccaatattgacagcaaataaatgtccggacacaaggaaagttatgagcatgatcaatactggcggaatataatggaccatttgggcaatcgtcgcactgccttttaagtagcggaagcgtaatatttgcatgaaatcatcattgggatgcaacacaatattggcccgttgataaatcgacgttgctaaagcaacacaaagaataccaaaaatatccacaacaactcttaatcctaatggtagctgattaatacctaaatgcacaatagcctgcgtaaataattgaattaaataactaaacggcgtgataaaaagtaaattacctaaaaaacgccgccacgaaagtttgcgggtcaaaaccatatttgctaaggccactaaaacaccgcaaataaataaggtcagccgcaaacttaagggccataaatgatataaattcaccgccgaagcagtccaaacggcgcttcctaaattagttgcaatggtcaatgaatggccagtcgcattgatcaatagtgataaaccaagatacccccagcgcatcattaaatcatttgatcgtcgctcatcgatgttgctcatcccctaaccaattgagctttaaataacaaagaggtcgcaacatacattacatatgtcacaacctctttgtttttcgaacattagcgttgaagcatgttccataaagtaattttaaccactttataaaactcacttaccattgaaagtagactattttttaccttctaccaacgatttcccagttaagaaatcaggatttggtttgatactgaaacgagccgccaaatcagccaagtctttatccgtaatttcttgtaagaaatggccgccttgtgcttgaacagttgtatagatcaaagcagctttttcaactgtttcgatcaagccaaaggtttcatccatcgaatcaccagcggcaaagatcccgtgatgtggccacaaaacaacccggaagtctttcattttagccgcagttgctgcaccaatatcattagtaccaggtgtcatataaggaatcacaccaagaccttcagggaagacaacgattgattctgcttgcattttccataaaatacggctaaatgttttttcatctaacggtaccgtgaaactcatgccaactaaattagttgggtggcaatgcataacgatgcgttggtcagaatctacttttagacgattgatatgggtcatcaaatgtgctgggaattcactggtgggttggccgccatcgttgaagccccaatgaatgtcgacactatggccatctgcggcgatctgaaccaagccagcatcgcgttcacaatgatcataaacattcttgaagtagcgaccagtaccagtaactaagaagtattgacccgctaattcactagcatcaaaatcaatttttacgttacgcaatactgtgtcaacatcagcatattggctgacttcttctttggtcaaacgataactaacattaccgccattccgttcgtcccagccgtgagtgtacaaaccgagggtgattttacgcatttcgtcagcatatggtgaattaataaatttttctttagtcaagatcaatgatctccttttcgttacttaaggatttgtattttttaaatctgtttcagcgaaaattgctccgtctttacacggagcaataatcttttaggttaaaacgaggttgaaaaagcattgtcgtttgttcttaacaactctatctaacaaataccagacagggttactaattcgcaaaccagagccctttgtcgcctagcctactccttcacaatagagggagctattgcgtagtagtaagctagtacgcaaaatctgaacgcttttccagacaccttcttagtttagtcacgcttgaattgaacgtctttttcatattgacgaatattcttcatccagtccatgccaacaggtgtgccattgtcttggcagaatttatcccaaacagcggcaaatggataagatttcaattcttcagtttcaactaaacgttgggtgaagtcgtagttcaattcggctttcttcaattgatcaattggttcgagcatagcttgtaataaagccttttgtgttgcgcgcgcaccaatgacccaagctgcaacccggttgatcgttgcatcgaagaaatcaaggccgatattagtcttgcttaattcgttgtcccgaaccaatgaacgtgtgatccgaaccaatgcttcatcgaagataacaacatgatcactatcccaacgaacaggacgagaaacatgtaacatcaaccctttaccaaatggtaagaaggcagagaacttatccgaaacatcttcggttggatgccagtgtccagcgtcgatcgtccataacttgttccgggtgatggcatagttattgtagaataaatgtgaaccaaccgtgtaagattcgatccctgtcccgaataatttaccttcgaaggcttcaatcgtgttcttttcgtcatattgtttttcgtcaatcgcgtctaatgacttgattaagcgcaaacgcggtgttgctttatcaactggattgtctttaaagccatctggaatccacaagttattaactgattgttggcctaattgttcaccgaagtaattagcaactgcacgagtccgtttaccatgttcgatccagaaatcacggatacctgcttcagggctagctaaagtaaagttttccttgaccttaggatgagagaagaaggtgccgttcatatccaagccaattctttcttgtttagcccagtcgacccaatacttgaaatcttctggttcgatttcgtctaagtccttctttttattagtaactgcataaatagcatgtaattgaactttatgactaccaggaatcaatgacaatgcttcgtgtagatcgccagataattcatctggggtgcgggcaataccagggtagttaccactgacaccgatcccaccagttaaggcttgacctgggaataggaaaccatggatatcatcgccttgccagcaatgaagtgacaatttaactttctttaattctgccataactgcttcggtatcaacaccaagttcagcataacgtgccttggcaatttcataagcttgatcaactgattgtttttgaaccattataatagctcctctttttgctaagattagttttttaaaatttaaatccttaattaatacaacttacgccggcattaatctaaatgaaagacttcttcaagatcatcggctaccggactttcatcagggtttgtcttcatgatcggcgccatatagtgccaccacttcttacaaatatcagtattagcaatggcattataagcagcaacatcaggtacttccaagtacgccaaagtctgaccgttagcgcgattgagatagatcgaatagttggtagccccatgttccttaagcgcagttttcatttctggccaaagttctgcatgccgcttagcgtattcgtcataagaatctggattaatgtacatcacttgtgcgatccgcttcatcaattacacacctctccttacaagttttgatttatgacctaaattattggttactggccaagaatgcttggtatttagctaaaacaccttgataggcatctgcctggggcacaaaggtctttaagttgaatgaatcggcgatcaaatgccgcccggcaaccacatccttaagctcaccactggtgatcatctgtacgataatgttaccgatagcagttgcttcacctggcccagcaaccaccgtcacgccaccaagatccgcggtcaactgattcatcaaagcaacattagagccgccaccgacaatgttcaaggtcgtgatcggatgcccgatgatcgtactcagtttatggactgaatccgcataatataaggacaaattatcgtagatcgcccgcgcaatttcacctggtgttttgggtacaaattggttagtttccttagcataagcctgtaattcttggatcatattctccggattttggaaacgcagatcgttaacgtcaatgaagactttaaacgattcctccttttccgcaagtgccgccaattcagcaaaggaatactgatcgttcagttcttcttttaccttttggatgatccacaggcccataatatttttcaggaaacggtaagtcccgtaagcaccccactcattggtgtaattctcacgaaaagcagccaacccattttctggcgtattaagttcggcccccagcaatgaccaagtacctgaacttagaaaggcccagttatcgccaaagcctggcgtaccaacaactgcgctggccgtatcatgggtcgcggtcgtaatcacatcagtttccggaatatcataacgtttacgccatttacgccggacagcccctaataaggtgcccgcttcaactaaatgcgggaactgatcagcttcaacattaacttcactcatcagatctttgtcaaacagcccttgccgtaaattcaacatctgcgtggttgacgcattagtgacttcagtaactgcattaccggtcagaatatagcctaaatagtctgggatcatcatgatcttatccgtcttttcaagaacggccttatcttcggtataaagctgatataaggtattgaaattctggaactgaatacccgttttttcataaatatattcttttggtaaggttgaagttaaattagtgatcgctgaattagttcgcgaatcacgataggcaatcggatcatgtaatttattgccatcttcatcaactagcacgtaatcaactgcccaagtatcaatacctaagttaacgcgattaatgccgcgggctttgattttgactaaaccggctaatatttcatcaacaagatggtcgatctgccaacaatcatggccatcttcactattaaatccatttttaaaccgatgcacttcttcaagtttcaaccgaccttcagcaaccgtgccgaggatcaagcgaccacttgaagcaccgatatcaactgctacatacgtattcattcgttaacacctcaaattcattatttattcagtgtatcgcgttgactttgtgtcaggaagtcttccccatattgttccttggtgatctcttccaagctcttgccgcgggtcttcggtgtccaaatgatcccaactagcaaggatacgatcagaattgcgatcataatataaccaccaacactgaaaccaagtttttccataatagttggaacaaaaatcgtataagcaccggcagaagcacgaacaataaagaacataataccttgagaaccagcccggaactgggtcgggaaaagctcagttgcccatagcgcataccaagcttgagcaccgatcccggctgagatcccccaaagtgcggcgaaaatccataatgcccatgattgactcatcccaaagagggtcaagataatccaggaaagtaatgccattgttgcaccgattgcgaagaacaaacgatgattaactttatcgccatacttggcaaaaccaaagtaagtgccacaagcggtcaatacccagatcacaatattcaacaaactagattgtgttgcatcaagcttaacaacactttcaaaaatatacggtaaaaacataccttgagaaccagcaactaaattccataaagcgtaaacaccgatcaggaagaataaccatttgatggaagttttgttggagaataaggtgcggtacggatgggcatctgccttgctcttatgtccagtcttcttttcttccgccttctgatccaaccaatcttgtgattctggcaatgtccgctgcaagttccaagcgataaaagcaacgatagccaaaccaacaaaaatcaagcggtaacctaacaagcctaatggtgcgaccaataatgccgcaatgaaaatcactgctggaccaagtgaccaagcaaactgggaaaccccaatattttttgcccgttcattacctgcagctgtttcaccaatatatgaccaggatgctggaaccccagcaccaacggcgatcccagtgatgatgaaacctgctaacaggaacgcaaaactattagcaaatacgcacatcaagcaaccgaccatataaactaacatgtcataaacataaatgaaacgacggccatacttatcagataaaggtcccccgatcagtgcgcctaaagcggccccaaatgcgttagccgacaaggcacctaaaatacctatttgaaatgtgctaagaccaaagtgtgagctccaagacgccatcccaactgatccggcaacaatacaacccgaatcaaggaaatttgtgattgaaacacgtaccgtggactttaatgatccttcagccatgccttaacctcctaaaagaataataaataataatgacttaattgcaatttcatattaaccgctttcatgatatgatggcaatatcataaagtctgaacaaaaatatcatatttacaggaggcacctcgttttgaagcaaagtatccttgatttacttaaagaacccacgttaattgaacaagagcaaaaaaatagtgatatttttcacgatgacattccaacctcggccattaataccggtttatctgcaacacgacatataccagttttaaataattattttttccgcaataaagatatttatattagcaagcataatcgctacgccccttacccgacgcacacccacacttttctcgaaatgaattatatgttgtctggtaaggccgatgaaataatcaatggtaagaaggtccatttaaaagctggtgatttagtgttattagatgttggtagccagcattcgatcggttatcttggcgacaatgatattttgatcaacctgctatttagagatcaaaatatcagcatcaacttgttaaacgatctgcgccgcaataaaagtattctttatgaatttctaattaatcgggtaactaataaggatggtgatccacaaaacaattatttgatcttccataaacaggccgaaaatagtgaagttcgcgtgactttagatacaatcattgaggaatatttttccaatcgcaaattttccgattcaatcattaagagttacctctcgattttattgacacaattggttcgtaactataccattcaaacaaaacaggcctcgtccagccaacagttaatgatcaagatcctacgtgacatcattcagaactaccaaaatattactttagataaaattgctcggaaatataattataataagaactatttgagcaatatctttaaacaagaggttggcaaaaccttttctgaagcattaacacaagaacgcatgatccaagcccatactttgatcacttcaacgaccctaccgatcactgatattattgagaaagttgggatttcaaacaaaaattttttctatgataaatataaaaagcaataccatatcatgcccagtgctgcacgcaaacaggccagcaaataactgttaatatgtatatatgatactaaaaattatgaatagatgctgtcagtttcatgaagcagctattataaagcgctttataaattagataacgttatcatatcttcaccacttagcttaatcagtccttgagtgattgcattcgtaatatttatgtgaaataattctcaatgaaaacaaatttagtccatcaaggagtgacatatattgaaaattcaggcagctgttgttgataaacaaggtgcacaattcacaatgaagaatgatatcgaacttgcggaaatgcaagacgacgatattcaagtccacatggtagcaagtggtgtttgccattctgatgaagcattgcgtaaaggtgatgctacaattggttacccgatcattctcggccatgaaggttctgggatcgttgaaaaagtcggctcccatgtacaaaacttcaagcctggtgatcatgtgatcatgtcgttttatgcttgcggcaattgtgaaaattgtctaaaaggtatcccaactcaatgtttacattatgcggataacaacctttccggtgtccgccctgatggaactgcacactttactgaaaatggtgaaaaaattgctgatatgttcgatcagtcttcattcaccacgaccacggttgttcgggaacgtaatgcagtcaaagttcctaaggatctagacctacggaaattaggacctttaggctgtggttacgtcactggtagtggtaccgttttgaacacactacaaccacgtcctggtgatacgatcgcggtcttcggtactggtgccgtcggtttggctgccatgatggccggccggatctctggttgtactcgcgttatcgccgttgatatcgttgacgaacgtttggccttggctaaggaattaggcgcaactaacacgatcaacagtaaaaatgaagatccagttgcagctatcaaagcactgacaaacggtcatggggtcacttatgcagttgatacaactggggtcactgccgtaatggaatcttctattaaagcattggcacaaggcggtgtctctgcatgtatcgccgttactgcacaccacattgatgttgacacttggaatgatctttgtgttgatgacaaatctgtgattggtgttaacatgggcgattcaattccacaaattgatatcccacgtttacttgaattttatcgtcaaggaatgtttgacttcgataaaactgaaaagttctacaagtttgcagaaatcaaccaagctaacgctgattccatcagcggcaaaacgatcaagccaattttggtcattgatcctgactaccaaccaggtaaataacttaaattttcttcatagtctatagaatcgagtaggaagtaattgattagttcaattaccgtcctctcacaccatcgtacgtacggttccgtatacggcggttcaatagtttgagtgaatgtgctcgtactgttgggcgatatcttgatatccccaacgggcgagcacttcgtttttcatcgaatagttgacgacaccgtgaccacttatggcccagtagcccttacgggtattggcccaaatccaggcatcgtgtctggaaatacctagtttgatcaaattgacaattttcgtaccaatcttcttccactgtttccaagcatattggcgcaatcggtgcttgagccactgattcagcccatggataaactccttcatgcgaccaatgccataatagttgagccagccagtcattacttggcgaacttcgtgcataatcaagtcaagactacgaccgcgattacgtttggtgatttgctttagtttagccttgattcgtaacttggcttggcgatgggggcgcaaccgcgctccctgcttagtcggtgaaataaagaaacctaaaaacttctgtttagttggactgccaacgatactctttacttggttgacggttagtttcagtttgccctctaggtacttggtacaactggctaacacgcgcgtacccgcacgtttacttttgacataaatattacagtcatcggcgtaacgcacaaatttatggccccgcgctttaagcagttggtcaaattcatttaggtaaatattcgctaacaacggcgacaaattgccaccttgtggtgtaccttgttcattggcaatgagcagttggttgaccatgataccgctggtcagaaagcggcgaatgagccgtagaaccattgattcatgaatatctcgtgctagaattgccattaacttatcgtgattcaccgtgtcaaagtattgtttcatatccaagtccacgactactttgtagccctcattgtagtaccgacaggcacgtaatagcgcctgatgcgcactgcgttgtgggcgaaagccataactattagccataactattatcgataaactttggttcgtagattcgattcaaaacttgcgccaccgcttgttgccgtaaccgatcaataaccgtaggaatgcccagcttacgctgcccaccattcggtttcgggattcgtacccgtttgactggcttaggctgataatggcccgttctaactgcttcaattagcgactcgcggtgttcctttaggtaaggtaacatcgccttaatcgacataccatcaattcccgcaacacctttatttcgcttaatccgcagataggcgtcattcaggttgttacgtttcaagatagcgtccattaatttggtttcaccaaccaactgatttacttcaccgccaatagtactacgcgctccggcataacctttggcttccagcctattcctctgtcggtagtcagctaattctgttttctgcgattttcgcactattgtcacctccataatctcagttgatttactattgttcagcccttcggtctaccaaagatagacttactatgacctcggctgactcctgctaatctcagcccaccatcactgctgggtttgccatattccgtcgcgctataacttgactagcaggcctccccggataagaacgtcaactttcgtaacatgtcaccgtcagctttaccgtcatgacttcgagtagtattggactttagtgtgtgtagccaccttatccagtcatcttcggccttatagctgcttcttgttcatcggtgcggtactttgctcatcaggcttccttcagattccacctcgcgatggacacccttgcccttggctagcggttccgactactacggcccgcaacggactttcaccgtctagctgacgcccatgccgagcgcaccgcgaaaaagccacccacaaaatagtcggtggcttttttgtttgctgctatttagcggcaaccggaatatagagatgaaaagcgcctttcccagtaatcagtggtgtaatcacttctaaattatgattggccgccactacatactcggctgactgtgctaaaattccataggcatcagcaacaaatcgatcagccgctactcgctgcttaattgtagttgtaaatacagcatacaaaccagcagccaccaaataatttgtctccaatggatcagtcatcgctactttgacaccaactaaataattctgttcatccgttgcaaaattaaccccataaaactcatcatcaactgcagtggaagtcaaagctgcctgttccgcctttaatttagcaatcaactcggtcttagcttcactcatccctgctaaatcagtcaccggaaccaccgcttctaacccaataatgatctgtgccggtagcgtgactatttctaataccatgtttgatcgactccttccaataaggggactcattcctactctaatagtagcatctcgctatcagcaactaaactttgcagcatattatgcttatgatcaagtctaaaaaatgctcacctaggataagccctaaggtgagcatttctactatacagtcaaggtgattttaccaaccgtatggccagcagcaagtaattcactggcggcatttaaattagcagcatttaagccttgataagttttagttgtgatcgattttaaatcaccagcagctagtagatcagttatttgactgagaatctggccttgactagccatgcggtattgctcgcgtgctttggtaaacataaactcccaatcaaaggataacgccttatttttcaatagtgcgatatcaatcggcttttgtgtgccgacgatcgtaccaatatgtccaaaaggtttagccagctcgaccatccgcggtagataactttcaatgctataaaataccgcaatggcatcgaattggttatcagcaaattgctctaaactattcggttgtcccgcatgataatcaactggaacatctacgccatgctgggtcaaccaatcaaaattacgcggactagcagtcgcatatacggttaaccccgcccatttagccaattgactagccaccgaaccaacgccaccagcaccgttgacgagtaagattgatttaccttcattcgcaccagcttgagcaataaaattaaatttttcaaacaataattcgtacgctgttaaactaaccaacggaaaagccgccgcttccgcaacagccagttgtgccggctttttggcaactaaccgttcatcgatcaattgtgcttcctgaaaactgccatcacgcgtggtcgtcccggcatagtaaacttgatcaccaatttgaaaatcagtcacctgctcaccgacaccgatcaccgtacccacactatcataaccaacgatgcgcagatcaccagctttaaaagtcgctacatgctttagatcaactggattaagtgaaactgccgcaacctttacgagtaaatcgtggccttgcgctaactcactttctttttgtccgtcaataaactgaccctgatcaatttcaatggttttaattgttgtcatctatataatcgctcctattccgtaatcaaggtaaaaagcgttaaatacagcttagccccttatactaaagtaatataggctggtgctgcctttaggtcaagcattaacacaaaaactgactaacattagtggtgaatcataattcgacggaattatgattcaccacttttatattctgttaaagtggaaatgaagttgacatgtcgaattgctttttggcgcaccttacggtgacgtcgtaacaaaaaacggcaacctcatccggttcaccaatgagctcgctcgaagtctgttggctattaaagtcgtgtattgaaaattgagatgagtgaatcgatgaatacaacttttatgtaggtggtgtttgatgatgcttgatatggaaatcatatttggtattgatgtcagtaaacatagttcaaacgtagccattttgattgatggcaggacgtttaaagaatttaaaataaccaataaccgaccaggttacaaaatacttgatgatgcgcttaacagttttagatcgccgaaggtaatttttgaatcttctggcatctattcccgaagtatacggtcctttcttcaaagggaaaattggaattatacggaaattaacccattagcagcaaaaaaagacatggatgggtttaggcataataaaaatgatcggttagatgccgtttcattagcaatggcaatggcacaacatcattatcagtcgacctttaaggaaaaagctgtgtatggcgagcttcacgacttggagcgaacctatcaagaattcaacgaagatattgtacgagctaaaaatcgattacatcaaaagttgcagcttactttcccagaggtggaacaatttataagtacgaccgatggtgcattgtattggcacgtcgtgcaacaatttccacatgccagccttgtattagcaatcgaattaccagcgttagcccaattcattttaaaggctacaccaaaaaacatgagtgagaagcgtgcattcgctctagctaggcatcttcatgatttggcaagtcaatctgcccccgcagttgattacaacgctcacgcagttcactccgttatttatctagctaacgaggttgaacacttaagcggacttaaggcagatattattgaggaaatgactaagatttcaagcttacttgccgaaatcccaatcttagaatcaattccgggattcggtattaaaacagcagtttgtctcttagctgagttaggtgatattagccgatttcatagctccaatgccattaatgcatacgttggaattgatttgatccagtatcaatctggggatttcgagatgatgcagcatattcgaaagcgcggtaatccatatgcaagaaaaatattatttaaagctgtcttaaacatgatgagtgtcgccaaatatcatccatcgaatatcagtattttttatcaacgcaaaaagcaatcttctagtgaatcacacactaagaagattgccatagctgcgatgggacgtctgattaggaccatctaccacctaattaaaaataatgaattatatgattcaacacaattctcaccagagaaataaatcataattcattcacacacaattataacacctcaaaaaatcaataacaccagaggtgctatttatcatacatttattcggtaatacaatctataaaacacgggaaaaaatcttaaagtactgctcaaaaaaaagagaacccgaattgtcaaatcaagtgcaacacttgctaaacttcacttataagtggtctaggtggtggtcatgcgagtagctgctcagccatgaattcattggctgatttataaccaaatagtttacgtggc

SEQ ID NO: 605 - DNA, 22857 bp, Unknown
  Metagenome-assembled genome
caggctattgaataaccggcaaaattaaaaaaatctgtacaaccaagggacaagtgtatccaaaagttcaaagcaattctgagttagttgaaagatctcactagctagaactgataaacatcgtatttcagcaaaagataaagacatacccgtcagttttcgaaaaaatacgaaaactgacgggatttttatgaactatgaataattcaggaagttgttttgtttcttaaatatgtaaaaaagaacgcccaacttaatgagcgtcccttaaaatcgattcaattggcttacatcatgccgcccatacctggggccatgcctgcaccgggtgcgccagcgccagcatcgttactttgtggttcaggcttgtcagcaacaacagcttcagttgttaataacaaggaagaaacagaagcagcgttttgcaaagctgaacgagtgaccttagttgggtcaatgatcccagcgtcgatcatgttttcccatttgccattagctgcgttgtagccaacttctggatctaatgacttcatgtgttcaacaataacggaaccttcaacaccggcattttcagcgatttgacgaactggttcttccaaagcacgtaaaacaatgttgataccagtttgaacgtcgccttcttcttcaagcttagcaacggccttgattacattgatcaaggcagtaccaccaccagcaacgtagccttcttcaacggcagcacgtgttgcgtttaaggcatcttcaatgcggtatttttgttcttttagttcagtttcagttgctgcaccaacacgaacaacggccacgccaccagctaatttagctaagcgttcttgtaatttttcacggtcgaagtcagaagttgtgtccgcaatttgtgctttaatttcagcaacacgttgtgcgattgtgtctttgttaccagcaccttcaacaattgttgtattgtctttagtaacggtcactttaccagcttggcctaattgactgatatcagtatctttcaattcaagacctaagtcagctgtgatcacagttgcaccagtcaaagtagcaatatcttccaattgtgccttacgacgatcgccaaagccaggcgctttaactgcaactacattaaatgttccacggatcttgttcaaaacaagagttggtaaggcttcaccgtctacatcgtcggcgatgatcaacaatgctttaccttgttctacgatcttttgtagtaatggtaaaacttcttgaatgttagagatcttcttgtccgttactaagatgtatggattatccagatcagcttccatcttgtcattgtcagtaaccatgtattgtgacaaataaccacgatcgaattgcatcccttcaacaacgtctaaagaagtatcgattcctttagattcttcgattgtgatgacaccatcgttgccaactttttccatagcatcagcaattaatttaccaacttcttggttagctgaagaaacagccgcgatttgagcaatatcacctttaccgttaactttatgcgaaatcttgtgtaattcatcaacggcagccttagttgctttttcgatcccgtcacggataccaactgggttagcaccggcagtgacgttcttcataccttcgcgaacgattgcttgggtcaaaacagtggcagtggtcgtcccatcaccagcgttatcgttagtttttgaagcaacttcagaaactaatttagcacccatgttttcgaaatgatcttctaattcgatatctttagcaattgtaaccccgtcgttagtgatggttggtgaaccgtaagatttttccaaaacaacgttacggcctttaggccctaaagttgttttaacagtgtttgccaacttatcaacaccacggagcatagcagaacgtgcgtcttcagagaattttaattctttagccattttaatatttcacctcataaattgattttttagagagtgtgttaaaaaagacgttcagattatggcgtatagcctagcttagtcataagatacacgcagtggatcgttgctaagcgtagctatacgcaataatctgtcttttttaacacgtttacgctaatctagaacaatatcgctaaattagtcgacgatagcaattagatctttttcatgtaaaacaagataatcattgccttcgtagctgacgttagtcccagcatatttatcaaacataactgtatcgtcaactttaacggttaatggttgaacgtcgccatgatgattagccactcctgggccagcggcaacaactttaccagtcgttggtttttctttagcatttgatgctaagacaataccgccaacggttttttcttcttcatctgcaactgctacaatgacacgatcgcctaatggttttaacacgtgtaatccctccgttttacatttaatcaatttttagcactcttagcagttaagtgctaatcacaatattcataataccatgttcgtttgggaatgcaagttttatgttcaaaaaatactgacggcttttcttttagcttaaaaaacgctactctaataacaagttgatttttataaaggagctcgctatgtcacttaagaaaaatgttgttacaacactgattacttacttgatcatctacctactaccgactgttctaaatttatttttacatttaggcggccatatttatttgattcaaacgatcgattacattattggtgcgattttactcagttactactattggcgcaccaaggaacgtcccctgatcgaggcaaaagccgacaaaggctatcaaattctttggtggggagtgctaggtttcattgccgctttagctgcacagatcctagctaattatattgacacttttttgtttcattctgtacccaactcagtaaacacaacaacgattttaacgatcatcaaaagctatccggtttatcttttggcgacgatcattgccgcaccgatcatggaagagctggtttttcgccggacgatcttcggttcactcgtccccttcacaggtaaagttggtgctgccctgatcgccagtgtcatgtttgccatggcacacaacgatggtcacttgctggtttacaccgcaattggcttggtcttctgctacctttaccaaaaaactggccggattcagacttcgatcatcagccacatgttaatgaatgcggtggtgattggcattagtctatggcgctaaacttaaaacagccttaattccaagtgcttgaaagtcaaaatagctttcaagcactttttttatggttcgaatgcttttttacaacttgaattgtcaaattaagtgcaatttttgattatgatagatctcatatggtgttttccagtttaaacattttcgtggccttttattcagccgatcaacgaattctaaaatgacggtatccgaaattggatccactggctgagtttttcttagctgctttgtgcattattaagtatcttgaacaacggtcaaccattgtgaccacacaagatctgccagttttgccagctacagtatccagctcccagtggccaatctgagtccgcttattggcagactcaggtcgttcttggagtgtatgcgatataggaatcttcccgcgacgttcctcataaccttttttatggcgcgatttaccatgatgtctaagctttctgatcacccctctggcacctcgtgatgaaagcttctgatcaaataaaccggagtagatgccacgataaatcgtggtatagctgatctgaaatgatgaggtctctaattttaagcgtgcggcaatttcttctggtgaccattgtagatccaagaataaatgccggattaattgaagcaattggtgatcagaaagtagcgaccggcgtccacaatgagatttttgagcttcgtagcgctcttgagcaatagaaggtgaatatgccgatctatttcgcgataactcacggctaactgtcgacgttgctcgaccaattgtttgggcaattgaagtcagtgaagcctgattattatgcatcaggaatatcgtttcgcgttcactcatggtaagatgtttgtatgggctcatgattatgtgctcccttcgatggttgtcttcgcaaacaccattttacagggattcatatcatgagtctcttttgttgcacttaaagtataaattcaagaaataaaaaagccctcaaaaatcataaaataagtcgcagccaaaagacacgagataagtttatgattctgagaactttttatttagtctaaaaagacagtatacgctatattaaaggcgttcgttcaattctttaccaagttcttcaaagccaggtttgcctagcaatgcgaacatgttcttcttatacgcttcaacacctggttggttgaatggattgatcccgttcaaatagccagatacagcaacagcacgttcaaagaagtagatcaagtagcctaaagtgaaggcattttgttctggaatgtgtacactcataactggcacaccaccatcgttatgcgctaaaacaaccccttgataagctttagtgttaacaaaatcaatggacttaccttgcaaatatgccaaaccatctaagtcgccttcttcaacaggaactgtcaagtcatgagttggtttgtcaactttgacaacagtttccatcaaattacgacggccttcttggatatactgacctaatgaatgcaaatcagtagtgaagttagctgaagatgggtagatacccttttggtccttaccttcagattcacccatcaattgtttccaccattcggagaagtattgcaaggttggttcgtagttttctaataattcagttgtgtagcctttacgatacaaaatgttacgtaaagcagcatacttgtaggcatcatttttagtgacatctggatctgaatattcgtcttccgctgcagcagcaccttgcatcaattgatcaacgtcgccaccagcaaccgcaattggtaataaaccaacggcagttaaaacagtgaagcggccaccagtaccatcaggaataacaaagctctcgtagccttcagcatcagcttcttgcttcaaagcaccatttgctttatcagttgtcgcgtaaatacgttctttagcgccttctacaccatatttagcaattaacttttctttgaagacacggaaagcaattgaaggctcagttgttgtaccagatttagaaatcacgttgatcgagaaatcacggtcgccgattaattctaataagtcatgcaagtatgatgagctgattgagttaccagcaaagaatacttgtgggacttgacgatctggtgccatgttatagaatgtgctgcttaaaaagtcaattgcagcgcgggcaccaaggtatgaaccaccgataccgatcgcaacgaaaacttcagaatcgttttggatcttctttgctgcggctttgatccgtgtaaattcatccttatcataatcatgtggtaagtgtaaccaatcacgcatttgtgattccacacctgtcccatcgaccaattggttatgtgctgcagtaaccattggttggatttcatttaattcgttatcatgaacgaactgactaacggcggaatcatcgaatgtaatatgtgccattaaaaatagcctcccttaatatagtaactaccagaaataactttagccgctttgttgcaaaattgcaagcaggtttatgcgttgtaagggcttttaaaatcaaggtagaaaaaaactgtcagtaacacgtgcaccaacagtttgaataattcaaattatgctttcatgtagccgagtaaaatcccgccaccgataacaaataagcaacccacaacaacgtagaccatttcacgtttggttttcttttcaccaagtaagaagatactacccaacgttgaaataatgatcccggtttgtgacaacgaataagaaacagctaagccaactttagggattgaaaggaacatgaaaatatttccggcaccccagagtagaccagttaaaatatttttaaccgtcgccatatttttaacgtctttgcccattgccatcacgattgccccgatcaacataccaattgcttgtggcaaaataaccgcaatcgcattaacttgaccccaatcgacaacgatcgtataaccaacatagccgatcgttgaaatcaaaaggacccgcagtccccggctgagttcagtattttcttctttaaccacatggctagctggatcattgcgtgaagttaaggttgccccaacgatcaagatgatcaaagctaagacaccgagactaatttcacgcccattttgccattcatggaataacaaagcaccagctaatgtgttaccgactaattgcatccctgttgacattggtactgtccgggaaacacccatgatctgcattgattggaattgttgaccttgaccaacactccataataacccagatgcgataccaaccaggaatacctttacatttaagacaggatgataagcaaagtaagcacctaacgcaaaaaccaaagcaccaattgtcattccaagggtttgctgatgtgcgttaccgccgagcttgccactcactaaaccgatactgccccaacacagtgctgggatcagtgcaattaaaatactcacaaaattttcctcaattctctcttgatttacgaaaacccattttaccggttacaaatcaaggatgcaacctttttttactgaaaaaaagtaaatgacttactggtatagcaaaataattccacttaattattatgttgaatatcgacttgaaagaattttcataaccgctaaacgccggcttaagcactaattaagaaaaagtagtctggctgcggctatatgaaaataagtctatgaaaacatttttatattcagccttttcttcaccttttccgccagcaaaagcccgtttaatcgcctatcagtaaatgaaagcgctaatgtgaattttcattccaaaataaataatattggtctgaaattaaaaaaaagcctcagaattacattctcagactcacttatgctgagacaccagtttaatcaacaaccattgtagtccccgccaaattagatataaaataaaccccagtaaacaacctaacgcattaaaagtaacatcatcaatgtcagcgatcccagttgataagaaaaattgcaacgtttcaattgacagcgacaccccaacccccagcaagtaaacttgcagaaattgtactggtaaccagcgctgattatcctgcaaacgaacaccataactaaagcccagcggcacgaaccatagaatattgccaaagaggttgtagagaaaatcaaatttggaaacaccctgagccaactttaacgtttcaacaaatggcgttgtattgattgcctcatgaggtaattgaagatgcgcccaaaattgacttggccagtagatccgccttaatgcggttagtgaatatagtaacaataagtaaatgatcaacacccacaaatagccttcacgccaccaaaattcccgttgccgccgcaagcgctgatgccgccataaataaattaatcgcagtacgacaaaaatcaaaaaatagaacagcgttttatcaagactataaaaaattaggcggatcaatggaaaatgattaatatgctctgcataatgtgcggccactagccgataaagtggccccagaaaaatcatgaacgcgcctcttttctactataataatgtttattttgttaaatgcgctcgcttaatcgacgattgctagtctaaccttaccgccttatattttagcaaaaaacgcctggcaaaacgagatatataacccttgatttgcaaaaacttaagctattattacatccatttactttatgtgtcttctatgccagtttgacaattgatttcgtttacgcgtacaatatcgtgagaattgatttaacagtctttatgtaaaatcgatcgcttaatctaaaggagcttatagcctcgtgaaacgtttacttaaccaattaaaaaatttcgttaatcaacgcaatggttttttcatcctcctgatcgtgcttttctggttaaaaaccttgtttgcttattatgttgatttttctttaggtgttagcggtatttttcaacactttattctgtggttgaatccgctagcaactactctacttgttttcggactagctttatacattcagcgaccattctggcgttattttggactgatgatcttagccaccgccaatacggcactattgtactttaacgttatctattaccgtcagtttacggattttatgaccatcaatacgattttaggctattcaaaagtctccgaaggtttaagcggcagttcgctggctttggcgcgaccgtatgatgttttatactggttagatctgatcatcctagtcgttttattacttgcccgtttgatcaaaattgatcagcgaccggtgccgcgacgttttccctttgctattacgtccgtagcggtattacttttttcaattaatctcacacttggtgaagctaatcggccccagttattaacacgaactttcgaccgtaattacattgtaaagtatttaggcttagatgcatatacggtctatgatgccgtgaaaactgcacaaaacaatcagacccgggcttccgcaaatggttccgatctaactaatgtactttccttcatcgaccaacattacgctgcgcctaatccaaagatgtatggtatcgccaaaggtcgcaatgtgatcattattcatctggaaagtttccagcagttcttgatcgattataaggttgacggccgcgaagtcacaccatttttaaacagtttgtatcatgatgatcaaacttacgcgtttagtaatttcttccatcaagttggtcaaggtaaaacaagtgatgccgagaatatgcttgaaaccagtgtttacggtctaccacagggctcagtcttcaccgccttaggttcggataatactttccaagctgcgccagccattctgcaacaaaaagctggttatagttccgctgttttccatggtaatgttggctcattttggaaccgcgataatgtttataaaaatatgggctaccaaaactttttcgatgcttcctatttcaatacgacgggtgaccgctcagagcagtacggcttgaaggataaattattattccacgactcagttaaatatttagaacaactgcaacaacctttttatgctaagttcatcaccgtcaccaaccattttccattcccgctggatagtgaagatactgattttcctttaccgactactgatgataaggctgttaataactactttggtaccgctcattatctcgatcaagcgttacaagaattctttacttatttaaaggctagtggtttgtatgacaactcaatgatcgtcctttatggtgaccactatggtctttccaatagtgataacttaagcttggccgagttactaggtaaatcatccgatacttggaatgattacgataatgcgcagctacaacgagtgccactgatgattcatattccggggcaacatgatggtggtattcagaaacaatatggtggcgagatcgatgttttaccgacgatcgaacatttattagggatcgacaataaaggctacattcagtttggtactgatctgttttcaccacaacatgatcaagttgttgcctttcgtaatacgaattttgtcaccccttcccatacagtgatcgacggtacgatctacaataataacggcgacgagatcacccatccgtcgactgaattgcaagcaacgatcaagcgacaacagactaaagttcaaaatgagttacagctttctgacgcggttaataataagaatttgctgcgcttctatacgccaactggcttcaagcccgttgatccagaaagttacaactataaaaacgattttgccagtttgaaacttgctagcgagaagcttggtaaactatcaactagcctttacgctaaaaatggtgatcgtacaactagcaatcactataaaactgatgcggctgagctttctgatagtagttcagataacgattccgctaacaattctgatagtaactcaaatagcaactcaacggactattctagtgctatgagtagtagtatgactggtcaaaactaacatgttacgttatttatgaaaatagattaatacgagccatattgcttattttttgcaatatggctcgtattttttatttacattttaatgttaacttgtttatttacctgattcgctattttagttagggaacttcacacttttttcaagatatttttttataatgggttgtgtaatgaggtgagcttatgcgggtcgtgcaacgggtatttgctagtttacgttatcattggcgttataccgccgttttcggcgtattcaccatgttatttctagttagtagtctttcaaccttgatcgtccatgatattcagggacatgcgttaggcttatttgagcagcgcatcgatattattgatcgtaaatcacaaatcttaacccgctggtcgcttttgcgccagctactccatgtacgacagtcaatcgttattgatacacaaaatttctattttattttatttggaagttttgccttattgatcctgattcttagtgtcattacattgattcagcgtaaacacgaatttgcaatttatcagttagctggtaaaagtaacgctgatattagctttcagttcgccctagaaaacctcttttcatttttaattgctttcttcattataacgatcattttattagtcgttcaaagttggtatttagatggtttgatccaattaaatcaatactggttcaccgaaaaattaccgactagcctaaaaacactattaacaagtaactctgaacaaacttggcaaaagttcaaccaactttttcagcaccaattcactaccttcaatggccaccttttactatttgatcaaggtagccacaatgctttgggattagccgattacgatcgttacttatgggcgttgctctggcaaggtagtggtttagtttttgccatcagttacttgagtacttcattttatagttggcggactagtcgccaagcattgaattgatctaagtagcatcccctctataaccattctaaaattatcgaatgggcaacctttcgcgtcactctctagtaaaggagcaagcttatgttctctttctatccaactaaaaatcaaattaattttatagataagtggcaaacagtcttcacacccgctcaactttacttcatccatgttccactagctgcgcaacgtcagcagatcattaaatactatctaaagttatttactcagcaccatttaaataagcgattaggcatcatcacagcgcaaaaagatatcttactaccctatttaagtgttcgggaaaacattatgcttaatttaaatggcagtattaagaaaaagcaacgccaactacaaactgcacatgatcatgctttttttgaaaaggatgccggtgagctaacggcgagtgaacgattttatgtacaactttatcgtaacgtttttgctggtaaggatattatcttagttgatgccagtcttgacgaataccctcctgcagaaatgcgtgctgttctggttaaattgaatcaactagtggtttctagtgccatcacaattatttttttaactgctaaccaagaattattgactagtgaacgcgaacaaagcctacgcaccgcaccgttcttagaagaaacacaaaaaaaagtttagccattcccactttctcgtggtgggtgactaaactttttatttttctgtcgtagtttctgctcgactagcaacctcatcgggaaaactaattgtaaaggtcgttccagcattaagtttgctggcaactttgatctcgccgccatgcagttgtactaactgatgaacgatagctaaacctaaaccagactcaccgtacttggtatttttacgtgatggatcagccttatagtaacgttcccaaatatttttaacttgatcagctgacatcccgatccccgtatcttgaaccgtaaagatggtttcgtgataaccatgttttgccgtgatcgtgatcgttccatctttagtaaattgaattgcgttttggatcacgttaaacatcacttgcacaaaacgatcgtaatccgcatagacttgaacggttggtcctggggttaaaatcaaatcatcattggcgtcattggactttttggtcaattgcataataatattctgcaaggcttcagtcgcattaaaattacgtctggacaaactgatttgattggtgcgaattttttcgtaatccaaattttcattaacgatgcggatcaaacgcttagtttcattttgtatcagctcaatgcttttaccacgcatatcttctggaattgcatcgtactgcaatccttctaacagaccattgatcgtcgttaatggtgtccgcatttcgtgtgcagcatcagccatgaattgccgccgccgttcttcttggcgtttgatctcattccgtgagtcacgcaatgaagtcgtcatttgattaaagtcgaccgctaaatcatccagctcatcatgatgtttagaatcaatttgaacatcaaaatcgcctttagctaccttatgggcggcaccccgtaatcggttgatccgcagaatttgatacttagctaaccaaaagctaagtgccactgccgctacactggaaatcaataacgccataaatagattatgctcaatcttaataatattggcgtgcacattggaaaccagtgaaccgaccgaaataactgccttcaaatcaccatcataaaaataaggtactaaaacatcagtcatttcctgctgattattcagtacattagttccgtgatcagacttacgataaatacgtttaccttgccgcagcttacgccaatccgttttcgttaacttacgcgctaacttaggtccatttgcattagcaattggataaatcatctgatttttgtcgttaaaaattgcaaaatgcaccttttgatgggataaaacagcttcactattactgagcatactaacctggaagcctgtaaaggtattggttgttttatcgaccgtcatcgcttgctgcattagactgtcggcataaccttccaactgatcccacgtattttcatagaccattttatccgtaaattgaacgaagaaaagacccacgactaacaatgtcgtcatgatcacggcaaaaaaagccagcatttgctggtagatcagtttcattgagccgtcacatcggaatcatcgaatttatagccgacaccccataccgtttgaatgatttgggggccgactttttcgattttttgacgcagctttttaatgtgagcatcaacagttcgctcgtcaccataatattgataatcccacaccaattctaacaactgttcccgcgaaaaaacttgtttgggttttttggctagggtatgcagtaaatcaaattccttcggtgtcaatccttcgattggtttacccgctaaataagcttcacgggtcttagtacttaatttgaagtgatcggtcaccacatcaaaatcggtttcagcattatcattatcagtctcattactcgcttcgcctaactcagcccgccgatgcagagccttgatccgcgcaattaaggtcatggggctaaatggcttggtcacatagtcatcagcaccgatttccagtcccaacacctgattgctttccgaatcacgcgctgttaacatgatcatcggtaccgttttagaaatcttacggatctcctgggcaacttgcatcccgtccattcccggcaagttaagatccaaagtaatgatgtcccaactatccggtgccgctttaaacatatccagtgcttcgttaccgtcataggcgaagctaacttgccattcttccttagtaaaaaacatattcatcatttcggagactgatttattatcctcgatcattaataagcgcatattcatatttcctccgtttgtcatcattttaccacgagcatttacgtcatccgtaaacaggtcccctaacctgtccatcaattcatattgcccttattatacaatatctagcagttattgtgggcctttgccaaaaaagttgtgctaacttcactaactattcacatttctgtctaagttccatggctgtcttttcggaaaactttttgctacactgaataatgacttttaatttattttagaaagcagtgaaaaaatgacctatcgtgcgttagttttcttcgacttagatggcactttaatgaacccacaatcacagcttgatgcggatgtccgcgccgctgtgcacagcttacgcgatcaggatattttgccggtcatcgctactggccgctcccgcggagaaattcccgaaatctttgaacaagctggcattgatacttatgttgcccttaatggtggtgtcattgtctacaacggccaaccgatctatgaaggcgccattgcccccgctaccatcgaaaaaatgctcacagtcactgaatcacatggtgatgcattggcctactataatggcactgattttcggatttcacggttaaatgacttagttaaagcgcaatacgattttgtcagcaccccttacccacaggttgaacgtgatttctaccaaaccaatccggtggacatgttattagtgatcacggttgataacgacaaacgttatacctatccttatggcgatgagctcactttttatcgcaacaccccttatgctttggataccgtcttaaaaggcgaatccaaacaattcgggatcagaacattgatcgataaaatgggtttggctgacgtacccacctatgcctttggcgacggcgtcaatgatattccgatgttgaacaccgtcgatcatccgattgccatgggcaacgggatcactgcagttaaggatcgtgccgaatacattaccgctaaaaatactgaaggtggcattattcagggcttgcgccattttgaattactaccataagctaaaaaatacgccagtcaaattgactaggcgtatttttgtaacttcaatttaaacgacttcaacatgtaaaacatttcgtttagcccagccaatcgccaacatgcctttgtggacggcgaacgtgatcactgctggcagtaagacacaggtacccatgtagacccagaacatatgcatatttttcgaggcaaacgtgatcggtgcaataaacgaattcaagcctaaaccgcctaactcataattagcccggaaaccgaagcccatgattgcgatcggtgccgccacaacagcagcaacaaacggtggcagcgccatttgcggatgtagtaacagattagggaattgaatcttcggcgtcaatactccttgggcgatattagcacctaaattattttcgcgccaggacatcacggtaaaaccaacaaattgtgccgtagttccaaccaaagcagcagcggacgacattggatccaacatcaacgcgatcgacaatgccgctgacgatgccggtgtcattaaaaataaactccacgtcaatgagataaccattgagccaaccaatggattaacttgcatcgaattagctaaaaaagccgaaactgctaataaggccggcgttgtgactgcagccaatcctaagccagtgattccaccgaccaaggtggccgccagcggtaccaacatcatatctagcggcgttttccccgttaaatatttaccgactaaagctgccaccaaaccggcagcaacggctgaaatcggctgacccgtagtgaaaacaccagagccagcagcttgtagtaacgcatgaccagtagcagtggtccctttagttgctgcatcagtaaaaaataccgcatttgaccccacggttgccgcaatcatactggaaaacataactaaactattggtccgtaattgcatcgcaattgccgcgccaaaagccggcgctagcatgattttagccatcgttcctaccatatgcaacgctggccaatggacaaagtttgcgattgattcgatcaacaagccgattcctagcatcacgagaattgcattagaaaccccagctgatactttataaacgtaatctttgatcgataacttctcctgattttgcgccgtctctatcatcataacgccccttttcataatctaaatagcatttatttctaatttaaatgagaattttttaatcttgttcatgaaattaaaccatgaaactgtagtggtcgtcaataaccaacactagattgacatctatttgtaatagatagcgtttgcttatttatgagtttattctcatttaatgtacaggaaacaaaaaaatagcagcttgatcaagactcgatcaaactgcgatttttgcttatttattcttaaaattaatcataaatgctagtagttgttccttggtcaatttcccagccaacgccatttcatcattgatgcgtacagcaccgtgcgtttgcagtgccggcaaaacttcaccgatcgtctgattactgtcaaacaccggtaattgttgatctgatgccgttaatggttctaagtagcctaacactttcaagcggttgaggtaaaccccataaatgtcattagtttgggctgaggcaaacattttactgacaaattcgttggccggttgctgggcaatttcgtcaggcgtaccgacctgcactagttgcccatgttgcatcacgccaatacgatcgcctaattgcaatgcctcattcatatcatgggtaacaaaaacaatcgtactgtttaatcgctgatggatcttcaaggtcaacttttgcagctgctcacgggaaattggatccagcgcactaaacggctcatccatcaataccactttcggttgccccgcaaaagcacgaatgatgccgacacgctgctgctcaccaccagataaatcactgggtaagcgctgttgataagttgctggatctaggccaacttcatttagtaagtccttgacccgagttttgatctccgttactggcatacgtttcatttctgggatcaagctaatattctgaccgacagtcatgttggggaacagcgcgatctgctgtaaaacataccccatctgtaaccgcaattgacgtaacggtaattcattcaagggttgaccatgataatagattgtgccactggttacctcttcaagtcgattgatcatttttaaagtcgttgttttaccactaccggaagcgccgaccagtacaaataattcgccagcctgaatcgtcaaattaagctgcttaaccgcataattttcaccaaactgtttactaacttggcgaaattcgatactcgattcggttgtcatcagcggtcacctcccaataaatgatgtgtcactagatactgatgtgcgactttagccgctgatttgcgtttaacgttaacttgataattcatttcctgcatatccgctgcagaaatcttaccctgcaaacgattcaaactacgtacgatctcgggatgagccttagctgttgctgtccgcagcaatggtgccccctggtaagtcgggaatagatgacgatcatcctttaacacaacaagatcgtattggcgaatctgagaatcagtcgaatagccatcggtgacattgactttatcttgctgcaaggcttcataacgcagatcagctgacatcgactgcgtcttgaagctaagaccgtagcgttgctggattcctttataaccgtcagttcgatccaaaaactccagatcaaaaccagcgttgatctgccctttgactttggctaaatcactaatactatgcacatcatatttattggcaaatgaacgcttcaccactaaagcgtaagtattattatattttaacggctctaaataagttaagtcatcctgtttttgcagtgcggttttagcttgctggtaaattccattagcactagttgccgttttggttggctttttaaccaaactttctaaaactgtgccagtaaattcaggataaagtgtgatctgttttgattttagtgcactaaataggaacgaggtttggccgaaattgggctttaaggttactttaacattgtcgttatcggattcgatcaaatcgcgatacatgttgatcaaaatctctggctcggagcctagtttaccggcaatcgtaatctcgactggttgcggacgcacaagtcgataaacaccaaagccaccgcagccgaccacaaccactgccaacgtaatcagcaatggcttgattttaatccgcttgacaccccgtaaagctaaacttagaacgattgctaataaagcagaagccaaagcaccgatcaaagtcattgtattattgttgcgattgatccctaataaaataaaagttcctagaccaccagcaccaatcaaagcagctagtgttgcagtcccaatgatcatcactaaagcggtgcgaatcccggataaaatcattggaaaagctaatggcagttcaactttacgcagtttttcccagcgcgtcatcccaaaagccgtcgccgcttcttctagtgaaggatcgatctcagttagtccagtatatgtattttgaaaaattggtaacaaagcatacaccactaatgaaatcactgctggcacactaccgataccaactaacggaatcaacatccctaataaggccaacgatgggatcgtttgtaaaacactagccaattgcaaaaacacgttggccgtttttggccgtggaatcacccaaatcgccaatggcaatgcaattacgatcgcaattgctaatgagatcaccgataacaacagatgctgccctaatgcagtcagcaatgccgcgcgttgggttactagtgtttgaaaaaagtccgccaagaaagtcgcctcctatatatgtaaaaagcccacaactgcttcactaatgtgaaagttacgagcttcaattcatcacacaaactaaattattactgccacttaaaaactatatataatagtagccaagatcactgcctggtgacggataagctaatatttgttgacctaattgagccttagtcattgtcatcaataaagttaaataattgatcacttcttcagcaatactggcataaacgactgcccccactaagcgctgatcagtacgttcaaaaatggtcgttactttagccgttggttccttgattcgattaaaagtataccactgcgtcacatcttgttctaagatttggtaacgttctggttgttttttagcatcagctaattttacaccaacctgagcaatctgcggactggcataaacgacttgtggtgtaaatggatactcaatagcagtcgctgtagcagctaaaatagtgtgcgccacataactgccttcaaaactggctaccggcgtcagtttaggttgttttttagcaattacatcacctactgcatagacatgcggattagtagtccgcaaatgatcatccactgtaagtcctttggcagtagctgcaataccagccactgctaagtcaagactagctaattgtggacgacgcccactagctgcaaaaactacatcaacgttcaactgtaaagtcgtattggtcgccaaactataacgatcatcatgcttagtgactgtggtcaattcggtatcccaatggaacgtgattcctttggcagtcattgctgctgagagcaactgcgtgtaatcctccggaaaatcgcgtaaaatccgctgattatgttgtagaatatgcacttcggctccagcactagccgcaatattagctaattccaaagccacgtaaccagcaccaataaaggcgatccgccgtggtaacgtcggcaaagctaagaaatcagtactagtttgcagatactcgcgcccattaatttcaggtactaccggtgcttggccagttgcaataataaaatgatcagcttgataacgtgtttgatctacttgaatttgatcagcagccacaaagcgtggttgcccatgtactgtagtaatattagccgcctgtagtccagctaaagtcccactaggaatttgatccgtataagcgcgcttaaacgccattaattctggccaatcgatctctggcacacctttcaaaccaaattgctgtaaatgatgtgcttgatcttgagcttcaacggctgaataaagcattttcttaggatcacaaccacgattagggcaagttccaccccaaaggttattttcaatcactaaaacatgttgttgtttagctaatgcataagccgccgcattaccacctggcccagcaccaataatgattgtatcaaatttagttgccataccttgcctccatttaagtagcgcgttctctttgccaaaaatcaacttttaccgtgatatctgtcccaagtttagcacactacttaatacgaatactcaaaatatgcttactatgacattagcaaaggtaattcagccgtcccaaaataaggaccttctagataatcaacataatcttgattctgtaaccaagtaaacatgctttcatcggccacacccgctacaataaattcaattttccaattagttgcgatttcaccccaaaactgaatgtccttacgcaactcaggaggcattccaatagcatcggttgcggactgaattgtcaatttgattccatcaatgtattgcaaactggcattaacttgttcaaaatgacgattgctgccaatttgactgagtacgattttaatcccactttcatgataaaatgctgccattggaatcaatagatccagcactggaatgcgatcaatctcaatatacataatttccggaccattcggactattaaagaatttaactagtttatcggcagtagtctggttaagaaagttagcgatcgataacgacacaacgatcgactgacagcgactattgactaagacgtcacgcatcaattcaatccgcgtattaatattcaaatgccgctgttctggaatcacccaagtttgcttctcacgatcatagcgccgcaaagttaattcattagctgctcgccgctcatcggcatcacgaccgctagtataaattccctcaacaaaataagcatagctttcccgctttgaatcatcttgtagttgctgcgttttgccatcgacggtgatcgtatcacgaccattctttttactaatatataatgaatgatcggcccgcttataaacatcatcaggtgattgatcgtgatctactaattcagtcaagccaaaggatacggtaattttgatcgtgtccttatcatagacgtactcagcagcacgcacggtccgccaacaatggatcaagatcgctaatatttcctgcgccgaactatctggaaagactaaagtgaattcctcgccacccgtacgataaagttgatagttttcactatattgcaatagaacacgctttagggcgttagcaacctcagttaatacttggttaccggctaaatgaccatattgatcattgatcaacttaaaatgatcaatatccatcatggcaattgccaacggttgatgcccagtacgtgcaatcccaaaggcgttaaagatctctttctgataagccgtaaaattcttggtattagtcaaacgatcataattggcttgatgagcaacttgctcattgtgcgcccacaaattctgctgtcacccagtagacaatttcatgacgaagaacatcaaaacagcttcgattgaaactgctggcgtcataaccatgctggccgaatgggtcggtagcgtaaaccaaaaatcgattgccacaattgacgatactaataagcgtaacgggaagcgcgattcgatcgtatgccgaaaacgccagaccacaaccaaaataatcaccagaatgatcattgaaatggcaaaacgatcaaccataaagtgacccatatggtgcattaaaccgtgatcaacgccacacaacgaatcaaatactcaccaaaattaatttcttcatcaagcaacgagaaaactaagatgaacagaccaatattatggtacatcatcgaagtgctaccgccgagataaccagcaaaatgtaatatcgagcctaacccgatagctaaaacaatcaaagcgacccgtaaccaaatacgttcggtacgcgaacgctccgaatcactaaatgcacgattccaaacttcagtataaacgcttacgaaccccgcaataaaaaatattgcgacggtcagctgtgctgcccatgacatcgcaactactaatagatttgttccatcttccactgtgtggtcccccaatacgaacaggataccgacctttagctattagataacgcataatactagcgcatgattaaagccctagatatcaattacctagggagtactaaaaaccactatcactgcaaaaattactttagttgtgacattaaatactaatcgaactgaactggtcatcaatggactataccaatatacaaagaatatctttatgcatctggcattgatttgagcgaacgcaattgcatttccgctgacaaaccacacccaaaaataacgattgatcagcataataaaatatggcagattgcaagaaataacttgaacaaatttagtaacgcagattacgcaaaaagatctcaatcggtgttcgccaatttaaacatttgagtggtcgggaattcaaataccagttaatttgaatcaattcatcatcggtaatctcatcaatcggttgacctttgggaatgaagcggcgtagtactcggttgcgattttcattactgcctcgttcatgtggcgaata

SEQ ID NO: 606 - DNA, 4231 bp, Unknown
  Metagenome-assembled genome
tcaaacacccaaagagcttttctccgctgcttccgccggttaagttaagtccataaaatatgaatattaatgaaaatactgatttaataggatttatcgtgtggctaatttgttcttgcaatttgggttaaaattaattctcctttaatctatatataatgtgtgtttctagtttgtaacatttaaaaacttagcaaaatccaatccagaatataagcggctaaacttaaatgcgatgtaataactgtgttgagacacttgaaataaagtgacttttgattgctgaaatagtatgtcgcgcgacactatataatctttagaataacttaaaattagctcagtttttcatactaaccttactaatttttataaaaaatccaaatcgtaaactttatatagttttccaaatttgctttacacaggtattttataacgtggcgaacataagttcctggtttgtgatagaatataagatgtacaattaaaaagtaaatactgttgatagtactaatttaattttttcagacaattggattaacattcactgagacattaaattctactgggaaataaactaaataggtaaggctatatttttattttacaaataatttattgatttttacgtatattaaatatatcagtcgtaatgcataatctataattacgttttaaaagtaattgggtaataagtgatcagtctaaatgttttaaagtgactgatattctatttcatgtaattgatgcattgtataaattcacgtataattgaatcttataatgatggaggtaatctaaatatgactattgataaagactatatttttaataaagattgttttcaaacgattgaaaaattccaagcaaaatcacttgatttaattgttacttcaccaccatattgggctaaaagaatttataactacaagggtgaattaggtggtgaggctactccagaaaagtttgttactaccctagcagattattttgataagttttcgatgtatcttaaagatgaaggtaatttatttgtaaatattggggataccttttttggttcaggtgccggtgcttggaagaaatatcttgataaagatggtcatattacagaaacacaaaaacaacgaaaagagaaatactttactacaaagccactccaacctaaaataaaacagaatggtagactttatcaaaataaacagttattgatgataccagcacgatttgcaattgaaatgcaaaatcgcggttggattttacgtgatgatattatttggcataagccaaatcgtattcctgctagtgtaaaagatagatttaacaatacctacgagcatgtatttcattttgttaagaataaaaaatattttttcgatcttgatgccgttaagattgaaggaatgaacggaaagcttaaaaatcctggggatgtgtggtctataaatacacagccattagcgggaagccacacagccacttttcctgaggctttaattgaaagaattattaaatgtgcctccccaaatggaggtgtagtatttgatccatttcttggtactggaacaacctggattgttgctcatcgattacatcgttttacaataggatcagaaataaatactgaattttatagatttgcattaaaacgttttgaagaaaacaaagaagttgtaaaacaattaagccttaatattaggaagtgatgtgggcaatgttacagtataattataaaaaaacatgctcttgtaatgagaaatatttagcttgtatttctgcaaaagattggatgaaggatcagattggtgtatggacatttaattatgaatcacgtgatgtacgtgataaaaatttacatccagctacttttccgatcagtctggcaagtaaattaattactttgttttctcatgaaggtgagcttgtaattgatccattttctggttccggtaccacacttgtagccgcgcaagatttaaatcgtaatgcaattggttttgatattaatcaaagttactgtgacttagcaagaacacgtatatcacaattgtcattagaagagtctgagcaatttgttgtgaatgatgatgcccgttccataggtcaatatattgttcctaatacagttaaactagttgttacatcaccaccttatgcaaacttactaaatcgaaagcgaaagaataaaagtagacgaggggaaaaacgaaaaaatgagcagtttgataagatagaacagtacagtcaaaataaaaatgatttagggatcttaacgcctgatgcttatgagaaagaagtggaaaatattttttcagatattaatccattattaactaataaagctcatgtactaatcaatattacagatgtatggatggaagggcataggattccattacatatcaaaataataaatgctatgcaacatgccggatatgaatttagaaatacaattatttgggatagacgcaatattgttaatcggattggtatttttggatggcccagtagctatataactatgggaaccacatttgaatacattttggattttatacctcaaaaataaaagtgagtatttatttaaaaaaggataaactatattctacacaaaatatagtttatccttttttatcaatagcttatatcctaaattatcaagaattctatattcaggtcggagcttcaactcttggcagaatataagtgacgctattcctggattatttcattcaactacatcattttttaatttaatatgagaggtgtgtacccttaatccaataaagtctcagtatacctaaattgatattttagttacacagtgatagctttctcatataaatctaacattaaatttttctttattctgaatttagtgccgtgattgtggcctgttcgagcatcgaaatcaattgccataccacctgtctctaataatttgagaagtttctccactgagggattgatatatgctttgaactctttatagtcaaaaaattctttatcattttcctttttgcttgatacttgcataagtattgtgtttttaagttttttagcaagcttgtcttgaattgtctgaaatgtccaaaaaggcacaggattaaatggtacgcaacaaccatttactgttaactgctttttccaaagttgttgttgagattttaactgctccggatcaaaaacaaagaataccttctgttgttttctatcgattttaattgtcatacctctgtcagtatatctatttgcaaatgttgtactccgaaaacttttttcagtacttggatattttaatcctgcctcttggtgtggccagccataatttcgcaataaattaggcacaatcttggctgatcggggttctggttcacagtgaaaaagtgtaacgagtgccgtgctttcttttcttcttgatgtttttaattcccatgatctgaaatctgggagggctagattattttcgactactgataataaatcttctaaaagatttccagctctaccttgattgttttgacgagaagtattttctatccaaccagcatcctttatttcttttaagcgattctgtaataagaataggtcatcgtctctagtattaggtaccataattattgctcctttgtattaattttaaagaaaagcgctaaaagtattttctttaaaatcttactgatagtggatatcagttatctttttcattatccatgtggttaagtgcgtattcacatgcttgaagaacaaaacttgaaaaagtcacatctttttctttaatagcactttcgatatcccttattaaggtagttggaaatcgtattgttttgttttcggattcttttttgcttgacttaattttaaaaccactcatagaattcctcctcttaattaaattgtatttcaaatagcatgtaattgatgcattgcatattgcaatgcatataaacctgtaccgttgatgaaaatttttagttaagtacgcgtggtgctagttcgtcataaaatcaaaaaagcctaaattgtataccaatattgtcaattcaatctttaattaaaaaccaaatagactacgggtgagattggtttcaatcccaaattgctgggctaaaattgaaaagcgtgactctattgtccaccgtaacgccttgagttgacgcttattatgctgtttagcacctttcatattagaacgataaggcgtccataagttatagcctagggccctaaaact

SEQ ID NO: 607 - DNA, 1689 bp, Unknown
  Metagenome-assembled genome
aacctgaattatgcatatcttttcctaaaccttaacgagaatgctgctacaccatcgttttacctttgattgagggtttcaccaaaatggtgtaccaaaaaagcaccttccgtgttattgttatagcgaccaaacaataacgaacacaggagatgcctcatgactaacttacacgaaacccaactgcgattcaaccctaaaatcaaaattaagactgatgatgttcaactttcaaataacgcaggcctgttgttttacgccgaatttaagcacgcagctggtcttgaccaaattattgatcaagcggcggcacaattaagcgaaaaacgtattggccctcattattctaaaactagcttactcaatcaaatgctggaactgaatattgccggttacggcaatgatgtcgcggccgacgcgctacaacacgacccagtcatgaaacaggtccatgggacgactgatttagcaccccaaacgactatttctcgttttttaagtgcgctaacttgtgatgatgttctgcacttggaccgtttgattttaaccttggcgctcgattatatcaggactaaccatattgacacggtcatgcttgatgttgattcgacgcattgtgatacctttggtcatcaagaagctgctagtttcaatgcgcattatggggttactggtttccatccgctagtggcctatatcgcgcagctgaatttgcttttaggaatcaagcaacgtccaggcaatcagtacaccagcactggtgtcaaagaattcttagccccgatctttgcggctttttgcgaattgccgtttgatgttcagttgattttacgcggtgatagtggttttgcgacgcctgagctttatacgctctgcgaattttatgatgtaaaatatgtgatccgcctgaagcgaaacgccgctttagaccaactagctgatgaattcacaccagtagtgcccaagcattttgatcagaattcggtcatctatggtgaattcaactacgcggccaagagctggtcgattgatcggcgcgtcctagtaaaatcgacgcatcaagtaggcgaactattctttgaacggcaatatgtggtcactaatatgactgaagccggggtcaaattattgtacttagcctatcaaaagcgtggggccatggaaaacctgatcaaagaaagtaaagccggcttttttatggataagacgaatagccacacctttactaccaatgccgcgcgagcaactatcagcggcattgcctataacttgattgccttgatgaagttaatggccttaccaaaagagcagcgcaacacgaccattagtacactacgctttcaaatctttcatgttgctggaaaactagcccgtcacgccggaaaaataatcattcatctggcgcaaagcaacgtctttagccagcagatcgaagccttattagctaacattcacacgttaagccccttagtgaccaactaagaaaatagcgcagttacttttaaaattattgtgtttgaccaagggattagtggctacttttttgacgcgatcaagtatgaaaactaatcaaactaactaaattaagtcaaacttggctagtcatgactagcccaagtcgtgaatatagagaaattacgtaaaactgataatttggccaatcaatttgatgcatatgcataattcagg

SEQ ID NO: 608 - DNA, 4234 bp, Unknown
  Metagenome-assembled genome
caatacctagattcttacttatttcattcatggtcatgtgatccttgttatctaagtaatactgaacggcctgttccttaaattccttgtcataactgtgcttcgtcattatttgatcctccaatttacttccttaattatactaaatcagagtctctatttaacttgtacactttttattctaggcccaaaccatgaaaaagtacaataaaagatcctatgaatatcgcacgttaaagttcgcctggcggctttatttgaagtatgccggaaatctagatgaggaacatgtcttttatgaccgacacctgcgaaaacaactcacacaactagaacgtgtagaacaaggactgacaattaacgaagaacttaaagcatcgtacgagtcgatgcaaagcatcatggaaaaccttaagaatcaagacaaagacaagcttgtggaagatctatatacaaatcaaaatataagtccctacatgaaagcagtgtttcaaacgttcaaaaagaacttagtggttgtactcaacgccagtgaatcggactatacgaatggcccagtcgaaggcatgaatcgaatgattaaacaaattcaacgcacagctttggattccgtaattaccatcatatgatttcacgtattaagttacggcaaatgagaacaaaaccaatgaaaaaaacagagttgaaagtcgcatggctttcaactctgtaaaagctattcatcaacaggatttgacaaagagccaacaaaagtaacttttgccctaaccgactctttcaacagccgaaatttgatcatctaaccatgttctatctgaacagatcgcatacgctgtttgattctattttgttttcaaatcttcaatcgaattaatattcgtcatatacttcggtacagctaaaccgaccttagcaccctctaagttcggacctaagtcttcaatctgacctttgtaatccttgtagtataaaccagcggtcttcggtaaccatgcggaaacttgtgcatcggctgctttagttgcgactgacgcccacatcggttgaatttccatagcttgaatcgttggttgataaccttgttgacgtaaaacttcagccaccacgttagttgacgcgatttctgaatcccaagccacataggttaacttaattttcgtgccatgaacctttttaacacccttagtccactcagcaactttttctggattgtcttgaatccaatcgcgcgccgccttttcaggttcaacaccgtcattgactttaagcattacggtcgacatttcctttggcgtccaatggaatcgatctaagatggtatatgcttctggcatatccttctttagccccttacgaacaatcgtattaatgtgttcagcttgaccaaaaacatttttggggtcttttaaaaacttgattggatatttagtaaacatccaatgtggttgccaaccagtaatgacgattgggcgtttatccgcaatcgctttgtctaacgtactggtcattgccgcagttgagctggtttgcaactgccagttctgatcattcaaatgatacttgttaattgcagtttgtgtggatgccataatcccagcacccgcgtcaattccggtaatcgtgtaattaatttgaccgcctaatttctcatcggtagcgtacggcttagtttgcgaactgcaggccgttagaagtgtgacgagccccactaaggtgaaaaaagctattaatttattcttcttaatcactgaatccctccttaatgtttacgttgccggttcaaagcttgggttaaacgatcaataataatcgctaagattacgattgccaagccggctgcaaaaccgcccccagcatcattccggccaacagcaaagtaaactcgtgttcctaagcccattgctccaatcattgacgcaatcacgaccattgataaggccaacatcatactttggttaaccccagccattaaggtcgatttcgccaatggtaattgaaccttaattaacttttgccattcagttgagccatatgaatcagaggcttcgatcaattcggttggcacttggcgaatcccaaggtttgtcatacgaaccgttggtggcatggcaaaaatcactgatgcgaaaacgcccgggaccatcccgataccaaagaaggcaacggctggaattaagtaaacaaatgccggcattgtctgcatgaaatctaagatgggtttaaatattgcctggacaatatcgcttttggccatccaaattccaagtggcaccccaattacgagggaaatcagactcgaggttaacactaacgttaacgtttgcgtcatatcccgccagaaatcaaggttccaaatcaagagtaggccgaggacttcaaagataattaaaccccattttttggtgtcgcgattcgctaaataagtgacgccagcgataatcacgatgaataaccagatggggattaaatcaaacacccattggaaagcgttgataattccgccaataaaattcgttaaaccattaaaaaagccagtaaattgtgtcagccaatcgacaaagtgatccatccaattggcaattggtaatttagtaatcgtcattaaattaagcaaaatggttcacctcgtttcctgcaagtgcccctaagacggccccgcgaataataatcccacgtaattgttgcttatcatttaagacagcaaacggaatgcccgtttgcgaaatatcatctaagatatcagcaattggtgtctcttcatcggttgttggaacttcagtattcacgattgattgcaaatcacgactttctttgcggactaactcaagtacatcacgcgcatcaataatcccaactaactcacgtttactgttgacaacgtaagcattagaaacttcattttcacgcattcgttttaaggccaaacgagggccatctttttcaatattaacagtcgttgggcgaatcataacgttgccggccgtgtaaactttactacgatcaacgttttcgatgaatttctctacatactcgtcagcaggccgtgtcaagatatcttccggtgtcccggtttgaacgatttccccatccttcatgatcatgatgtggtcgccgattttgagcgcttcatttaaatcatgactaataaagataattgttttgtgcatcgtttcttgcaagtcgagtagttggtcttgcatgtcagaacgattcaatggatcaagcgcagaaaaagcttcgtccattaataaaatctcagcatcattcgctaatgcacgcgctaaaccaacccgttgttgcatcccaccagataattgtgtcggatactgatcgccataaccatttaaaccaactaaatcgagtgcttcattcgctttttgttcccgtgtcgccttatcaatgccttgaatttcaagcccataggctgtattttcaagaatcgttcgatttggaaagagcccaaaattttggaataccatgctcatctttttacgccggacttcacgtaatgccttcttatcaatctgcattaaatcctcgccatcgattaatacactaccttcagtaggctcaatcaaccggttgatcatccgaaccaatgttgatttaccactcccagatagtcccataatgacaaaaatctcgccagattctacttcgaagttagcccggtcgacaccgattgtcgcacctgtttcctttagaatcgctgcttttgattttccttgtttcagtaattctttggcacgcggcacgcgcttaccaaatatttttgttagatttttgacttgtaatttgatagtcatagaatccccctttgatttcattttctgaaaactatatctaaaaagtatacaggtttattgtgaaaattgcacaccgtccacttttattctcattttattctaatgtgatagttaggtaaccaactttctttaaaaattaaaaaatcgctagatggggctttatgttagtctttaaaaatcagattagttctaaaacggaaccaatctgaaaatgcaactattttcctttgtacattaaaattaaatgagaattaatcccttttaaaattcacaagcccttaattaggccatcaaaaaaagcggttctatactttttcctgttgatagcttacttaacatggtaatctattagcaggattttttagtgcaaaataaaaaaggcccataagcctcgcacctaaaaaatccacccactacagcatcttttt

SEQ ID NO: 609 - DNA, 29509 bp, Unknown
  Metagenome-assembled genome
tcttcaatcagttgaagaactttcgcaggattgcaacgcgttatgataagctcgctcatgtttatctggctacggtctacattgcctcaatttgcatcttacttaagtagttttcagacggaccctaaaacaacgccacatcaattatttactttgcatccccatgcaggtgaatataatatcatcgagataaaaggcacccgtatccgcgacaaagaagataacacgcccgaccagatcgccgttcataccagctggatcaataaacctggtcagcagagcatctgcctacctcatcgactgatcatcacgatcaaaagtagccgcaagtctgcttcatcaggcgacccgctggtgcaaccgtaatgatcgactcaaaaagcccttaaagcagcgatcactctgctttaagggtttcttcacatctagttgatgttggtcaatcttcaaatatgcagcatatgaataaacaaaccagaaaggaagatccacgcacagatcgcgactaagtagcctagaaaataggtcatacttttcttcaagatcgtgccttcttgaccttgtaaattagttgccgccgaagccaccgcaatactttgcggtgagatcattttaccagcagtcgcgccaaccgcattggccgcaactacccagtaagtgttgtcgtgtagcgtgctggccgcctgccgttgcaaaccgccaaataaaacgttggctgatgtatcggacccagtcacaaaagtccctagcgccccgatcaacggtgcgatcagcggatagaacacgcccaatacgccaaccaaggttgcggcgatgatcgcgatcataccgctataacccatgaccttagccaaagcaacgatcgcgcagacggtgatcagcgtctgggtcatttgccgcgccgttttgccgaggatcttgaaaatctcacctagcggcattttctggatcagcccaccaatgatcgtggccaaaataatcagcgttcctggcgttgagatccaattaaacacgtacggactggcgccggcgccggtatagatcgtcagctcagacttaatgctggtcagaaaatgattcagcggtggcactagtggtgaagctaacataacaaaaacgaagacaaggataaatggcattgccgccagcacaaatgcttttgctttaggcgccgccgttgtcgttgcttcggcgctggggtgcttgcgttcatagcgcaaagcaaaccagaccgtcacgatgatgcagatgatcgaaccaataatagcgggtaattcagcgccaataaaacgcgccacaaaaatctggggcacaccaaacgccaaaccggcagccaaggttggcatccacacctctttgatcgccttaatgccaccgccgatcagcgccactaggataaacggaataatgacgatcagcggcaataattgaacggcaaccaggtaggacaaatgctgcacatttaggccactgatctgcgccaaagtcgtcaccggcaagccgattgctccaaaagctgtcggcgtggtgttggcgatcaagcagatcgtcgccgataaaatcggatcaacgccaaacgcgatcagaatactagcgggaatcgccaccgccgttccaaaaccagcgatcgcttccaaaaagccgccaaagccccaagcgatgatcaaaactaacaaacgtttgtcactggtaatactagataaaccggtgcggatcgtcgccatgctgccactggccgtcgtcaaattatacgtaaaaactgcggcaataatgatataaacgatcggccaaacgcccatgaccgccccttctagcgcggcagttaaactatcgaccaacggcattttaaacgccacgatcgctaaaaccaccgtcagtaccaagccgatcacacaggccttactccctgccatttttaaaacacctaatgaaaaaatcagccaaatgatcggcaataacgccactaaaaataaaccccactgcatatgcgcatcctcctaaaatgaataatcagatatacattttttataatatatgaattgtatccgcttacattagtgaagtcaagtttctttttactagtgtcatttttaacgggcaacgcagccgctttatttcgttattcggctaaatgatcgcgtactaaaaaaagcgcgctccataaacggatcacgccaaatatgatcaatgacagctgcagccatctgcaccgccacaacagccaccaccagtattcgcgggcacaaaatctagatcagtatagactgaaagctcatccaagcttggatacgcaccagttttaacgatcgcaccgtctaagacagtgatcgggaaaatagcggcagtattgtgatcaagtaccgccttaatatcagcacgttgcgcaaaaatcgccggctgctcttcgaaattatagcgttgcgtctcaataaacgggactggttttaatgccgtaaaaacggcggcgatcatttgcatcacaggattatccgctgaataatgcgcagcctcaaataactcaatttttgtcatagggggttcacaaccttaacgtagaataatctcaatatagacagcgcttacctaaatgtcaaatcaatctcattttttcaggtaataccctaaccgacccacacaaaaaaagccgcaccgtctttaactggttagagagtggttggaaaagcacccagcttatggaatataacctagctagataataagcaacacgcagtgatgcgtttgactagcgtagttatatgcaataagctgctttttcaaccacgtttacactaaatgagtggtaaaaactaacttaatagtattttccagacactaattagtcaaagaaatcggccgactttatgtccccctttttaattagaatgtggttggaaaagcgcccagttataggtaataagctactttttcaaccacgtttacgctaaattagcggtaaaaactaacgcaatcgtatttttcaaacactaactagcccgaacgtcagttggcagccatgttagtctgctttgccgctgtttgggtgaaacgttggcggatcacgaatgataccgtcagcgcgatcaactcgagaatgccgaaaataactagcgttgaattgtaactatgcaacaattgatgtgagatcgacaaaatgactggaccaaccaagccggcaataccccaggcggtcagcacatagccgtggatcgcccctaggtccttggttccaaaaatatcgctcaggtaggccggaatcaccgagaagccagcgccatagccagaaagaatgatgcacagcgcgatggtgaacaacgccggtacatgcagaaccatcaggctcaagatcaagatcgcctcaacggtgaacaccacactaaaggtcgtcggtcgacctaaataatcagagaccgttgcccagactaagcgacctaagccgttgaaaataccgatcacgccgaccatcaacgctgcttgcgtcgcactcatcgcagtaaactcttgagccattggcgccgcagcagcaaccaagccgatcccacaagtgatattgatgaataacatcagccacaacaggcgaaattcccgcgttttgaccgcctgattggcagttaattgttgaccgttcatcaagctgacccccgctgcagcaggagtcaccgctgcggcagcatttacttgatcagcctttggcggtcgaatgaattgggccgcgatgatcatcacgataaaataagccgtgcctaaaatataaaaagtcgcttcgatccccacacgatcaattaaaatgtgtgcgatcgggctagtcagcatcgccgcaaaaccaaagcccatgatggcacagccagtggctaatccccgccgcttcgggaaccatttaatgatcgttgaaactggcgtaacgtaacctgaacctaaaccgataccccccagtacaccgtaagccaaatataacagccacaactgctgctcatgaatcgccagtcctgtagtgatggtgccaataccgtaacaaaaactggcgatcgtccctgtgactcgtggcccaaaccgctccactaatcgccccataaacgcagccgacatccccaaaaagaagatcgcaatactaaacgcaaaagtgatcgcagattccgaccaattcgtttgtgcttggatcgattgagaataaacgctccaagcgtaaaccgaaccgatcatcagatgaaaaataattcccgcagtagcaacaacataacgattaattcgcaatactctgtcccctctctatgcaaaaacagaacaataatcaaatcaccgatgatacatttagtatataacacgaattataaaatttcaatatcggtttccgttcgttaatcggccatttgttggttcaggtcaaaacaagcaggacgtgtgctaaaagtcggttctttcggcaataataaaaggccaggacttctgtccccgccttgtcgcgatccaacttaaacaaatggaccgttgagcatattgaaataagtggtggccaacgccgcttcattggccagcgtgaattgatattgctgcatgatctcattagttgccagctgttcaaccagctcattacactgatccggcatgaccggctgctgccgataaacatagtcgtttttagtcagcgcggttagaaaactaattttgaagccataccaatagccgtaaaaataaatatctagtagatccttaacgccaaaacctgccgtggttgcgcgttctggagcgacccacggcgctaatttgacgtcggctaaaacctgaccgcgaatacgcgcgtccattagctcgtaatcaggcgagtcagtattttgcagtcgttgcttcaacgttcgataaatacgcaaaacttgaacttgcatcgttcgggtataatcaggaagcgtcgccgccagctcacgaatcggcacgccacgatcctgcgcaataaaatacccataggccgcttcgacgccgacggacatcccggtaatatacacatccgcaaagcgcgtgaatatctgactaaacggttgaccgtccaaactggcgatcaacgtgcttagctcaagccgcgcttgaccactagtatctgccattagatttcctcctctacctcacttaataggttaagtttattagccaaaaacgctaataaacttttaatgttcatggcgatggccattcaactactactccgcaatcagagtgaggtatttgtaaagaccacaaatatcttttaacgctacggacagtgtccattcttgtggtaaaacccgtaccgcaagaaatatggcaaggcaaagaccgccaagttgaaacatggctctacctcattgttttaagttcgtcattattaaccaatagaccaccgcaactttagcaaggcttgacgcgttcgctataataaagaatacattcaatcatagacaaggagtcctacttatgcccacaattaaaattagtgctgcattgaccacattgatccaagcaaaacaccttgctgacaaacaattgatcctgatcaccgatgatggcggtggcaagtattcgctgcacggcggtgcttgtacgatcggcactaagttcaccttgatcagccttgaccaccctgatccagcctaccccgttaaattagaaaacgaacagcagctacacctttggacctccacttacgacttacttttcctaaatccaggggtcgccatggactatcgtgacggccggatctcgatcaaggataatgcacatttattggatagcgccgtccagatcgctgatggcgctgcggtgctagcggcatttgaaaatgggaccacactttgatcctcaggcgagcgcacttaagcgttgaccacaaatttagccgcttgcccttcttcgaccctgatcacgttgttagcgacgatcgttcccataagcgcgcgggcctcaaccgtggcattgccgatatgcggtgttaagatcacgttggtcagcttttccagtcctgccgtcactttaggttcgtgttcgtaaacatctaaggcggcaccagcgattgtttgccgttgtaaagcagctagtagcgctgattcatcaacgatcgggccacggcctacattgatcaagtaagccgtggccttcatttgtcgaaattgtgccgccgcaaattgatgatgattttcttgggtttgcggcgcattgatactgataaaatcgctgctagcaactagcgccgcaaaagggacatacgtgacacctaaacgccgttccgcagcaggcgtcaaccgatgtggctgccagtattgtaccttgacgcctaatccttgcgcttttgcggcaactgcttgaccgatgtggccaaacccaacgatacctagcgttttaccagcaagttcatggcctaagaagtacagcggcgcccagccgggaaatccagcggcacgtatttgctgatcaccttcaacgatacggtggctaagcgctaacagcaagccgatcgtcacttcagcaaccgaattggctgaaattgccggtgtattgtgacttggatgccctttgttttcgcgtaggccacatcaatattattaaaaccagcaccaaaattagcgatcagctttaaatgcggcgcagcatcgatcactgccgcgtcgacttgggtcgataacggcgtgatcaaataatcgatctccctgacctgacttaataattctgtctgcgtgatcaacccagttccggtatacatcgccacatccaaatattgatcggctaatatctgagtcgtgacgaccggcaacttagccgatagaaaaactttgctcattcaaaaaagacctctttacatgattagcacacaaaaacggctagcgcatgatcagcgcaattttagccgtttttttcgtgactgctgagttggtggtagttggctacttttctataaaaatacctgcgtttgtgcgcttgctagcgtcgtttcttagcgcaagcgattacactgaatatacttattttgtataatcgtgtcaattaattttataaaaaatgttattcgttcacaatctattttaaaatcagtgtctgcaagcacgcctgccactcgctaataaaattagtcccaaatttccattcagcgtggggctggcgcccatagccgactggttggcaaaaatacgttgtgccattgatctgccgcggtgggtattttgtatgcgtatggccaaataatacgtagtcgacttgcgaacgatctagtaaagtggctagctgcggtaatcccatcatcccgttcgccatttcccagtggctcacctgcggcacatgtgtaatataaaattcctgtggcacgaaatgtgtcatataaagcacttttttatgctgcacctgtgcccgtcgcaacagtattttagtattagtcaagaccagcgccatcctgcgttggtcgctgagcggttgatcaatgcggccatcgatccaataagtctttttccacttaagaaagtcggccgtagttttaccttggacttgggcaaaacgatagtcgtaccaaccattattaccgatcaaaacataatcagtatcaggaaaatcaatcattttttgatgtgcataatacgaatcgaccgaaccatatcgtgattaccagcaataaaaaacaggcgacaagttggcgccagccgccaagccatttcctccacgaaggcaacactttcgctgaagccgttgaataaatcacctgcaatcaaataatcggtgtagtggttagccaacaaataggcgacttgctgctgcatcgtctgggcaaccgcgacttggttgacatcaaagtgattatcgctggtcattgcaattttttgcatgctatacctccagtctaaaaactaatttgacctggtccacggccacctcattccagtttgaaataaatcgcagcacctgggaaaaaatgctttagtcaaattaggtaaaattatttttatctaaaatatatatttataattactttttttatatatcattgtgatgaaatacgcttagctagttagtgtttttagcgggttaaacttcgatttgacggcgaactttgtgatactataccataatcgtaggccggattcattaggtataatccctattatcaggtattgacaacgcttacttaaatgattattctaaattcacttacagattaccaaattttatataaacgaaatatggaggggacattatgcaagcagcacgaatttacggcgccaaagatattcggatcgaagacgtgccactcacgccaccgcaagccgatgaagttcagctcaaagttaagtattgtggtatttgcggtagtgatctgcacgagtatttagaaggctggggcttacctacacagccctacccgctgaccggccaaaccttaccggtgattgaaggtcatgaattttctggtgagattgtggccgtcggtgcggccgttacaacactagctgtcggtgatcacgtcaccgtcgagccgatcattgcttgtggcgactgcgaaaactgccgcaaaggccaatacaatatttgcctgaacgctgtggcagcagatgatgccggtaattttctcggtttctcagcaaatggtggttttgccgaatacgccactgtcaaagcagccttcactcatcaattacctgccggcatgtcttatgaattaggcgccttggcggaaccgaccgcagtcgtttatgaagcgatcaagaaaagtcggctacgcgctggccaagatatcgccatcctcggcgctggcccgatcggtttattgactgcgatcctagccaaaatcgccggcgccaaccacatctttgtcatcgatgtggccccagaacgcttaaaagtcgccgaacaactaggctttagcggcgttttcaacccaagcgacgctgacgttaatgctttgatccgccagcaagttcccaacggtgtcgatattgcctacgaagctgccggtgttcaaccgacttttaataccgcacttaaattgatcaaacgcggtggtattctgcaagtgatcgccttattcggtaaaccgatcacatttgacatcaccaatgatgttatcactgaaggaatcgatatctacaccacgatcacctatcaaaattcatttccacaagtattagggatcatcgacaacaatcgggaactgatcggccagatcatcactaagaaaatcagcttagcacaactgatccctgaaggtatcttagcgctgacgcaagataaatcgcaggtcaagatcctggtgaccccagaataaaaacccactcgctttaatcaagcgactaaaaaatcagcacaccgtttatgtgctgattttttgcgttcttatttaggctaacaaggttattagcgccgatcagttttaaaggccgtacgcagttggatctgttgatcgacttcggcacgcattgctttgatcgttgcttcatcccaatcataatacgcggccattgttttgatcacatcatctttgatcgcaaacatatgcgcaaaattaaataacatttggctactccggcgtaataagaagtctaacggatggaccactagctcagctttgagcccataggccagcatcgccgcatcaactggcagtagcgaattagtcgctggcttcaattcttggtagaccgcggtcacgttactgccgtagcgatggaccaatttagcggcatctgcttcacttaaatcgtattcgctgacgccttgttctgtggcttccgcaacaaacgcggcaaaaccagcatcgccgccgacagcaccaccacttaagcgcagcgcgactgtttgtgttgcttgataagtataagccgtttccgccgccaattcacgcgctacccgatcgacgattttctccgccattttccgataaccagtcagcttaccgccagcaatcgagaataagccgctaggtgcatgaaaaatctcatccttacgtgagatctctgacgggcctttgccttcttcttggatcaatggccgcacacctgaccaagctgactcaacatcagcaaaacccagtgctgccggtagatcaaacatctcgttggtcgcattcaagatgtaattaacatcttctttagtgatattaggctccagcggatcagcctgccaagttgtatccgtagtgccaacgtaggtcttaccctcgcgcggtatagcaaacatcatccgcccatcattgaacggagtgtcaaagaagatcgcgttggtcaacggaaatttagcgttatcgatcactaaatggacccctttggttaagtgcaaatgtttaccttgatcagaaccatccaatttacgaatcgtatcgacccacggacctgcagcgttgatcactttacgcgcgtggatcgttcccgttgcgccagtgacggtatccgtataagcgacccccgttatcttatgttggtcgtcatacagtaactcagtcaccttaacataattcgcaatataagcgcctttttcgtgggcttttttaacgacttctaacgtcaagcgcgcgtcatccgtgcgatactcaacgtacaccccggtccccttcaaaccagcctccttcagatacggttcccgctgcaatgatttcgccggtggcaacatgaatttacgttcactttttttgacccgcgctaaccggtcatagatatctagcccgatcccagtggtaaagctgccaaaagtccccccttggtaaaaggggagcatcatttttagcggcgttgtaacatgcggtgcgttttcgtaaacgattgcccgctcccggcccacttcggccacctccttgattgcaaattgtttcaaataacgtaagccgccatgaacgagtttagtcgaacggctggatgttcctgaagcaaaatcgcgcatttctagcaggccagtttgtagcccccgcgtctgcgcatccaacgtgatacctgaaccagtgataccaccgccaataactaatatatctaataactctgatgacatttttgttaaatccgcggcgcgcgtttttgttgaaaattccatacatgattcctccattggtgctcctttttgtaaagcgctttccaaattagaaattagcacatcgtattaggcctgtcaacgcagcaatcccaatgttttacgaataatattcacaaaatgatgaccatttcaattgaaaagccgacttaacaaataatatattttcacaaattatcacaaatcttaataaattaaaatttagcgcagtggcagcagtgaaaaacttcttttttcacaagttgaagttaacctagttgttaatctagatgatataagtattgcaaataatcacaaaattcacataaaaaattttataatttaatttatcaattcttattcacaaataacatttaacacggtattatagggatatgctgttttagacagcgctttcaataatgctaagtcaggcgaccatcgcattaagtaacttgcgttgcttagcctgtccggcgatcgttagcacagtctaaatttttctaggaggcgttcattttggcagacgagcaatatattctagcaattgacgaaggtaccaccagtacacggtcgattatttttgaccatcaaggtaataaagctgcagattcgcaaaaggaattcccgcaatatttcccccaacctggttgggtcgaacatgatgctaatgagatctggaatgcagtcctttccacaattgccaacgcttttatcgaatctagcgtcaaaccagcgcagatcgctggcatcggcatcactaaccaacgggaaacgacgatcgtttgggacaagaaaaccggcttaccgatctataacgcgatcgtctggcagtcgcggcagactgcagatattgccacacaattaaatgaagctggttacgccgatttaattcataataagactgggctagtgatcgatgcttatttttcggcaactaagattcgttggattttagatcatgttgccggtgcccaggaacgtgccgaaaaaggcgaattattatttggaaccattgatacttggatcgtttggaaactcactggcggctcggttcacgtcactgactattccaatgctagccggacaatgttattcaatattcacgatctggcttgggacgacgagatccttaagcttttgaacatccctaaggcgatgctgccggacgtgcggccgaattccgaagtctacggtaagaccaaggactaccatttctttggcagtgaagtgccgatttccggcatggccggtgaccagcaggccgccctcttcggtcaaatggcgttcgaacctgggatggtcaaaaatacctatggcacaggctcctttatcgtgatgaataccggtgaaaaaccgcaaatgtcggcgcataacttattgaccacgatcggttacggcatcaatggcaaagtttattacgcccttgaggggagtattttcgtcgccggctcggcgatccaatggttacgcgacggcatgcgcttgatcagcacggcgccggaatcggaaaaactggccaacgcctcaactgatgataatgaagtctatgtcgtgccggcctttactggtctcggcgccccctattgggattcagatgcccgcggcgcagtcttcggtttgtcacggggcacaacgcgggaagatttcgttaaagcgacactacaggcagtggcttatcaaactcgggacgttgttgacacgatgaaattagactctggtatcgacatcccactgctaaaagtggatggcggcgccgctaacaacaacatgctgatgcaattccaagcagatattttaaacaccccgatccagcgggcccacgatttagaaaccaccgcgctaggggctgccttcctcgctggcttagcggtgggctactggaaagatctcgacgccattaaggctgaatacgctgctggcgaaactttccaaccacaaatggtggccgaacaacgagaaagtctctacggtggctggcaagaagcggttgcggcgacccagacgtttaaacatcaaccattagcataatattgccccagctgcaaggctaggttgtatttgaaaaataatattgagttagtttttaccgctaatttagtgtaaacgtggttgaaaaagcactgtcgctcgttttcagcaacactttttgagaagtatctgaactatagcccatttgctaaatagatcgtgcttcccgatgtcgattggactaagccaaagtacggcaagtccaagtcgcagcttattgcatataactacgctagccaaacgcatcactacgtgctgcttattggttagctaggttatattccataagctaaacgcttttcccaacgcactctagtcagtccgttgggtcattattttattacgagcaggaggaatctatttatggatgtttacctaggtgagtttgtcggcacaatgatcttgatcattttaggtaccggtgctggtgccagtatcaacttgaatcaaacctatgctaagggccagggctggctgtttgtcgcctttgcctggggtatggccgttacatttggggtctacgtagccgccgcgtttggcgcacccggacatttaaatccagcattcacgatcgccgctgccatttccggtatgttgaaatggtcgcaagtggctggctttatcggtgcacaaatgttaggcgcatttgtcggcgcagcgatcgttgtgatccacttctatcctcattttcaggctagtaaagatgaagccgcaggtaatactgttggaatttttgcgactaaaccggcgatcaacagcccgatttttaacttcctcagtgaagtgatcgcgacttttacttttacctacatcacctttaatttaggtgatttcgcaactggcctgaaaccatttatcgttggctttgtcatctttgcgatcggcgctagcttaggttcaaccactggttatgcgttgaatccagcccgcgattggggcccacggtttgcttacacggtcttgccgattccccacaaaacagccgcacattggggctacgcttgggtgccattgtgcggcccgatcgctggtgccgccattgccgccgtattgttcaacctcgaataaagcagctgtttacctttattgaaaaataacccactagtgatctatgctagtgggttttatattacggcaattttagaaacacagaataagtcagcagccgatttctaactcaatcactgccgccgtaagttatttaaacaagtagtcaataaagcgcgcaactgctcgacctcggctgtgcttaatccagccgtcatctgcgtctccaaaaattgatactgccgctcaaaatccggctgctttaaagtcatctgtgcccgtacttttgccaatagttggactcgcttgtaccgtttatcgaccgaatcacgggtcacggtgatcagcccggccgcctttaactgcttgactaagccattgatcgttgcccggctcatccctaaaagctgctcaagattgcgctgatatatcacctgctgcggatgctcaaataaataggtgactaaacttaattgtcctttagttaagtgtggtcccattcccgcccgacccagttgcacggccaattgccgctcaaataacgcgctgaccgccttgagccgctgtcccaaatgttgctgtttaatggtgtttaccccctttatacatcttcaaacgccaaaaaataagtcgtggttgggccgccccggccgcttgctgaccataaaaagcatatcagcgtttacaatgattaacaagccagagtgcgttgaaaaagcgctcagcttctgagcactagcctagtaagacaataagtagcacgcagtgatgcgtttggcttacgtagctaggcgcaggaagctgctttttcaaccacgtttacactaaatcggtgataaaaactacttttctgtatcctccaaacactctctaggcaacaacttatttaaattagcgaagttgaccccagtcaattccatttaccgcgcgcggcggtaaacttagctttattaaaatctaaccgctggaggtgttcctatgctaatttggctaatcatcgccgccgtgatcatcgctcacccgctaattttcatgtggctacgcaaaaatgaccagtcccgctcataaaactaagctggtgttaaaatgacaaaactaagcgcgtatttcgcgactatgctcaacgaagcaaaaatgaaaaccatcttctttcaattattgcaaattgaaggcgttacccgcgtcgcccctgacctcgggcaacgaaccatgaccatttgcaccaaagccagtgcgctaaaacaacttaaacaggcctttcccaccgttgattttgttcagctgcgcgccattagttagctatcggcggcccagcgctacttgcacttaataatggcgaacccaaataagcggactatttttggttcccagcagtgcacttatttgaaaagcgcttataaaaacgttaaagttggcaacaaaataatttagaagaagggttatttatgacaacatacaactatgattttcctaaatcgaaggcgcaacttaaccaactgatcgccgatattagccaattaaaggtcaacgttcagcagactcactggtacatgcgcggcgaaaacttcttccgcctacatccactaatggacgattacggtgaccaactcagcgaacagctcgaccaaatcgcggaacgcctgatcgctttaaacggcagcccgctggccaccacccacgaattcattgccaacactggcttacctgacgaaaaagtcgcgttcgaccaattaacgatgaccgaattgatgcagcggctagtcgatcaattcaaatacttacgcgaccaatatcaaaaaggcatcgaagtcaccgatgctgaaaaggacttcccgacccaagacatgcttaacggcttcaaagatgaaactgacaagaatatctggatgatcagcgcttatctcggcaaggcaccattcgctgactaagtgacgctaaaaaaacgatgtgcacgttcatcctgtttatgggcaaacgtgcgcatcgttttttgctttattcagttactcatccgccaaaaagccgtgctcaacaatatccatcagcgccatcgcctgctcaacgataccatcaaaatcagctattttaagctgcggattcgcttggatcattactttacttttctcgccgataaaattagagattgccaagatcatcgcctgcacatcatcccgcttaacgccagaacgtaacggcagtcggtcgataactggggtcactaataaaggtaccgaattggccaaaacgctgcgccagatttcctgcatctgcggccgtagtttttccggcaacgcattggtatcaccgtaggcctgcatcgccagcgtaaattcatccgggtactgtaattgcattttaattttatagcgcagcgcacgtacgatcatggttttcaaatcggtggcgtcttgccagacactcaaatccgccgcttgattgatcttatcaaaagtccggcgaactgtttccaaataaaggttggcctttgatttaaaatagtgaaagatcagccctttggaaacatcggcttgtgtggcaatgtcgtcagtttttgtgtcacggtaaccatgttgtgcaaattcatgcatcgctacatcaacgatgcgcgcttctttttccggatcgatcggttgtcttgcttttgccataaattgcctcccactacacaattaatgataacttattagcgccgaattagctgcctttttctaactgcttttgcatagtaaccagccagtgcacctaattcgctaaaaggtcgcggcgggcgtacgcaagataaccggcgaggatcaagatcagtcccaaggccgtcatccagccggcggtatcccaagcgactgcgttgatcggcacccgattgacccagccatatggtgagatccgcgtcgcccatttagggaagtccagcagcgggccaaggtacagcgagatcagcccataaacggggatcgcccaggcgatattttgcagcttcggcactagtccggccagtaacgccgcaatgccaaaagtaacgatcagcgccggcgcgtaaccccagaatgcccgcatgaagcggctaacagccaaggcttcatcgcccattgacgccgcgccagccacgtacatccctagaatgcccagcaacaaagcaatcacggcactgaccaagccaaaggccacgatactgagatacaagtacccgcgggaaactgccttggcgtgcagctgctcaaaataaccgttgcgttcatcgcgattaagccgaaataaggtgatcaggccgggaaccgtcgccagtacgacaaagatgatcactaatttattggcaaaagccagcacgatggcgcgattggcctgggtcaccgctgtagtaccgatcaatttagccatagttggattagttttcatcaagtcgccggcagtgccaaagatcgatccataggtggcgcctagaataaatagtgccaccaaccaaatgatcgtgctggtgcgttccaaccgcgcgatcagtgttagcggaccacgcaataggccggaagcacgccggcggccagcgcgttgcggcaataagccggcgccaacgtcacgggtcgcgcctagtgtgatcgctaggccgccgacaagtccgatcaagcccagcatcaagcccaccggccaccaaatattctgtccataaatatctaatttttcgatccagccatagatcgtccaccaagtcagatctgtattttgaacatccgtccccatccgcgcgacaaataaaacgccgaggatcaaataacttaaaatcgtggcgctacgactagaactggctagttgtgcggctagtagtgaaaaagccccgaacatcagcccaaatgcagctaaactgagcccaaacagccagtttcctgcggcattaatacctgacataccagaaacttgcaatcccaccgcttcaagcacgcctgcaatcaagttgatcaataccaattcaagaatagccgcagtcagactagcattccgaccagtggcccgcgctctgaccaattcagcgacgccagactcttcatcggtacgtgtggcgtggatcgcaaaatagatattcattatcgccacgaataaccccatgaagaccatcatttcagctgcgtaaacgttggccacggtgtacggcttttctgcagtaaaggggcctagcagcgataccattgccggtgtacgtaaagttgtaatgatcgaattcatggccttgctcgagccgtacagcgtatcaaatttaccggcagcccccgccatcaagccaacaaccccgatcaaccacagcataatttttaaccagtcacgacgtaaataaacccgcagcaaaaagccggttttcgcataattagtgttggtcatcagcgacaccctcctgctggttgtaatagcgcataaacagatcttccaatgttggtggcgtactttgcaatgatttaacgcctaatggggctaaatcgctgatcacagttgccaacgcttctgaatcgacggcaaaagttgctttgttgcccgtctgtttaaaaccgtggaccgccggattttcaccgatccgtgtattttccttttctgtggtcaccgtcacctgtgtacgactcagttgacgcatatcgtctaaggtaccagtttcaataatttgtcctgcacgaataatggcgatgcgatcacacatatgctccacttcgcttaaaatatgactggacagtagcacacttttaccagcatcctttaatgctaagacctgcttttggaaaacttcttccattaacggatctaaaccactagtgggttcatcaaagatatacaaatcagctgccgtggataatgccgcaatcaaagctaccttttgccggttccccttagaataggtatgacattttttagtaacatcgagctcgaaagctttgatcagcgtatcagtacgcgcagaatgcttttgatcattcagttttaaaaaaagatcgatcacttcgccgccacttaaattcggccagagataaacatcccccggaacatacgctaaacgtttatgaatcgctacggcatcgcgccaaacatcctgatcaaaaattgttgccgttccaccgcttttcttcaaaatccccagcagcgtgcgaatagttgtcgatttacccgcaccatttggaccaataaaaccgaaaacttcaccggaattgacggtcagtgtaatatctttcaacgcttgaaacttaccaaagtgcttctgtaaatgcttaatttccactactgattgggccattataatagcctccttaaacggattaattgtttacggccagagtgtaaactaaattgactgtatagtcaatgactaaatagtcaatttttatattgctacaacactccgctaaatgacagctttttcacgctaattaaaatagcctgatccagagaaaatctgggatcagactattttaatcacactgcttattcaaaacggctcaagacgaccattaattcactgtcttccaagccttccatattatgcaattcgccacgttccatcacaacggcgcgcccaggataaatttcttcgctgcccttttcagtaaaaaacttgatccgccctttgactgggatcacaacaccatgtgctggtgctggatgcaacttaccattacccgttacttcgcctttagcgatcgtacggtgcccaacaacttgagaagggatattaaaaagatgctcgtgaacgccagcacctgtagttccagttaaaaattccatcaatgaacaactccttaagtcgcgcgtgtattttgcaatactgcgtgctgagattataaccaagccagcattaaaatccgacctagcttatctatcattaaaggcgtccaccattaaattgtcaattagggtttcaccgcagattcctgtgccatcgcagctaaaccgagctggttcaggtaattaaatggtcgatcatagtaaggcgagaacaacatgtcgacaaacgccaactgctcgatcgtattctcattttgaatacaaacggatagtaaattcgctgactgcgcaacatcatattcactataaagttggccgcctagaattttatgggtggcgcggtcataaactaggcgcatatcgatcggcgtggtcgatggcataaactctggtcgataattatcggtcagactagctacggcagcagtgaagccgtgactttgtgcccgcgccagtgtcaggccagttgaagccaacgttttgccataaaggtgcaacgccgaagtcgcctgcgtgccaatatccggcaaggtgggttgaaaaatattcatccccaccaacaatccttggcgaacggcatttgttgccaacggcgtgtaggcgtcttcttgcgttgggttaaaatggaccgccaccgcatcaccagcggcataaacatctggatcagaagtttgcatgtagcggttaacatggatcgaaccatcctgattcaatttaatttgccctgcaagtagatcagtctgcgggcgaaaaccaacgcagatcaccgccagatcagcctgatgctcagcctgatccgtttgaatatagacatgctgttcatcactatcaaatttcaacgcggtttcatttagctttaacttgacaccatgtgccgccaaatcagccgccactttttcagaaaaatcggtatccacataatgacttaacagcggatgcaagccattgatcagcgttacttgatggtcagtgttgctgtaactttccgctagttcaacgccgatatagccgccaccaatgatcgcaatgtgcttcttgacccgcgccgttgctgcaattttggtggcatccgcatagtccttacagatcagaatattcggcaaactaactccctgaattggcggcaccactggaaccgagccagttgtgatcactaatttatcgtattggtcgacaaatttgcgttcagaaagcagatcatcaactaggacttgctttttggccacatcgattttataaacatcatgctgcgtgtgcacttgcgcgcccaggtctttcagatcctgaggcgtggcgtaaaacatatcttccagcgccttaacggtaccgcctaaatacagcgagatcccgcaggacagaaacgaaatgttattattacgttcataaatcgtcaccgctgtctccggatgcgtttttagtatctgttgtgccacgctggtgccagcatgggtacagccaataatgatcactttcataagcagtctccctttaccaactcgaccaaataaaaccatcaactgattttaccacggcccagtcagtaagaatagcggttactttttagcagcgcgtgagttgaaatacagtctaataaaggcgtagcgtcactggtgtcttaatcgcagcaaataaactcgcccactgactcaacgacaacattgtatttacccgttctgcccgcgcgatctgtgattgattaatattaccaacttttgccgctacttctttttgcgtcattttagcttgtcgccgggcaatttgaaacttaagcgctaatttgacttccggtgataagtcgagcacttcgctaatatccttaccagtataactggcaacgatcaacgccgcggtctcctggtatgtgatcgtgtggtccagctgcgtgagcatcaagtgataaacacgaatcggaatatgatcatagatcagcgcactttgcgcatccccagccaccatagaacgctgatcatcactggcataagtttcaataatctcaccgtaatgttttaacgccgcagcaaccgcattgctgtcagtcaaatctagttgctttcctgctgattcatttagattgatcatggcaatttcctccactcaaataacgtttgatcaaggccatgcttgtatcaggatagaaaataacattttgatgatcaacaatgccgcccaatcgcgcatagaacttttcagtaccgttagtcttggtcgttagttggacaaatccggcaaacgcgtgatcaaatgagtcttgcgcaacttgagcgatcaggtgcgccccgatatggcgctgacgcatctgactagcgacttccacattatggatccgatcaaattcgttactgaaaatccgctcaaatagaatcacaccaacaagtcgtgtttccaacaatgcaataaatagttgcccgtttgggtacatttgaagtaaattggcccaattaaattggaaatttatttctggccaatacttagccaaaaattctggtaacacgttgataagtcatttccatagctttattatagcataatatgctattttagcatattatacagaactccttcgtcattaattatagctagctattaaaaccacagccccactatatttaatctacgcaaaaagtcaccgctttatttcgtcttcgcaattaaatctaacgccgcctgcaattccggcgtgactgccgttgccggtaaattagccgccacgttagccgctaaaatcaagccgatcgttttatcgatggtcgaacggacggcggttagctggatcagcacatctttggcggcgcgctcctcggtcagcatattttgaatgccgcgcaactgaccttccgcgcgctttaatcggtttaaaagttggtcgttagttgtcaagtcgattcctccctactactatatgaaaaaacgttccggccacccttttagcgagtaactgaaacgtctttcttctattgaaattgatccaagttgataaagtaatcttgataccaaactaagaacgtgtaaatgacccaaacttggcgacgaccatcttgggtatccttgtgggtcgcctctaatagatcaagaatttgttgttgatcgaagaattccttgacgaaatcctgactgaaaagatcacgtacttgttgatagtacttgtcttctagcagccattgatggatcggtactgggaagcctaattttggtcgactagcaaattctttacctaaatgtttctcagaagcgcggcggaatgcgtacttagtgtccttagtgttcaacaaatacttgctaggaatactgttggccaattcagccacatcgcgatctaagaatggtacccgcaattctaagctgtgcgccatcgagatcttatcagctttttgtaaaatatcgttggccataaaatgatgcagatcaatgtattgcatttgcttcacttcgtcagcgtctttaatttttttgaaatcacgttggtagttatcactaacgttcaaatcatttttgtacgcagcggtcactaaattattggcttcatcagcgctgaaaatcgttgggtgctcgaaagtatagatcactgattcaccaacataaaattcgctaggtttggctaagcgcgtgtacaaatggaccttaccgtggaagttacgaccttttttgattcggttagccaaccgatagcgcgtaccccgtggcaatttgcgcaagccttccgcaaaaactttgatcacttcattgtgcgagtgcatgccgtagttgacgtagccggcaaacatttcgtcggccccttcaccagacagcaccaccgttacttctttggcggccatttccgataagaaccacagcgggatcaagctgggattgccatcaggttcgtccatgtgatattgcatcaacgggaacttagcaaaggcatcgtcaccatggaccgtggtcgtgtgaaattccaacccgagatcatcagccaacactttagcccgaccagcttcgttgtaagtttcgtcaaagccgacactgaagactttttctggcttcaaaacgctggttacgtaactactgtcgaccccttcagaaaggaagctacccacaggtacgtccgcgatatgatgcaatttaactgattcttcgactgatttattgatggcttcaaccgtttcgtcaaagctcatattattttctttgtattccgcatcccaatattgttcaatatcaacgtgcccatcacgccacataaaataatggcccgcggggaacttgaagacacctttgaagaaggtttcatccaagtcattgtattgattcattaaataaggtttgagtgcatccttattgagctgctttttaaagccgggatgcttcatgaacgtttttaattcgctggagaacataaacgtgccatcgtctaagtaagtgtagtacaacggtttgatgccgaaaaagtcgcgggcaccgaatagttcctttttgacggtatcccagatgaaaaaggtgaacatgccgcgaatccgcttaagcacatccttgccccaagcttcgtagccatgcaacaaaacttcagtatcggtatgcgttttgaaaacatagccgaggttttgttccaaatcgtcgcgcacgctttgatagttgtaaatttcgccgttaaagacgatcagtttagtattgtccgcgttgtagatcggttgcttaccgttggtgagatcaatgatcgacagccgccggaagcccagcgcaacatcttcgtcaacatattttcctttgtcattcgggccccgatgtttgatgacttcaacttgcttgtctaaagttaagttcttatcatcaaccgacaaatcaccgccggcaaagccgataattccgcacatataaactcctctttcgttgtgaatattcagagtgtaaaattaggcgctcagattctggaacagagcctagtttaccgataagatacacgcagtgaatcgttcggtaaacgtagctatgtgcaagaatctgcctaattttacacgtttacgccaaacaattggcaatggtgaacgcccattaccatgccataaaaatagccgcacagcgcacggttaccttatgtttacaagcataactttcattataacattatgtgcgttagagaacaggggcggttcaataaaattatatgctcatttgtaatggaaatattgcgattcggtaacaagcaaaatagacgcacacctgttcgagcccggtaagtgtcaccaaaatgtaatctactcagcgttgacaccgttttgatgagatgctaatttatacatatgtagtagtagataatttaacaataatttaattaattttaaactttttgaaatattaacccaccattcaactgttagacacaggttgtataaaatttgggaggatcttatcattatgcaaaaagaaacaaacgaacagaaagtacattataaaatgtataaggctgggaaagcctgggtcttcactgggatctcagtcttaacattaggtttaggtatttttggtgctcaaaacgccgctaatgccgctaccagtactaaaacgaccgatgaccaagccacaactgatgacaatgctgatttaaccagcaacacagcaacacttaaaacaagtgcagcagcggcagcaagtacggctgcacaatcgacagctgacagtacagctcaatccgcggcagcagttagtacagccaaatctgcagcagcaagtgctgcggcggcatcaacagctgccagtcaaactgcacaatcaacggctgatagcttagcagctaagtcggctgcggctagcactgccgctaaggctgttgctgctaaatcaacggctgccagccaagctgcacaatcagccgcagcttcaactgcagttaaaaatgctgccctcagtggccaaacggttttagcaacagcattacaaaatgaaagcagtacagccactagtacagcgagccaagctgatacgactaaggctgctagcaatacaactagccaagccgctgcagcaacgagtacaacgccaacagccagtgcggcggctggcaacgaagcaaaaactgctagctcagcagctgccactacagaaactactagtactgtagctaattcggcagcaactgctgattctacagctagccaggcgacaacatctgagcaagctgcaactgatgccgataaggccgcatctgatgaagcagccactagcacagatacaacagccactactgacaaagctgaaagtgacgtagcggcgacaactgatactactgcagacagcaccgcagctgaagcaactactgatcaagcgaccacggatagcacgtccactgacactgctgctgcagcgacttcaaccgctagtacgagtagctcaactgcaactagccaggccagtgctgaaagcactgccgcaactgaagtggttgctagccaagccagcacgagtactgcagcgagccaagctagctcagcgccagtttacgctttaggcgatgttgacgatgctgctttgtattcagctaaagcagtcgctctagctgaatacaaagctactggtcaagcccaaacaattacccgcgtagctgctaactattacttatcagcggctaaccaagctttcttagatagtattaaagccggcgccattgctggatggaaaaaatatggtattttaccatccttgacggcagcccaagcgatccttgaaagtggttggggtaaatctagtttagcggctaattaccataacttatttgggatcaaaggctcatacaacgggcaatccgtttcattaccaacttctgaatattacggttactggacgacgatctatgataatttccgggtttatccaaataactcagctagcgtcgaagaccacggcttattcttaactcagaattcacgttatcataacttaatcggcgttactaatgccgcaactgccaccactttgattcgtcaagacggttatgcaactgcaccaagctacagcagtcaattactgaatattatcaattcttacggtttgacagcgtgggatcagattgccttcagtggtggttcagtttcaacttctacaggtagctcaagtagcagttctagcaccgccagtggttcaacttacacagttcaaagtggtgacactttatcggcaatcgctaataaatacgcgacaactgctgctaatttagccagcaagaacaatttaagtaatcctaatttgatctatgtcggtcaagtacttaatgttgccacaacaacgagcagctcaaatactggtagcactacaactgttggtaatactaagtattacacggttcaaagcggcgacactttgtctgcaattgctagaacttttaacacaacaactgcaagtattgctagcaagaataatatcagtaacgccaacttgatctatgtcggtcaaaaactactggttagtggttcaactgccacagctaattcgactgccagccaaactagcagcagtacttattatacagttaagagtggcgatactttatccgctattgctagtaaatacaatacaactgcagctaacttagccagcaaaaatagtattagtaatgctaatctaatttacgttggtcaaaaattagttgttggtggttcaactgctaaggtgacaacaactgctaagacaacatcatctagtaacacttacacagttaaaagtggtgacactttatcaagtattgccagcaaaaatgggacgactgctgccagcttagctagcaaaaataatattagtaacgccaacttgatctatgtcggccaagtactaacattatccggtagcactgcaactagcgctaccgtaacgcagttaagtaatagcagcagttataccgttaaaagtggcgatagtctgtatagcatcgccgctgcacatggtactactgtgcaagcattagccagcaaaaacgggatcagcaatactagcttgatctacgttggccaaaaaatcagcttctaattgaattattttaaagccgttatgtctgaaatcatcaggcatagcggctttttttattttccttacgccagtactgcataaatatgctataatatttaggtaagttatttgggtccgtagctcagttgggagagcgcctgcttcgcatgtaggaggtcgacggttcaagtccgttcggatccatcgcgtaccagacagccgtttgctatagcgacggtttttatttttgcttttatacaaaaccagcagcttaattaagttgctggttttttgattgaacaaaaaaacgactcaataactgagtcgtttttaactactttattttactcgtgctaagaaataacgtttcttaccgcgccgaacgataacgaagcgtccatcaaaggcagccgttggatctaattcaaattcaacctcacgaatccgttcaccattgacagtgatcgcaccattggtcacatcctcacgcgcttgccgcttagaaggttcgatcttagtatcaaccaaccattgtacgatattggccttatcagcggtcacatcaactgatggtacatcgcggaaaccttgttcgatctcttctgcagttaaagcggtcacatcgccagagaacaatgctttagagatgtgttccgcttcaacaactgcttgttcgccatgcacaaatttagttacttcttgtgctaaacgccgttgtgcttcccgcttttctggttccgttgctactttttcagctagagcttcaatttcagcacgatccaagaacgtgaaatacttcaagtaacgaacaacatcccgatcatcttggtttaaccagaactggtagaattcgtacggtgttgtccgctctggatctagccaaacggcgccgccggcagttttaccaaacttagtcccatcagctttcaacatcaatggaatcgtcaaaccaaagaccttagcgtcagcaccttcttgccgatggatcaagtcagtcccagcagtgatgttgccccattgatcggcgccaccaatttgtagttgaacgtcgttgtatttgtataaatgcaagaaatcgatcgactgcaaaatttgataagtaaattcagtgtaagaaatccctacttctagccggctagcaacaatttccttattcaacatcgtattaacgttgaataatttaccgtaatcgcgcaagaaatctagcaatgacagtttggacaaccaatcatagttatcaacgatcgtgaagttttccgtaccaaacaatttctccatttgtgccgtcagatgttctttattggcttgcacttggtccattgtctgcaaaactcgttcggaattcttacccgaaggatcgccaatggcaccagtaccgccaccgataacgatcacgggatgatggccggctaattggaaccgtttcagcaccatgaatggaatcaaatgcccaatatgcaagctagaaccagttggatcaaccccgcaatataaactaattgattttttctgtgttagttctttaagtccgtcttcgtcgatcacttgattgatcgcctcgcgccatgtaagatccgccataatatctgtcataattataaacattcctttcgcgtaccgctcaaggcacaaaacgcaatgaaaaagcgtttgcctgcagcggtatttctttgtatatttaacttgtgatcgtaccttgtacactacaaatcac

SEQ ID NO: 610 - DNA, 3567 bp, Unknown
  Metagenome-assembled genome
cttgttggttgcacaccaaggataacagaagaattggtccgggtgttttttaatttcacttagataatacaaaaccattagaaacaataattaaaactagacaaaatcgggtacgtttgacagtacctaaatcaagtagaggagttttctatggaaatcaaccggaaacgcgttattcaagctgcaatcattggcggcctatttctaattattttaatttatccaaaacagatttatggggcattcaccaatattcttggcgtgattttaccattgattcttgggggtgcactagcttatgtgttgaatttgctgtgtgcccgtttggaaaaatggtactttccacacacaaagaagcgttggttacaaaaaagtcgtcgtccagtggtgatcgtggtggcgttgctgatcattatcgcggttattttaggtgtcttacagttggtgatcccgaagtttgccactgcactcggtgattttttcacttctgtaccaacgatcgcaaacaatactgccaattggcttaaagatactgaccagttaccattgattaccaaacaattggaatcaatggagatcgattggcagtcgattcaatcaaaagtgatgcaatatttcaccagtggtgtgagtggaatttttggttcggccttcacgatttttggtaatatcactaaaggaatcgttaatttcttcttagcagtgacttttgctatttatattcttagtagtaaggaacggttggctaataatgtacgtcgcgttagtcacgcttttgtgccacaacgcgtattagataaaatccattatgttttgcaggtagccaataaaatgttcagcagttttattgtgggtcaagttaccgaagcgtttgtactgggaacgttgtgcatgttaggcatgtggctatttagatttcctaatgcggtgccaattggggcatttatcggtatcatggcgttgattccaatttttggtgcgtggatcggcgcggcagttggcttcttgctgatcgttgttgattcaccacttaaggcattcctgttcattgtttttattttagtgttgcagcaactagaaaataacctgatttatccgcgagtggtcggcacttcgatcggcttacctggaatctgggtgttggcggcgatcacggtcggtagtggtgtcgctggcattattggcatgttactgggagtaccaattacagcaactttgtatcaattactccgtgatgccacgaataaacgggcaccagctaagcctcagaaaaaagctgaagcggccgagaagtaaggctaaaaacagtaactattttgctgctctgcgaacgttccgctacaataatgtgatcttgccaccactagatgagtaatgctctattatatttagcctgaaaaattagttgaacagaataataaaagccactaaacgcagtaacttagcgtttagtggcttttaaatatgattgtaatctttctagtcgcgatgcaacaccgtgctgatcaaactgattacgccgatcgaggcactaggaaaagcaaaaatcatttggtctagcgcagttgcggataagtggccgtcaatgatcatggtcagtaagttgatcaagtcaggggcgtcgttaccgtatagactagcaccaaccaagtagttatcttgatccaataccaaggttaattcagcgtcgacttcatttttatactggaacatcaattgctgaccataagggacgacttgtgtatggtaagcggctgaatcagctgcttccgcagtagtcacaccaatttgggctaagcgtggtaaagtgaagacgactgacggaattgctgggtacttgattgcagccgtgttgccgagaatttgttgggcaatatagttggattcaaaggttgccgttggggtcaagcgggggatttgtttgtcgatcacgtcaccgctagcataaatacttgatacggcggtacgtaagtgatcgtcaaccacgatgccgccacgagttgtttggataccaacttcttctaagcccaggccttcgatgttggcaacgcggccagtggcatcaaggacgtaatcactaattaattgcaagccagctttagttgtaaccaaataatgatcatcttcagcagtaacctggctaactgcttcgttaaagtggaaagtcacaccagcagcttgtaatttagtaactaatttagtgacatgacgctgatcgaaggcattcagtgcatggtcggcgaattcaacaacatcaacgctgctaccaagttcgatcgccatcgttgcgaattctaaggaaatgatcccagcgccgataaaggtgatccgttgcggcatgttagttaagtcaagaaaatcacggctatcatgtaggtattcacagctcggaatgtttaatttagcggcacgttggccggtaccaatgataatgttgtcggcagtaaattgatcatctgcgacagcaactgtatgatcatcaactaagcggccagcacccataatgaggtcgatacctatttgttggaacaacgcagtcatttgtaacggtagtgggtcaatgattttatgcttataagccattaattctgcccaatcaattttagtaccgttatgtaccccgataccattatattgtttaagttgggctaataattcaaacgggccatccaatagaattttagggtcacaaccatagttagtacaagtgccggcaatggtatctttttcaatgattgccaccgatttacctgcttgtttgagcgttactgcagcatgccagtttgcgtgaccactgccgataaaaataacatcataatgtttcattgtgagttcctccgtttcgtttttgattgtttaatcgtgcacgacttattattaaaaagtaaaaggcggacttatgctagtgtcgcctctaatgcgttaactaattcattattgactgccaatgcagtttcgtattttgcaatgtccaacttttcatgactggcgcaagcgctgatggcagcgtaaatatcactttgtcgtgttttagccatatccgtcagtttgacatttaattgtcgccgatcattagctggacgaacgcgagtcaaccagccagcattttccaatcgcttcaataatggggtcaaagtattgctgtttaactttaactcggcgcctaattcatgaagtggttggtcgtcatgctgccataatgaaagtaaaaccagatattgtgggtaagtcaattcaaatggcgctaacgcctgttgataaaacttactgaacaagcggctggcattgtagatcgaaaaacaaagctgattggccaactgcatttcgtcgctcatcaatttacctcaatcctttcagtcgtgtacgattgatattcagcatagacctatttgtattattttgcaagaacaattatctcaaagcgtgctatgattaataatgccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 611 - DNA, 19456 bp, Unknown
  Metagenome-assembled genome
ccctcattttctagtaaaagtgcacgaccttttgtcgtaagtggataaaacccttgcagtaattatactaaactggcgttgagattactgctacaaaaggattacaagaacgattcagtagacattaagtaaacgctgttaaatcagtgtttcgtgcttaactttatttttttgccaaaatagcgggacaaaagcggtcgctcaaacgtatatataaatgaatagctaatttgaggtgagggttttggaaacggttattaaaataccaattaacttatttgaattacctgaatttataaaactagaacagttggcaagtaatggtcgtcaagaaagaactgcacaagcactttggttgcgtttagcttgtattgctggccgtgcgggttgtgctggctacgttactggtactgatcaaccagcgttgactaacagcgaatatgcacacctagcgcatattactcgtgctaactatgtaccgcagttattggcgctactagaaaaggctggtttactgcaacgacatgcggatgaccgctatcagatcagccactgggaacgctatgcagttgacgatgtcgatcctaattattgcgggctagttaaattttacgacgtggatgatccgcagccagccccaccagcaccgccattaaccggcgtcacgccactggccctgcaaaaatacacccccgcacaacgcgctaaattagtaacgaccaccggcaaaattctggcgtacctgcaccagcagtcgggtaagcaatttagtaacgagccggcgacgcagattttactggcgggcttatttgatcaaaaagtgacgatcaagcagatcaaacaggtgatcgattggaaatgcaaggattggtacgagactgatttttggaagtttgtgcggccgcagacgttattcggaccgaagtttaagcagtatttgttggaggcgccaccaccggcgcacgtgcagccggcagctcagctgacgcggacgcagtatttgcgcgatctgtatcagttgagttgtggcgacgtggcgatggtgttgcggcgagcggctgatgaggaagttgacgtgactgaagacgaagtggaggcgatcgggcgtgaccttggatactaatgtggtccattatttattgcaacatccggcggcgatcaaaacagtgacgatcgcgccggaatggttcagtggcaagagctgccgtgagtttgtcgaatttatggtgactgatccgggaccgtttcagagttttgtggatgtgcagcggcgctttcaggcggcgtacccgctggcgtttgaagaggctgattggcaggcgtttgctcaaccctgtgacaacgagcaagtttttcgtgacagcgtgcaggcacagcacttttggtacgagcagggcaacacgcaaatggcggcccaagcttattttgccacgccgaacgcggaaaacttggcggcgttgcaggcgcaaagtcgcttgttgctgggcttaaacgaaccgccgacaccaacgcaaccgatcactgaacacggggcgacgttagcggcggaactggcacagccacagccgttgggcatcaaaactttcgccaatgtcgatcgcgtgttcaacggcggcttgcgcggcgggatgttgtggacgatcggtgcccggccgggtgttggtaagtcggcctttgcgctgaatctgatcgaacaggcgatcaagtatacgccaaatctgacggtggatctgttctcactggaaatgaccgcccaggataattaccagcggatcgtcgcctgcgaaactggcgtggcggctggcaagttcactaacccgtaccaaatgagtgccgctgagaaagacaaagtccgcgccggcatcgaacagttgaatcgacaacagttgtatttacatgataaattgctcattttgccgcagatcatcaaaacgatccgcgcccacgccgcgaaagctgccgccggcgaatatttagcggtgatcgattatttgcaaattatcagtttggaacgactggcagcgcgcactgatcggcggctggagatcgaaaccatcacccgcgagttaaaattattgaccaacgaaatgggcatcccgatcattttgttctcgcaattaaaccgtgagctagaaaagcgcgttgaccgcacgccacaactagccgacctgcgcgaatctggcagtattgaacaggattccaacacggtcagttttctttatccaatcagcaatgacgaagaacataaagcggtccgccatctaaacttgattttccgcaaaaaccgttctggctgcctgaccgagttggcctttacctttaccccggggcaaatgcgcttcacgccgcagttagtgctggacacgccggtggcagcgggcaacgggacggtaaatatgcagcaagatgtggtgccgccaacaatgcggcgcaattaaaaaggaggtgaagccgatgatcgaaacactccccgtcagtaacgccaaaatgcacctcaatcgcctcgtccgcgagcttgatcgcagcgacggcgtggtggtgatccgcaatatgcgcaccaacgattgcgtggtgctggtcgccgcgcacaaatggcagcaagaactcactaaaatgctgggtcaggatttagagatttaggtagctgttctttcataataagtagaggaggagttgaatgactgatttaggcattcccttagaccatgagctggcgcgccacgactttttggatcggccggtgtcggctaaggatgagttgtattgtttaggcgagtttttgtaccggcaacaggatgcggcggaatttttacagtttctacaatttttgtgtcagaatcagaaaagtgccgcggggattttgcggttgctgggggcgcagacgctgcaatagttggctctcaactgtaatatagatacacttatgcctggttttcatgaaagcctactaataccagctgataaatactgtattttatttacagataatcaaaatttaatttagtttggaaggctaagtcaatgatttagcataagctttgtataatactagttacattgcttgttacgttttcagaaagcgaaaggtgttttcataattaatttacaagaatcaagacttgcacagcagaatgttattcagtattggcaacaacattatgagccaactgcaccgcggaagatcataactaaactggcgatagcagcacggaattatcagctagaattacctgtggctgatcggatgttgtatcgcgcggcagttagttatacatctttatctggttggcagcattggcaagtgcagcggcaattcttaaaatcagttgcaaaaggtgctacacccgctttagcagctaatcgggaatagtgaaagtatattaatcgatatttagtgggactgagcaaaataaccatctgatcaatttaatttgatcaggtggttatttttagtttacggttgtcgttaattaatcatgctcaaaaagcatacataacttaaaaataagcattagacgtatatcacttttggctttatgctagtactcgtaagttaagcgaagggtggtgaacaggttggcggtggtgatctatttttcccgcgccggacagaataagcagcatggtgcggcgcagttcatcaatgtgggtaataccgcgttggtggcggacaaattagcgactcaactgggttgtccagcggtggccttgcaggcgattccggcttacgcggcggattatgcggcaacattgcagcggaccaaagcagaattggcgcaagccgccgcagcccagctggcgccgctgaccgttgatctaactgcgcaaacgcaactttttctcggctttccaatttggtggcgcacgttaccgcaagtggtggtcacctttttacagcaagtcgatttagctggcaagcaactttatcctttttgcacgcatgaaggcagcggttttggccgcagcttggatgcattacaaaaattagtaccgcaagcgcagttgttgccggggttggctgtgcgcggttccaacgcttataaagccgatcaggcgctgatcaattggttgcagtcgttgcaacttaaatgaacacataaggagattttcaaatgacagttaaaaacaaagtcgtcgttattaccggcgcttcttccggcatcggtgaagccagtgctaaattattagccgccaatggggccaaagtcgttttaggtgcacggcgtgaagcacgtttgcaggagatcgttcaggcaatcgaagctgccggcggccaagccgcataccgcgtgacggatgtgaccaaaccagccgaagtacaggccttggtcgatttagccaaaacacaatttggcggcattgatgtgattttcaacaatgctggaatcatgcccacttcaccagttagtgccttgcacactgaagaatggaacgacatggtcgatattaatttgaaaggtgttttgaacggcgtagcggcagtgatgccagacttcactaagcaaaaacacggtcagatcatcaccacctcatcagtggcggggatcaagagtttcactggcgccggcgtttatggggccaccaaatttgccgtgcgtaacttaatggaagtcatccggatggaaagcgcgcaagaaggcactaatattcgcaccgtcagcttgtatccggcggcgatcaatactgaattgctgcacacgatcaccgacaaagacgccaaagccggcatggaacagttttacgcccaagttggcatcaccccagacgccgtcgctcgcgttgtcaactttgccattgaccaaccagaagacgttaacgtcaacgaatttacgatctacccaacgaaacaagcatagagtgctagagtgcctaaaaaaggcgtttaggcactggaatctaacctagctggaagtggctgcttttagcacgtttccaataaaaaaatttaaaaggagcatgataatgatggctaaaaatgaaaatgttaaagacggggttatttttccccgtggcgctaaaaatgatgcgtacgcacagtattttgtcgggcaaagttatttacaaggtttagtcgctgatccagcggtcaacgttggtgtcggtaacgttacctttgaaccaggttgtcgcaataactggcacatccatcacgatggtttccagattttgttggtcactggcggcgaaggctggtaccaagaagaaggccaaccagcccagcacttggttcctggtgacgtgatcgtgactcatgatggcgttaagcattggcatggcgctactaaagatagctggtttgctcatgttgcgatcacggcagggacaccagaatggttagaacccgttactgacgaacaatacgctgctgttgaaagcgaggctaaataaaatggctaaaaaacaaactgctggccgcgataatttaggtgactttgcgcctaaatttgcggaattgaatgatgatgttctttttggcgaagtttggtcccgcgaggataaattatcggcccgtgatcggagtttgatcaccgttgccagcttgtttacccaaggcgtgccccaactggaagcgcatatgaaaattgcgaagcaaaatggcgtcactaaagatgtgatggtcgaattgatcacacatctggccttttacgctggctggccaaaagcttggtctgcctttactttggcgaaagaaatttatggtgactagtgtattttaaataaattcagtactaaaaaagcagcccgcaatggctgcttttttgcgcgattatagaaactcagcccgataatcgtgcacgtattgggcaaacgtcaatggtggtcgccctagaacgaaaatagctcgacgctgtctgcattgaatgtgcagattggtgtcaatgcaagctaaactgctgcggcttatgaaaaaatttgttatttattaaggttaatttaggttcgctctgcgatactaggcgtaataaataagtcagcgaggagtgagcttatgtccagcaaacttaaaagtaaacaattaactcaaggcctgttcggtatttatctgatcgcgttattttggatcatcattttcaaattaaacttgtcattgattccactgggcagtcgccgtagtatcaacttgatcccgtttgcggcctcagcggcgatcaacggccacatcgattgggccgaaccgctgctaaacgtgttggttttcgtgccgtttgggctctatgccgctaatttattcaaaccaatcggctttaaagtcaaattgatcatcgccgtcagcgttttttgcgaagtcgtccaatttattttcgggatcggtgccaccgatatcaccgacgtaatcaacaatacgctaggcgggctcattggcttattcgtctatcaaggtgttaaaataggggtgcaaaatagcgataaaatgcaaaaagtcatcaaccaaatcgccgtcgttggcacggttttgtgcgtggcgttactggcgttggtcaagttaggcatgcatttacgcacgtaatctgagtgtggctcaaagggcgcagaaatttgccttttgagccacgtttacactacaaaggtttggaatgataaatttcaggcacattttgtcaaaaatggaggaatttaaatgtcattaaccgctttagctcaggtgctcggcggcgccaacaaagtcgcttacgccaccagcttagataatgtacccaatttacggatcgtcaattttgtctgggatgaaaccacgccaaacgtgctgtatttcgcgtcagtccgcgactcccgcggcgttcaagaatttcttgccagcgaccgcattgctttttccactgtaccagaaacgggcaacgcgcacgtggccagcaatcaggcgactgggcaggcgtcgcaacggactttggcgtagatgcagccgcaatttttagcacaggtcccggattttgcccacgttttagaattgatcggccctaaattggcgttgtacgaaatccgcatcatcagcgcggaagttgatcaaggtttgggtaacggcgtgcaacaggtgacgttttagggcaataaaatggcagcgactgatcacaagtcgctgccattttttattcatcttgatcatgttcgcgatgccattgttgtaaaaaggccagccgctgtttaaagcgtttttcgttgccttgttccgttggcgcgtagtactcatggccctccagcgctggcggcatggttttcatcgtggtcagtttttcttgactatcgtgggcgtactggtaatcagcgccgtaaccgagttccttcattaaaccagtgggcgcgttgcggatctgtagcggcaccggctcattaccggtttttttgacgtcggttttgaccgcttcggtggcggcgtaaactgcgttggacttaggcgccaacgacaaatagatcaccgcttcggtcaaatgaacgttacattcgggcatcccgaggaactggcacgcttgaaaaacgtccaccgctaacgataaggcgcgggtgtcggctaagccaatatcttcgctggcaaaacgcaccaaccgccgcgcgatgtacagcggatcttcaccgccggtcagcatgcgcgttagccagtagatcgccgcgttaacgtcactattgcgcatcgatttgtgcagcgcggaaataatattgtagtgttcctcaccgtgtttatcgtagcgcaacgatttggtgttgatcaactggctcaacgctgcggtgtcgatggtgacttttttgtcttggtggtcggcgttcaaaacggccatttccagcgtgttcaatgccacccgcgcatccccgttggcaaattcggccagtaactgcaaggcatcagtattgatattaacggtcagatcaggaaaggcgtgggggttctgcaaggccttagtcaacaaagccacaatatcgctgacttgcagctcgtggagcacgaataccttacagcgcgaaagtagggcggaattgatctcgaatgaaggattttcggtggtggcgccgatcaaaataatgctgccccgttcaacaaagggcagaaaagcatcctgctgagctttgttgaagcgatgaatttcgtcgacgaacacaatggtccgctcaccgatttcacggttcatctccgcttcttccataattttacgaatatccttgatgccgctggtgacggcgctaaaggtgacaaaatgcgatttcgtttggttcgcgatgatccgcgccaaggtcgttttgccgacgccaggtgggccccagaagatcattgaggaaagctgatcatgatcgatgatctcgcgcaaaattttgcccggtgccagcaaatgttgctgcccagcaaattccgccaacgtttgcggccgcacccgattagccagcggactgttttgctggctaccagcggcgaataatgattcttgttccatatcgattcacttcacttgcttggtttgagggtggttgcaaaagctacttttgcaaccacgttgatgctaaatcaatgataaaaactaattttagtttaccacgttggctggggaaataaaaaaacgcgacgcaccaataatggtgttcgcgttaaacttattttaccgcaatgatttacgataaccggcggcttgcgcttcagcctcagtattgaagtgaaccgcgttggccgcattcatgttgtagccggcttggtcaggcgtgtggtagatcttactattgacattaccgacgatttggccttgctcatcggtactgatctgaccggtggtagcgctggaactagtggtcggtgctgccgctgtcgtagtggcgtctgacgaactagttgctgtgctagccgctgaacttgttgcttgggcggcggcgctgatctggctagtgccgtccgcgtaattgattgtgacgccatcctgcacgttaaaaatgtaaacgttgaatttcaagttagcgtcattgaccgcctcagcttgcatgtggacgccgcgggcaaccaattcgttatccttgaaaaccggcgtgacctgataacggacgtaggctttcggattatttttaatgtagtaggcaatgtcgtcttcgtagcgcagcatttctgggctatttaacgaacgggtaccagtgatcaaatttttcggattgttgttttgacccgttaattgaaagccaatcaagtgtgaccgattgtataaatagccacttttgatcttcttattccgccagccagttggatcaacggttagtggttcgcgtttttccgttggcatcaggcttttactaagtagggcgttggcgaccacggggcggttcaatgaatctaagttggcgtatttctgccaagcgcctttagccgtgctcaagttggcttgagtgaacgtgggctgattgttgttgacctcgaccgtttgcgtgccattataagttaacttaagtaatgcatcattttgttgctgtagagcagttttgctaccgacttgctttttggtgactttggccgcgtgaacagtggtggtactgtcggtggccgttgtttggttggtccccagaccgaccaaagtcagcgttaataaagtgaccccaattctgaccagtaaattccctttgtgtttcatctaaacccctccgtataattattcgttgaccgcgaataggcactgattgttattttatcatgaaaaattcaaaaaagctgtaaccaaaaaattgcgtagccgtttgttaaaaaagagttaagtcagcaatgttcggtaataaaatgtggtagcatatgtttaccctttagatgagggaaattagcttaagagggagctatgtgattgaaagctatcaaaggcttattgtgggcaattgtgtgggcagttgttttgcttgccggtctatatgtttttaccaccagtgattttaaagcactatcagataaattaaccaatgaagtggcgcagtggatggcgggagtcgcaccggaagcaacgtccagcgccgccagtcaagcgagttccgccaattcgactagcagttcggtggcgaccagcagctctagcgcggcgaccacgacagctacgccgatcgaacctaatgttcaaggcaaaacgttggccaatacgtattattatcagtttgacgacgatgttccggccgccgcgcggcaggcgtttaccaaagccattgcggtttacaatcaaacggggatcgttaaattagtcgccggtaccggtgatagtgaggaaaataaaatcactttttcgatctatcataaaacgatgacggcggcggaacgcggcacgatcgagcttggtcacggcgggcccaacattattcagcgcatcggttggggcgcttatacggctaatcacgccagcgcgagtttgaacgctacttacaccgcttcgttccgcaaatcggtggcggtgcacgaactcggtcacgccctagggcttgatcacagtgacagccaagattcagtgatgtatccggtcgatcaaggtaaaaccagcttgaccgcagcggatatcgctggactgaaaagtatttatgaaagttagcgtgtgttgaaaaagtgtttttcaaccacgtttaaagctaagccaactttaacacgagcaaagaagtaaccaaaaaggtcgcaggactgattgcgaccttttttggtataatcaagtatgtaagcgatatcgttaggagagcgataaaatggaactatatttagtgcgccacggggagacttatttaaatcgttatcagcggatgcaaggttggagtgattcttttttgacgccgcggggtgaaagccaagcgcgtgcttgtgggcaaaaactagctggtattccatttacgcggctatacgccagcgattcaggtcgcactcaggccaccgcgcagttattattgcctagtctaaccggcaatttagcggttgaaatcagccgcttatttcgcgaaacggcctttggcggatttgaaggcgccaaaaatgcaccgacttgggcgcagatctgtcaggctttgggccagccatcattggatgccttatttactcacacgtcgttggcgacgattttggatacgttcaaggcggttgatccgtaccacgatgctgaagataatgcgcagatgcaggcgcggttggaccaaggtttggccaagatccggcgggaaaacgcagctaccgccaaggtgttgttggtgacccacggcaattatattcggatgctgaaattgcgctacgcaccaggatttagtgcccacaccgagatcgtcaatgcgggggtaactaaattggtgacccgcgctgattcgtgggtcgaagtggcattttaacggcgcttatttttcaccacagatcataatcacgaatacctagctagtagcgatagttttgggaaagttgtggttttgccgtgaaaaaataggcgcttgtggcatacgtaacgtacgtcgcaagcgtctattttttatggcatgttcaagtttctatgcccgttccgtatctcccagtgagaacacggcgacacaaccgaggccggtgtgactgccgatcgtcggtccaatatgctgcagtgagatttgagcaccgggcacctgacgtaaaatctgttcccccaccacgttagccgcatcctctgcttgggtggtggcgatcaagattcgcggagtcgtgggctcggctaaagtggccactgtattggcggccaacatttccagcgatttccgccgtgagcgggcttttttaaccacgcgcaaatggccagccgtgtcaacgtccatcactggcttgatgtggagcaatgaacccaccgccgcggaagtgcgggaaacgcggccgccgtggtacaaataattcagatcatccacggtgaaccactggcggtagcgcagccgattagtggtcagccaatcggtcaattcagtgatactcatgccagcggcttttttatcaatggcatccagtaacatcaagccttgaccacaactggctgccagcgagtcgactaagtagatctgggcatcaggataatcctccagtaacattgcccgtgcctgcacagcgctgttaaaggttccgctgagcccagaagagaaacctaagtagagcagtggcgttttggtcaccacgtagggtttgaaaaactcaacgaactgaccaatattgatctgggcagttgatggcatcacgccgttagcgatttgttggtagaaatgtgcaaggtcaaaatggtgttccagatcatcatcgtagttttgcccggcgatatccacatgcatcgacacaaaatcgacctgattgtcggcaagcgtttggtaaggtagatcaacggctgaatcggttaatagctgatacatagcgtgctccttcgttcatattatcatttcattctacgctcattttacacaaaggcaatggttaaggcgcttaataaaatggttcgtcctaacttataagctaatcataagtatttttgcgctagggtgcaagaatctgacccccgatcaataagataagttgctcagcatgataaaagtcgctatgcttgaactaacagcacttgtcattaaatggtcgacttgaagttaaaggaggaaattttgcaatgaaatatacgattaccggtgccaccggccatttagggcggttagtggtccaagccatgttacagctggtcgcacctaacgaaattcgtgctgcggtgcatacgccagccaaatccgcgcatttgatggcgcaaggattggaagtcgtcacggctgattatttagacgtatcgttaatgaagacggcgctggttggtactgacgttttaatctatattcccagcaaaacttacgatttagtgcagcgggtgaccgaattggaaaacacgttggccgcgatgcagcaggcacaagtcaagaaaatcatcttcgttagctttttcgccgatcaagccaataatccgtttcgaatgtcggcttactacggctatgtgccgcggcggttggcggcctctgagtttgactacgcgatcgttaaaaatgcgttgtacgctgatccgttggtgccgtatttaccagaattgatccagcgacacaacattatttatccggtgggtcagcagccattagcgttcatcacccaacaagatagcgccgccgccatcgctaaattagcggtgcagccgcagctacgtgatcacggccaaacttatttattatcccaaacgcaaaactacacgatgccgcagttggccgagatcatgaccacagttactggtgaaccgatcggctatcaaccggtgactctggccgaatttgcggcgatctatgcggccgaaggtgacggccaagaattagcctccatgtaccacgctggcgcgttaggcttattggctgatgtgtcgactgactttgcccgaatcactggtcagcaaccgcaggggatgcgtgaatttttggcagctaattatcgaactgtttagttgattttgccgatctgcttaactgccttgttgtagttgagcagatttttatttagcccaatttctgtgcggccgctagtatctgctctgtcgacattgtttgtacgtacttttcagtaccatcggcgatagctttattgtaataagcttgcttgaaattgatttcgtccagtgtggcacttaattgctgcatcttctgttccagtgacacttttaaattggcgaacatcactttgcgcaattttagggtagcgtcaccggctagacaccaacgaatgaaaaccttgatatccttgatctgcatccccgccagtttcaaacattggattatttctagcgtagcgatattgtacggcgtaaacactcggttaccagctgcgtctttagccagatcggggatcaaaccttgtttatcataataacggatcgtcgggatcgacaaatcaaactgttgtgccacttcaccaattgaaaaagtcttcattattaatttaacctctttttttgaattttagtgttgacctaaagttgagtttaggtgatatattttgattataccaaaaatagtaaggagtttttaacatggcaattaaagataaagtcgttattattactggcgcatccagtggtattggcgcagcaaccgcgaaaaaattagctaaaaaaggcgccaaattagtacttggtgcccggcgtgcagataagttggaagcgttggttgatgagatcacagaaaatggtgggcaagcaatttttcaagtcaccgatgtaactaaggcagcggataaccaaaaattggttgaattagctcaaactcagtttggtaaggttgatgtgattttcttaaatgcaggattaatgccaaactcaccattatcagatttgaaaacagcagagtggaaccaaatggttgacgttaacatcaaaggggtcctcaatggcatcgctgcggtattgcctttgtttaaagcgcaaaaatcaggtcatgtgatcacaacttcgtctgttgccggcttaaaagcgtatcctggtggtgccgtttatggggccaccaagtgggctgttcgtgatttaatggaagttttacgaatggaatccgctcaagagggatcgcatattcgcaccgctacgatctatccagccgcgatccaatcagaattattacacacgatcaccgatacagataccgctaaaggcgccgctgaattatatcaacaatatcaaatcagccctgatcgggtagccaacgtggtggcttttgccatcgatcaaccagaagacaccaacgtcaatgaatttaccatcggcccaactgatcaaccttggtaatgaaaaatcttgcaccgaagttgattattatttagtaataaaaaaacgatcaaattagcgtaaaaaactaatttgatcgttttgcttatttagtcgcaatcaataaatggctgcggtgttgtttggtagccgttaaagcggcttccgctgccgccaaagtggtattgctagtaaccaactggcgctgtgccatgatcaatggggtaacggtggccgtataaactgcttgcgcatgtttttgctgcaacttagcttgggccaatgttgcttgagcgtctagtagctcatggcgggcttgggccaaattagccggcgcattttttagcgccgttagtgtctgttgcgcttggactaatgtttgttgggcctgttgcatctgtgttttagccactgtcaactgggtttgcgcggtcaacacttgcgtattggcttgttgcaaggcgtgttgcttagtggataaagcttggcgttgcgctgtggcagcggcttggccattagatagttcggcttgggccaaggccagctcagctcgtgcgcggaccgttcgttgtggtaaataagtcaaagtcgcctgggccgcactggctgccgcctgccgctgacttaatcgcgcttgcgccgttgttaacgcagtttgtgcactggctgcttgcgtcaagctagttttagcagctactttagccgtcgccaacgcttgctgtgcactgaccactgccgcggccgtttgcgctgcctgtgcttgttgggccacagttcgcgcctgcgcttgtgccaacgcttgttgtgcgttccgtaatggtgccggcgttgttgctgcggcccatgcttggcgggctgcagttacggcttcacgtgcggctgcctgcgtggcttgcgcttgtgcataagcgttgcgagccgcctgatgctgcgcctgcgcccaagctaaggcgacgcgttgccggcgcaactgagcgggctgggcgaggtgcgcgcgtaagcggcgtaaacgtagttgttgcacactgacgacctgcgccgccaatgttgaccgttgcgccgcggcgataacatcttgacttgctttatgtaaattaaaatccgcagttgtcatttggtcagcggcttggcgggctgcactggtagtcgccaccgaagttgttgccgtggcagcagcggcttgcgcctgggtcaccgctatttgagcagtactttcagcaacttgggccattgacaattcgtcttgcgcggcgttatccgctgccgtgactgtggtcagtgtattttgcgcggcttggacggcttgttgatcacgaccagcagtaacggttgccgttgagctggcgtaactggcagtactgacggccgcttgggcggcggtcacctgattactagttgcactgaccgccgcctgaactgaactaggggccaaataatctaagtgcgtttgggcttgatcaaccacagcttgttgactagtgacggtcacttgcgcggtgatcgcggcactggctgccgcgtcgacttcagtttgcgccgcactggcttggctagtcgcactggtaaccaccgtttggctggcggcgacagtttgttgcgcaaccgcaacctgactttgggcttgcgccacggtttgttgctgcgcactaacattggccgaggttgcctgggtttggtgggcttgctgcacgtcaacgttagcactggcacgggtaacattactggcagccacagctacttgcgcatccgcagaattgacgaccgtattggcactggtcgcctgtgcttgagcactttgcaaagtctgactggctgcagtttgactggttgccgcactggtgaccgcattttgtgcagtggctaccggcgccgtggagtcactctttggtgtggcggtggttgtcgttgctgcggcagccaccggttgatcgttgcttaatagtaaaccgccggtgacggctaaggcgccaactgctaataaagcagctggtgctggtattttattttgttttgacaatggcgctggcattgggtaattcctccactaaggcgatatcgttgttatgtcaaaaagtatgacccaacaagcggcgatcaatttgaatgaccgcatcgctatttttggctaggctgcattttaactgttaaattagtttttaccactaatttagcgcaaacgtggttgaaaaagcctaggctatgtgcccaaaatctgggcgctttttcaacacacgttagcagcgactgaccatataatagtaattttaccattgtcggtcagtaaattatatttcatttttaagtcggatccgggatggaaccattttacttcggcggcatttaaaaactgggtattgcaagggtggctaatttagcgtatgcttagattagctagtaagaacgtacgttcggtattgaagggcgatagtcattgtggcaacaaagtgcgtacgccggttcgtgaaccgcaagacagcactgcatcaaattacttgcggctacaccaactaagtctgtttaaaattttcacgggcaaaggtagtcacgttagggctgtatttctggtaaaatagtttgcagtagttttcatgaaattaacaataggtggcgtaagcaacatggacatgtacctcgatacctacgctaattggtatccacaaaatcatcagttgggcacgtatccgcgccgcaacggtgcacgacagtacactgaagcagagcggacggcgctgtacaaagcgttaacgccggcgcagcagaatggcagtttgttcagcgcaatgttgaccccgattacgtgcgcggtaagcaggccaagtatcactgtatctgtcatcggccgttaaaatatcaatttgtgctgcgctcgcgcaagcatcccagcgaggttaaaaagttgggcatcaagcatttttcggatcatttagggattccgatgaaggtcgtcagtgaaattcaagctggcgtgcaccggatcgatctggcatttgatgagttattatggctgaaacagcggggcgacaagtttccccttgatctgtggcggcgctacgtttacgtgcacttcaccaataaccgcctggcccaaccttataaaatgaatcaccatctctggttgcgtttattggacttcaaacaggctgacatgccgatttttattctcgattacaccactgtgcaaaaagagattgcacaagttgatcgcttggtttatgccgccaaagaaccgctggcaccagcccaaaaggaaacgtttgagcattatttagcggacgtgcaggaatattctaaattaccactgtttcagtttaaaaacttttgggatcccagtatgcggccatttctaaccgaatgggcccaaaaacatcaagctgaaccaggtgatttctatttccgtggcttattaaaagtcctacaaagtccagaacactggaagtttgcgtggcagacctttccatttaaagcgggcaccaaaatggttcagccagaagtttcaaaatatctgtacgaactatcgcggcggtatcccttggatgacaactttttcaacgagatcccgttagcatttcgtcatgggttacgtaaagtcttgcgccaacaaaaaacgccatcagtcaaggcaacagctagtacaccagcgccaaaaaagcgtcccgctagcaaagcgagccagatcgcggccctgcagctgtataaccaatggcggggcattacggcggaagcacaggcagcagcatttgctcaatttaagttgctagttgaagatgatttaactccacaagcggcaaaacagcctgatcagattttcttcgataaattatttaataccttattagccctaaatccgctgaaccaagtgcagatccagcaggcggtgcagcagctacttaaccggtattcggtaacgactgctgggttggcggaacaattgatacaagcgctgatgacctatcaacaaaccgctgactttgccagcagttttcaggcaataccagcgccattttatgccgaattggcccagcggtttaacgatttaccgtgaataaaaaatcacccagtgttgggtgatttttttgcttttaagttcgtgcccgaaactggtggcggcacttgggacaggtgattttaagctgtcctttgccacgagggatgcgaatccgttggtggcagtttttacaggtgaagaagcgatagtgttttcgctgctgccattcatgatagtgatggcgcagcggcttagtcagccaggcagttcgctgctgaaactgagtattttcatgggcccgctggtaaattttgcgggaaaggatgcgccaataagcgacgagcaataataaaatgcccagcaaattaagccagctagtgtgaataaacagggtcaagaagatcaacagcaagccgcaagtcattaaaaatttattcaaactatccataataccgtagcgaccgcgcataaattgcgcaactttaaaaagccattttggtggttgtttcaatcagatcagcctcactttttacttaatagtcctactatgccaaattgagacgttaaagtcatcgggcaaaaggcggaaagtgaacgtccgtggccttttctaccattagtcaagggaaagttgatataatcagctttcttttttctttacccagatcaaagcggcaatattggtagtagccaatctaaaaatagtattttagggtatattaaattgatccca

SEQ ID NO: 612 - DNA, 1448 bp, Unknown
  Metagenome-assembled genome
acaaaaaactctcagagggcgcgctttgcttcgccctcgtatccatgatatgaaaccgtcttcgctcttgatataatcaagaggaaggcggctttatttgttcatcgctggtttattggtggttcttcagaccccgtacaaaaaaccgatggtcttcagctctgagattacccaattgttgccctgagcacgtatataaaatttcaatccctcaatagccgaagacgctgcctatcaatactaggaggtctccccaatggaagttgtcgcagaaagtgttgccgggatcgatgtccaccaaaaggaaatcacggtaaccgtattaatcggttcagccgaatcagctaagccaaaaaaggtacacgcgcgttttcaaacggtcacttttgacttgaaagcgtgcggcgcatggttgaaacaacaagctgttaagcaggtactcatggaaagtactggccaatattggcgtcctgtttggcagatccttgagccgtttggctttaatatgatcctatgtaatccgcgtatcattaagaatattcccggtaagaagaccgatcaaaaggattctgaatggttatccgaacttgcgcggtacggacttgttagtgccagttatgtgccaccacgtcagattcaagagctacgtgaatcgacgcgtttaagcaaaagtatcacccaacaaatgacgcgcctgaagaatcaggtccacgatattcttcaacgttctaatatcaagctcacgacctatgtttccgatattttctccggttctggacgccgcattctggcattattggagaatggtgaggtgatcaaccttgccaacatcgaacaagcagggaccggtaaacgcgggtatcgattaaaggccactccaaaacaaatcttggcttcgcttgatggcgctctgagctacaatgatcgctttttgatggcaatgaacatgaatctgctagcgagttaccaacgtgaattaatcaatctagagtcgcgaatttatgagcaacttgaagccttctcagagttgtatcatcgcttacaagcgattccaggcgttggtgagggtactgcacaaatcattattgccgaaattggctcagacgtaagtccattccccgacgcccaccatcttgcctcttgggcgggcttgtgtccaggtagctatgaatctgcgggtaagaaacatggcgcgcatacgcttcacggtaataaatacctcaaaacggcgttgattactgcggctatggcagcgaagtcgacgaagcaaacgggtctacgagacttttactggcggttgtgctcgcgtatgggcaagcagaaagctaatgtcgcactcgctcacaagttactgcgtattatttatgtgatgatccagactggcgcgacgtatcaagaatataaaaagagccaacgtactgaagatacgttgactcccaaaatataag

SEQ ID NO: 613 - DNA, 1939 bp, Unknown
  Metagenome-assembled genome
tcaaatgataaaatagtggtgcccataaaggtccttctttctagtggaatgttgtggtgacaccattaaagacctttatgggtttttctgtccactaatatgttcaacttaaattttacaatctaccacttacaaaaaaacaccgttactggcgttttttcttttgcccattttcttccgctggttccggcaccatgcgccgatagccccaataaccgactaacagtaaaatcagcaggttgatccctagattggtgttttgaagcaaccgcgcaccgccataattcaatagccgcaccaccgtgattacacaatttgccactagcagccacttggtcagcgtcagcaagtgctgctcgcgtatgttgtgcagaggcacataatctagaataaagacgatcccaatttgcatcagtaaaactaaccaaacatccatagcgcacacctcactcaaatatttataataattatagcgcttacataaagtgtgaagcaatctttttccaggcaaagttgtttaccgccgctggtttcctgttatgatagaggtaatgttgaacgttggagggaatcatgcaaaagtcatggacattatcaggggtcttgcttgccagtggtggcgcggttttgtggggcatttctggtatttttggtaaattattatttgaagggccgaatgcagtgacaccggcttggctaacggcagtgcggatgcttctagccggggggttgttattgctgtatagtttggcgcgtcacggcgatccattagcagtatggcggacgccgagtacggcgattcggcaaattttatacggggtacttggtttgttgccggtgcagtttttttattttttggcagttgattacggtaatgcctcgattgcaaccattctacagtttctgggaccaatcgtgatcgcgttgtactacgtgatctttaaacggcagttaccatcacgggccgaagcaattgggatgttgttggcgttactggggaccttcattttggtcacccacgggcacttcaatcaattagtggtcgcaccgttagccttattttggggtttgatgtcggcactagcaattgctggtgatacgttattaccgcggccactgttaccaaaattcggctcgatcaacgtcaatgcttgggggcttttagtcggcggggtgcagatgaatttcattcagccagtctgggtcggtgtgccgcagtttacatggcaattggccggcgagatcaccgtggtcgtgttgtttgggaccttgatcgcctacgtgatgtattctaatagcttgttgtatatcacgccgaccaccgccagtttattagatgccttcgaaccactagcagcgacgattttatcgattattttcttcagtattccatttgcttgggccgatgctgtcggcggaattttgattgttttggcggtggtgatgctgtcattgaatgtacgaccgtttaagaaacggcgtaaatgaaaagagcctgtggcataagtctcaaaaaataaatagaccgactgaaattattcatgtggtcagttgagccatttttagttataagctaaaggttgaaagcatcaaaaatatcaaaaggttatggcgcaatatattactagtttttactctattaagcattacctcagagcttgtcaaagctatgaggtaatgcttttataaattcgtcaaaaattatatttaatgtacgtgtggtgctagtttgtaacatttagaaatttaacaaaaaagtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 614 - DNA, 2280 bp, Unknown
  Metagenome-assembled genome
tatcaaccaacttctaagtgtatctttaccgattccatgccgcctttcataagtagccctagggagccccgactgctgataatcttcaattaaattgagcttctcgagaactgtgaacttagatctgagcatacaaaaatccctccatagttgttagatgaattattgtatttcatctgacaaccataaagggattatcgcaacgtagttttaaaaccacgttaaggcctttaatttacagtttaatagttgatatgcacaccgaatgaaggcatgaaataacttgaaattgaagcaatagtaaccgtttcaccaggttgtggtgcattaatatactggttattaccaatatataaagcaacgtgataagttgcaccggcactaccccagaataccaaatcaccaggttgtaattgactgatggaaactctagatccagcactttcttgcgcagttgtcacccgaccaatcgaaacgccagctttagctaacgcccattgtgtcaagcctgaacaatcaaaacctgaaccttcagattcgccaccccaaacataagcgacaccaatttgtgactcagcagctgagatagcggcttgtgcaccagtgccataacttgtgctagagcttgaactacttgctgatgagtttgtattagttgcttgcgaagcttgtgagctcgtattttgtgttgaagtttgatctgtattggtacttacttgcgttgcttgtgaagttgcttggctagcagcggcagcagatgccgcattggcgctggcagttgcagctgattgggcggctgcttcactagcagcattagcactagcggttgcggctgactgagcagcagcttcactagcggcgttagcgctggcagttgcggctgactgggcagcagactccgcattagcttgagaggttgcttggctagcagcggcagcagacgcggcattggcactagcggttgcagctgattgggcggctgcttcactagcggcgttagcactggcagttgcggctgactgagcagctgtttgctgtgcagcttgttctgctgcagtcgatgcagcggcagcactagcagcagctattgaattagcagcggcttcgctagcggcattagcgctggcagttgcagctgattgggctgcagccgttgatgcagcggcttcgctagcagcattggcgctagcagttgcagctgattgggcatcagtcgttaacgcaactgaactagcactaactgtacttgtactagcagcagttgaaccaatctgtaaatcagcacttttagctggctcaacaccagctaagtctgtattattataagcaacgtatgcgcttggtacccatgcattgtcagcaattttgtaccaagtaatgctaccaactttaacttgttcagttgcagtcttcgtttgaccataaaccatgtaattaccagttggttgaccactagttggtgatgtccaaattgtgatcgcaccatctttgtaattaccagttacagtatcacttgttttagcagttgtcttttcagcagtattcgcttggaaatatttagctggaacccattcatcagttccgatctgataccatttttcaccgaaaacttgtttagttgcctgtaccttaacggcttggcccttagttaagtaacgggttggtttctgaccagttgttgggttgttccaaacggtggttgcaccatcttgataagtgacctcagccgtttgcgcagcttgcgtttgctgagcccctgctagtgttgcaccggctaaaccgacaacaccggcagccaagtatgtagataaatgacttttagactttgatttcgcttttgacatataacagcctccttgttacgcctagattaggacaatgcacgtttgcactatatgatctaaactgggaacaacttgggtccccgaactttcgaactttagtataacgtactttaagaaaaaattacagtatttatccctccgcggcgaaaatgtaatctatttgtgatgaaaaaaagatgaaaaatcagtcaactaaacaaaataaactagggtccgtctgaaaactacttaagtaagatgcaaattgaggcaatgtagaccgtagccagataaacatgagcgagcttatcataacgcgttgcaatcctacgaaagttcttcaactgattgaagaagttctcaatcaaatggcgctcacaataaacgtggtaatcacaggtccacttgtctttggtattttcctttggcggaatggtatagacgcctgctttatctt

SEQ ID NO: 615 - DNA, 88025 bp, Unknown
  Metagenome-assembled genome
agtactacgccgcttcattcccaaaggtcaaccgattgatgagattaccgatgatgaattgattcaaattaactggtatttgaattcccgaccactcaaatgtttaaattggcgaacaccgattgagatctttttgcgtaatctgcgttactaaatttgttcaagttatttcttgcaatctgccatttaaaaaaacaaacagcgcgcttagtagcgggcaaaatgccagcaaccagtatgcgccgttttgtacgggcaaaattgaccggaactgaggtagtgatcgataaaaaggggcattacgcgtcggtactgcataatatgatcgataataattgtttaattgaacagataaaggggaagagcttacaggtcggcgatcaggtaactgtctattcatggccagattaggtgtggtcgttaaaaaagtgtataaaaagaacgtttgatctgcgcctccagcaagtcaagcgtccgccataccgcgatattgaattgttcctaaccttcatcaccaagatgatgcttatcatgaaataacatgagcaccaaccctgttacaattatggcaccttcaataagagccgccaagtcatcagcctcctgtaattggtcacaactacaattctattgtaaaacggaataaggtaattgttaagcactaaatgtttttttcaaaaaaaggttgacgggctcacagacagttgttatactaatgccattcaattctaaggagtttttaatatgacgcaagtaaaccgaatgtgtaccctaatttcacaatcgaatacgtattattactattggttctttaagtagtgtctgcatcggtaagctagatgcagacacgaagtctgcatctatgcgagccaatagtctttaagcgtgtattaaaaacttggccacatggatgatttaagaaaatcagctgtgtggcttttctttttgggaacctttattaggctatctctctaagatgaggtctaaggtcgcacagcaaataacatgttgtgcgaccttttacttttacttacggagggatttatatgtttgatgaaacagatcagttgagtgtgaatgcattacgggctttaagtattgatatgattgagcgggcagggtcaggacatcccggattacctttagatgctgcgccaatggcttacgttttatatagtcgtcatttacgagttgatccacaagcaccagattgggtcaatcgtgatcgattcgtcttatcagcagggcatggttcggccttgctatacagcatgctgcatttgagtggttttccaacccatatggctgatctgaaacaattccggcaattacacagtatgacgccaggacatcctgaacatggtttggttgcgggagttgatgcaacaacaggccccttaggtcaaggcttgggaatggccgttgggatggcgatggcggaaacgcatttggcggcgcaatataatacgccagaacagaaagtgatcgatcatttcacttatgtgatttgtggtgatggtgacttgatggagggaatctctcatgaggccgccagtttagctggtaacctaaagttaaataaattaattgttctgtatgattcaaacgatgtctcactagatggtgcgacggaccgtactttttctgatgacgcccaacaacgatttgcaggttatggttgggattaccaaaaagtaagtgatggtaataatttggcggcaatcgatgcggcaattacagcggctaagttgacagacgcaccaagtatgatcgaaattaaaaccacaatcggttatggcgcacctaaacaagggactcatttggtccatggggcccccttaggccaaactgatttggcggcgactaagcaaagtcttgggtggcaagcagcgccgttcacagtgccagcagcagttaagcaacggtttgctgagcgggtgcaggaacgtggccaggcggctcatcgacaatggcaagcattactaaccacctatcagcaggcacaacctaaattagccgctcagttacaccacgcgttagcacaagaattgccagttgattggcagagtgatctacctaaatatcaaattggggatagtgaagctggtcggatcacgagtcaaaaggtgatccaagcactagcggctaaggtacctagtctctggggtggtgcagctgatctagcttcttcgaataaaacggatattgctgccagcggttccttcagcgccactgcgcgacaagaacgcaatttaaactttggtgttcgtgaatttgctgaagccgcagcaatgaatggcattgctttgcacggtggtagtcatgtgttcggtggcacgttcttcgttttctcagactatatgcgtggtgcaattcgtttggcggcattacaaaaattgcctgtgacttatatttttacccatgattcattggctgtgggtgaagatggaccaactcatgaaccggttgaacaattgatgagtctacgagctatgcctggcatcagtgtgattcgtccagctgatcccaatgaagcagttgctgcttggcgtttggcaatgactaccaatgaccgaccatcggtgctagtattaacacggcaggatttggcggtattaaaaggtagcttaaatcaccctgacggtgtcagtcgtggcggttatgtgatttcaccacaacaacgtaaacaagctgaagggatcttacttgcgtctggttctgaagttgctttggtgatcgccgcccaacagcgtttgcgcaaattcggccatgatgtggctgtagtctcaatgccgtgtttcgatcggttcatgcaacaaccagcggcttaccgtgaaaaagtattgccgcgaaatattcgccggcgggtatcaattgagttgggcgcaacactaggttgggaacgattcattggtttagatgggttaagccttggtattgatacctttggtgctagtggtcctgctgctgaagtcttggcggaatatggttttactagtgatgctgtggttgctgcttatcagaaattatggcgggccgataaccggctacaaacgccgattcaacggagtgtgatttaatgatcgatggtaaaacacagttatatggattctttgcgcatccggcgcagcatagcttatcgccgctgatgtataataccacgtttgctgaacagaaaatcaatgcagtttacttagcttttgattttacggctgatttagctactgcggttacgagtatgcggactttgaattttggtggtgctaatctatccatgccatttaaggcacaggtcattccactattagatgagattgcaccggaagctaagttgatcggtgcggtcaatacgatcgtcaatcaaaacgggcgcttgattggccatagtactgatggtccaggattctttgctggtttggcgcagcaagggcagacttttcagaacgctcatttgacaattttaggtgctggcggtgctggattagccattattgccgcggctggtcaagcgggtgtcaccgcgatcgatgtgtttaagcggcgtaacgccacctacgcgtcagtagcagccaaattgactgaaatcgccgcggcgactaaagtaacgattagattacatgattatgcggctacaaatgagttgaccgctgcgctaaaaagtagtgatttattggtcaatgccactaatattgggatgggtgctggtagtacagcgctaccgataccacagactgtgttgactcaggtaccaccaacgactgtagtcagcgatgtgatctatttccctaaagaaacggcatttttaaaggcagcgcgacagctcggacatcctacgtataatggattgccgatgctgatccagcaaggtgtcttagcttacaaactatggactggcgctgaaatgcccttggcaaaagtaacccaagcattagaacaacagctctatcaaaaataataaaaatgaggtaattaatgatgatcatacaattaaagacaaatgcagacgaacaaattattgcgggcttgattgcgcgtttggaagcaactccagccactgttattcgcatcaaaaaccatttagcaattcctgaagttaaaacgactgaattatctgctgctgaagcgggtgtagttgctgaagtgattgaaaaaacgccagctgccgttttagggagtcgtttgttccaaccagaagatacgatcattaaattgccacattctgtgatcggtggtaaaggtaatttcacaatgatggctggtccatgctcagttgaatcggaagaacatgtccgaaaaatggctaaggtggctaaggcaggtggtgcaatgctattgcggggtggtgcctataaaccacggacttcaccatacagtttccaaggtttaggtgaggatggcttgaaatacttacgcgaagcagctgatgaaaacggtatggatgtgatcacagaagttatggatgagactcacgttgacttgattgctaagtacacggatgttttccagatcggtgctcgtaacatgcaaaacttctcattactaaaggcagttggtaaaactaacgttccagtagcattgaaacgtggtttagctggaacggtcgatgatctattaaatgcatcagaatacattgcggctggcggtaatcatcagatcatgttgttagaacgtggtattcggacgttcgataataaatatacccgtaatacctttgacttagcagcggttcctgtgttgcaaaaattatctcattacccagtgattgttgaccctagccatgcagttggtgaatgggatctagttacaccaatggcccatgccggtgttgcttctggtgcttctggtatgatcgtcgaaattcatgatgacccagaacacgcattttctgatggcccacaagcattgaaaccagatacttacttaaagatgacggaacaagtttacgcgattcgtcaattaatggatagttgggaataaggttagtgacaatcagatgcttacttagtaatttttgctaagtaactttcagcttaaagtgagatagaggaagaaggcagtatgttgcaaaaaattgaagttaagttaccacaaaaagaatacccgatctacattgaaaatggtcttttgacgcaaataggtaccttggtgcgggagcactggactaaagtacagcaagttgcgctgatcagtgatagtaacgttgcaccattgtacgcagaaaaggtgcggattcaattgactaatgcaggttttcaagtctatctttacaccgtgactgctggtgaagcagctaaatcattaggtgtggcgtcttcactgtatgatgaattattaggtgatggcttcacgcgtagtgctggtgtgatcgcgcttggtggtggtgtggtcggtgatctagctggttttgtggcttcaacttttatgcgcggtttagcctttattcaaattccaacttctttgttagcccaagtcgatagtagtgttggtggtaaaaccgccgtcgatctaccggcgggtaagaatttagttggaacgttctatcagcctgatgcagtattgatcgatccggctacgttgacgactttatcgcagcgttatttagttgagggctatgcggaagtagttaaaatggctgccattgccagccctgatttttggcaattggtgacccaagtccaatcggttgcagctattttagatttagctgaagcattgatccaggccagcgtgactttcaaagctaagattgttatggcggatgaaaaagagggcggcttacgacaaatcctgaattttggtcatacttttggtcatgcgatcgaagccggtgccaatggtgctttggcgcatggtgaagcaatcagtatcggcatggtggcactgacgcagtgttttgaacatgccggcttaacgccagcggggatgaccgctaaattacagcaacagttagctgccgttgggttaccgctaactagtaaattaattggtcaggccgatttttatgcgcgaatcgcaaaggataagaaaaatcggggtggccgggtaaacttgatctatttaaaggcgattggcgagccagctatttatccaatggctctggcacaattaccacaatttgtggaagaaaatctattggcggtgatgtgatgacaccacgtttagcggtgttgggaccagcagggacctttagtgatattgctgcacaacaatatttacgtcagcagcagcttgattggcaattgacttactataattcaatcgatcaagtagcagctagcgtgcaggcagaaaccgagtacgccttattaccattagaaaatacattggacggctatgttcaaaacacattagcaattttaagttatgctgagctacaggtagtcggtgaagcgttagtgccggtgcgcttttccttagccgcaaatgctgctgatttggccagtattaagcggatttacgttcagtttaaaaccaagggtcagtgcggacgaatcctagcgcagttaccacaagctgaacgtttgaccaccgaaagtaatatgctatcgtttaataaattacaaacggcagcgcgcggcgatgcagctattattcctcaatttcatttggcggagttaccagatacttttctgaaattagctgatgttaccgatacgactgaaaattatacccgttttatcgtagtcaaaaaacaagctgctgctttgcaacaagtgcagccgtggcaacaagattttcgggctttatgttatattacgccgcaaacggatcgggctggcttattgagtgagattcttcaggaatttgctcagcaacatttaaatttgatctcgatcatgtcgcgacctacccggcgtgagttaggccattaccgcttttttattgaaatcggtggtcaagccggccaatcaccagtgttagcggatgctttggctcagctagcgcaacggcatcacgtgaagtacctaggcagttttagtcgctaattgctgccgctataaccaattaaaatttaattttcaatccccttgcattttcatgaaaatccttgtagactatccactattgtctaaacgaggtttgaaaatgaaaggggattttgtcgtgcgtactttgactgcagggcggccattaaaattgattctctggtttacattaccattattaattggtaattttttccagcagttttataatattgcggatactttgattgttggtcagacgctagggattaaagctttggcggcagttggtgcaactggtgggatctcatttctgatcatcggttttgctcaaggtatgaccattggattatcgttgttaacggcacgtcggtttggtgcgcatgattttcgtggtgtccggcgtagttttggagttagcatcgtgatcagcttagttgttgctagcttattgacggtgatcagtttacgtttcacacgtgaatttttagtgatgatggcaacaccggcctcaattttaccgcaagcagttgctttcattcagatcatttttgctgggatcatcgcctcaatgatgttcaacttattatcaaacatgttgcgtgcgctaggtgatagtaaaacaccgctgatctttctagtaatcgccagtgtaatcaatattgggcttgatttcttgttgatcatgggctttcatttaggcgttgctggggccggttacgccacagtttcagcgcagattgtagccagtttactctgtttagtttatatttggcggcacattccgtatttacgcgtcacttggtgcgatttgaaatgggacaaagccttgtactgggaacatttacggatgggtttaccactgggctttcaatcatcggttatcgccatcggtgccattattttacaagtggcgttaaatgatttaggaacaaacgctgttgccgcatcaactgcggccagtaaaattgatcagattgcgaccttgccgatgatgtcattagggatcacgttaggtacctatgctgcacaaaattttggtgcccaggaatatggtcgaatcatcaaaggtgtgcgccagagtttgttgttatctgttgttttcagtttagtactcagtgtactcattattatcagtggccgtacattagtgactttcttcatcggtaacgatatggcagtgttagatttggcacagacttatttcttggtggttgccagcggctatgtttttcttgatattttatttgtcatgcgctacacgctacaaggattaggctacagtatgatctcgatcattgccggaattgctgaattggcgatgcgcgctttggcggtttttgctttagtcaaaccatttggctatgctggtgctgctgcagctgaaccattggcgtggatcggctcctgtattgtgttagtgatcacttatttacaggcgattcggcgactccgtaaagccgaacaattgaaacaaaaagttcatgggcaacctgctgaaccagtggcagcaccggaattagaattagttgaagagtaacgaaaagacgtcaaccacaaaaaagttgacgtcttttttaaatcaagcccgactaggtaactcaatttgagcttgtgctaaaatatggccggcgctggcgtgatagaactcattcagccaatagccattagttagaggtaataactgatcaagtgcgtataccgttaattgataattatgggttttgtccggtggtgtggggccaatataatgtttggctgcgtccagatcattatttttaacaaacggtgaagccagactattcttaccttggatcaattgagtcgttaagtcacgactggcgttggctggtaaggttgtttgttctggcgcgatattagttactaaccagtggatccacgggaaaccagcaactggcacggcatcaaagtctaacaaagttagcgcccaggctttagttgcggccggtaactcagcaacttgcactgggaatgaacgattgggaccgccattagtaccacgcgcggtatctggtgcatatttaccatattcatcagctaagtacccattttcagttgggacaataagtttcatttgctcaccactttcattaaaataaaacggctatcgtctttaatttacgcgtgttggctggctaattcaagttttgacaccgacagctttgttcactatcgggattgtggtagaatgagtataattttaatgtaacactaataattaataaaggatgagtgtgttatggcagagatgcggcaaattgaagcgcaacggatcgtagtcaaagtgggaaccagtagcctcatttaccccaataatcaattgaatctacacacgatcactcgcttagcgctggtgctcagcgatctgaagaaccagggcaaagaagtggtgctggtgtcatcaggggcggttggtgttgggatgaataagttgggcttggcgcaacgacccacaaccttaccggagcaacaagcagtggcggccgttggtcagggtgaattaatgggcatctatggccgggcatttggtacctataatcaaacggttggtcaaatgttgttgacgcgtgatgtgatcgcttatccgcaaagccatagcaacgccttaaatacctttcagaatctactcaaaatgaatgtgatcccgatcgtcaatgaaaatgatagtgtcgcagttgaagaattcaatcatttgactacttttggtgaaaatgatgtgttagcggctatcattactaatctgatcgatgccgatcttttaatcgttttatcggatattgatggtttttacacggccaatccagctaaagataaaaacgcgcgcttgttggctgaggtacggcagatcgatcagacgactttagctgctgctggcggtcacggcactaaatatgggactggtgggatgatcaccaagttaaaggcagcaaaacgaattattgccaatgatcagcaaatggttttggctaacggtagtgatccgcagattatttatcggattttagctggtgaacctgtggggacattatttaaagcggctaaagtacagcaattaaccagtgaacatcatggctaaggccatatttcttgcggcaatattttgccgtagtaacatcaaggttaattagtgtgttttgctaattaactaccttaaaagtgaagtagaggaggtagtggcatgcaatcgattcaggaaatgggacaggttgctcaagcggctgcgtttacattaggtcaattggcaacaactaaaaaaaatcaagttttactagcgatggcggacgcactagtagcggcgacgccaacaattttagccgctaatcgacaggacatggcggcggctaatgccaatcaggtacgtcaggtgatgcgcgatcgtttaaaattggatgagcaacgaattgcgacaatggcaacgggtttgcgccaagtagcaactttagccgatccaattggtgtgatcgataaaggttggcaaaccgatgctgggttgcaaattgcccaacaacgagtgccattaggtgtgatcgcaatgatctatgaagcacggcccaacgtaactgttgatgcggcggcactgacttttaaatctggaaatgcggttattttacgtggtggtaaagaggcgttgcaatctaatattgctttagccactgttttgcagcaagtgcttgttgatttacagttgccagcggcagcaatccaattggtcacggatacgtcacacgagacggcacaagcactgatgcggctcaatgattacgtcgatgtcttaattccacgtggcagtggcaaattcattaaaacagttgtgcagacagcgaccgtgccggtgatcgaaaccggggctggtaattgtcatatttacgttgatgactctgctgatctagcgatggcccgggatgttattatcaacgcaaaaacgcaacgaccagctgtctgcaatgccatggaaaagttagtggtcaatcagcaagtcgcggcgcaatttttaccacagttggcagcagcattggcaccctataatgttgagttgcgtggcgatgaacaagcacaggcaattttacctacgatcacaccagctactactgaagattgggcaactgaatataatgattatattttggcaatcaaagtcgtacctgacttggatgcggcaatcaagcatattaatcggtataatacgaagcattcagaagcaatcattaccaatgattatgcgcatagtcagcaattcacgaaacaaatcgatgcagcggtggtttacgttaatgcgtcaacccgttttaccgatggttttgaatttggttttggtgcggaaatcggcattagtacacaaaaattacatgcccgtggaccgatgggcttaactgcgctgacctcgaccaagtatgtggttcggggttctggccagattcgtcaataaagcaaaaagccgcatttgcggctttttttgcgttcagtcttcttcagtaatatcggcaaacttagcaccaaggaatttgactagtttacgcgggtctaaccgaacggagcgaccaattttaccggaagaaactaaaatctctggttggattttggcagtggtactgaagtagattggataattatatttttggtgaataccgattggtgtatttgcgccatgttcatagccagttgtggcaattaattcttttagtggcactaagccaaccttacgattaccggtcactttagcaaatttcttatagctgatccgttcatcaactgggacaaccccaacgatcgggcctgttttttggcctgtcatgaccaaggttttatagatcatgtggtcgtcaatattcaattcgcttaatttcaattgacgcacatcaccatcttgttcagtcggaaattcgtattgcgtataatcgattttggcctgatcaagaattttttcgactaaagttttatttaatttagcgtttttgtcatgtttcttactcacgttcaagatcctttctgcacatgatgcttagtaccagccagacggtcactaagcacgaatgaattaatactttcaatatagcattttcattgcgcagatgcgagccggctgaacggtttaatgttaaactagacataagatattatgaaaataaatgatggaggcagcatatgacggatgcagtaactgaaacgcttcgccagctggaccagttaagaactagattgagtcgcggcgaactttatcaacgtttacctcaaaaagttggtgagttgatcgataatttaccacatgaaaaaagaactccggtaccagtgttgaaagacaataaggcggcattagcgcaaatcaagtcattgcgcttacagatcaagcagaaaaaattgactgcgatcagtgatgctgaaattgactttttactggcacatttagcggcaaccgatcctttggtacgcgataaaggcgtctatttcttatttaacgatattctccaagcacgattattaagtgcagcgcaaatcaaacgaatatttcatcgtttacttgaccccaatatattgtacgggcatattttggagacgaaaagtaatgccatttttttacgttcttttagtgtcatgatcttgtcaggaattttgtatgttgatcggatgcattatcacacattacaaaccgctgatttagaggaagtcagcctcaagatctctgcttacatggcaatggaaacagatggtcgcggctatattgggacccgtggttgggcacacgcgtatagtcatgttggcaatgtactggatgaactgactgaaagtacgtcacttaatcgagctaataagctgttttatttaacggtacttttagcacgttatcagcgattggaatcaccgttgatctttggtgaggatcatcggttggcgttagcaatcgctaatttggtcaataaaaataaattttatgcggattattttttattgctcttgcaagcttggcagcgtgaattaatgattatgcgcccacaagaaaatgaaggcttttggaattgttggtataatcgcaatcggttattacaagccttgatcattcggggtgatctacctcagaagatccaagattttttaatgcagatcgttgatgttttttaagtgactgctaaccatggagtggttgttgtgttgattatattactgttgctgaatgtaagtagttactgggtttatcataacagcgggggtaacccgctgttgttattgatttggcttttgttgggattaatagctagttatgcatgggtagagcgtgcccaagccttaacttggtggcaattattaggtcatagtctacgtggcagcctttggttgcctttttctggtttattagcatttaatttttggcggtatagttggcaaccgccaagtggtttactcgatcaatttttaaatcatcgctggcaaattttgccgttacttttggtgctttacctcggtatcattggttttagtgtgcgtcatcattttagtgaatatttaccgcacatgctccgctggctagggttacttttgctgctggcagttagtttgctgatcgtgcaatggggaagtgatcagattggcggcactttcagtcgttatagtgtgcgattgctttggttagtctggttgaatggtaagtatcttttgtggctagatttattattgcgtttgcggcaacagcaactggcattagattatcgttggtttagtgttggacttttattagtaataattcttgcttggccaatgagtggtcaattttttgctaagacggccacacaaccgcaaattattgcccatcgaggtgtcaatggtcagggggtacaaaatacgatcagtgctttacgctcaacggtaccggcacagccaagtttagttgaaattgatttgcggactactcatgatcagcaatttattgttagtcatgatgctgatactcagcatttgacggggcaggctaataatattgcgcacactaatttggctcacctacaacatttgacgttgacggagaatggacagcacgctcactatgccagttttgctgactatttacagacggcacaaaaggtaaagcagccgttgttgatcgaattaaaagcgtccgatcattttcagcgaatggctcgtgagtttgttcagcaataccgaactaaattaccagcatcggcgcagtttcatagtgctagcttaacgttggtcaatttattaaagcaggcgcggttcacaccggttggctatattttaccgtttacgcaaactgggttgcctgcaactcacgctgatttttatagcgttgattggcgtaccttgaatccactgatcgttgcacaagcacggcagcagggtaaaccgttatatgtctggacggttgatcaggcttgggcattacaagcagttcgtcatttaaatgccactgtggtgatcacggatcaaacaagtcaagtacagcaacagcttcaccaaccggctggttataatggtaatttattattgttattagcaaatttttagttctttttgcgtatgttaattaatagtgtgtttctataaaagtgtcatttcagcatagtcaaccagcagcgagaactagcgtcaatacttttattagccacgctttctaattaacttatccattacaggaggacgaaaaataatgttagaacaacaacgctgtccttgggcacaacaacaattacgtgtgtttcatgaccaagagtgggcggtaccagtcacggccgaagatgagttatttaaattattggcattacaggtatggcagtcaggcttgagccaaagcgttttattgcgcaaacgggctgcaatttgcgcgacctttcatgatttagcgccagaatggttacgacaaaccgagacccaagtcttgctggatcgtttagctgatccagcattgatccgtaatcggcgtaaattattggcaattcagcataacgcttttgctttagaagccttgcagcaacagggtggatcgttatgctatttattgtggcaacgcacgcgcaaaacgtattttacgactgctactgcaattccgcgttatgatgaaactgcggttcgtttagcagcacagctcaaaaaagccggcttccaatttatgggaccgactaattgctatgctttacttgccactgcaggcgtgcttaatttacatctaactagttgttggcgttacccggtgatcaatcaagcacaacagatggtgaaggaatcacttggcttctaattgccgtagaatttgttgcagctcttggcgccgttgcgggctggtgctcgggtaagccaaaggtagggtgctcagttgttgattgatgatctgcgaaacaatcaaacgtgaggtccacttatcgtcggaaggaataatataccaaggatcatcattggatgcagtgtgctgcaatacatcagcgtagacccgctgatatttaggccaaaaagccgcttcgcgaatatcggctgcggagaacttccagtttttttcgggtagttcgatgcggcgggcgaagcgctttttttgttcggctggagtgatatgaagaaagaatttgagcaccatgtagccgcaatggttcgcataagtttcaaaatggcgcagatcttgataacgtgtgcggaaaaaatcagcgggaatgtcactcaattgatcgattcccggtaaattttcttgcaataaaatttctgggtggacttgagtgaccaaaacatcttcataataagaacggttaaaaacaccgatctgacctcggcgcggaaagacttgatggacgcgccagagaaaatcgtgagccagatcctgtttcgaaggtgttttgaagttattgactacgatgccttcgggattgacaccacttaaaatatgtcggatcatgctgtctttgccagcagcatctaaagcttgaaaaatgatcaacacgccataacggctttgggcgtaaagcttatcttgatagctagccaattgcttaatatttttatcaatcgttgatttaatttcgctggtagctaatttagccggtatggtagtcggccaagtggctaattgtaacttcttttttccagtatagcgatattggtctaaatccagaatagattccattatcaacgccttcttctaattgattgtaaattaaaagccaagaactgactgttcttgacttttaatcgtttattcggcttgaatactagcttttttaccggcttgattcaaggcaggtttgttgtccaagtctgtccgtacgacaagcacatcacaaattgccgtccgcgttacgtattcggtaacggaaccgattaataaacgttcaaccgcgtttaagccagttgcaccgatcatgatcaagtcaatattgtgttccttaggaacttccttggcgatgataacttttggtgcaccgtattcaatggcataattaacattatctaaaccattctttttagcggtagctacatattgttccatcgttttcttggcagtgtcagtcacttgctcaaccattgcggaatcgaagctagaaacgttttggaaagcacgggtatcgacaacatgaatcaagaataattcaccgttgttccgtttagcaacttccacggctttgcggaaagctaattcagcttcgtaagaaccatcaatggcgactaaaatatgtttgtattgttgtagcataatgatcactccaattatttttatctcacccttattgtacgttattttagggtaatgtgtaaatgaaagcggctaaattatatttgatttgcgaaacttacagcaaaaacggcggctaaaacacaacccatcagcaagcaaactaaccaaaaagtcacattattggcgatcgtgctgataaaagttaaaccaccgatcaccgcaaagtaattacggtaatgagtcaaaaaactttttagctgtggttcctgctgcggttggtgatttaaaaattggccattaagttgacgatgtaaataatagctgattgcaaataaaactaaggcaaaaataagtagcccgatacgcatgatcttgttctcctattccacaattaaagtctatttattggccaggtacgctaataaatcctgctgtgctactgtcgcttgttttgaaaatactgtctagccagtattaattactagaactgatttgctaaacagaacttgctttccgctgtcgcaagcaacatggttctttaaaatcaaaataataaaaaagacgactcttgcgaatcgtcctagataatctggtggtgccgttgcaattccgtttgtattgaacccgcaaattagcaggtgggttcggctatttacccatgctagcgtcctcgtgaaaaggctggctttgatgagttaaaattgtcgttcccgtatttaaattacttgatcggtcaacacattgtggaaaaatacgcacacctcagaaaatctatccttatactagcatatggattcggattgtgcaattattacgcaactaatggcgttgggcagccagtaaacgctgatattgttccgctaacgctttttcgtatttaccgttagttttgggctgataataagttacttgctttaaacgatccggcaagtattgttgtttgacccaatcgtttggataatcgtgaggaaatttatagccaacgccgcgattcagtttagcggcacctttgtagtgggcatcgcgtagttgatcagggacttcaccggctttgccggcgcgaatgtcttctagcgcggcatcgatcgcaacgataccggagtttgattttggtgatagtgctaggtcgatcactgcgtcagctaaaggaatacgagcctcagggaaacctagtttttccgctgcttgtacggcgctgaccgtccgtacacaggcttgcggattaccaaggccaatgtcttcataagcgataaccattagccggcgggcaatactcggaagatcgccggcttcgatcagtcgacccatgtaatgaagagcggcattaacatcactgccgcgaatcgatttttgaaacgctgagatcacatcataatgtgcatcgccatttttgtcgttactaacagccttacgttgaacgcattcttcaatgatcggtaacgtaatattgattttaccatccgttacgggagtcgatttgaccgctaattctaatccatttaaagcgctacgtagatcaccattagtggcttgggtcaaaaaagtttccgcagtatcatttaaatgaactggtgactcgccaagtccacgcgttttatctgttagtgcgcgctcaatcgcgactttaatgtcattttctgccagcggtttaacctcaaagatctgcgtccgactgcgaatggcaggattgatcgagatataaggattttcggtggttgcaccgatcaaaataatccggccattttccaaatgtggcagtaaaaagtcttgtttagttttgtctaagcgatgaatttcatccagtagcaagatgacagtgccgctcattttggcttcttcagcgacgatctgtagatcctttttactgtcggtggcggcattgagcattcgaaatgcataatgagttgacccggcaatagcgctggcaatactagtttttccggtgccaggcgggccatataaaatcattgacgataacattttggcgtcgaccattcgccgaatgattttaccaggaccaactaagtgttgctgaccaacaacttcatcgatattagtcggtcgcatgcggtaagcaagtggctgcatcaaaaaacctccttcgctcatttaagaacttaattgttgaataaactaaatcattgttgatttgctgaaaatgctaacagaacattatagcacggtaaacaaagttgactcaaatgatgggctgttagtgacggagatttcttgtataataaagttactttatgttgtagagaaagtgagctgaaattatgttagatcagattggcacccaattaaaaaaatatcagcacgaagcttttttgtttgctggtcactatgggattgaaaaggagggtcagcgagtaaatacgcaaggggatttgagtcaaacaccattgccatttacacaaccgcatccttatgtaaaaaatgattttgcccaggctcaagcagaagtggcgactgattattttgatacttgtcagcaaacttttcagcaattacaggggctagatgcggtattattacgggccttaccagaaaatgaggtcttatggccattgtcaatgccaccaaagttgccatcagcggcagagatcaaaatagcggcgcccactgcagctgggttacattaccgccaacaaattgcgcataaatatggttatcagatgcagatgatgtcggcggtgcacgttaatttttcattatcggaacgcttgatgcgctttttatttgaagttcattatcataatcaatttaatgatgactatattgcttttcataatgcagcttatttgaaactgactcagaattatttgcgctatcgttatgtgctgacttatttatttggtgctagtccgttggctgcggctaatttttcaaccgctgtgccagatcatttggttcgcagtttgcacgctagtcggcgctttggttatgttaatcgcgctagtcaggaagtctctttccaatctatcacggcgtatgttgctgatttgcagcaattgatcgataacggtgaattgcaaggaccacgcgaattttattcaccagtccggttacacggtaattcgctagctgaattagagtcagctggcattcattacttggagttacgtaacttagacatagatccttatgcagctgatggtttaagtgcaaccacattaaactttttccgtttatttttagcctatctactggtgacacctagcgtgcccgtcgaacaagcgccaactgttttagtgcaagcagcggcccaaaatgaaaccgtagcgttagagtcaccgttaggggtctcgcgcttacagccacaattacaagaatttatgcagtcgttaggaaaatttgctcaggactttcaggcaccaattgaattgcagcaggctttgcaaacaatgcaggctcgtgtcgttgattatcggttaacgcccagctatcgcttaagtgaagaaattaacggtggttcattgcagcaatttgctttgcgacaggcacaaacattcaagcaacaagcgattgcacagccttaccaattactgggatatacacaattggccgcggatagtcagttgctgctagctaacgcttatcagcgtggtttagctgtgcgtttgctggatgaacaagctggcgtacttcaactagctgagcatgaagtgatcggacccggtgccagtacgcgtttgaattcacaaacggcggttatggctagccaaaataagctagtgacaaagaagttattgggtcaagcagggttaattgtgccagccggtgccgaatatacacaggttgcgactgcgatggctgactttgctgatcttgcaaaacagggattggtggtcaagcctaagcgggaaactaaggggcaaggtattactgttttccaaactgcgccaaccgctgagctatttaaggtggcgctggagcgagctttgacaactggaactagtgctttggtggagaattatgtaccaggcacagtttatcgttttctagtcattgctggacgtgtttgcgcagtggcagaatgcatgccggctaatgttgttggcgacggtcggcaagctttgactgctttagtcgtacgtaaaaataaacaagccaatcgagggttaaatcgtccttttcgaccattaccattagatggacaaacggattttgatttacaacaacaaggattgcagcgttcgatcattccggcgcggggcaatcaggttaatttaagattggctgcgacttttgctaccggtgctgatgcggtggatgtaactgcagatatggacgctagttacaaagaagtggcagtggcggcagcgcaagcattacagttacaagttgctggggtcgatattgtgatcgataatctttatcagccggtagatgcagcccatccagaattagcgacggttttaagtgtgaccgcacgacctgaattagccgtacatgaggctccttattttggcactgcacaaccagtcaccgcggctttactcgatcaattattgactaaataaaaaacgtagccacaccgtgtttgattacgggtggctacgttcattaatgatcacgatggaataaattatctaaaaacgaatgctgcggcgtttctttttcttcagcttgataaaagtgactaatatcaaccttagcctggttgaccgctgttgttgtaactaataacaatgcaatcgcctccggtgtggtgctggtggtatcatcattaaccatggtaaaggcgagatcgtgttgtgtggcgtattgtaaataaggtttcagttgcgctgaatttaagcggccattgagtaataatttagtcgctgccaattttggcgcgatcgacttaaaggctggtaatgtccgttggtcggttaattgcgccacctgaatttgcaataaaactcgctcacgtagcgaaccgagataacgacggcgctcatctggtttagtctggggtgtgcctgtcatgcgactttttaattggctttcgaggtcattgttttccgtcacgctgggtcatccctttcatcattatttgataccatcatgatagcatatccaattaataaaccaaatttagtgcagtaagtttaaaaggggagtgagtatgatcagttttacagcaaatgattttaaagtttttaacgagcaaacggtagcagggcggatggcgttgattcgtgagcagcttgatcctaagtttgagatgcttggtgcaacgctcagtacccaattggcggcagttaaattgccggtttatattaatgtagctaaacacttacgtcgccatattaatccggcaccaaatacttggtttgcattaggaccatataaacgtggatataaaatggtgcctcattttgaaatcggcttttgggatgatcgtttgtttacttggttgtgcttgttggaaaatattcagcaaccagcgccatatgccgcgattttacaccaccaacagcatttgatcgaacacttgccggttggtgactggcagttgtcgggtaatcatatggctaagccaattcaaccgttaaatacagctaatttagttgcacaaacgcagcgttttactgaagttaaaaaaggcgagtggctgttaggcaaagagtggtttaaaacagatcctatttttgcaaccaatggtgcaattgaaaacgagatccagcaaacggttttagaactagcgccgctttatcgtgaactattagcagcaattcaaccagactaaaaaaacgcctgacacaatgtgccgggcgtttttagcattgatattacaataattggttgtagtattcaacgacaagtgtttcatcaatatctggttctaattcgtcacgttctgggaaacgagttaatgaaccttctaatttgtcagcgtcgaagcttacgaaagcaggacggccaacaactgcttcaagagcagcttggatgatcactaagtttttagatttttcacgaactgaaattacttggccgacttcaacgtggtatgaaggaatatcaacacgtttgccatctactaagatatgaccatggttaactaattgacgtgcttgggcacgagttgtagctaaacctaaacggtaaaccatgttatctaagcgttgttccaataagatcatgaagttaacaccttgcttaccttctttgatcttaccagctttttggaacaagttagagaattggcgttcgtttaaaccatacatgaaacgtagcttttgcttttcacgtaattgaacaccatattctgataatttgcggcggctgttgggaccatgatcgccaggtgcgtaaggacgccgagctaattctttacctgtaccagataaagaaatacctaaacggcgagattttttccattgtgggcctgtataacgagacataaaaaaattcctccaataagtttatttggagtaaaataacgaattgtaagttcagtatacgtgcagtttgttctgcaactttcgccttatgcagccgcaggttacttgttgaactttggtgcaacaaactgttgacgcgcttaccacttactgctgcattattttacacaacgaccagtgtagcaaagctaaggggtaaagtcaattattgtttttatgggccggggaaaaaaccacaccagttgttatcgctagtgtgggctttaaacgtggttgaaaaagtaaattattgcgtacagctgaaccttttttcaatacacacttttttatagatgcttgaccaagacagcggcaaattcttctaacgcagcttgatcgtcagcgttaaaacggtcaaactttaatgaatcaatgtcgagaacaccaattttacggtcgccatcagttaagggtacgacaatttcggcattggtagctgagtcgcaggcaatgtgaccagcaaattgatgaacatcagccacgacttgcgttttttgggtggcaaaagcagtgccaacaacgcccttaccattagcaatgtgcatacatgccaccttaccttgaaaaggacccaagtcgagttcgttcttacttttattataaagataaaagccgacccaattgacatcagttaagctgtcatttaataatgcggcagcgttagccagattagccattaaatttggttcgttatatagtagcgcatcaacttgttgcgccaaaagtgagtgtttagtcattctatttggacctccaaaataaattagatgctgtttttgcgattcgttagtgatgcaccgcggtcactatgatataatttagagtagattttaacgacctttacaaataaatgcaaggtaaattgtgaaacgtgacgggggttttattgatggagttaattttgatcggtattattattttagcattagtgctatatgtcggggtgattttttaccagcgacgtaattctaagcagatcgatgcactgcaagatcgagaacagaagctgactaaattaccgttcaaaaaaacgatgagtgctgcacggcagcagggcttagcgggacaaagtcaagaagaatacgctaagtggcaggaacgtttacaagagattcagaaaaattgctttgctgatttagagcgtaaattattattagcggaaacgaccaataatcgttatcgtttctttgcagcagcaaagacgatcaaagagctgaagcagcaattgactaccgttcaacaagctctggatgagatcatggctggttttggtcagattcaagctgatgcaacggcaaatcaaacgaaggccaaagaattacgtgaactttatcagaagttacgtaaacagttattgaccaagagcttttcgtatggagccgctgctgacggcttagaagaaaaattaagttatttagaaacatcctttgataagtataatcggtttactaaatctggtgatcatgtcgaaggtaaagcaattttaggccaattggacaaagatatcactgagttgaatgatttgatgaaacggatcccgccccgtttcaaagaattaaataatgaatttccggaacaattagaagaattacgtcaaggttatcggcgtctggccgatgaggcgtatcaattctatgatattgacattccagctgaattaactgatctagatcaacatattaatactactagaaaatcacttaagaaattagatttaacggcgatcgaggcaaccgatcaagatattgcacggcggatcgatcacttgtatgatgtaatggaagctgaaatcaaggcacatgaagaagttgaatcgcgccatgatgaattacaagcttttatcaatcacgcccagaaacaaaatcgtgaattacaagatgaactggatcatttaaatcaaagttacagtctaaataataatgaaataagtcaagcacaagagttaaaacatcaattagacgaaattcggacaacgtttgagaatgatatgcaggaagtagctggtcagacggcagtctattcaatggttgcggaaaattatagcaccgcctttgcagctttgactgagatcgaaaagaaacaaaaagcaatcaacgatagtgttcaaggattgcggcgtggtgaagaagaagcccaacgttcgttgcaatcatttgagtttgagatccgtaatgttaaacgtcaggttgaaaaacttaatcttcctgggctgccacggcattatttagatttcttctttattgtcgctgatgagatcactaaacttgatcaggaattaaatcaagttaagatcgatctagatgtgatcaccaaggagctgatcactacccaagaagacctaaacaagctgaaagaagaaaccaacgctttgatcgacagtgcactattgactgagcagttactgcaatacgccaatcgatatcggcatagtcatgccgatgtggcgcaagctagtgatgaagcgctgcgtttatttaatagcgaatatgattacaaacaagcggctgaaaccattgccactgttttagagcaagtcgaaccaggtagttataaaaaagttgaagaaagcttctataaaacgaaggatcaggagttaaaggtttgatagtcgttataaaaggtgctgtccgttctgcgttgagcggtggtgcctttttgattgcttattaaaagttagtattgtcttttaagatgagtttgttataatagttgggaattttgttattgatcgtaagagttagtcaacaatacgctgtgaataaaatcgtcaggcgtggaataacgaaaaaggaagaatgtttgcatgatttattttgataatagcgcgacaactgcggcggcaccagaagttctgcagtcttaccaagcagtcagtcaggatttttttggtaatccgtctagtttgcatgcgttaggcgataaagccgataatttattacaacagtcgcgacaacaaatcgctcagttgatccaagccgaacctgatgaaatttatttcaccagtggtggtaccgaaggcgacaattgggtcgttaaaggaaccgcaatcgcaaaacgccaatttggtaaacatttgatcagcacagagattgaacatccggcagttaaaaattcattagcccaattggaacagttaggctacgaggtgacttatttacccgttgataagcgtgggtttattgatcccgctgacttaaaagcagccttgcgatcagatacgatcctagtttcgatcatggcagtcaataatgaaattggtagtgttcaaccacttaaagaagttgccgatattttggctgattatccacgagtgcatttccatgttgatgcggtacaatcgatcggtaagggactattaccattactgagattaccacggatcgactttttaaccttctcagcgcataaattccatggtccccggggaacgggctttatctatgcgaagcgtgggcgccagttagcgcctttgatgactggtggtggtcaagaaaacaattggcgtagtggtacagaaaatctaccggcaatcgcggggatggctaaggcattacgtttattgttaactgatgagtcagttaaggtacaacaacagcaggcaatcaaaactaaaatttatcagcacgtggcgcaacagcctaaggtcacaattttctcggaaaatactgctgatttcgcaccgcacattctttgctttggcattcaaggtgttcgtggtgaaaccatcgtccatgcttttgaggagcatgatatttatatctcaaccaccagtgcttgttcctctaaaaaaggaacgatttcgggtacgttagcagctatgcacgttcctgatgagattgcaacgagtgctgttcgggtttctttagatgaaaataatactttggctgaagcagaggctttcatcaaagcttttgatcagatttatgcgcgttttgaattgatcaactcataatcgtacaaggaacagatttttcgtggcataaattttgccatggggaatagtcgactttaatcgtgaaataggagaatttaatggaatatacagaaattatggtgcgctacggtgaattatcaactaaaggtaaaaaccggcgcagctttatcgatcgtttatacagtaatacacgcaaggcgctacatcgttttccagcgttagaaattcatgctcgccgtgatcggttacacgttgttttgcatggtgaagacagtgccgcagtgatgaaacgtttaggccaagtttttggcattcaaaacttttcaccatcgatccgagtagaacgtgatatggatcaggtccgggcaaccgcaatcgctatgattaaggaacaatatcagcctggtgacacatttaaggtcaatacgcgtcgttcagatcataactttgaattagacaccaacgaaatgaacgccgagcttggtggcgtaattttggacaatgttccaggaattacggtgcgtgtgcataagccagaaatcacattgcgagttgaagttcgtttggatggtatttatttatctagccggacgattcaaggtgctggtgggttgccagttgggactgccggtcggggtatgttgatgttatctggcggaatcgattcgccagtggctggttatttagccatgaagcgtggtgtagcgattcaaatggtgcacttttttagcccgccatatacgagtgccaaagcgctagccaaggccaaggaattgacttcaaaattagcaccgtatgctggtagcattcagtttattgaagtgccatttacgcatattcaagaagaaatcaaaaataaagtgcctgaaggctatttaatgactgtacagcggcgtttaatgttacgtttgactgataaaattcgtgaacaacagcgagggttagctatttttaatggggaagccttaggtcaagtcgcctcacagacaatggaaagtatggtcgcaatcaatgatgtgaccacaacaccaattttgcggccagttgtttcaatggataaaaacgagatcatcaaaattgccgaagaaatcgatacgtttaatttatcgatcatgccgtttgaagattgctgtacgatttttgcgccaccagcaccaaagacacggcctaacttggaaaagacgcgggcctatgaaaagttcattgatgttgagggcttgatggctgaagcgttagctggtattaaaatgactgaaattaaagctgacgaagaatttttgtctcaagatcagactgaaatcgccagtctgctttaatttagcattgcactactgccgattttttgctacagtagtttcaaagcattgaacaagcgagtagttgtggaatcgcggcatagagaaaaagtgaattgctgcaagctttacgcgacacacaatgaaggtaacttgggagctgttactttgaaatctaggttgtttaagttagtttttatcgctaatttgatctagaagtggttggaaaaattgcttttttaaccactcgagtaggagtagccggtagatagccgttatgatcaattaagtggcgcagtatgcgcaatttaggtggtaccgcgaataacagcattcgtcctattgatttaggacgggtgcttttttatttgcagtgaacgatattaattttagaggggtgacgtcaatggctgacaaaaaacagatgtcaactaagtacgatccgcatcaggttgaacctgggcggtatgaagaatggctcaaaaaagatttattcaaaccaagtggcgatccggaagcaaaaccgtattcaatcgtgatcccaccgcctaatgtaactggtaagctacatttaggccatgcttgggataccacgttacaggatatgttgatccgtcaaaaacggatgcaagggtatgacgttttgtggttaccagggatggaccatgctggtatcgccactcaggccaaagttgaaggtcacttacgcgaaaagggtattacgcgctatgatttaggccgtgaaaaatttgttgacgaagtatgggattgggtccatgaatatggtgatatcattcatcagcaatgggctaagttaggtatctcagtcgactattcacgtgaacgcttcactttggatgaaggtttgtccaaggctgtccgtaaagtctttgttgaactatacaaaaaaggcttgatctatcgcggtgaatatatcatcaactgggatccgcaagcgcggacggctttatctgatatcgaagtcattcatcaggatgatcaaggcgctttttatcatgttaaatacccgtttgttgatcctgattatacgtttgatggtaagaactacattgaaattgcaaccacccggccagaaacgatgtttggggatgtggctgttgcggtcaacccagatgacgaacgttataaagatctggttggtcgtgaagttgtcttaccattacaagggcggcatttaccaatcattgccgatctgtacgttgataaggagtttggaacggggatggttaaaattaccccagcccatgatcctaatgatttccaagttggtaatcgccataatttaaagcggatcaatacaatgaatgaagatgcatcaatgaacgccaatgccggcaaatatgaaggtatggaccgttttgatgcccgtaaagctatggtggctgatttagatcaggaaggctacttattacgcacagatccaatcgtgcatagtgtgggccattctgagcggactggcgttcaagttgaagcgcgcttatcaacacagtggttcgtcaagatgaagccattagctgaagcggctttgaagaaccaaaatggggacgatcgggttgattttgtgcctgaacggtttgaaaacaccttcacgcaatggatggataatgtacatgattgggtgatctcacggcagctttggtggggacatcggatcccagcttggtataacaaggaaactggcgagacgtatgttggtatggaagcgccagccgatccagaaaattgggaacaagattcagacgtacttgatacgtggtttagtagtgctttatggccattttcaacgatgggttggcccgacactgatgcgcctgacttcaagcgctatttcccaactaacaccttagtaacaggctacgatattattttcttctgggtttcccggatgatcttccagagcttagaatttactggtaaacggccatttgaacacgttttgatccatggtttgattcgtgatgaacagggccgcaagatgagtaaatccttgggtaatgggattgatccaatggaagttatcgaaaagtatggtgccgacgctttacgctggttcttaagcactggttcaactccagggcaagatgtacgcttctcttatagcaaaatggacgccgcatggaactttattaacaagatctggaacgccagccgttttgtgatcatgaatttagattctacgactacgtcaacaatgccaactgcggatcaacgtgacttggctgatcgctggatcttgagtcgtttaaatgacaccgtcaaagacgtgacgcgcttatttgaagactttgaatttggtgaagcgggccgcttgctttataatttcatctggaacgatctttgtgattggtacattgaaatgagtaaagaagtcttgtacggcgatgatcagacggccattgcaaacaaacaacaggctttagcttatgttttcgaacaaacgttgaaattaatgcatccgatcatgccatttgttactgaagaattatggcaacaattaccacatgtcggggattcgattgtgacggctagctatcctgttgaacacactgaactggttgatgctgatgcggtggcgcaaatgtctagcttgattgatctgattcgttcagttcgtaatattcgggcggaggtcaatgcgccattatccagcccaattgatgtgatgatcaaaacaacggatcaatcgacgcagactatctttgagaacaatcgggaatacatcgagcgctttgttcatcctaaggccttgacgattgcggcggatgttgcggcgccagctttggcgatgtcggcaattattacgggcgccgagatctatgtaccactagctgagctgatcgatctgaatgaagaaatcaaaaggatggaaaaggaagcagctaaattacagagtgaggttacgcgggctgataagaaattaggtaatgagcgtttcgtgcaaaatgcacctgaagcggttgtcgctgaacaaaaagctaaacgcgctgactatgaacaaaaattagcagctgctaacgaacgaattactgaattgaaagctaatttataggcggtaaaaaaagaagtctgaatttcaggcttctttttttgttatactggaaaaaaagtgaaagtggcgaaattatgtacgcagaaaattatcaagttgccttaactaaaattcacagtcggcctaaaatgcataaggaaggcagtttaagtcgtatgcaacgggcagttgctgcctttggtcatccggaaaaacagataaccgcgattcatgttgctggtaccaatggtaaaggatctgtggtcaatgatctccgttatttagcaaatgcgcagggtatgacagtaggaacatttacatcaccgtttttgacgcattttaatgaacgaatcagcattgatggggaaccaatcagtgatgaagcattgttgcagttagtcaaccaggtcggcccacgtgtggccgaattggatgcggcgcaaccagaaaatcagatcactgaatttgaatttgtcaccttgttaatgcttgtctactttgcgcagcaaccgattgatttggcgattattgaggtcggtatcgggggactgacggatgcgactaacgtgatcacgccattggtgtcagtgatcactacgattggttacgatcatatggcactgttgggtgacacattgaccgagattgcagcacataaagcggggataattaagccaggtcagcctgtggtcagtgggcgattgccggcagaagcgcaggcggtagttagtactgtggctgaacaaaagcacagccgactgtaccggttaggcgatgattttaaaacttcgcggcatcaagccttggcgacttggggcgagacttttgatttcactggcttagctcagcacgtaaaaggaatcgagctaccgatgttaggcgattatcaaattgataatgctgcagtggccattgctgcctttgtcttggcgttacaacaattgcagcaaagtagtgatgccaaaacaatcaaggctggtttagcacaggctaagtggctcggacgcttagagaagatcaacgatcagccgctaatcgttttagacggggcgcacaatgaaccggcaatgcatgctttggcggacacgttgaaagcaaatttcagccaactagagatctatattatttttgctgcactgaaggataaggaaaccactaaaatgttagcaattttggaacggttacctaatgtccatctcattttgacgcagtttaacggtaatgatcgggtggctgcagctagtgagttagaacaagcaagtgagcaagatctgccgttatatacatactggcaggaagcgctgcaagcggtcttgcaagaagcatcagcagacgatatgctattattaacgggttcactttattttgtttctgaagtgcgccactattttgaaagttgaggactgacgatgaaggtacaaggcgtaatttttgatatggatggtttgatgtttgattccgaaaagttatactatcaggccaatttagcggcggcaaagcaaatgaaactcgattatagtgacgactactatgagcgttttattggcgcctctgatgaagacttaatggcctttttccgtgaggcttttggtagtgaagcgcaagtgcaagaatttatgcagctgacctatcaagcaatcgatcaggccattcatcaaggaagattggaaaaaaagccaggtttggatgaattgattgcttatctagagcaacaacaaatcagtaaggcaattgcttcgagtaattttaaaactaaaatcagtgattttttgacggccacgcaaacggctagtcattttccaacgatcatttcaatggatgatgtcgctaaaggtaagccggcgccagacttgtttgcagcagcacgggcagctttggggacgcccgcggcagaaaccttagtgcttgaggattcgctgaatgggcttttagctgctcaggcggcgggaattccttgtattatcgtacccgatttgatcaagccaactgttcaaatgcaggcccaagcattgacgatcgtacctgatctgttggcggttcgtgattttatcagaaataatcactgagattttgcgtagtttaagaataggcgttaaaagaaacgtttaatcttaaatcagcaaggggtaattaaatgttaaggctcgagacacataaggaaccattgcaaccacgggagcagttagtttatgctggcgcggcgagtttgactgatcaacaattattggcaattttattacggacgggaacaaaacaattgccagtcatgacggtagccgcccaagttttgcagacttatccgcaattagcgactttggcgcacgcaaaaatcagtgaactgcagcagattactggtattggacaaactaaagcgattgaattacaagccgctttagagctaggtcgtcgctgtcagttagctgctcagttgcgttttggtaccattgcttccagtcagcaggtcggcgaaatgatgatcaaacggtttgctggctgtcgtcaggagcatttaattgtggtttatttggacactaagaatcagattattaaggagcaagaattattccggggtacgttaaatgcttcgatagcgcatccacgggaaatttttgcgtatgggctgcagttggcggcggctcgttttattttggtgcacaaccatcctagtggcctaaccgaaccctcgaattatgatctgaaatttactaagcgtgttgcgagttgtggggagcttatgggcatcgaatgcttagatcacttaatcgttggtcaacagcaatatagcagcctaaaagaacgtggtgatttatgagggttctggcttgttattaaaccggtatcatggtaagattaacttgtatttttgttaggtagtggatcaaagtttcatagataaactttccccatcgtaccaatcagaattacaaaaaattgtgtcaaaaaggcacgaggaggatttttattcatggaacaaggtacagttaaatggttcaaccctgaaaaaggcttcggttttatctcacgcgaaaatggtagcgatgtattcgttcatttttcagctatccaaggcgaaggttttaaaactcttgaagaaggccaagctgtaacatttgacattgaagaaagcgatcgcggcccacaagctgttaacgttaataaagcatagtcaattattaaaagcagacaacatcgtattcgcgatgttgttttttgtttgttttttatttaaaaattgaatctaaaattaagtttatttgatctatctaatgtaagcgcaatagttactaaaaaagggttaagtttgtaaaagcccttatcattccactgattattcggtatgatagattagtagatgttaaagcattttgtatcggaaataagtgtgttataattcctttatctgcaaacggagatgctaaagcatttaatgattaggcgcagccagtaatggtcagcgaatagtcagtaaatatcgctgaatttgaaggagagagacgctgtgttcggattaggcacaaagaatattggaattgacctcggaacagccaatacattggtttatattgatggtaaaggaatcgtgctgcgtgagccttccgttgttgccaaaaatacgaagactggtgaagtggttgctgttggtaccgaagcacgcgatatgattggacggacgccaggtagcattgttgctattcggccgatgaaagatggtgttatcgcggattatgatacgacagcagcaatgatgaaatactttatggaaaaatcacaggggcgtggtgcgggtaagccatacgtcatggtttgtgttccaagcggcgtgactgaagttgaaaagcgtgccgttattgatgcaacacgtgtggctggtgcccgtgacgcttatgtgatcgaagaaccatttgcggcagcaattggtgctggtttgccagtgatggatcctaccggtagcatggttgttgatattggtggcggaaccactgatgttgcgacgatttccttaggtggcattgtgtccagtcgttcgattcggatggctggtgacaaatttgacgaagcagtgatctattatattcggcaacattttaatttattgattggggaacgtactgcagaagatgttaagatgcagattggttcagcgtcattagaaaaagctgctgaaattgaaggaatgactgtgcggggtcgtgacttgatctctggcttacctaaaaccgttgatattgaagctgttgacattgctaaagcgctacaagaagttgttagcgagatcatcacagcaatcaaagaaacactggaagaaacttcgccagaaattgctgccgatgtaattgatcacggtattgtgttaactggtggtggagcaatgctaaaaaacttgcctgaggtcattgctgatgcaactaaagtaccggtttttgttgcccaagcaccgttggattgtgtggctattggcactggtgaatcgctaaaaaacatcgatattatgaaaaaacgttaagataaaaaggttagtaaaagcctacattagtcgctgaagattggtcgaatactcgccattttcagcgattaatattgtcagctcaagacttattgcttgctaggcaaattgttggaggtcgccctatgcagaaatttttctcaaatcgaaaactaatcattgttatgatcgttattatcatcagtatgggcttgatggcattttcggtcagtgtacgtaatagtgagaagacaccaccattagtccagcgtttcggtaatgatgttgttggcgttgtcgatcacgttgtagctttaccggctaatagtattaaaggtagttttgctgctgtttccaacttgatcaatacgtatgaagaaaacggaaaactcaaggcacaattggatgatctagcgcagactagaacccgagcgaatacgttacaaagtgaaaataaagaactgaaaaagcaattaaaacttgataaaacgttaacggactattcgcagcttaatgcagcagttttgacacgttctccggctaattggcagaataatcttgttattaataaaggcagtttagctggagttaagaaaaatatgccagttatggctggttcaggtctagttggtcgtgtggttgaagttaatgggactaactcaaaagttgaattactcactactgacaatcaatccgctaatcgtttcgcggctgagattattactgacgacgggacggctaatgggattattactggctataatcaagcaactagtcaaattaaaatgggccaacttaattcggatgctaaaattaaagttggggacacggtgcaaacttctggtttaggtggattgacgccacgtggtttgtatattggcaaagtggctaaagttaagcatgatgattatggcttggctttatctgtattgatcaaaccagctgttgatttagataatttctctgttgtgacggtaattgaacgacaactggtaggtgattagatgcgtttacgcgaaaaaatttggatcagtgtctttttgacatgcttgttgctgctggatgggtcattcagctatatatttggtagcaccttgcaccggtttccagatacgatgattattcgacttgtggttttagggttgatcttagtctatttctttgcgccggattttccacatttgatttgggtcgcattagttcttggtctgttttatgatagtttttacactggtgttttaggtgtgtacatgtttttatttccgatggttatttttctaactcggtggatcgcacaattctttacgccagcaccgctggtgatcggcgcgatttatttgattgatttgacggtcttggaaagttttgtgtatggcatgaatacgtttatgggtcagacgacgatgtcattgaatgatttcattcccaatatcttaggaccgaccttggcactaaatttagttttgtttatttttctgtatttcccgttacgtcagttgatcgtaagattagattcgacgtactaataaggttttacaaggggaacttatttataataatgggtcgtgccaaatagtaacgagacacaggcctaataagtatgctaaaatttaaataatcgtgtcaactagggagtggcaatcatgcataatgtggttttaaagggacatcaaggcggctatcaactaaccttaaaacaaaacggcgcttttacagcaattattggcgagcttggtgagctatttgctaagttaagtcgtgagcgctcgggtcaagatgatgagcaaatcgttggctttaaaattaatactgagaatcgtttactgaccgatcgtgagaagcaacaaattcaagaactgatcgaacaatacccgcaatttcgggtcgaaaaaattgagtccggcgtcatgacgaaagcggcagcgaaggcttggaaagagcaagatagtattcacataagccgtttggttattcgcagtgggcaagaaattcagatcgatggtgatgtcttgtttattggcgcggtccatcgtggcggtattttacgtgcaaccggcagtgtttacgtggttggtaaaatcgaaggtgtggttcaagctggttttcctgatcgcgaagaagcaattgtggttggtgatcttagccaggcaattcaggtacggatcgccgataacgttgatattttggccgatagtgaccaaacatttacaccacgctcagttacatatattaatgatttacacatgcttgattatggcaacctagatgaacttaaagcgattcgtccaaagttatataacaagattggggaggcataactcatgggaacggcaatcgtagtaacatccggtaaaggcggcgttggtaagacgaccactagtgccaatttagggactgcattggctttacaaaataaaaaagtttgtttgatggatctagatattggcttgcgtaatttagatgtggttttaggtctagaaaatcgcattatttatgatattgttgatgtcgcgcaaggtcgagctaaattacatcaggctttagtcaaagacaagcgttttgaggataacttatacttattacctgcagcacagaatacggataaggatgctttaatacctgacgaagttaaagcaattgtcgatgaattgaaggaagactatgacttcgttattttggattgtcctgcaggaatcgaacaaggtttccagaatgcaattgctggtgcagattgtgcgattgtggtcactacaccggagatttcggctgttcgtgatgctgatcgagtagttggcttattggaacaagctgaaatggcccaagaaccacgtttgatcatcaatcgcattcgtcagcatatgatgaatgaaggggacgcgatggatattgacgagatcacgcgccatttatcgatcgcattattaggtattgtgttagatgatgatggtgtgattatgtcatctaatcatggcgatcccattgtgctggatcctaagaatccagctagtcaaggttaccgtaatattgcgcggcgtattttgggtgaaacggtaccgttaatgtcgatcaaggaagagaaggctggtttctggaaacgtcttttcggtaatcgcaactaagtactgtattaaatcgggactaattttaaattatgagtgcgtttgacagtaaagttaaaatgtgctaatcttattctcataataaataacgttgaacagaagagtaaatggacttaaattatcagagagtttctggatggtgtgaagaaacaattgagtgtattgaaacacatctgcgagtattgtacgctgaacaaattaggtgtacacgggaaagcccgttactgctgtagttcattgaactacctgaggtattgcttgtgaaagtgatacaaattagaggtggaatcacgaaatcaatcgtcctcttgaagttatttaataacttcaagaggcttttttatttggcgaatgaactacttgaggtgttgatcgtaaggttagcacgaattgaggtggaaccacgcgctgcgtcctcgaaaacgatttgttttcggggacttttttattggctgatttttaaaaggagatgttggcatgaatatcttagcaacacaatggcattatgcatggcagattatgccgtctttatttgatggtatcaaaatgacattatcattatttttcttcacgttgatcggttcgattccgctggggattattgttggactgggacgcgcctcaaagtttaagctgattcgtaatattcttggaatttatgtctggatcatgcgtgggacgccgctattattacaattgatttttgttttttatggattaccaattgtcggaatcgtgttccaacgttatgatgcggcgttattcgcttttatcatcaattacggggcttattttgcagaaattttccgtggtggcttacaatcgatcgatcatggtcagtatgaaagtgctaaggtattgcgcttaacttattggcaaaccgttcaaaaaattatcttaccgcaagtcatgaaaattgttttaccgtcgattgggaatgaggtcattaatttagttaaggattcatccttggtttacgtcatcggcttaggcgatttgttgcgtgctggtaatgtcgcaacagcgcgagatgtaactctgctgccgctagttttagtgggtatcggttacttattattgacggccattttgacactggcgcaacgcaagatcgagcagcattacagttattataaataggagggatttccgatgttagaattaaaagcaattagcaaatattacggtcggcgtttaattttggatcagcttgatctaaccgtgaatgatggtgaaattttagcaatcgttggcccttctggtgctggtaagacaacgctattgcgctgtatcagtggtttggaacgaattgatagtggtcagattctattagacggacaagcgttcgatccatttgataatcaggataaagatagcgtcatcggggtcgttttccaggatttccaattgttcccgaaccttagtgtattagacaacattacgttagcaccaatgctggctttaaagcagacaaaagacgcagcagaaaggcaagcatgcgccttgttagagcgattagctttgactggaaaagaaaccctttatccctatcaactctctggcgggcagaaacaacgggttgctttagcacgagcattagcaatgaagccgaaaattctctgttatgacgaaccaactagtgcccttgatcctgacttacgacaagaagttgaaaaattgatcctcggcttaaaagctgacggtatgacgcaaatcgtggtcacccatgatttagaattcgcggaaaacattgccgatgcagttaaacgagtcgaggcattgccagaaaaatagggctgattataaaacataccatgcgtaaaattgggctagcgattcaacgttgcccaagatattaaccactattgtggagtagaggaggccaaataatgcgcaaaaaaatactgggagctttactggcgatcttaatgctttttagtacagtcagcctaactggttgctcacggcaaagtgctaatgctgattcttggtcgacaatccaaaaacggaaaacggttattgtcggtttagatgacagctttgtaccgatgggatttcgtgctaaaagtggacaattaaagggctttgacattgatttagcgcgggccgtttttaaaaagtacaatattaaagttgattttcaaacgatcgattggtcgatgaatgcaactgaattacgtaatcacacgattgatttaatttggaacggctatacgatcacaccgcaacgtaaaaaggttgttcgtttcagtgcaccttatttggaaaataagcaaattttagtaacgatgaagaaagataaaattaacagctttgccggtatgaaaggtaaagtattgggggtacaaacgggttcatctggctattcaagtttagaagcagagcccaatttattgaagaattatattaagaatcaaactcccgtgttatatagtacgttcaacgatgcgtttattgatctaaacgccaatcggatccaagggttactgatcgatcgagtatacgcaaattattatatcgatcatcaatctaatcgtgcggactatcaagttactcaaggcaagtttgcttctgaggattttgcggttgggatgcgtaaatcagataaaactttgcagcgcaagatcaatcaagcgatgaaggaattatatcgtgatggtacgatgaagaagatcagttataaatggtttggggaagatgacacaattccgcagaaataaataaaaccgtcactggaaaattttccggtgacggttatttattaactgtaaattaagctgtttcagtgttaaagaaggctttgtaaaggccacgaaccgcattatattcatctttttcgcgtacgccaaacatgattgatactggtgaggcaccgtgatctagagtgacgattgaaaccccagcctgggcaatgctgttggtggctttagccatcattccgatgtggtcttggataccctcaccaacgatcatcacgagcgcgtaatgatggatcacgcgaatatcatcagggtggatagcttccttgattactttgataacttttggttctagctctggtgttaattcgcgttcacggatcacaatcgtgatatcatcgatccccgaaggaatatgctcaaaactgatgccgtattcggcgagaatttgtaataccttgaagacgaagccgacttgtttgttcatcaagtacttgcgaatgtaaattcctaaaaagccggtatcactagcaataccagaaattggccgcttgggatcatagatcttacgagctgaaattaatgttccgggttttaacggatggttagtgtttttaacgcgaacagaaacaccgccttcgatggctggaatcaacgcttcatcatggaaaacagaaaaaccagcatacgatagttcgcgcatttcccggaaagttagatgttcaattgccgctggatgtgccacaatattcgggttagctgcataaattgcgtcaacgtcggtgaagttttcatatagctctgccttaaatgcacgggcaaagatggcaccagtaatatcggagccaccacgtgagaaagtacaaatctgaccatccttagtgtagccaaaaaaaccggggataatcaataatgttttgctctttttaaaagcagctaattgcgcataactttcaggtaaaacctgtgcatctcctggagtagcactaaccagcagaccagcttcacgtggactaagataatgactaggcatccctaaatgattgaggatcgcggcaatcagtttcgcattattatcctcgccggcagctttaaatgcatccagcaaatagtccgcagaagggtagtcgtgatcaggtaattgcataatatgatcatggatcggttgaaattcacttgctggtaaattaaagccagtggcgatttcttggtagcgtgccaaaatggcatgttgaatagcaactggattcgctttttttaaaacaacattagcgtagtcgatcaataagtccgtcactttacggtcatccgcaaaacgtttacctggagcagagacgacaactgcacgtcgtttactatcaccgcgaataatatcaattactttttggagttggttgctggaagctaatgaacttccgccgaacttagccactttcaaacttagccacttctttctggattattaaaaataaattagtattagcatagcaaatccacatctaaaaggcaatttttgttggaaattataatgttattgacaccgattgcaaacaggcttatgctaaaaacaacaattaaataattaactgcaaaggggagcccttttggctgagagtgattaagttcagacccttgaacctgttgtgttaacgcacgcgtaggaattgtagttggcgccaagccaaatttgcaacctctttgtagtcgattgatctatagggaggattttttatgtctaatcgacatctattagtttggatcgaaggaaccgtgattgctgccttggcaatggcgttggagtatttaccgcatgcggtgggcccattgaatgtttcttacggaattattccattggcagtctatagtttgcgccgaggttggaaggctggcttaagttcaggtttagtttggggcttactggatctctttttacgtggttttggcagtggcggctttcttaacccgctgcaaggtctgatcgaatacccgctggcttttgcagtagtaggtttgatcggttttggtgctagcccagtgcaacatgcgctcagtcggcagcaacgtggacgagtacttggttatgcaatcagtacgacattttttggtgttttgtgtaaatatttccttcatttcgttgctggtgttttttactggggttcttatgcacccaaaggaatgagtccggttatttattccttagtcgctaatggtggtagtgccattttaaatttagttttagtcagtttggtagttgggttgttattggttagtgccccacatctatttatgcctaaaaacgttcaaactgcctaattattaattataaaaaaagatccggccagcgccgaatctttttttatttaaccgattattgaaaagctgcgacggcagttatgaccatgccaccaagcgttgcaatcaacatgatccaaacaacgattttagttaattttgcgaaaccgctagttttttcttttttcattgcgctttattgccacctcattgattggtttaatttaggacaagtttaacgtgtttcttaatagattgcaattattgtttcagaaaaaattgcggcggcgtaaccaccaagcagctagccaagagacgacgattgttcccaaaatgataaaggtgaaggcccgcgcactactagcacctggcaagtgtacattcatcccgtaaatcccaccgatgatcgttggaatggtcaaaatgatggtgatcgaagttaacactttcataatgatatttagattattagaaacgattgcactgaccgtggtattgtactcatcaatgatttgtttctgctgggcagtcatggtggccgcttgctcactttcaattaaaatatcactaagtaattcgctaaaaggtgcagtctcaaagtaaaattcactggcttgcaattgggtcagcagctgacggtttttacgcagtgcccattgaaagtggatcaagcttttttgcatggcagtcagctgaaaaaggtcgttattttcggtagcaatggttaagtttttttccatggtatccattgtatgactattttcatctaaacaattaagatagcttttatgaataaaccagactagttttaacgtgaagcgttcgtggttgttgatgtttaattggggttgatgaaacagaaagtcttggataaacactgccggatgattgcaaaccgtaatcaatacttctgcggtcagaataatggcgaaaggataagttgtgtattcgttataacctaagggactaaccgattcatgtggaaaacgaaccaggatcaatgctggtcgttcgataatcgattgttcggttccttcagtccgtggattctctttatcatctagcgctgcagttaaataagtaaccggtaaattaaagcgagtttgtaggtgtttgatttcagcagcacttggtcgctcgacattgacccagcaattgcgttgataagcgggaatcggtgttatttgtccatcagtagtattgaaataattgatcacgttagccgcttcctttcgcacattcggtttattaatctgctcttgtcattttaccacttttcccgtaggctaaaataggaataagaatgaacgggtagtggaaacaaagaaggtaggttagagtgaatgcttgtactgggactattgatgccagtgataggtttgattattggtggtgtattgcacaaaacacatattaaatggcgcatgacgccaatcgattggttgacgcttagtttactgattgccagtgatattttaattttggttcgttatcattatcaagcaattagtttgttgatcatgatcctagcgtctgtagcaatctgtgttgccattggtttagcctggcggcggggagagattctttaccacaccttttttaaactatggtggcggttgctattcataccaagtgtcattgcatatttagtgctaatcgtattgcaatggtgttaaataaatatagcgtcaaaatcagggcgatgatcgtatggtgagataagggcttacatacagatcagaatgactgattttggcgttttttttatcgagtatcaactttagaaaagtttaagcagttattttactagtttttgagggaaactatggtagaaagtggggggatgtggtagactaaaaatgtgcatttgcgggggtgttgtcaatgttcatgggtgaatttcgtcattcgatcgatcaaaagggtcgcttgatcattccggccaagtttcgggatgcattaggtgcgaaatttattgtgacccgcggcatggacggctgcctatttggctaccctcaagcagagtggcaagcgttagaggaaaagttgcgccaattaccgctaactaagaaggatgcacgggcgtttgtacgtttcttctactcagctgcaactgagtgtacgttggataagcagggacggatcaatttaccgcaatcactgatcacccacgccggtttaactaaagcgtgtgtgttgatcggggtttcatcgcgaattgaaatttgggatgctgagcgttgggctacttctagtgcggagattgcggaaaactttgattcaattgcagagaatatgttagattttgatttttagagatgaatggatgggtgaatagcagtgtttaagcatcaaactgtattattaaatgagaccgttgacagcttgcaagtcaagccagatggagtttatgttgatgcaacactgggtggtggtggccatagtgagctactgttaagccgcttgagttctgctggacatctgtatgcatttgatcaagatcaaactgcgattgataatggcaaacgacgattacaagctgaagttgctgccggtaaagtgacttttattaaagctaacttccgtgatctcgctgctgaattagcccaacgtggtgttgatcagatcgacggaattctgtatgacctgggggtttcttcaccccaatttgatgaagctgcacgtgggtttagttacaagcttgatgcgccgctagatatgcggatggatcgtaccaagccattgacagcacatgtcatcgtcaatcaatggccgtacgccgatctcgaacgaattctttaccgctatggggaagataagtttgcaaaacgagtggcacgtgcgattgaacgggcgcgagctgaagcacccattgatacgaccctgcaattagctgagatcattaaatcagcgattccagcagcagcaaggcgtaaaggtggccatccagctaagcgctcgtttcaagcgttacgaatcgcagttaatgacgaactaggtgctgaggaaacgtcactagaagcggcaattagtttgttggctttaggtggtcggatcagtgtgatcagtttccattcattagaagatcgaatcgtcaaaaccatttatcgcgatcacgcgcgtgttgcggaagtgccacgcggcttgccaatcgtaggtgatggggaacaacctgaattgaaaattataactaaaaaaccaattgaaccaacagcagcagaggttgctgaaaatcggcggtcgcggagtgcccaacttcgggtcgctgaaaaacaaaagctttaaggatgtggtgaagtatggcagatgaaagtgcagcaagagattattctttattagctgagccgcttgcgcccagcacgccccaaccagaaatacatattaaggcgccattagagacaacgccagcagcaagaccgcaagctattccagctggtcgggttgcagtatccgcttttgaaaaaattttacttatggtaactggtgtcataacagttgctttagcaaccgttatcgtggcaacacagatctcagttgctgatgcacaacgtgatctacaggatgttgagcagacgattgcgacagtgcaagcaaaaaatagtgatgcaaagcaaacaatcaatgagatcatgcagtctagtcatttagatgcggttgcagctaaagatggcttaacttttaacgaagcaaatataaggaatgttagtaaatgaaggtaccacgtaataaacgattgatgggcaagagaaatccacgacggaaccgccaaagatttggcgggttctttcttttcattttagtgggcgtttttcttttgttcgtctttcgtttttcttatatcgtgatcagtggccatgtaaacgatgagaatttaaccaaaaaggctagcgcgctatatgaaagtagtacggtgctacgtgctaaacggggcacgatatatgatgccaatggcactgcgattgctgaagattcgacaacatattcggtttatgcggttttagataaaaactataccggcattaatcataagaaactttatgtgactgataaagcaaaagtggccaaggtattaagtcaatacttaccactagatcgtgcagctattttgaaacggctgaatcctgctaacgataagactttccaagtcgaatttggttcggcgggtaaggggttatcattaacgatcaaacaagcaatcgagaaagccaatttaaacgggatctatttcacagaaacaccagcacgcttatatccgaatggtatttttgcatcacaccaaattgggttagcgcaagcgaatactaaagcaaccaaagtggcgaatgcacaaaatttagttggcattatgggcttggaaaaaacgttaaatagtaccttggctggaactaacggagtcaaggaggtcaaggaagattcttacggctatcaattacctaataccaaagccaagaaaaaggccgctaaaaacggtaaaaacgtttatttgaccttagattcacggctacagacttatttggaaacgttgatgactaatgtacaaacgaagtaccaaccggaacaacttaacgctgttttaatgaatccgaaaactggacagattttagctgcttcacagcgaccaacgtttaatccggaaaccggttctggtttaggtagtttttggcgggacacgttagttggtgattcctatgaacctggttcagttatgaagacttttacattggctgcggcaatcgataaaggtaagtatcaaccgaacacaaattatcagtcaggtcagatcacaatcggtgggacaacaatccatgattggaaccaaactgggtggggctcgattcctttaagcaaggcttttccgctttcaagtaacgttggttttgttcatattgaacaggctttgggtaaggataattggctgaattacattaagaagttccaatttttgagtaaaactaattcattgttatccggtgaggtgaatggcagcattcaatatgagcatacgtcggatcaagctgtaacctcatttggtcaagggattaacgtaacggtaatgcaaatgatgcagggcttttccgccattgctaacgatggtaaagaaatgcaaccacagatcgtttcgaaggtagttgatccggtgacgggtaaaacgactaagtataagccgcatcaagtggcaacaccgattagtaagtcaactgctagtcaggtgttgtcggcgatggaagatgtgacttataaagattatgggacggggacagcctaccagatccctggttataagatcgcaacgaaaacggggacggcgcagatcagcaatgctaacggagctggttatatgactggtgataacaattatattttttccgtagtcgggatggcaccggcaagtgatccgaagtatgttttgtatattacaatgaagcaaccgcaagacatgtcgcaatcagcgaccgaaattttatcggaaatctttaatccattaatgaaacgggctttagattatgatgctggtgataccacaacagaatctaaaacgatgatgccaaatattacgggtaaatcagttagtgctgcgacagccgcacttaagaaagaaaacttacagaccgtgcagatcgggactggggacactgtcgttcagcaaatgccgttggccaatgaagtgattctagatgatcaacgtgcattgatcctaaccaacggtgcgatgacaatgccggatgtaactggctggtcgaagagtgatgttttgaaactggctgagttgactggtaagcagatcacaatcaagggaactggttacgtgactaagcagagtttgtcagctaaaagtttattgaattcggctaagacgattaccgtcactttaagtaagccatagagccatgcttcttgcggcatgaacttagccacaagaatggtcattatccgtaacatcaaagctaattagtgtgttctgctaattagctaccttaaaagtgaagtagagccatgtttcttgcggcacgaactttgccacaagaatggtcatcgtccgtaacatcaaagctaattagtgtgttctgctaattagttaccttaaaagtgaagtagagccatgtttcttgcggtatgaactttgccacaagaatggtcatcgtccgtaacatcaaagctaattagtgtactttactaatttagctaccttaaaagtgaagtagaataagaatggggagtaagagagttatgcaatttacgcagatgttgattccgatcgttagtagctttgccatcacatttattgtgttgccactgtttattggctattttcggatgaaaaaagagggtcaagtgatccgcgaagaaggacctaaatggcacgaaaaaaaatcgggtacgcccacaatgggtgggttaatttttctgattgcaagcgtcatttcaacaatttgggttggctattggcaacatcaaatgaccgttcaagcttggatcactttgtttatcctggtactctacggtgtgttagggtttatggatgattcgatcaaattatttgaaaaacgtaatctaggattacgtgcttggcagaaattgcttggtcaaattattggtggtttgatcttcactgcggtgtatatttatgaaggtttaccactggctattgacttaccggtcgtcgggcaagttcatttaagtgtattatatgtgattttcattttgatctggttagttggtttttccaatgcagtcaatttgactgatggtttagatggtttagttgccggaactgcaacgattgcttttgcaacctacgctgtaattgcgtataaagaaggacgcacggacattttgattttctgtttgactgtgatcggtggtttgatcgcgttcttctggtttaaccacaaaccagccaagatttttatgggcgatgttggttcattggcattaggtggcgcgttagctgcaatttcaatcctgctgcatcgtgagctatcattattattgatcggtttggtttttgttatcgagactgctagtgtaatgatccaagtttcggtctttaaattaactggcaagcgcgtgtttaaaatgagtccgattcatcatcattttgaaatggtcggttggtctgaatggcgtgttgttctgactttctggggctttggtttgttgtgttcgatcatttacttgatcgcatttctttaataattaatatattttttaaccataaagaggaaaagggcgaatattcttgaatttagtaacggattatcagaatcaaaaagtattggtgttaggcttagctaaaagcggtttgcatgccgctaaactactggccaaattaggtgcgttggtaacggtcaacgataaaaaggattttgatcaaaatccggatgcgcagtcattgttggctgaggggatccgcgtgatcacaggcagtcatccgttggcattattggatgaggactttaaattaatggtcaaaaatccaggcattccgtacactaatcctttagtacaaaaagcacaggcaaagggtattccgattattactgaacctgaattagcctatgaaatttctgaagcaccattgatcggggtaaccggaacgaatggtaaaaccactaccacgactttgattacgcaaatgcttaatcaacagcgttcagcaggtaaagcctatgtggctggtaatattggtgttccagccaccgaagttgctcaaaaagtaacaccggaagatgtgatggtgactgagctttccagctttatgttaatgggcatcaccaagttacggccacatatcgctgtgttgaccaacatctatactgcacatatcgactatcatggtagtcgggctaattatgttaaagccaagatgcggatcacgatgaatcagactaaggacgattacttcgtggtcaactgggatcagccagaatggcgtgaattaagtcagcaatctaaggcccaagtaataccattttcccggcaaggcttaagcacagttggggcttacgtcaaggatggtcaattctgttatcgggatgaggttttgatgccggttagtgaattaaatattcctggtgatcataacgtggaaaatgcgttggcagcaattgcggttgctaagttagaaggacaaaacaatgaagctatttgcgaagttttgcggacctttactggggtcaaacatcggttgcaatttgtaactgaatggcaaggtcggcgcttttataatgattctaaagcgaccgatattgaagccactgagatggccttaaagggatttaaagctccagtgatcttactggctggcggtttggatcgtggctttacctttgaacgtttagtaccggcgttacaagaacacgttaaaagtttgttattatttggtgagacggctaaattattagctcaagctggtgaagcagcaggaatcaaagacattcaaatcgttgaaaatgtagcaactgccttaccgatcgcttaccaaaagagtcagccaggcgacattattttattatcaccagctaatgctagttgggatcaatacccgaattttgaagtccggggccagatctttatcgatggtgtagctgatttgatcaaaggaaatggagcgaactaaacgttatgcgtgtaatcttttcaggtggtggcacaggaggtcacatttatccagctttagcggtattggaacgactaaaggaacgtgatttattagatgaagttctatatatcggtaccgaaaaaggcttagagagtcggatcattcgccaaaaacaaattccgtttgaagccattgagttgcaaggtttcaagcgttcgttatcattggaaaatttaaaaacaatcaagttattcttgcaaagtacacggcgagctaagcaaattttgcgtgattttaaaccggatgttgttgttggaactggtggttatgtatctagtgccgttttgtttgcggcggcgcgactacatattccgacggtgatcaatgaacaaaatagtgtagctgggatcaccaatcgctttttaggtcgttatgtggatcgaatttcgattgcttttcccgaagtggcggaacaatttcctaaggccaaggtggtgttgactggtaatccgcgggcacaacaagttgcggggattcagccaaatcagcgcttaactgattttaagttgcaaccaacgataccaacacttttaatttttggcggtagtcgtggtgcggaacggatcaacgctgcatttttagaagctttgccggagttgaatcaaaaagattatcaagtgttatttgtctctggacgcgtacattatgctaaaattcagaaagcacttgctgagcagacggtggcagctaacgtggctgttgtaccttacatcaatgatatgcagacagttttacctgatattgcggtgatcttgggtcgtgctggggcgacttcgctagcagaaatcacagccttggggattccctcaatcctggtacctagtccatacgtaactaatgaccaccagactaaaaatgcgcaaagcttggtttcacatcaagctgcggagatgatcaccgaaaacgaattgactgggacttcgttacttaaagtcactgaccacttgatgcaggatcaaagcttgcgtcaagcaatgggcgagcaagcccggcagttaggtgttcctgatgctgctgatcgatttattaaggttatgcaggatttgatccattaatatacttatacggttggcaatgctgtttaaatgggcagctattgctagtgataaaaatagtgaggaggtgtgcggatggcgaaaaaaaagcttaagcggtcaaaaaaagcgacttcggcagaagatccggcgtccgcgctgaccccttgggaagcttatcagcaacaacagcaacaatcacagaaaaagcaaaaggcacgatcaaaaccgacgattgaacataaactaccacgtttacgtgaattgcggcataaacatttagttcgccgcttagcgttattacttactgttttagttatgattttagtggttgccggctattttgtttctcccttaagtcaaatcaatttgatcagtgttagcagcaatcaacaaagtccgttaagcgaacaaacggtgatcgatgctagtgggattcaaactaaagattctgtggtagacgtgttgttacaccggcattcaattgctaaaaagatgacaacccgggaacccaagatcaaatcggctacgatctcgattcgacatttacgtaatgttgagctcaagatcaagacttataaaacagttggtttaatggtgcgcggctcccggtactacccaattttggaaaacgggatgatcgccaaggatagtacagcccaaccaactagtaatcattcggtttatagccactttaagtctggtaaaaaattacaattgatgatcaagcagtataataaattaccagcagcagttcgtaatagtatttctgaaattcggtttacaccgactaaattgaatccagaacggatacatttatatatgaatgatggtaatcaggtttacgcaacaatctcaacatttgcaaaaaaaatgcaatattatccaagtattgctaaagaaatgcaaaaaaaagggacggttaatttagaagttggggcctactcttacccattttaagcttaaaatttcttgaagttatgtgaaaacgtgttaaaccgtaatgataaggcttttaaaaccaactttgagtgtgttaaaatctaggcatatagtatatttaaaaaattaaactgaaaattgtttcaaggaggttccaccgcttatgggaaacacaggcatatacgttgggcttgatattggaaccacctcaataaaggttattgtcgcggaatacgttaaaggacaaatgaatgttattggagtgggtagcgagcgttccgaaggcttgagccgcggtgttgttgttgacatcgacaaggcagtcgctgcgatccaaaatgcagttcgtcaagctgaacaacgtgctgagattgagatccatgaagtaactgcaggaattccagctaatctgctcgaaattgagccatgtcaagggatgattgcagttgctgatgagtccaaagaaattaatgacagtgatgttaggaacgtagctgcagcagctttagtacgtaacttaccaccggaacgtgaaattctgacaatcattcctgatgaatttatcgttgacggttttgatggtatcaaagatccacgcggaatgattggtgttcgtttggagatgcatggtattttactgacagcaccaaaaacggtcattcataatatgcaaaaatgtatcgaacgtgctggtctcgttttaaatgaattagttgttaatccattgagcttaggtaaattagccttagccgatggtgaacaagattttgggactgtcttgatcgatctcggtggtggtcagagcactgctgctgttatccatgatcataaattaaaatatacttatgtggaccaagaaggcggcgactatatcacaaaagatatttccgttgtgttaaatacatcctttgacagtgctgaaaaagtaaaacgtgattatggttatgctgattcgttacaagcatcttcagaagaagattttccagttgaggtcgtgggcaaggatgcgccaattacagttaatgagaaataccttgccgaaattattgaagctcgattgacgcaaatcttcgaaaaaatgaatcaagctttacgtaaagttggtgcgttggctctacctggcggcattgtaatgactggtggtgtcactgctttaccaggaatcgttgaattagctagtgacatctttgatcataatgtcaagctatatattcctgatgagatgggattgcgccatccttcttttgctcaagcattaagtttgatcagctatacggctaatttaagtgagatcgatttaatcgttcaaagtacgcttaaaggtacaaatacaacaaaaggtaactatacttcgagaaaagttgttaaaactgatagtgagcaattccgacccgcaaacaatcagaccacaacccaaaatgaagcgtcggaaccaaagaaagagcgtttcgccagcatcaagaagtttattagtaatttctttgaataatggcactatcagattattaggaggatacaagttatggaattttctttagactcaacacaaaacactggggctgttatcaaagtgatcggtgtcggtggtgctggcggtaacgccgttaatcgaatgattgccgaagatgtaaaaggggtcgaatttatcactgccaacactgatgtgcaggctttagataactcagatgcagagaccaagatccaattaggggccaaattgacccgtggtttaggtgctggtgcaacaccagaaatcggtcaaaaagcggctgaagaaagtgaagaagcgatcgctgaagcacttaaaggtgcggatatgatctttgttactgctggaatgggtggcggtactggtactggtgctgcaccaatcattgctaaaacggctaaagacttaggtgctttaacggttggtgttgtgacccggccatttagtttcgaagggcctagacgtgctaaaaatgctgctgaaggtatctcagaaatgaaacagcatgtagacacactagttattatttctaacaatcgtttgttagaagtcgtcgataagaagacgccaatgctagaggctttccaagaagctgataatgttttacgtcaaggggtacaaggtatctctgacttgatcacttcacctggttatgtcaacttggattttgctgatgttaaaacagtaatgcaaaatcaaggttcagcattgatgggtatcggttccgctactggtgaaaatcgtaccggtgaagcaaccaaaaaagcaatttcgtcaccattattagaaacttcgatcgatggtgccgaacaagtcttactaaatattaccggtggccctgatttgtccttgtttgaagcacaagatgcatcggacattgtttcacaagctgcaaccagcgatgttaatattatctttgggacttcgatcaatgagagcctaggtgatgaagtggttgtgacagttattgcaactgggatcgatgatgataaaaagacacagccagcacggcgtaatttaaattcacaaacaaatgctggtcgtgccaatgctggtcgtaattttgatacgcagcgggctaacgagtcagaagcaaactctgcagccccaagtacaccacggactgcaggcaataagcaacgtaatgatgatccatttggcaattgggatattcggcaagaaccaagtcagcgtaaaaatcccgaaaataatgataattttaccaagacagaaaaacctgattttgatattttccggcgaacggatacagataacagcgacgacaatgatggcggcctagataagccaccattcttccggcgccggcgtaactaatttttaaatgaaatgggggcggcgcaatgacaattgcagaaaatgtgcaacacgttcagcaaacaattgcggccgcacgcgctgaagcagggcggactgatacggtgactttagttgcagtaactaagtaccacacgattgcggaagctcaagcagtggctgcgactggcttagttgatttggcagagaatcggccagatggtttggcagaaaagcaggctgctttgaccgcaccagaactcaagtggcatttcatcggtaacttacaaaaacgcaaggtcaagcaagtgatcaataaaatcgcctacttacattcacttgatcgtttaagcctagctgaagagattgaaaagcgtgctgaacggccgattgattgttttatcgaagtaaacgtgtctggtgaggcttctaagtcgggaatcaccttagctgaggttgaaccctttattaagtcattagcagattttaaaaagatccgcgtgatcgggttgatgaccatggcgtcaatcgatgcggatgaggcgactctacatgtgttattcaaaaagttgcgattaaagcgagatgcagttgctcagttgaatttggcttatgcaccttgtcatgaacttagtatgggcatgtcgcgtgattatcgcattgcggtattagaaggcgctacttttgttcgtgtcgggactgccttgtttcaataaagcagctgacaactagagagaaaaccttactgaggtaacaattatcttcatgaagtcaaagggaggtcagaaaatggcatttggtaaattgaatttgagcaagttttttggcatgagcgatgatgacgatgaattttacacagagccggtctcacaagagaaaaaggtaagtgaaccccagccatcgcggccaacaagctcagttaaagcaccacagtatcgtgcatcaacaacggcaaatagtcagaaggtggtttcaatgaatgctgcgccaactaaagccagtaaaatcgttatttttgaaccacggctctattctgatgtgaaagaagctgcttcacatttgttaaatagtcgagcagtcgttttaagttttaatcggattgatcaagcccaggctaagcggatcgttgatttcttgactggtactgtttttgcaatcaatggtgatattgaacgcatcggggatgatattttcctgtgtacacccgctaactttgaaattgatggtaacctttcggatatcttacgccaggatggcttaggataaattagttccagtacagttggtaagcgggtagctattaggacacaccgctagcatggatattggttatcttgatggctgcacttatgtttgccaaaaatatggtaggcccaagtcgtattgaaacgatttgagttaaggaaacgcagttgctgattttgcacctacgcaccttaaaatcaccacaagattatgtacgataaaggaggttatgcggtgctcgcttttgtcggtattattttcagcattttaagtcgcttgattgacgtttatatgtttattattgtgatttacgtgttgatgtcgtggttccctaatgcctatcagaccaaacttggtcaatggttgggtcgaatcagtgaaccttatttaaatattttttatcgtatcattccgccaattgctggactaagttttgcacccttggtggcattactagtcttaagtatggcacagtacgggctgggtgctttgtacaatataattgttttttaaattgacttagattcaaaataaggaggatagtaagtatggacgcgaatatttaccaacattttcggaaagcggaagccccgtttatcgatcaggtggccggttggctgcaggaagttagtgatcagtatcgcccatatttaaccgactttttggatccacggcaacaatatattgttgaagcaattgttggtgaaaagggtgaacagcattatcagtttgatggcgggtatctcgctgctgaacgtaaacgggcgctgatttatcctgaatattttgtaccaacccaagaagattttgatattcaattatttgagatccactatcccactaaatttgcgacgttatcccatggtaaagttctgggcacactggttaacgcagggatcaaacgtgaagtgtttggtgatatcatgaccgacggtgaccgttggcaattttttgtaacggcaagtatggctgattatattcaaacccaaatcacacagattggtcgaattggtgtccgtttggaacctaaagattatactgaattattagtgccaaaggatgcttggagtcttgaacatacgacagcgagctcactgcggatcgatggcttgatttctgctgtgtataatatttcacggcaacgttcgaaagaattagtggaaaatggtaaaataaaattgaactggcaagttttcgagcggcccgattttgaattaggtttacgcgatatcatctctgtgcgcggtttcggccgaatacagttacgtgagatcgaaggcaagtccaagaaagacaagtaccgcttgttacttggtgttttaagaaaatagttttttggagggattcatatggcattaaccccgttggatattcataacaaggaatttaacgttaaaatgcgtggttacgatcaagatcaggtcaacgattttcttgatcaaattattaaggattatgaagcggttttaaagcaaaaagatgatctgcaaactgctttgaaggcaagtgaagaaaaagtcacttactttaatcaattgaaggatgcacttaatcagtcgatcatcgtggcgcaagaagcagctgataaagttaagacgaatgcgcaaaaagaagccgagatcattagtcaagaagcgcagaagaatacgcaaaatctgttaaatgaagcgactgataagtccaaccggattttggccgacgcctcacaaaaggctaaacaaattacgattgaaactgaagacttgaagaaacaaactcgtgtcttccgtcaacggctacaagtaatgttggaatcacaattagaaattgtgcgtagtaaggattgggatgaattgttggctcatgatgatggcgcacaagatgaagcgattcaacaaatcttgcaacaacggcttgacaatacggaaacaagtggcgtaaactcaaatcaatcagaagctgcaccagcaaatagtcaagtaagtgctgaagcggcagccgatactgcagcagcgcaagttgagagtgaagcaccaggggagacgatgattattttccctgataatacaagcgaggctgctggtattggtgatcaaccagcaattgaacctgattcacaaaattccgataaataaatcacaaagaacagtaagctgatcgttatcacaacagcgagtcaacagttggtgggaggttgacagtgcgctaacgagcagtggatcatctttgatttgatgcaacagtgaataatgagtaagtgttgccggctttgtagtcgttataactacagttgagggagtgcctgaggtgctctaaatctgggtggtaacacgacgacttcgtcccaattagggatggagtctttttttatttgtatcaggaatgctgtgtgatagctgataaaaatgtaacttaaataagggagagatgttgatgcgtgttaaagacactttaaacttaggtaaaactaagttcccaatgcgcggtaatttgcctgttcgtgaagctgaatggcaaaaagcatgggaagaaaataacttataccaacaacgccaaaaattaaatgagggtaagccaacttttgtcttgcacgatggccctccatacgctaatgggaatatccatatcggtcatgcgttgaacaagatcagtaaagatattattgtgcgtttcaagtctatgtccggcttccgtgccccatatgttcccggttgggatactcatggtttaccaattgagcaacagttgactaagcaaggctatgatcgcaaaaaaatgtcaatttcagaattccgtgccctttgtcataaatatgcattagaacaagttgacaaacaacgtactgattttaaacgcttaggtgtttctgcagattgggatcgtccttacttaactttagcaccagaatttgaagcacatgaagtccgtgtttttggtgaaatggctaaaaaaggttatatttatcgtgggaacaagccaatccactggtcaccatcttctgagtcagctttagccgaagcagaacttgaatataaggatattgaatcaccatccgcttattatggtgaacaagtcaaagatggtaaaggtatcctagatactgatacttactttgttgtttggacgactacaccatggaccattccagccagtgaagggatcgtcgttgaagccgaatacgattattccgttgtgcaaccagctggcgaagatcgtaaattcgtagtggcttctgaattgatcaatactttggccgaaaaagctggctggcaagatgttaaggtgctgaagacacttaaaggtcaagatatggaatatatgacggctcaacatccgttctaccaagaacgagaattattagtgatgttaggtgattacgtcacgcttgattcaggtactggtttagtccatactgcacctggtttaggtgacgatgactttaaagttggtaaaaaatacggcttggatattctatcaccagtggatgatcaaggtcgtttaactgatgaggcgcctggcttcgaaggtttgttctacgaggatgccaataaattatccatcaaaaaagtcgaagatgctggcttgatgttgaagcaggaaccatatctgcatagttacccaatggattggcggacaaagaaaccagttattttccggtcaacaccacaatggtttgcgtcagttgatgctttccgtgatcaaattttggccgctattgaaaaagtttcctttacaccagattggggtaagactcggctttacaatatgattcgtgatcgtggcgattgggttatctctcgtcagcgggtctggggtgtgccattaccaattttctacggtgaagatggtgaagccatcattacaccagaaacgattgatcatgtcgctgatttgtttgccaaacatggttccagtgtttggtttgatcgtgaagctaaggacttattgccagaaggtttcactagtgaacattcaccaaatggtcagtttactaaagaaacagatatcatggatgtctggtttgattccggttcatctcatcaaggtgttttagctgaacgtgattacctaacttatccagctgacctttatctagaaggttctgatcaatatcgtggttggttcaactctagtttgatcactagtgtagcggtttctggtgaagcaccatacaaacagatcttatcccaaggtttcacaatggataaagatggtcataagatgagtaagtcattgggcaatacgattgcaccaagtaagatcatcaagcaaatgggcgctgagattctgcgcttgtgggtcgcaacggttgattcttctgctgatgtgcgggtttcaatggaaggcttcaagcaagtttctgatagctatcgtaagatccgtaataccttacgcttcttgttagctaatacaactgactttgatcccgcaacggatgcacttgattatagtgaactacagtcagtggataaatatttaatgattcgcttgaatcaagtcaaagcagcatccttagcagcttataataaatatgattttgcaacggtttataaacagatcagtaacttcattactgttgatctgtcggctttctatttagactttgctaaggatattgtttatattgaagcagctgatgatccaaaacggcgggcaatgcagaccgtgatgtacaatgttttagttgatttgactaaattattgacaccaattttaccgcataccactgaagaagtttggggcttcttacacgaaccagaagattacgtgcaattagctgaaatgctggtagtcgatcattttgatgacgaagctgaattacaggaattatggaccaactttatggatctgcgttctgatgttttgaaggcattagaagaagcgcgggacgctaaagtgatcggtaagtccttggaagctaaagtgactttgtatcctaacgaaacagttaaaacgttgttaaatgcgttggatgctaatgtgatgcagatcctgatcgtttctgatcttgaagtagcagacgcagctagcgcaccagctgatgccgctgactttggtgacgttaaagttgttgttgaacatgctgccggtgaagtttgcccacgctgtcggatgacgcggaccgatgtcggcgttgatcctaaacttcctgctttctgtggccgctgtgctaaaattgttgaagaacatttccctgaagcagtgactgaaggatttgaagattaatcttaaaagagtcaatgactattttagtcgttgactctttttctgactaaaaataagtagctgcgtagtttttttttctcatctgtgctacactagattttaatttcaataatgaaccgtgttatgatgcgcaagattagtaggtatcagaagtgcggtataaaattattcatgattgtgttgtgttacatttttgtggtagctattcatgattgtgaggtagaggtggaatggtaatggacgtcacattgacaaaagtacacggatcagagaatgacttttttattcttgatcaaacaaaattagcccatcgtttaagtgaggctgaactaaaacaggccacgcaacaggtgactgatcgtaaatctggcttagccggtggtgccgatggcgttttgtacgttgacgactccagtcatccgcaagtcagtggtaaaatgcgggtcatcaatgctgacggaagtgaagcttcaatgtgtggtaatgggattcgtactgtagcacgctatctttctgaacagaaacagcaaactgattttaaaatcgaaacgatgtatgctgatcttaatgtaaagcaagccgctgatctcgcaccagaagttaagacttttcaagctgagatctcaccggttagttttcaagcaactgacttgggtatgcacgtggctgatttaactgaactacatcatgttaagctgcccgcattatcgaagtcattgttctttaccgcggtggcggtaccgaatccacatttgatcagttttgttgatcatgccacgttattaggaccagaattaggccgtattgccggttacttaaatgatggccaaaatccttattttcctgatggcgttaacgttagttttgttgaagtgctggggcaaaatcatatctttgtacgcacgtttgaacgtggagttggctttacgaatgcgtgtggtaccggtatgtcagcggctagtttgatctatgttttagagcagggtggcgatttcgaacaattgattaccgtgcgcaatcctggtggcatggtcaaaactttagttcaccagacagatactggttattggatggaattgatcggtaatgccacttttgttggtaccgcaacgctcagtctcgatgacttattggccggcaattttagtcaaactaaattcaaggtcagtgatgaacaaccagcttatcaggcatttgttaacaatttaaaataaggataggcttgtcgttattttattagcgacaagcctatctttatgactaaataagaatgaggaattaatatggcaactgaagtcaaacaagcttcttttcaaacggatccgaatgttcaaaaaaatcgttggtggatcttagtcgcagtcggtctatttacgtttatgtcaaccttagatggtagcatcgttaatatcgctttaccagtgatgagtcgtgatttgcatattccaatgaatcaagcagagtgggtcgtttcaatttacttgatcgttgtttgtgcactcttattgctatttggtaagttaggtgatgcctttggcaaaatccgtatctttcgcttaggcacgtttttctttgtattgggctcactattatgcgggtttaatcaaagcttaacgtttttattgttggcacgtagcttgcaggcctttggtgctagtatgacgatgagtacaaataatgggatcatcactgaaatctttcctatacaggagcgaggtaaagcgttaggcttcatcggctcgtttgtctctttaggttcgatcgctgggccgggtattggcggtttgatcttagcggtattgccgtggggctacattttctggctgaatataccaatcggtattttgactatgattataggtcataaaactttgccgcatgacttattagccaatcgtaaaccaattgatttcggtggctttatgctattcatgatcacaattgtgagtctatttgtcggcgtttttctaggccaacaaattgggtttactcagccaatcattttaggtttattcttattggctatattgatgtttagtgcctttctttggtatgaaccacgccaaaaagaaccgttgatcgcatttaaattattccgtaattctgcatttacattaagtttgattgctggttttctgatttttgtgaccaactttttcttcaacgtgatctcgccgttttatttagaaaatgcgcgagcaatttcaccgacgattgctggttatattctaatgatgtttccaattgttcaggtgattgcatcaccactggctggtagtatctctgatcggatcggaccagaattattgacgtttattggtttggttttaatttccctaagtcagattggttatttattaactgatttaagtacgccactttggctatttatggcttttgtcggcttagttgggctcggcaatgggatttttcaagcacctaataatacaatggtgatgagttcggttactgctaaagatctaggcattgctggtgggatcaatgcactagcgcgtaatttagggatggtttttggtatttccattgcaacaacagtgttgtatggggcaatgagtcataactatggtcaacatgtgacaacctatttagcgaagcaaccagatgtgtttatttacgggatgcatgcttcctttgcggtggcactggttatttgtttaattgcgacgatgctgacaggggttcgtttattacgtaaacgccgttaataaaaagcgctagaccgttaattctggtctggcgcttttgtagtgctatttattatggtcctgggtcaaagctaataattgatcacggagattattttccatatgactcaattctaattcggcactttgacgtttttcgcggccttcttgttggatcttcagagtttcctgcaaagtttcaacgagatcattttgcgttttctgtagcgtttcaatatcaacaacaccacgttcgttttccttagccgtttcaatggaggaaatcttcagcatttcgctgtttttcttcaacaggtcattagtggtttcggacacttgacgctgtgccgtgactgcttctttttggcgtaacaaagtgagggcgattgccacttgatttttccatagtggaattgcagtgttgatcgatgcctgaattttttcagctaaaacctgattggtattttgaatcagccgtatttgcggggcttgttggatcgtgatctcacgagctaatttaaggtcataaacgcgtttgtctagccgctcctcaaattggttcaaatcgttaacggtttgtagatccatttggctgccgctagcttgcgctttttgattagcttcaggaattaatttggtttgtaattcggtgcgttttagttcgccagcggcaataaaaatattcaaggcgtcgaagtagtccttatttttttgataaagttgttccagtagccggttgtcgttgagtaagttatttttttctttatctaatttaacggcaatcgtatcgatctgggcaccaattttttggtatttagcctggatctcatagatcgatttgcgcactttgccaaacatgcgtttaaagaaattactgtcgccagcttgtaagtcttcgggactagcttcgtttaagcgaaacattaaaccggaaagggcatcgccgattgcacccgtatcttggctctgtactttacttaacataccttgtgaaaattcactaagtttagtttgcgcttgagcaccataagtcatcactgattgcgtatcactgacatcgatttgttgggccaacttttctgcatcggctcgttgctcgggatttagccgatcaatcatctgctcaggctgtcctgtctgagtcacttgctgattattgacgactggggcattaggggtgctaaaaggatcttttaagagatcatctaaaactgcgttatcaggggtaacatcttttttttcgttattgctcatcgtcattggactcctttgctgccgtttgggattttttaagtgctgcttgtgccaaggtgatatcgacatcgatatcacttaagtcatcagcaactaaggcctcataatcgtcacggaattgctgagctagatcactaatgaccgtcgcacttttatccagtacggtgtaggtatctttatctttaacttcgtgcttactgattgcgatatgcttttccgttaaatcgaccattgtgggtaaatgccggtataaaaagtcactggcagcgtgtaacttttgtggttcggcaacgatcgttttaaaaattgctcgactgactttaactggttccgaatgtaattcaattgcacgtaatttaggtacgctttgcatattctgatttaattgatcgatttgatctttggcggtactcatggtttcgcggaaaaactgaatgtcttcgtcagacatacctgctttacgatagtgcgtcaacatggtctgatcaacattttttaaatttttcgccgcttgtggttgccgttgttgccaccagaaaataatccccgtgacgatcacagcaccaccaagtgccaaagtattgttaaaattaccattcatgcagccatcaaaaactaaacggaacgcgtagaagctggcaataaaaataatcgcattgatcagccagctacggcgcttagaaattcttttttgcattattgtcaactccattcattaacgatctattgtagcttcattttaccacagacaaattacgagcagctaagtctaaagattgattttctgctaaatcgaactactgattcttacaaatgtatttgaatttctaaattattaccggtatcatgaaaatatcaatgcaaaagtattgcggaaagatgaaggaatgaccatggaatttgcggaaaagcgattgacgaatcagcgcttgtatcatggtgcggtgattgatttagatttagagaccgttgcgctacctaatggtaaaacggctaaacgtgagatcgtacgtcaccctggtgcagcggcaattatggcgttgactgccgatcagcggatgatttttgttgagcagtggcgagaaccattacaacaggttacgttagaagtgccagctggcaaaattgatgcgcgggatgtagatgctgaagcagcagcttggcgtgaattaaatgaggaagctggttatacagcagataaattaaccttacaggcccgattttattcatcgccgggttttgctgatgagcgcatgtcactttatctagcaactgatattcagccggtgaccacgcgtttggccttagatgatgacgagtttttacgattacatttgttaactttggcacaggcccaagaacagatcgaagctggggtgatctgcgatgctaaaactttgattgccgtccaatattggcaagcaatgagttgactcattgctcaacaatcgtaacagtcgcggcaggttatctggcacgggttggtggctgttcagttatcctcgttttgaagtaaaggatcgtgattaaatgtcaaatgaagaaaaaccactaagtcgggcagcgtaccgtaagcaacaggaacaacacgagcagcagacggaaccagctaaagaaccgccattacggcgcgaagataagcggcggggcaataaacggtcacatactagcagtgatttggatgaacccgcggctagtcccaagcttaaaaaacgtttaaattgggcgattggaatcgttgctgtgttgatcgtcttggtttatctggttttattttttgtctagattaaccatgaatgtcgttttttatcctaactagtgattgtgataagaaaaacgacaggtgatagaagtaatattaatatataaggagtgttttgatttgaaaatcggtattgtcggcgctatggaagaagaaattcgtttattacaggaaaagatgagcgatttgacccaagaaaaaattgctggagtagatttttatcaaggaacgatcagtggtcaaaccgttattttagttcgttcagggattggtaaggtccaagccgggatgacaactggtttattgctatcccgttatacacctgacgtcgtattaaatacaggttcagctggcggtattggtagtggcttaaaaattggtgacgttgtggtttccagtgaagttgcttaccatgatgttgatgcgactgcctttggttatgcgttaggccaattaccgcagcaaccagcacgctttaaagcggatgcgaactgggttgcacgggtgcagcgggcttcggcggcggttaatttagcttcacggacaggcttaatcgtttctggcgatcaatttatttctagtcatgcagctagtgctaaaatcttagccaactttcccgatgccttggccagtgaaatggaaggcgctgcaattggtcaagtagctgctcaatttaaggtcccgtttgttgtgattcgtgccatgagtgatgttggcgatgaagatgctggtgtgatcttcgatgattttgtggttgaagctggtcaacattcagcagccatgattttagcgttattagctgacttagcatagctaaacggttgcttgacttgtaaactgtgctaaactattattgcttactttttacaaggggagaacaaataatgacacatacctatttagataatgcagcgacaacaccaatggatccggcggttattgcggtgatgacggagcaaatgcagcagaacttcggtaatgcttcaaacatccactattttggccggcaagcgcggcaagtgcttgatgccagtcgcaaaacactggctcaaagtatcaatgctaaggaagcggagatcgtttttactagtggcggtactgaaggggacaataccgcgatcatgcagacggcattgcaacgacagaaactaggacggcatattatcaccacggccattgagcatgaagcagtcttaaagccattacattttttggaaacacaaggctttgaagtaacttatttacctgttgatgagcgcggtctgatttcattagccgattttaaagcagctttgcgtgacgatacgattttggtctcgatcatgatgggcaataatgaagttggtagtcacatgccaattcatgaaattggtgaattattgaaggaccaccaagcttggttccatacagatgcggtgcaggcttacggtttgttggatattgatgtccagcgtgatcatattgatttattatcagtttctgcgcataagctgaatggacctaaatttttaggtttcctctatcggcgtcagggaattaattttcccagctttatcaaaggcggcgatcaagaagataagcggcgggcaggaacagaaaatattccggcaattgctagtttcgctaaagcggtcgaattagatacgccagcggaaaaagccgcacgacagcagaaatatgctggctttaagcaccagttactggctgggttaacggctaatgggattgactttgctgtcaatggtgagctgaatccagataatttacaacatgttttgaatatttggatcaaaggaatttccacctacgtcttacaaatgaatcttgatctggctggttttgcaatttctggcggttcagcatgtactgcgggcagcttagagccctcacatgtattgacggccatgtatggtaaagatagtccgcggatcgaggagtcgattcggatcagttttggtaaagataatacggctgcagagatcgataattttgtggcagctttgacaaaaatcgtacaacgagttaaaaagacagtcaaaatttaaacagaagagccatgtttcttgcgacacgattttagccacaagaatgaacatcgaccgtaacattagaaatttttggtacaaaaatcatccacgattgtggagtagaggagtgagcggaatggcatttgcagcaacagcggcagttaaagggagcacaacaacttacgcgcttagccctaatgttaaaaaatatacattaaaggatgtcggttttgttgaaacgcgtggtggtaattttcaattagaacgaccacttgatcctaattcgccatacaatcaggcgttcaagctaaaaattactgttgccaaagatttaaagaacctgaagatgtcgattacaacagccaatgggttacaagcagttgacatttttaaacagccggctaaaaccgaagaaattacgcaatttaactttttagtggacaatctgattgaccgtgagattttaattaaaaaataattagtaaattcacttgattttatcatattaagttttaaactaaaacttagataaataagggtgggttaaatatgaaaaaattggtttggttgatcgttactagctatcatgatcttcagtgggtttatcaacatgatgaagttgcttggaagatcaattaaagttgcaagtaagactactcagaaatgggtggccttttttacttatgattagttagcttgctttctatctgtggcttgttataatggtaattactgaattacgcgaccttcaaatcgtggattttcagaatctatttgaaatgatggtgatcaaatgaatgagaacgccaatacacgcgttgtcgttggtttgtctggtggcgtcgactccaccgttgccgcattattgctgaagcaacaaggttacgatgtagtcggtgtatttatgaagaattgggacgataccgatgagatgggtgtctgtaccgccaccgaagattttaaagacgtggttaaaattgccaatcaaattggcattccgtattactcaattaattttgagaaggaatattgggaccgcgttttcgagtatttcctagatgagtataagcacggccggacacctaatccagacgtgatgtgcaataaggaaattaagttcaaggcattcttagattacgcattggatctaggtgctgattatattgcaacgggtcattatgcccggattcggcgtgatgctgatggcactgcccacatgttacgtggcgttgatggcaataaagatcagacttatttcttgagccaattatcacagaatcagttgaataaggtcatgttcccattaggcgagatgactaagcctgaagtgcgcgagatcgccgctaagtatgacttggcaaccgctaagaaaaaggattccatggggatctgctttattggtgagaagaacttcaagcaattcttaagccaatatttaccagcacagcctggtaagatgatgaccgttgacggcgaagttaaaggaacccatgacggtttgatgtactatacgattggtcagcgtcagggcctaggaatcggcggtaacggtacttcgaacgatccttggtttgtgatcggtaaggatcttacgactaatacattatacgtaggccaaggcttccacaatgagcatttatacgcaacgcatttgactgcatctaagtttaactttacaactgacttagatcgaggcgatactttccacgtaacggctaaattccgttatcggcagaaagataccggcgtcacagtgcatatgaatgctgatcaaacaacggcaacaatcgagtttgacgagccggttcgtgcgatcacacctggtcaggccgttgttttatatgatggcgacgagtgtttaggtagcggtacaattgacgctgcctataatgatgagcgcgtattacaatacgtttaattgagaaaagttggctgcggccaacttttttgtttgcgatggttgcttgaatttccgcgcacttttccgcataatagtaggaaaggtattggaaagaggatcagttctggtgactaaattattttttgtacgacacggtaaaacgaaatggaatttagaaggacgttatcaaggcgctaatggtgattcaccgttattaactgaaagttatacggaaatcgatgacttggctaattttttacggccattacagtttaatcgaatctatagcagtccgttaaaccgcgctaaaacgactgctttagcgttagaagatcggttacccggtaatattccggttgtgattgacgagcgtctacgcgagtttaatctaggtaaaatggaaggcatgaaattcactgaggtggctaaacgttatccgaaagaactatatgcattccgacacgcaccggcacaatatgatccgactgtgatcaacggcgaatcctttccacagctgattgcgcggatgcaaccagcaatcaaagaaatagttgctcaagacactggtaaaggacagtacatcattgtcagtcatggggctgcgttgaccgcactgatccaatcattattgggcacaccgatcgctgatatccgtaaacgtggcgggttatcaaatacaaatgtgaccacgattgaaactacagatagtggcgcaacttatcaattgatcaaatggaacgatactcattttctaagtaaaacgttagacgagactgatacgatttaggtgattttttgcagaataaaagtaaagctttatgggcaaagggcgataaacaaggtgcagtcaaagccttagttaaagctattgaacaggcaccgctacaattagataattatttagaattagcggcttatttaaatgcacttaaggatactgatcaggcagaaaagttattgcatagcgctttagtgcgttttccagataatcaagatctgctttatagtttaggcacaacttattacgcggcaggcaattatccacaagcgctggcgcagtttcagcagatcaccgctacccgtttagaaaatgataaattatacatgctggcgtcaacttattatgcgcaacaagattacgctcatgcattagcatttgcgttgacagcgcagcaaaatgaaccacagcgtagcgatgttgatctgctagtcggtgatttatttctagcgttaggggactttggccatgctgaaacatattatgcacaagtcttgacgcaagagcctgacagcgcggccgccaattttaaagttggtttagcccgattggcgcaaggaactgctaacgaggcttattttgaaaaggctaagcagttagatgcagcctattttgaacgtgagaaacaccgtttaagcgatattgaacgttacttaaaagcacaacaaaaatgaggtaccactatgtcagaacaagaactaccattatttacagaggatgaacaaccgccatatttgattggtaaagttagtgcggtcttttttcataatccaactaatttttaccaagttgtgctaatcaaggttagtgaaactagtttcgaatggcacgaggatgaaatcgtggttactggtagttttggtgaactcaaagaagaagaaacttatcagttttttggcaagttagtgactcatcccaaatatggcatgcaatttcaagcgactaactatcaactaaataaaccaacgacgactgctggtttggtggcttatttgtcgggcgataattttaaaggcatcggtaagcgcactgcggaaaaaatcgtggctgaattagggactgatgcgatcgataaaattctcgccgattcaagtgtgctggcgccattagggttaccagcaactaagattcaagcgttagttgacacactgacggctaataatgggctggatcaaattattattggtcttaacggttatggctttggtagtcagttagcttataccatctatgaacggtatcaacaagacaccttaaaagtgatcacagagaatccctatcaattagtttatgatattgctggtgttggctttaaaaaagccgataacattgccttgcaacagggttcagcggctgacgcaccagagcggatccaagcggcaattttacaggtgatcactgagttgactcaagccgaaggcgacacttatacgactgctcagccattattgaatgggagtttaaagttgttacaagaaagccgtaacgtcgcaatcgatccggataaagtggcacagcagtttatcgagttagctaatcaaggcaaattagtcggtgacgaggatcgaatttatttgcggtcgctttatcgggccgaatggcaaattgctgaacatctctatcgtttggaaaatgacgaggatgcgatcacttatccaggacgtgatttagataaagagattcgccgtctagagaagctttttgggatgagttatggcgattcacaagttaccacgatcaaagaagctatgacgcaccgcgtgtttttattgactggcggacctggcactgggaaaaccacgatcatcaatgcaattgttagtttatttgctgaactaaatggactatcacttgatccaaaagattacaaagatcaagataaaacttttccggtcttgttggctgcaccaacaggtcgtgcggctaagcggatgagcgaagttaccgatattccagccagtacgatccatcgcttattaggtctaaccggccgtgaaagtagtcctgatgtggctactaaagatctagaaggtggcttattgatcattgatgagatgtcgatggtcgatacgtatttatttaaaatgttgatccgtgcggtgcctagttcaatgcaagttgtcctagtaggggataaggatcaattaccgtcagtcggtccaggacaggtttttcacgatcttttgagtagtcatgtgttgcctggtcatgaattgactgaaatatatcggcaagatggtgaatcatcgatcattccgttagcccacgcaatcaaggaaggacaattaccggctgattttaatcaaaataaagtcgatcgttcattcattgcttgtaatgcttatcaagttgagtcggtgatccagcaggtagtcactaaggctaaaacaaaaggttttacggcacaagatattcaggtgctggcaccaatgtatcgtggtgctgcgggtatcgaccgactgaatgttgaggttcagcagatcttgaatccaccgaaatcagcaaaaacgaaagcaatcgaatttcgtaaccaaacgtttcgaattggtgataaggtgttgcatttagttaatagtccggaacaaaatgtttttaatggcgatattggtgagattgttagtattcagttggctaaagataaaggtaacgaggatcgtgccgacaaaatgacaattcgttttgatgctaccgaagtaacctatgggcgtacagattgggcgaagatcactttagctttttgtacctcgatccataaggcgcaagggagcgaatttaagctggttattttaccaatggttcatcagtatcaacgcatgctgcagcgaaacctactgtatacggcagtgacccgtgccgaaaagttattgatcctgattggtgaaaaacaagcctttatcgatagtgttcaacatgaatccgttaatcggaaaacaactttaatgcagcgcgtgcaggctacttttgcacctgacgaacaacctgctaaaattgaagacgaactagcaacttacgcaaagtcaactgatgataaagcgccaactgcgaccacctcagttgaagttacagcacctgagcaaccggcagattttattttgactaccgcactgattacacaaggcaaaattgatccgttgatcggcatgaagggaatcaagccccgcgattttgtgaccgcaaataaataagcaggtttcccatttagggaacctgcttatttattaggtacgaaccagaagtcttggtgtgccacactaaattctaaatcaaagcggcgcttgcctaaatcttcgccgtcggcttgtccgtattcagccgctgaggtttgcacatgtaatttacgaacgtggaaatgatggaccggcggcattttagtatgccattgacgaaacatcatggcgaataataggatgaagtaaaaaacgttgacgcgttccataatgactaagtctaaatggtgattgtagactgaagcactggctagtagaggaacgccgccgccaaaatagggatggttagttgtagtgaccacaaatcctcgcttaaactgacgctgttgcccatcggcagttaccgttaccgggaaggctttttgactgaaaaaagctttaactaatgaagccaaataggccaacgagcccgcgtgatatttattgagatattttttagtgaccgagcggttggtaatgtggacaacgttagcgtcaaaaccgattccgatattattgctaaagtagctaactgtgtgctgctgtaaatcattgcagcgaccaatatctaaggttaagggcttttgtgcagctaagatctgtgctaaagcttgttgtggatcagtggtgataccgacaccacgtgcaaaatcattgccggaaccacagggaatataagctaatggtattggattatccggcacttgttgtaagccgtttagcgcttcatgtaaggtaccatcgccaccgaggacaagtaatattggcgactcggcggttgttgtatgatattttgtagccagatcgtaagccaacttggtggcatgaccgggtgcctgtgtaaaattctctgtataagaaaggtgacgttgttgtaggatcggcacgagttgtaaccaagtttgacgagtacgaccaccaccagcaaagttattgatgatgacataaaaagggcgttgttgagacacagccggcacttctttctaaattggaaatttaatggcccaaaagacgcagtaaacgtcttttgggccattattggttgcacggtgctaaaccgtgaccagcattggtaagatcattgggtggcgttcagtttgatcaaataagaattcttgtagatcatcgatgattgcatcacgtaacattgactcagtcacttgttcgttcgttttgaaaatattacgcatgattcgataaattcgtttttgacctttactgattagttcgccagattcacgcatgtagacaaagccacgtgagagaatatcagggccagctaaaacttgcttggttttaaggttaattgttgctaccacgatgacaataccttcttcagaaagtacttggcgatcgtgaagtaccacattaccaatatcaccgataccactaccatcaacgtaaacgtcaccggcagtgaagtgaccggcgatccgcgcggagtcgctggttaaggctaaaacatcgccattttccatgataaaggtgttttcttcaggaacatgggtctgttcagctaactcagtgtgtaattgcaacatccggtattcaccatgaattggcatgaagaatttaggcttcatcaaacggagcattaatttttgttcttcctggccaccgtgacctgaagtatgcacattattaactttaccgtgaatgacttcggcgccggcctcagataattcgttgatcacatggttaacactggttgtgttacctggaatcggattactagagaagacaactgtatcaccaggttgaatggaaatctgccggtgagtaccattagcgatacgacttaatgctgccattggttcgccttgtgagccggtacagaggatcataatcttgttggctggtaaatgatttagttcattgccttcaactagactttcttcaggaatatttaagtagcctaattcagtaccattaacgatcgcattttgcatactacgaccaaaaacagcaattttacggccagcggctaacgcggcatcactagcttccttgatccgagagatattagatgcaaaagtagcaaagatgatccggccttcgattttgtcgataatatgtttcaatgattgttcgacaaaacgttctgacttcgtaaaacttggtacttcagcgttggtactgtcagacattaaacaaaggacgccttcttcaccaaggcgagccatcttttgaaagtttggtgcaggttggtcgcccactggtgttaagtcaaatttatagtcaccagtttcaacaatggttccttgtggtgttttgacggcaacgcctaacgtatcgggaatagaatgggttgttcggaaaaacgatacgctagttttacggaattttaagacggtatcttcgttgatttcatgtaactcagcgtcttttaataaaccacgttcctctaatttaccgcggatcaatgctaaagctaaaggcccagcataaatcggaacattcatttgttgcaacaggaaggggataccaccaatatggtcttcgtgtccgtgagtgatcactaaggccttgattttggacaaattagtcattgcgtaagcataatcaggaatgacgtaatcgattccgagtagttcatcctctggaaatttgatcccacagtcgatcaagatgatttcatcttgaaattgaatgccatacatatttttaccgatttcgcctaagccccccatggcaaaaacggcagtttcgttattcttgacgttcagtttcttcatcattgaactccgttagtttaaaattgggactcttttgttcatattcgagatgattaccgatcagttcttgaataaattcaacattatagggggtttgtgtttcgatgattgaccgagcagctactgcatcagtagcgtccatgtaaagtgttttagtgctttcgcgccgtggtgccatagatttattttcttgataaagtactttaaagatcataagaaatagatcgctcctttgaaaaaataagataaaatatagtcacactactaaaaagcccacctgattacgtgggactttcagcgtgcaattaaattgttttcttccgaacaagtggttgtaaaaacaacgtatgcctaaattttagcataaaacgattaataagtatactcactaccatgcctgggtaagttcaataactgagcatgatagtatgtctcttttcgttaggtgatcaattatggtacagtaaagtcagtacaaggcttatttaaaatcgcttttagtaccgtttcttgtgagaactgccgcttgttttgggccatacttttagcaaggaattagttaatgaaattactgataaaacgtttgctcaccagttgcagttgaactgctaccacagacgaggtggacttttactaatagctttcgggtttctgtgttgttcattttgttggccgtaactgtgcttggcaaaaacctagcaagataaagagttgtattgagtatgaacggtaaaaattgcttaacattttttgctaagcaacgatcagtctatatgagatagaggaaggtaaaacaatgaatacattatttgtgagcttagttgtactaggcgtcattattttggtcgttgtgttggtccttacacagcgtctacgccgtaatcacgctttacgtttactgcaactaactagtcaaaaagcgagtgatgctgctgcagcaactgcactgcaacaattaagtcagcaaaaattgttgcctgcattgacggcgccgttagtttcacaagttgccgccgatatttggggccatggtgttttagtttttgagtatcaggtcgctgcaggtgagctgacatcgccgcagttaaatatgttagcccatcagttagaacaggctttggcacaagccgcaaaacaacaagaattgacggcgtttaagccggacgtaccggtatttatcgtttctgatatttggctgttgactggaaatttacattttgatgttgcctatttacgtaatcaagcaacttttgattatgtggccgatatgcgtaaactcagtgttgaaaaaggaactaattaaaaaagtgagctgcaattttgcagctcactttttgtaatcggggaagtttattcgatgactaagtcttcgttttccattgtaaatggatgttcgtggtcaatatgatcataaaataagatgccatgtaaatgatcgatttcgtgttggcaaacaattgctggatagttttttaggcgaatcttatgttggttgccgtcaatatcatagtaacgtaaggtgatccgatcgtggcgaacgacgtagccaggaacatcacgatcaacggataagcagccttcgccttcagacaaggccgccccttgaacggagtgactgataattaccggattgacgatcgtatctttaaataatggggcttcaccttcaggcccaggaactaaaactgatgccatctgtaaagaaacatcaacttgtggtgctgccagaccaacgccagcacgtagatgatatttttccgcaattttaggatcttgactattttcaagaaattccatcatatcatgtgcgagttgcagttgttcatccgttaatgggaaggttgctttttttgcttccgctcgtagcgtatcgttaccttcacgaataatatttttcattgtaatcaacttctattacctccgctttattaccatttatgagaatagtttagcataattattcgttaaattaaaagcttgttctgatgtgcactcggtttctaaatgcccagcagaggaaatgaagtgaaagctaactaaagctttagaaaaaagttggaaaaaataaatttttgaattttagtcaatctagcttaaaatagagatagtttatctggtttttggggaaggggttgaataagtatagtcaaggatagccactagattttaattgcacgacgattagtttgtgggggttactttaaattgggtatacttggatcaatgaaaaagaatatcgtaatttgcggtaatgcggaccgcgtttatgcagcaacacttgcctgtttgctggttgattttccattaacgatcaatttactaagtgatgatggcttaagttcagaacgattacaagaattagttaatgcagcggacttacagaataatattgatgttcagctagcaacgccagcaatttttaaaacagccgatttattactgatcaccgatttacaagcggtaccagctgatatctcagcattagattacgctacggcgattttacctgaatttcgtaaattgattgccagcgcgatggctaatggatttactggtaagatttgtttgctgcaaaaatacgacgaactgtttacctattttgcgtggcgcttttctggcttaccacagagcgatattgttggttttggcacgttcccagcaacgttgctgttagaacgtttgctacaaaaacaattgcgggttggacggcacgatgtgcgggcctacgttgttggtacggcgcaacagccgattgttgtctggagtcgagcctatgttggtgtggccccggtgttgactttagttgccagtgaaacaacggattttgacgctgataaaatgatgcaattggaacagcgggtacaacaggaaagtggtgtggagcaattcgctttacaagcaatttgtttacaaactgttttacgggcattgctatttgaagcaggcttgttatcgacctttacaacgttgcatccatatactgatgatcaattagttgcatatagcgcaccaatttatctaagtggttcgggaacgcgtcaagttactgaattgtctttgactaaggaagaacaagctgaattggcagcatcattagcagtcactcgtgatatgatcacacaaatcgaacaaggaggattaggtgtttgaataatcaaaattatcagtatccaatggatgcggattggtctaaaaccgaattggtgacggtgatcaccttttatcaggcagttgaacaagcctatgaacaaggttgcctcgtagctaaatttttaaccgcttatcaggattttaaggtcgtagtgctaggtaaagctgatgaaaaacggttagatcgtgagtttaaacaagcttccggctattcgatttatcgcgctgtgcaggcggctaaaaaagcgactaaaaagcaatttagaatggaatgaggtgtgggtatggatctattggaaattaaagcagttaatacagatgttcaacgttggttagctactgcagcaaccaatttacggcaacatttaaccgcacattttcaagtacaaactaaatctggacgtaatgatttagtcactaactttgacaaagaaactgaacattttttggttgatcaaattcggcatagcttcccgaatgatcagatcgtaagtgaagagggttttggcgatcaagttcagcaaatgagtggtcgtgtctggtttgttgatccgatcgatgggacattaaatttcgttaaacagcggaatgattttgcgatgatgatcggcttatacgaagatggccgcaacgttttaggttatattctagacgttatggacaacaagttattgtggggtggtcctagtgtcggcttacatttaaatgaagaggcaatcagtggcccggcaaatgagcccttagctgctggtttgtttggcgttaacggcccgatgtttgcaacgaatcgcgagtccgttcgtgatattgcgtttgccagttctggcgcacgcattctgggtagcgctggtttagaatttcaacatgtgatcttaggccgccaggtgggatacatctcacgtttgatgccatgggactttgcggcgggaaaaattttagcagaaactgcaggtttatcggtcacaacgattgacggcgaccctataaatatgctaaaatcgcaaactgtattagtaacaacgcatcatgcgctgccagagattcaaagaatccgacagtcttaaaggtagtttatgaataaaaaacgcaggactgtggcaatggtcacagtttttttatggcgttggggcggatgttttctgaaaaaaactgcgcatcagcaatattttctggtataatatgctgttgagtgtgaatttcgcctgaaatttatggtttcgggcttggttttaactaagcaaatagcgcacagttaaagaaggccaaccgaaataaccggatctattagtggcttaagctaataaatcatcatttttgtgaagtagagccatgtttcaactaggcgaattgagccgtagttgaatggacatcgcccgaaacatcaagatttattagtggtttgaactaataaatcatcatttttgtgaagtagaaaggatagagtaaagtgaagcgtagagaagatattcgcaatattgcaattattgcgcacgtcgatcatggtaagacgaccctagttaatgaaatgctaaaacaatctgatactttagatgaacatatccatttagaggatcgggccatggatactaacccgattgaaaaagaacgtgggattacgattttatcaaagaatactgcagttgactatgcaggcaagaaaattaacattttggatacaccaggccatgcggattttggtggcgaagttgaacgaatcatgaaaatggttgatggtgttttgttagtcgtagatgcctttgaaggaacaatgccacaaacacggtttgttttgaaaaaagccctggaacaacatttaacaccaatcgtcgtgattaataaaattgaccgtcctggtgctcgtcctgaagaagttgtggatgaagttttggacttgttcattgaattaggtgccgatgatgaccaattagaattcccagttgtttacgcaagtgcaattaatgggacttccagcttggaatcagatccagcagcacaaaaacatacaatgaatcctttgtttgatacaattatcaagactattccagcaccaattgacaactcagatgaaccattacaattccaagttgccttgttggactacaatgaatatgtcggtcgtatcggtattggtcgtattttccgtggtaagatcaaagtcggtgatcaagtttccgttttgaaacttgatggctcagctaagaacttccgcgtaacgaaactatttggtttcttcggtttgaaacgagttgagatcaatgaagctaaagctggcgatttgattgctgtatctgggatggaagatattttcgtcggtgaaacagtgacaccagttgatcatcaagaagctttaccagtcttgcggatcgatgaaccaactttgcagatgcaatttgttgctaatgattcaccatttgcgggtcaagaaggcgaatttgttactgcacgcaaattggaagaacggctaaagacacaattgcatactgatgtttctttgcgcgtagaagatactgattcaagtagttcttggctagtttctggtcgtggcgaattgcatttgtcgatcttggttgaacaattgcgtcgtgaaggctacgaattacaactctcacggccacaagttatttaccggacggttgatggtgcattaagtgaaccatttgaacaagtggttatcgacactcctgaacaatatactggtacgatcattgattcattgtcacaacgtaaaggtgaaatgcaaaatatggaaagcgaaggcaatggccaaacacgcttgactttcatcgcaccttcacgtggtttgattggttattcttcagaattcctttcacaaaccgctggttacgggatcatgaaccatactttctccaaatatatgccagtgatcaaaaactgggaaccaggtcgtcgtaatggcgcgttggtttcaatcaatgctggtaagacaaccacttatagcctagaaggtatcgaaagccgcggccaattattcttgggtgctgccgttgatatttatgaaggcgaaattgttggtcaaagtaatcgtgaaactgatatttcggttaacgttactaagggtaagaaacagactaacacgcgtgcttctggtaaggatcactctgcagctattgcagtcccacgtaagatgtcacttgaagagtcaattgaattcttaaacgaggatgaatactgtgaagttacacctaagagcattcgtctacgtaaaaagattttgaataccggcgaacgcgaacgtgtttcgaagcggcgcaaaattgctgctaaaaaagcctagattttaaaattaacaagtgaagtgcttcataattgttagacaaatattctaataattgtgaggcactttttgtatggtcaaatataatcccgagttaaaagcacaaattgttggtcaataccttaataatatgagtgtggttgaacttgctcagaagtaccgggtacctgaacgtcagattcggtattggattcagaggtatcgcttaggtggtgttgaaacgctaaagcgaaaggcaaataagcgaaagttttctactgatttcaaactaagtgtgatagactactaccaaactcatgatgagtctttagctgatgtcgccacaaagtatgatattctagcctgccaaattagcgtttggcgaactggatttaatcgtgacggtgttgaagctttacggtctcatcaaaaaggtaggccagtcaaagtgaaacagaagaagaagctaacatcatctccagaaaaacaaagcgaagttgaacgacttcgtgcggaactcatgcaaaaaaataaagagttatacgagacaagattggagaatgatattttaaaaaaatcaatggctctgttcggatcttcaaaggacgacgcaaaacacaaatagttgatcagatcagagctgaccaagctaagctttcaaagcctgaacgttataaaatcggagatatccttaaggccattggccttaagaaagcgacttatcatgatgagcgtaaacgaattagtaatcgtaatgacaagtacgcgagtgtgaaagagaaaattattgaaatcacaaatagtgggaaatatcggggacgtttaacttatggttatcgccgggttcagactgaactgatcaaattaaacatccatttagcagataccgttgttcgccatttaatgagtgaattaaacgttcaagtgcgcctatataaccggcataagaacgggaaatattcatcttacaaagggactgtaggtaaaattgcagctaatattttaaaccagaatttcagtaaaactaaaccatatgaggcgtttcataccgacgtgactcaagttcgtttagtaaacaatgaatgggcttatatctctgttatcaccgatgaagcaagtaaagaagttcttgcatttcaaattaacgatagtccaaatcggcaattaattatgagtcgcgcgttttataatcaagttagccaaatacttttagctaattgataaaataaaaaacacccagacaaatctctgttatcattgatgttcctacacaaacaatgaaagaggttattgtcttgatgcaagaacagaataccacagtcagaaaaaaaggtcagcacctaacttcgtttgaacgaggcagaattgctacgctgcacagccaaggctat

SEQ ID NO: 616 - DNA, 1348 bp, Unknown
  Metagenome-assembled genome
ccacccagttttgttttgattctcgtgaaattataatattgaatccagttcgctacggcttgggttaattccgccaaggtatcgaactgtttttgatcataaacttctgcttttagaatgtgaaaaaaactttccatagccgcattatctaagcaggttgctttgcgtgacatactctggaaaagatgttgttgctttaaaatacggacccaacgtggattttgatattgaaagccttggtcagagtggaccgttgtccgataacctagttgtttgggaatcaggttgatcgctgttgttaaaacatcggtggtgaacgccacagttgggtttaaagcaatatcatggctcaggacttcaccggaaaatagatcataaacacacgtaaagtaagcccgttcttcaatcgttttattgccccaacgaagctcagtaatatcagtcgttaacttttgatacggtcgattggtcataaagcgtcgtttaagtcgattcttagcgacagctccaaccgttcctttgtaagagttatacttacgggtttgcttattatatgccgttgataacaggtttagttcacgcattaagcgcaagactttcttatgattgaccaccagccccatttcacgcaattggccagtgacctggcggtaaccggccgcagtcgcgttagctttaatgtctgtaatggtttgtttaaggatcgcatccggatcgttttcagttgggatagactttatcgcatagctataggtgctcttggccatgccaacgactttaaggatcttaccgagccgataattaggccttagttcttggatgatttgtgctcgttgtctacttgtgattgagccaaggcctttaatttttttaggtattcattctcgatctttagtaattcgttttcgtcacgtaagcgggttaattcatctggttgtttcgttttcttgctttgtttatcagctgacataatttttgaccgtcctcggttacgaaacaaggcatcaaggccttcatcttcaaacgttcgttgccattgccaaatagttgacggcgcggaaatatcaaaattaagggcggtttcagttatggatgcctgattcgttttcatccagtttaaaacagtcaccttaaaattgccatcataaactttctctggtcggcgaacctcaagcccactaacgccgaaacgctggtattgccggacccatttattaacggtcgcatgacttttgatctggtactttctagcgatcaagataaaacctaatgaggacgtcagatagtcttgaacaacatgtagtttaaactgcttggtatatttggtcatagtaaaacccccggtatt

SEQ ID NO: 617 - DNA, 58519 bp, Unknown
  Metagenome-assembled genome
tgcatcaagacaataacctctttcattgtttgtgtaggaacatcaatgataacagagatttgtcttggtgttttttattttatcaattagctaaaagtatttggctaacttgattataaaacgcgcggcataataaaaactccttttctactataaaataaaatacgtagaaaagaagtgatattttttatacattccatcccgccaaaagtttacacttgaatttgctaaataactaccagaaatagataatactttcagttttctaaaaatgaagccttgattttataggctttgtctgctcatttcagaaaatacaaaaactagttgacttactttttgtaagctgatatactattttacatcaactaaccaaaaggagtgtcacgcacacatgaaaacaactgtagtcgatttattgaaaaaccgccgttcaatctatgctttaggtaaaaacgttacggcttcacaagaggaaattgcgagcttagttaaatcagtcgttcgcgaagccccaactgcatttaacggtcaaacgacccgcgcaattatcttatttggcgacaagcacgatcaattatgggatatcgtggttaaacgcttgaagtcagaagtaccaacagaagcagcttatgaaagcactaaagctaaaatcgccagcttcaaagcaggctttggtacgattatgtactttaccgatgaagatatcgtgcgtaatgaagaacaacaattcgaattatatgcagataactttgctgattgggctgaacaagcgcaaggtaacgcacaattagctgtttggacagccttagctgaaaacggtattggcgctagcttacagcattacaacccaatcattgatgaattagtacatgatgcatttgatattcctagcaactggcgcttacgggcacaaatgccatttggttcgatcgaagcagccgctggtgaaaaagaatatatggacgacgaatcacgtttccgtgtgcttaaataataatattttcatcaaatagccgaatcagacttgattcgactatttttttgtgtttaattggttaaagagtgcttgctgggctaaattatgcggcccacgatgctgatgatcggcttcccaaacgtggagtactaacggaaaggtctgttctagttgtaagatttgatcaacctcagcctgaaaatgtttggcgtagcctttttctaggctagaatgaactagtttactgtcggtacgtaattcaagtatttccgtggttagatgtcgttcatgcagggcctgcagaccaaaaataaccgcagcaaattcggcatgatggttatccatttcgggtaaaactttttttaattgtaatcgctggtgatcataggtgatcaatgcaccagccgcgctgggaccgggtgaacctttagtggccgcgtcagtggcgagaataatcattagtgggctcctttcattactgtgtaactacgctccttaagagtgccgcaagaatagccgtaacatcaaaaagttattagcgtacttagctaataaacaactttaataatgaagtagagaggtgccaaaatgcaacgttctttttattatcaacctgatttatattctagcattattttttggtcatggacttttgtgattttatttattagtgggacgggttggttagagatcactacgattcaatggtttacgattgcaacgtttattttatttttaattgtcgcagcgttaggtatttttcggcgtcgtttaacgctagatgctgctaacgctagtttgactttgcgtcgtttttggccgaaacaagcacgtgagatcaaatttagtgagctacagcatgtggtggttttaccgcacggtgtacgcttcgagttaacgcgcttaccttatatcacaatcttaatgactaaacagcagaaacaacagctaattgccacattaagtgaactacgtgccgccgcggcttcacgttagtcgaaaaacacggtatactagtgctatcgcatttagtgttctgcggtaagctgtgatcaaaaattaacctaaggggtgttctacttgtctgatattgaaattgcacaacaaaatgagcaaagcgagatcaagccgattcaaacgattgccaaacaaattggtttagatcaacatgatattgagcagtatggtgaatataaagcgaaagtcaaattgactgcgttagatcaacggtcgttgcctaaagaccacaagttgatcttagtaacgtcaattaatcccaccccagctggtgaaggcaaatcaacggtcacaattggccttggtgacgctatgaatcggctcaataagcagacaatcattgcactacgcgaaccgtcactaggcccagtgatggggatcaaaggtggcgctaccggtggtggctatgcacaagtcgtaccaatggaagacatcaatctacactttactggcgatatgcatgctttaactagtgctaacaatactttagccgccttgatcgataatcacattcagcaaggcaacgaactacatatcgatcagcgccggatcacctggaaacgggcactagatattaatgatcgagcgctacggaacgttgtgattggtcttggtgggccattccaaggcgtgccacgcgaagacggctttaatattactgttgctagtgaattaatggcaattttatgtttagccactagtattaccgacttaaaagcacgaattgcgcggatcgtaattggttatacggatcaaaaacaaccagtcacggtggctgatcttaaagttcaaggcgccatcaccatgttattaaaggacgcactaaagcctaatttggtacaaacgttagaacacaccccaacctttgttcatggtgggccatttgctaatattgcccacggttgtaatagtgttttagcaacgaccgcggctttgaaattagctgattatacgattactgaagctggttttggagctgatctaggtgcggagaagttcttggatatcaaagtcccacaattaggcaagcatcccgatgccattgtattggtcgcaacgattcgtgcattaaaatacaatggtggcgtcgctttagctgatctacaaactgaaaacgttgcagctttaacggcgggctttgtcaatttgaaacggcacatcaaaaatatgcagcagtacggcttaccggtaaccgtcgccatcaatcattttgtttctgatacggctgccgaagtgaccgctttacaagaactgtgcgctgaactaggtgttaaggcaattgatactgaagtttgggccaatggtggtgccggcggtattgatttggctaatgcggtattggcttcattagcgcaaccagctacgtttaaccctctatacgacaatcaagcatcgatcactgaaaaagtaacgacgatcgtccaaaaaatttacggtggtgacgcggttgaattttcaaccaaggctcagcgacaaatgcagactttcatcactaatggttgggataagttaccgatctgtatggccaaaacacaatactcatttagcgacgagcctaaacagttaggtgctccaactggctttaagatccatattcgtgagtttgttcctgatttaggcgctggcttcttagtggctttgacggggaatgttttgacgatgccgggcttaccgaaaaaaccagccgctttaaatatggatattgctgaagatggtacgatcactggcttgttctaatggcgactattttacctgccgatttactgacacgtggttggcaaactgttcacggtaacgtggaaggtctagtgcctggtaatggtagtcttacaccgcgatttattttagtgggcgaagccccaggagaaaccgaagttacttcgcataaaccatttaccggtcgtgctggtattgaattagataaatctttggctacattaggtgtgactcgtgccgaggtttttattaccagtgcttatcgtagtcgaccatttaagctcgtcactaaaacttctaaacgcactggcgaaacgtatcaaaaaaaggataaccgcccaccaaccaaacaggaaatgatcagtcaagcgtttctattggattatgaattagcgcatttaccaaccgatttaattttgaccattggtaacactggcttacaacgactgttgggtaatgactatcgcgttggttcagttcacgggcaattatttactgggccagtcaggcgttatgattacgaccaaaaaaagtttgtgccgacgcaacgaagttatcgcattatgccaacttttcatccagctgcggttttctataatcgtcaattacaagtcgatttagcagcggacttagcgcaatttaaacaacttttgtagaaagtaggaccgcttttgctttatttaattctgttagtggtgatcgtgggttgcgatcaattactaaaatactggatcacgaccaatctcgcgttacaacaagtccaaacgttgattcctaatttattttcgctgacttatttgcgtaatgatggtgcagcctggagcattcttcaaggtaagcaattattttttatgcttttaacgccgatcgtcattttggtgttaggttacttgcttcttaaagctcggcggcaacaccgcatttacgcattaggcttaacgttcatgattgcaggtgcactaggtaattttatcgatcggttacgcttgggctatgtcgttgacatgtttcaattggattttatcaacttcccaatttttaatcttgcggatagtgctttaactgttggtgttattttagtgtttgtttatttgatatttttcgcagatgagaaagggcaagtatgcaagaagaaaatttaacgttgactgtaactactgaaagtggtcgcttagataaagtgatcagcagtcattttgaagaattatcacgggcgcaggttcaacaactgatcaaaaccgagcatgttcaagtcaatgggcagctagaaaaagcaaaatacgcggtggcggccggtgatcaaattaccgtcagcataccagcccctgccgctctagatgtgcaaccacagaacattcccttagatattgtctatgaagatgatgatgtcttagttgttaataaaccccaaggtatggtcgttcatccggcaccagggcatccccaagatacgttggtcaatgcgttgttgtatcacagcccgctgtccacgatcaacggagtgattcggccgggtatcgttcatcgaatcgacaaagatacttctggtttactgatggtggctaaaaatgatcaagcacatatcagtttagccgcgcaattacaggcaaaaacgtcgcagcgtgaatatttagcgctggtgcatggggtgattaaagaagataaaggtaccattgatgccccaattgcccgtgctaaaaatgatcggaagaaacaagccgttgttgctggcggtaaacatgcggtgacacattttgaagtgttagaacgctttaatgaatatacgctgatcaaatgtattttggaaactggccgcacacaccagattcgcgtgcatatgaagtatattgggcatccagttgctggtgatccgctttatgggcccaaaaaaacattaaaaggacatggtcagtttttgcacgcagcattgttagggttcaagcatccacgaacgggtgaacagatgacctttacaacaccattaccgccgatttttgaacaaaccttagcaactttgcgaaaacaggttgacagatagtaataatttaagtatgcttacattaatgaaaaacaaatacggaatcctttaaagttagtcccgtgaggctagtaaggtgatcttttaaattagggaaagtctaacctagtttagtaaatcctcttgccgccgcgggcaaggggatttttttatgcagaaaggtggaacctagcatggataaagaagtcgttgacagtgtgacgatgaagcgtgccctaacacgaatcacgtacgaaatcattgaacagagtaaaggcactgacgatttagttttagttggtattaagacgcggggaatctatttggctcgacgaatcgctgaacggatgaaacaattagaaggcttgacggtacctgtcggggagctcgatattacgttatatcgcgacgatctgcatgaaccaggcaaggaagaaccaaccttaaatggttctgatatccccgtgtccattgaagatcaacatgttatcctgatcgatgatgttttattcactggccggacggttcgtgccgctatggacgctttgatgaactttggtcggccaaagaagatctcattagccgtcctagtcgatcgtggtcatcgtgaattaccgattcgggctgactttgtgggtaaaaacattccgacttcattacacgaacaaatcaaagttgcggtggaagaaattgaccaacgcgacagtatctttattcaaaaattggatcaaccaaaaacgatttaattgtctccagagagagcaaaatggtttagtgggtcactttgtatacccataaaacgcgcattttgcttgctgacagctaagtaaatcatgcgcgtttttttacagccatttatcagcgctgccgcagataaaaacttccacatttgtggaacagggggttacatcatgcaagaacaaaagaaaaaaagtaatgcaattttagatatcggcgatcgaccagcaccgctacaatggtttggcttatcactgcaacatttattcgccatgttcggctcgaccgttttagtcccgattctagtcggtttaaatcctgggatcgccattctcagttcggggatcggcacgatcatctatattttaatgactaaaggtaagattccggcgtacttaggctcaagttttgccttcattgtcgccatgcaggctttaatgaaaacgcaaggctatccggctatcgcccaaggcagtatcgccgtcggggtcgtttacctgatcgttgcgttgatcatcagtcgcatcggttccgcttggatcgataaagtgttaccgccgatcgtcgttggtccagtggtcatggtaatcgggctctctctagctgggagtgccgctaatgacgcgatgatgaacaacagccattatgatatcaaattcttcattgtcgcattgatcactttaggcttgaccgtgttcctcaatatgtttctcaaaggttttttcagcctgatcccgatcttgttagggatcgtcggcgggtatctagtagccgtgttctttggcttagtcaactttgcgccagtaatgcatgctgcttggattgctttgcctgcatttgaagtaccatttgtcaattaccaaccaggcttttactggggcgcgatccttggtatggcaccgatcgcctttgttacgatgactgagcatatggggcacatcatggttttggatcaattaactggccgtgacttcttcaaggatcctggcttacaccggacactttctggtgacgggttagcttcgatcgttgctggttttatcggcggtcccccagttacgagttacggtgaaaacattggtgttcttgccattactaaagttcacagtgtctttgttctagttggtgcggccatcttagctgtcgtcttcggctttgtcggtaaactgagtgctttgatcatgagtatcccgagcccagtgatcggcggcattagtttcctactttttggggtcattgccgctaatggcttacggatcttgatcgaacacaaaatcgatttcgacgaaaagcgcaatttaatgatcgccgccacgattttagtcatcggtatcggtggggcatacttacaactcggacagttccaattaacgggtgtggcgctggctactttactaggcatcttcttaaacttagttttacctaaacaggcacgtaacgaagattagaacggaggaaaatactatgattgcagaacctttaacttgccaaccagctttagtttcaatgcgtgatctggatgtcagaacagttgaagccctaattcatcgggcagaagaatttaaacacgggactgaattagaactaactgaacccgtttatgcggctaatctgttttttgaaaatagcacacggacccatactagttttgaaattgctgagcggcgcttagggctgtcagttgttgatttcaatccacaagccagctcagttagtaaaggtgaaacgttgtatgatacttgtttgacgttagccgcagttggtgttcgtctgctagtgatccgccattcacaagatgcttactaccaagaattgttgcaccaaccagcgctaccagttgctttgatcaacgccggtgacggtagtggagaacatccttcgcagagtttactcgatatgatgactatcagcgaaacttttggtggttttgctggcttaaaggtggccattgtcggtgatctgaaccattcgcgggtcgcacgttcgaatatggaagttttacaaaaattaggcgcacaggtttatttttctggaccagaagcctggtatgataatcaatttgatcagtttgggcagtatttaccaattgatgagttagttgaacaagttgacgttatgatgatgttacgggtacagcacgaacgccacaacaacgattcgacctttgatcaagcggcttaccatcaacaatatggcttgaccttagcgcgggccgcgcgcatgaaaccagaagcaatcatcatgcatcccggcccgatcaatcgcggtgttgaattagccagtgatttagttgagagtccccgctcaaaatttgtcgaacagatgcgtaacggtgttttcatacgtatggcaatgattgaaagcgtactgcggggtaaccgtctagggggactagcctaaaatggattatttattgaaaaatggccgtttgttgatcaatgatcacttacaaatatgcgatttgttgatcacagacggtaaaattgcggcactaggtaatgatttaaccgcggcagcagcaacgacgctcgatttacagggcaattttgttagtccaggtttagttgatttacacgttcatttacgtgatcctggacaaacttataaggaaacgatcagaacgggtagcctagccgctgcgcacggtggctttacctttattggggcaatgcccaatgtcacaccagtgcccgacaatgtgcaacaagtgcaaaccatggttcagcgtaaccgtgctgaaggtgtggtccatatcggtcagtacgcgacaatcacaactgagcggactggcggacagttggttgattttccagccttaaaggcggcaggggcatttgctttttccaatgatggttctggcattcaaaatacagctaccatggaacaggctatgcgtgcggctgctaaagtcggtttacctttagcggctcatgtagaagatgacagtcttattcacggaggggtcatgaatgccggcacacgagccgaacaactggggttacctggtattagtaacacggtggagacggcccagctagcacgtgatttagcgctagctcaggctaccggcgttcattatcacgtttgtcatgtctcgactgctgaatctgttcagctgattcgcgacgccaaacaggcaggtgtcaatgtgacttgtgaagtcacaccacaccatttattgttgagtgatcaagatattccagccgacgacggtaactacaaaatgaatccaccattgcgcagtgaacatgatcggcaagcattgatcattggcttattggatggaacaatcgattgtattgcgactgatcatgcaccccatagtgatgcggaaaagcagcagagcatgcggcaagcaccatttggtattattggtagtgaaatggcctttagcctgttgtatactaacttcgttaaaacacgaattttcactttaaaacaactgattaattggctcagtcaaaagccagcacaaatttttcaattggcaactagtggtcaattaagcgtaggacaaccagccgacattgcagtatttgatcttgatcatccttaccagattactgcggccagcttgttgtctaaggggcataatacgccgtttattgacacccaggtttgcggcgaaactgtttatacatttgtcgcgggtcaaattgcttaccagagaggcggaacaaaatgaaacgttacttaatattagaggatggctcggtttttgccggtgaaggctttggcgcaccattgacaaccactggcgaagtggtctttaacactggtatgactggttatcaagaaacgatcactgatcaatcctataatggtcaaattatcacctttacttatccgctgattggtaattatggcattaatcgtgatgattatgaatcgattgcccctacctgtaaaggggtagttgtacgtgaagttgcgcgtcgggccagcaattggcgtaatcaaatgtcattagacgagtttttaaaacgaaaacatattcctggcattagtggtgttgacacgcgacgattaacgcggcggctacgaaccgcaggaaccatgaaggccagtattgtcgatacagttgatgatcatgcttttgaccaattgaatgccttagttatgcctaagaatcaggtgcagcaagtttcaactacgaaaccatatcctagcccggccactggtcgtaacgtcgtggtgatcgattttggattgaagcacagtgtattgcgtgaattatctaagcgtaactgtaacctaacagttttgccgtacaatacaacagccgcagaaattctcgacttagcgccagatggtgttttattaagtaatggccctggtgatccgaaagatgttcccgaagccttagatatgattcggggcattcaaggtaaaattccgctatttggtatttgtttaggtcatcagctatttgccttagctaatggtgcggatacctataaaatgaaatttggtcatcgtggctttaatcatccagttcgtgaaattgccactggacgaattgatttcacttcgcaaaaccatggctataccgttgatccagccacggtcgaacaagcaaatctcttggtcacgcacatggagatcaatgatcagacgatcgaggggttacgtcatcgtaactatccagccttctccgttcaattccatcctgatgcaacgccagggccacacgacgcaacacatttattcgatgaatttatggaaatgatcgatgcatttgctaaacgtgcttagagcaggttgaaaagtagcttttccgacgctgtttatcctaaatagcttaagttaggataaacaaacgcgcagattagattaaaggggagtcagtacattgcctaaacgcacagatattcataaaatattggtgatcggttccggaccaatcatcatcggccaagcagcggaattcgattattccggcacgcaggcttgtttagctttaaaagaagaaggctaccaggttgttttagtcaattccaatccagcaacgatcatgactgatacagaaattgctgatcaagtttatatcgaaccattaacaattgagtttgtgacccgtatcttacgcaaagaattgcctgacgcaattttgccaacgctggggggacaacaaggattaaacatggcaatggagttgtctacagccggaattttagaagaattaaatattcaactgttaggcacgaaacttaatgccatagatcaagctgaagatcgggaattgtttaaaaatctgatgcaacagttaaacgaaccaattccagcttcaactagtgtcaacaccgttgcggcggcggttgattttgccaaaaaaatcggctttccagtaattgtccggccggcttttaccatgggtggtactggcggtggtatgtgtgataacgaaaatgaattagttgaaatcgccacaaatgcattgaagttatcaccgatcacccaagctttgatcgaaaaaagtatcgctggttttaaggaaattgaatacgaggtcatgcgtgacgctgctgataatgccttggttgtctgcaatatggaaaatgttgatccagttgggattcatactggtgattcgatcgtcacagcgccagttcaaacactttcagacaaagaaaatcaaatgctacgtgacgcttcattaaaaattattcgcgcgctaaaaatcgaaggtggctgtaacgttcaattagccttggatcctaatagtttccaatactacataattgaagttaatccccgtgtttcgcgttcatcggcgttagcttctaaagcgactggttatccaatcgccaaaattgcttcaaaaattgcggttggtttaacgctagacgagatcatgaatccaattaccgggaccacgtacgcagagtttgaacctactttggactatgttgttaccaaaattccgcgctggccattcgataaatttgccaagggtgagcgtcgtttaggtacgcaaatgaaggcgactggcgaagttatggcaatcggacgtaactttgaagaatcgatcttaaaggctgtgcgctcattagaaattggtacgctacaccttgagttaccagaattagcgcaagttagtgacgctgaattaactgataaattagttcatccccaagatgatcgcttgttctatctcgccgaagcattacggcgtaattatagcttagaagaattaaatgaattgactaagatcgatattttcttcctagataagttattacacatcattgagcttgaacagcaattggcggcgcaaaaaggcgatttgacggttttagagcaggccaaacgtaatggctttactgatgaaaaaattagccagttatggcagttaccggtcgatcaattgcgtaaaatgcggcgtgaggccaatatctggccagtttataaaatggttgacacttgtgctgcagaatttgaatcgcagacaccgtattattacggcacatttgaagaagaaaacgaaagccaagtcacaaagaaaccgtcagtactagttatcggttccggcccgattcgtatcggtcaaggtgttgagtttgattatgctacggtacattcagtcaaggcaattcaaaaagccggttatgaagcgattattatgaacaataatccggaaaccgtctcaactgattttacgatcgcggataaattatattttgagccgctaacatttgaagatgttatgaacgtgattgaattagaacaaccagaaggcgttattgtccagtttggtgggcaaactgctattaatttagcggctcctttagccgctgctggagtgaaaattctagggactagtgtggctgatttgaaccgggcggaagatcgtgatgagtttgatcaagtgatcaaggatttagcgattccgcagcccgttggcgcaaccgcaacgactgaagctgctgcagttactattgcggctcagattggctatcccgttttaattcgaccaagttatgttttaggtggccgagccatggagatcgttgaaaatcaggctgatttagaagtctatatgcgtgatgccgttaaagtttccaacgaccatcccgttttgatcgatcaatatttagttggtaaagaatgtgaagttgatgtaatttctgatggtcagcaagtgctgttacccggtattatggaacacattgaacgtgcaggcgtccactctggggattcgatggctgtttatccgccacagtcgctgtcagcggacgttaaagcgcagatcgttagtgccgcacaaaagttagcggtggctttaaagtgtatcggtatgatgaatatccaatttattattcatcaggaacaggtttatgtgctggaagttaatccgcgtgccagccgcacggtgccatttttgagcaaagtaacgggtattcccatggctcaagtggctacacaagtgattttgggcaccaccttgactgaactaggctaccaagctggcttgtatcccgaggggaaactagtacacgttaaagcgccggtcttctcgttctctaaattagataatgtggatagtttgctaggtccagaaatgaaatcaactggggaagtcatgggtagcgatactaccatggaaaaggccctatacaaggctttcgaagcttgtaaattacatttaccggattttggtacggttctgtttaccattgcggataaagataaagccgaagctgccgatttagctaaacgtttccgtgaaattggttatcgtgtcattgcgactgccgggacggctgattatttcagtgccgctgagatcaagacgagtaccgtggccaaaatcaaagataacgctgaacaaggtattttacagttattaaatagcggtcatgtgcaagttgtgatcaatacaatggatgcagatcgtgatgtggcttccgatggctttcaaattcggcaaacggcaattgaacaaggcattccactgtttacttccttagatacggctaacgcgattctaagagttctagaatcacgtgcctttacaacgttaccactctaatttaaatacaaaggggattgtggccatgcaacaggaaaagttaaaggtgattaagcaacgccaattaactgcggatgtgtttgaactgaccttaaaaggggcgatggctaaggcgacaactacggcaggccagtttgttgatgtgaaaatacctgatgaccggctattgttgcggcgaccatttggaatcgcacaaattgacccggcaacaagtcaattacggttgatctatcgtacagtggggcagggtacaaccgtgcttagtcatatcgctagcggggcacaactggatacgatcggcccattaggtcatggttttccaaccgactttttacaggcgggtcagcgagcattgatcattggtggcggcactggtattccacctttgtatgctctgtcacgtcaattagtaacacaaggggtgactgtgacccacgcaattggctttggacgccgcgagcagattttttatgaaaaagaatttcgcgagcttggtaccgtccattatgcaaccgatgacggttcatatgggtttcacggccacattggtttactgctggatgcagaatttgcgactacagaatttgatgcagtctatgcctgtgggccacgtggcttgttgatggcagtcaataaccgttaccgtacacacccacatgcttatatctctttggaaagccgcatggcttgcggtgtaggtgaatgttacgcctgtgttgtaccggcacaaaatagtaccaaactgtataaggtctgcgacgatgggccagtatttgcaaccggggaggtagaaatttaatgaatcgtttagctgtagaattacccggattaaatttgaaaaatccaatcatgcctgcgagtggttgctttggctttggccagcgctacgccgaattttatgatcttgatcaattaggggcaatcatcgttaaggcggcaaccttacaaccacgtgccggtaatccaaccccacgggtagcagaaacaaccagtggtatgttgaatgcaattggtctacagaacccaggtgttgacgcaattatggctgataagttgccttggctggctgaacgttaccctgaattaccggtgatcgccaatgttgctggttcaacggaaagtgactacgtggaagtttgtcgccaaattagcacagcaccaaacgttaaagccattgaattaaatatttcttgtcctaacgttgcccatggcggattggaatttggtaccgatcctaaatcagcctatgccttaactaaggcttgtaaagcggttagtaaagtcccagtatacgttaagttatcacctaatgtgactgacattcgtgtgattgcgcgtgccgttgaagacgcgggtgctgatggctttactatgatcaatacgctggttggtatgcagatcgatttaaaaacacggcaaccgcttttaggtaatcgcaccggtggtctttctggccccgcaatcaaaccagttgctgtgcgtttgatcaatcaagttcatcagatttcccaattgccgattatcggcatgggtggcgttatgactgcagaagatgttctagaattaatgatggctggtgctagtgctattgccgttgggactgctaattttagcaatccgcaagcttgcccagagattattaaggcgttacctgatgtaatggatcattatcagatcaaaacgctaactgatttgatcacggaaatggcggtgacctcggtatgagtcgacctattattgcgttagattttccggatcaggcggctgttaaaacttttttagctcaatttccacaggaaatgcgtttatacgttaaagtaggtatggagctattctatagtgcagggccagatattgtgcgtttcttagttgctgcgggtcacgatgttttcttggatctcaagttacatgacatcccccatacagttgaacagagtatgagggtgctggctggtcttggtgtgcgtttaaccaatgttcatgctgccggtggagtggctatgatgcaggcagcacaagcggggctaatcgcgggtacaccggccggtaaattaccgccgcaattgattgccgtgacgcagctcacttcaactagtgaacagcaaatgcagcaagaacaattagtcaatacctcactgattaatagtgtgacacatttagcccagctgactcaacaggctggattagctggggtggtttgttccgctctagaagcgcaacaaatcaagcaggcgacgagtcctgattttctctgcatcacaccaggaatccgtttggcaactaatcgaaccgatgatcagcaacgagttgttaccccgacagcggcagcaacttatggcagtgatcgtctggtagtcggccgaccgattacgcaagcagcggatccagttagcgcttatcggcagatcaaacaactttgggaggcagctcatgaccaacaataatcaagatatggcaaccagaatcgcaactgacttactcgccatcaaagcggtaacactgcgaccagaacagccctttacctgggccagcggcatcaaaagtcctatttatacagataatcgcttgacgatcagttatcctgcagtccgcgaacatattgcaattggcttagctgaattgatcaaacaacattttccagcggttgaagtgatcgctggtacagcgactgccgggatcccgcatgcagcttgggttgccgctaaacttgagttaccaatgatctatgtacgctctaaaccaaaggatcatggtcaaggacgccaaattgaaggtcaattagccgctggtgcgaaggtagttgtgatcgatgatctgatctcaactggcggcagtgttctaaaagcggtgactgctgcacagaacgagggggcaacagtattaggtgtttgtggcatcttcagctatgaattagctgctagtacaacgaattttgcgcaagctggtattcctttttataccttaactaattatacggcgctagttgaaacggcgattgattcaggttcgatcgatgctaaaaatcgtgagttgctacatcaatggcgacgtgatccagaacattggggtaaataaaaagagtggaaatctgttgagatttccaccctttttatggttgttgacttaatttttgtacgagttgttcatccggtgtgactgtgatcgttttttggccggtatagatcacaaagccaggttttgctccattaggtttatggatctttttaacggcaacggtatcgactggtacagttgccgataaacgtgctttagaataataagccgctagattagccgcttcaaccaaagtttgttcacttggttcagcactggcaataatcacgtgtgatcctgggatatccttagcgtgcaaccaaatatccgttttacgcgctgtttttaacgttaatcggtcgttttgtaagttgtttttacccactaagatctttgtgccatcactggcataaaaagtttctggctgacttaatttaggccgctgctttttttgtttactcttcgtccgtaaataaccttgttggcgtaattcagcttgaatatcttgtaagtctttcggcgcggctaaatcaatttgcgtcaaaataccttgaaagtaatcaatttcttgctgagttgctgcgagttgctcgttaacgtaatggactgagttctttaacttttgatacttagtaaaatacttttgtgcattcttagaaggcgataattgattagaaaggctgatcttgattggcgcttcatcagcgtaaaagttaggcaacgtgacttcagtcatgccgcgttcaactttatgcaagtaagtggtcaaaatttcgcctttgattcgataagtgtccgccttttcggaggccgctaaagtttgttcaagtttgcgatattttttcttatttttctttaactcattttgtaccagccgaataaggtcgccgccttgttgatgtacacgatctaattgcgctttatcacgataaaaatgatccaataactcgcttaagctcgcgtaggttgtgcgcgtgccatgctgacttataaatgcgcagggggagaactgtaactgtttcttagtcggatcatgagtaatcgttggctgaggagcttgatccagcgtctggaaaaagtcgtgccaagtttgatcttgatcagtggcttgtgctaagcgtgtggccagctcaagcgctgtatcaaaaccaaacccctggtaagtctgctgtaaggccttagcttgcgcaaaaatatctggtgttgctggcagcatgcggtacaacggttctgtcgcagtaaatggatcagcttcattttgctgtggtggggcaatgtaggtggccccaggtagcaaaagtcggtagcggttttgatcatgagcgacgtggcgaatcgtatcaatgatccgctgatctgcctgattaactaaaataatgttactatggcgacccatcatctcgataatcaatactaagctctcttgatcaccaatttcatttcgtgcggtaaaggtcaagtgaacgacacgatcattatcgatttgcttgatcgatttaagaattgcgccatccaaatatttccgcaaagtcatggtaaaattagtcggtttttctggattaacaaagggaatttcagtaatttgtaaacgtgcataactcggatgtgctgatagtagcagcggataattatgccgattagcccgaacagtaataatcagttcattgggatatggttgactgatacgacttaagcgtgcaccagtgagtaagggtgacaattcattcaccattgtatgggtaaagacgccatcaaatgacatttaagccacctcgctttcgtaagttctcaatatgtttctaattatacttgttttaggcttcagtgacaaagaagctgaatgaaaatttacttgtaagttacaactagactattgtagaatacaagtaatctagtttttttagattaggacgggctgtaagtgaagttcggcggattcttatatacgaaattagaaggtgagttcgatcgacccaatttttaccacccttaaacaattcgaacaacaacgacaacgttatgagcagcaaattggtcagcaatttggtttaaaccgtgccgatgttcgcttgttaagctttttaaccgatgcacaaccaacgatcactgacctacatcatttaaccgggttagacatttcaacgctcagtcgacagctaactgcattgacacataaaaaattattacaaaaacaaagtgatcaacacgatcgtcgtaagcggacatttattctaaccgagcttggtcgtactcagtttcagcactttcgtcaagctaacgctgagctagaacaagtgattttagccaattggcccgctgatgagcagcaactcctcaaagttttactgaaacggttagttagtagcacccaacgcttagcccccactatggtaggtaagtagtagggtgatagggcgattaaaatttactagtttcagctgtgagttagttgatattatggtatagttatttagataatgaaaacattaaagtaggtgtccaattatgaaaattgctgttgtgacggacagtacagcgtacttaccccagcaattgatcgataaaaataacattacggtggtgccgattcccgtcgttctagatggtcaaacctataatgaaggtgttgacgtcacttctgctgaattctatgaaaaactacggcattcggaaaattttcctagcaccgcacagccttcaatcggtgaaatggtcgctttatacgaacgtttaggcgatcaaggctacgataccgttattagtattcatctagccagtacgatctcaggtttcgtaaacaacttaaaaaatgccgcacaattagttaaaaatacgcacgtaatcccttatgattctcagatcaccgttattttaatgggcgaaatggttttagcagctgctaaaatggctcaaaaaggcaaaacggttgaagaaattcttgcacgtttagacgctttacgcgcaacaactaacgaatacttcattgtcaatgatctgcagaatttagttcgtggcggccgcttatccaatgcatcagcatttcttggcagtatgttgcgaatcaaaccaattctaacgtttgatgatgattctcataaaatcgtggcctttgaaaaaattcgttcattgaagaaagcttatgcacgcgtcgaagaattattcgcgcagaccgtgcaacaaaccgattatccgattcatgcctatgtgattcacgctaacgatgagccagcagcaatcgagtggcgtgatcaattagccgctaagtatccccaagttaaattcgatattagttatttcggtcctgtagttggcgcacatttaggtgaaaaagccattgcaatcggctggatcaaagatgaaattatttaatcaaaaaagacactttttcgagtgtctttttaatttacctaaaaattgcttttagcaaggggagacctaaaaatcagctgaaataaaagtcctgattttaatttaattatcctagtttacataatatatattatacaaagtagtgtctttttaattttatttgatcaaacttgctacttttagcttaaaaaataaacttagttgctttatttcaactaagtttatcgtattacttctattgttgttcaaacgctgcagttaattgtgggacaacttgtttcttacgtgaaaccacgcctggtaaaactaaccgttgctgtgcgttgagtttttgatcaaaggcagcttcaactggtgcaattggatcaccaataactaaagcttccgtatcactattcaagatgttagtaaccatcaagaagaacaaatcatagccattgtcagcatttgctgttttaatcgcagtttcaaaatcagcttggcgtttaaagatatcgttaacgtcaacggtgttgatttgtgcgacccgcacgtttttaccagctaaagtaaatgatttagcatcagcatcgatcaaatcagcggctgatttaccgtcaacgttagtaccagcacgtaattcttccaaaccatacttattagcgtcaacacccgcaatttcagctaattccttgatagccgctttatcttcatcagtcgttgttggtgatttcatcaataacgtatctgaaatgattgctgatagcatcaaaccagctaattgcttcggaatttcaatgttgctttcatgatatagtttagtgatgatcgtgctagtgcaaccaacgggttcagcgcgataatacaatggattagttgtttcaaagttagcgattcgatgatgatcaacgacggcaacaacttgcacctgatcacgatcagcaacactttgctgtgcttcgttatggtcaactaaaataacttctttaacttcgttagccactgtttcaacgacacgtggtgctgtggcgttgaaacagtctaaaacgtacttagtttcgtcattaggcgttcctaaggctacggcctcagtatcggcacctaattcgtttaacagatggctataggccattgcagcaacaattgcatcagtatctggattttgatggccaaaaaccaattgtttattcataaaaaacactccctataaatttgtgaactattcgtctgtttagacaaatttctgggaacacacgaaaaccacatgaacattgtactcatgtggtttttatgctattaaccacggcacgtcccatacccactaagttatattagtagcgtttactactaacaatcgtaattaattatagcacggtggctatatagtgtggcaagttatcttggtaaattcgtggttattcagtttctgttgtggccttaagccgtgaaatataatcttcggccttgatataatcatcaaatgcatccaagaagctagcaattcgtggtatttgatctttatcttgccggaaaacaaatgccaaatcaaagtgaattgccggatcaaatgaagcaacgtatgaatcaatgtctgcctgatgggcctgcacaaatgaatttggtaaagctgtataagtctgcgttgaacgcgcaaaccgcaagatttgattaggtgttgtaaagtgagctacgatattgggcgcatcaactaattgattcttatacgattcattgatcagtgaatttagataataacgttcgggataagtgacccaattattatcgattgtatccttatatttgatcttcttacgtttggctaatttttgattatgatgcaagaataataaatcttcattgaggatcttcttggatttatatggtttccagtttttgatactgtcatcgggtagatacataaccgctaaatcgatctggttggtttctaagcgctcccagatctctttacgtgtcagcatatggaaacttaattcaatctcaggattttccttataataatgaatggcaaaatcttccaaaacgcgatcctcaatggaagctaataaaccaattgaaatcttaccttgagttgcactcgtcgtttgctgaatctcatcagttgcctgatttaataattcataaatttcgtgcgttgtttgtaacattgttcggccggcatcagatagatgtaacttcttacctaccgaataaaataatggtgcttctacactacgttccaactttttaatttgttgggttaaagcaggctgcgtaatgccaagcagttgggcagcttgcgtgtaattcatcgtttccgcgagctgtaaaaaataagtcaacgttttagatgaaaaaatgttttcctgtttggttttcaaaacgtgatcccccttcaatatacttgatgcttatactaataataacctaaagctttacataaagacaattatttcattgtgaaaaatagttaagcggaatctgacgcactgctgataattatacaataatatgcaatcaaaattgtgactataatctgaatttttcattaaaaaaataatagcccccacttccctagctagtttaccagcattaggcggtggacgctactattataaactaaacttactaattatgctctagaataattaggatattgctgataattggtgtaatcagtagtatgcaataacttctcagcatttttgacccgtgcctgggtcggtggttcaatgccatccaatggataatcgattcctaattcttcatacttagaaacgcccattgtatggtatggcaatacttcaactttatcaacgattggtgcgatagttttaatataattaccgatctgaatcaattcagtatcaaaatcagtccgttgtggcactaacacatgacgaatccaaacgtgtttatcatgttctaacatgtaactcaacatatcaaagatattttcattactccagccagtcaaacgcttatgctcacgtggattgatctgcttaatatcaactaatgaaatatcagtataccgcattaattcttcaaatttatcaaaccaaggttgtttccgggtaaacggttggccacaggtatccaaacaagtccgaattcctttagccttagctttcttaaataaatcgatcaagaaatcgatctgaagtaaagcttcaccaccactggtagtaatgccaccctgcttaccccagaatgctctatatcgctcagcgtcagctaatacttgatctgcagtcatttcatcaccaacgccctgattccaagtgtcaggattatggcagaattgacaacgcatccgacaaccctgtaagaaaagtacgtaacgaataccaggtccatcaactgaaccaaatgtttctattgagtgcacgtagccaattggtgtttcgtctgctactgcaactgatgattgttcttgttcaaaaattttcatctcatcaccccatcatttaaatccatcattcactttctagtaaaatacttaaaccgaatttaagtactttactagaaagtggatgaatcataatcaatccatccactttcaaaaatgaaaactattacattgcttcgaagtatgtccgcgaaataacgtcgtcttgttgttccttagttaaatctgcaaagtagacacagtaaccagaaacacgaacggtcaatgttggatacttttcaggatgagcttgtgcatctttcaaggtatcacgattgaagacgttgatattcaaatgcatacctttgttttccatgtacccgtcaaccatgttaactaaagtatcttcttgactactaatatcattacctaaggtccgtggtgttaccccaaaggtattggagataccgtcacgagcatacttataaggaatcttagctgttgataacaaggaagctaaggcaccattttgttctgcaccatatgctgggttagcaccaggtgagaatggttcgccggcttgacgaccattaggtgtagtaccagtgttcttaccataaacaacgttagaagtaatggtcaaaacagaagttgataatttagcaccatgatataaatgatgtttattcatcttgtcaaacaacttcttaactaacatcttagcaatgttatcagcacgatcatcattgttaccataacgtggatagtcatgatcagctttgaagtcaactgcaataccatcttcgtcacgaataactttaacatgaccatacttgattgcagaaagcgaatctgttgcgtgtgataaaccagaaataccagttgcaaaggtgtaatctaagcgtgagttcttcaagcataattgttctgcttcatagtcatacttatcatgcatataatgaatggcatttaaggcattaacataaacgtcagcaacccagtctaattgacgatcaaatttctccataaagtcatcatagtcaatatattcagtagtaattggttcagctgctggtccaacttgaacacggcccatttcatcaacaccaccattgatggcatataaaacggttttagccatattagcacgagcaccaaagaattgaacaccatcagcaattggttgtgcagaaacacagcaagcaatgccgtagtagtcagtaccccattcgttacgcattaatgcatcattttcatattgaatcgttgaactatcaattgaaactcttgtagcataacgtttgaagccgtctggtaagcgcttgtcccataataacgtaatgttaggttctggtgcagcccccatgttttccaatgtcttcaaaacacggaaactagtcttattaacatgatgacggccatccataccaacaccggccattgaaagtgtggcccagataggatcaccagagaacaaatcattgtaatcagttgtccgaatgaagcgaaccatccgtaacttcatgacaaattgatcaattaactcttgtgcatgcttttcatcaagtaagccacgatcaaggtcacgttggataaagatatccaagaatgagtcgatccggccaacagacattgcagcaccgttttgtgttttaacagcggctaaataaccgaagtaaacccactgaacggcttcctgagctgttttggctggttttgaaatatcaaagccgtagctagcagccattttcttcataccttttaaggctttaacttgttcagcgatttgttcacgtaattggataacatcatttgtcatttcgccatcgccaacattatcgtgatcggcgatcttatcttcgatcaaacgatcgataccatatagtgcaacacgtggcaaatcagggataatccggccacggccataagcatcaggaagaccagtaatgatcttgtagtgacgagctttacgcatatcaggtgtgtaaacatcgaatacaccttggttatgtgttttgcgccattcagtaaagatctggtgcatcttcggatcagtcttgaaaccataagcttcgagggcatcttctgccatccggataccaccataaggcatgaatgcacgtttcaaaggtttgtcagtctgtaagccaacaattttttctaaatctttttcaatatagccagggccatgagaagttaaagttgcgggaacgtcattatcagcgtcaagtacaccgccggcttcacgttcttgtttcttcaaagccataactttgttatttaaggttgtggttgcttcagttgggccagctaggaaactttcgtcaccatcgtattgtactaaattttgctggatgaaatcacgaacgtcaattgaatcttgccagtcgccgccgttgaatccttcccaataatctgtggtcgtgtcatttgcttggagctgtttcataattgagtgcctccttaaatgtcaaacattaatgtaacagttttcacaagttagtataacataaatagttcgttatgcaagccctttctctaattttattttaggtttttttatgaatatttcgggaataaatccaattgggacaaccataagaataatcgatgacgtcattatttattttttgctggcataatttatttttttgctctgtttcacttttttatataacagtttgattatatattataacagaaacaaaaaagcaatcgcgaatgcgattgctcaaaattaagattattcagcttgtgcaaattggattttagggtagccaattaccggtgtaccagttttttcagtgtcaagaacaaaggaaccgtttgaataacgatcactgatgggatgttcatccggcgttaagaaaaacgtctgtcgtgtatctgtttgtaccaataattttgcagcggctggtaacgggccagtcatgatctgaacccgatgtggattacgttttaactcgcgcaaaatcagcataccacgacgagcgcggctagtttcagtgatttcctgcacgtccatccgtttcaatgcaccccgttgagtaatgatcgtgacgggagttgctttttcacgtggcactagcactgcattgaccacatgatcgccatccttaagtgccattgacttagttccggcagctttagcaccgatcaccggcacttcactaagtgggtaacgcaaaccataaccagtatagctggccaagaaaacatcatattgcgccacttcatctggttgaatatagatgacatccgttacaaaggcagactcatcttttagccgcatagcttgtgcggcgcgtgatttgtaagtacgaccaggcaaaaattcactaaattctgtctgcttgatataaccatcagttgtggtcagcacaaaccggccaccctgttttaattcactgaaagcaaaagtacgaatgatcgcctcatcggcggctaaaccgatcgtctgtgaaatatgttcaccagtgtccttccaacgagcatcgctgagttcataaactggccgatagatcacgtgacccttgttggtaaacataaacaagtgatttagcgtactcaactgttgttggaagatcaaaaagtcttcgtctttcaagccattatcatcatcggtcgatgagttataagaacgtaaactactgcgtttaagataaccatcgtgactgacagctacaatgacagcctcatcagcaacgaccacctttgtatcaacttttagtgattcgatctctgcttgaatctcactgagacgcttgttgccataatcatgatcgatctggcggagttgtgctttaagtacacggcccaattcttttggttcagctaagatcttttctaacttggcgatctgcttatctaagtcagcctgttctttttgtagagcggtaatatctgtattggttaaccgatacagttgtaacgaaacaattgcttccgcctgcggttcggtaaattggaaagcagcgactaaattgtctttcgcgttctttttatttttactttgccgaatcactttaatcacttgatctaaaatcgatagtgctttgatcaaacctagtacaatatgctgccgggcttgtgccttgtccaaatcaaaatgggtccggcgtgtgatcacgatttgttggtgctctaagtaagccatcaataattgctttaagcctaattgatctggccgctgatggttgattgccaccatattaaagttataagtgacttgaagatcggtattctttaaaagataagtcaaaataccttgcgcattcgcgcccttcttaagctcaaccacaatcgataaaccacggcgatcagattcatcacggacttcagaaataccgtctacttttttcagaatacgaatttcatccatttttttgactagttgcgccttgttaacttcatagggtaactcgctgatcacaatctgttcacgaccaccacgtagggtaactgtttcggtacgtgaacgaacgacgatccgaccacgaccagtttcatacgcttgtttgatcccatcaaggccttggatgatcccgccagttggaaaatcagggcctttaacaaaggtcatcaatttgtccaaagtcgcatcgggatgatccagtaaataaatcaaggcttgaatcacttcaccaagattatgcggtgggatttcagttgcgtaaccagcggagatcccagtcgcaccgttgaccaacaagttagggaaccttgctggtaaaacggtcggttcttcttcggtatcatcaaagttaggtacaaaatcaacggttttcttatcaatatcttgtaacatttcaccagcgatcttgctcagacgtgcttcggtataacgcattgctgctggcggatccccgtccattgaaccattgttaccgtgcatatcgatcaatggtgcccgtaatttccaatcttggctcagacggaccattgcttcatagatactagaatcaccatggggatggaaattacccataacattaccaaccgacttagctgatttacggaaacctttatcataggtattgccatcacgattcattgcgtacaaaatacgccgctgaactggttttaagccatcacggatatccggtaaggcacgttcttgaataatatatttggaatagcgaccaaagcgatcgcccataacttcttctaaagttaattcttgaatgttctgttgattactcatttactcactcactttgctgcttgatcaggtgtgtcagatgccacactgttagcggtatgattagctgtttttgtctctaaaatactgccttcttcagccattgaaaattgaacatgactttcgatccatttacgtcgcggtgcaactttatcgcccatcaaggtagtgacacggcgttccgctagagcggcgtcatcgattcgaactcggatcaaagtccgtgattccggattcattgtcgtttcccataactgatcagcgttcatttcaccaagacctttgtaacgctgtaaactactccctttaccaaaagtcttcatttcagcagctaattcatcatcggtccaagcatagcggatctgcagatttttgccactacctttttgtaggcgatacaacggtggtaaggcaatataaaccttacccgcctcgatcagtggtttcatataacgataaaagaacgtcagtaataagatctgaatatgggcaccatcggtatccgcatcggtcatgataatgatcttatcgtaattactgtcttcaacggaaaattcgggaccaacaccggcaccgatcgtgtagatcatagtgctgatttcttcatttttgagaatatcatccattttcgccttttgggtattaataactttaccccgtaatggcaaaatcgcctgaaatttgcggtcacgcccctgtttagctgagccaccggcagaatccccttcgacgagataaagttcgttacgcttgctattacgcgactgtgcgggggttaatttacccgagagtaaacgctcagttttctttttacgtttgccattacgactttcatcacgtgctttgcgggcagcttgacgggcttcacgcgcttttaaggcctttttgaccatcatttgcgcgaagtcaccgttttctagcagatagtaagccaattgctcaccaatcacattatcaacggcagcacgggcctgtggtgtccctaatttacccttggtttgcccttcaaattgtaagatttcctcgggaatacgaatagaaatgaccgccgacagcccttcacggacatcactaccctcaagatttttatctttttcttttaataaattaactttgcgcgcatagtcattgaacgagcgcgtcaaggcggttttcataccggcttcatggctgccaccatcattggtccgcacattattgacaaaggacaagatattctctgaataaccatcattgtactgaccggcaaactcaacttggataccatctttttcgccagagaaaaacatcgttggtcccaacgtatctttgtcttcgtttaaatagtcgacaaattctttgataccatcctcataatgataaacttcttgtcggccttcaccacgttcatcagtaaaaacaaacttgacatcacgcaacaaaaaggctgactcacggattctttcagctaacacattataattaaagtctatagttgtaaagatcgtagcatctggcttaaatgtaatcgttgttcctgtagcttcccgcgttttacctaacttctttaatgtgcccacgggctgaccaccgttacgaaatgtttcttgaaattttttgccatcacgcacgacggttgccgtcattgactcagataacgcgttaacgacactagaaccgaccccatgtaatccaccagatgttttgtaaccgccttggccaaatttcccaccggcatgtaagacagttaaaataacttcaatagttggaataccagacgcatgcataccagttggcatgccgcgaccaaaatcacggacagtcacactattatctttatggatgatcacatcgatttctttaccgtaaccagctaaagcttcatcgacagcattatcgacaatttcatagactaaatgatgcagtcccttgctatcggtcgagccgatgtacataccaggacgcttacgaaccgcttctaatccttgtaggacttgaatcgaagcgtcattataagccgtttgggtttctttcatcaaacaaaaactcctttacagaactaattcatttattgatcgtgagtggcacaaaaacgctagtcaaagactagccgatcatcagacttttggtagctctagcacctaaaacaaagatcaatgcgagctaaaattgttggttaacgtcgtgatgttgcgcacaagatactatcttaccttatgcgaatccatttgaaaagtcaaagcagaacaaacgttcgttaccctattttaacacatattcaggctcattagtggaggaaatatcccagtagcttgttttagctgttatctagtatggcttgcaggggcaaaacatgctaaaatacagactgtcactagacttgcgcattcattttcatatgaagcctgtttaatttaattggacagttgcgcctgaaataataaatatatttcgcataaaattatccactattagtgggactataggaggcaatattttgaaacttgcattaatgctcgtctgtgcctacctgctggggtcaattccttcaggtttatggctaggtagatatgtttatcataaggatatccggaccttaggtagcggtaatattgggaccaccaatacctttcgtgtcttaggtaaaaaagctggcttgatcgttttattcatggatatgttcaaaggcacattggcagcagcattgccgtatttcttcggtagcttcagccacccgtattatagtccgatattaatcggcttggccgcagttgttggtcatggtttctcaatctttgatcattttcatggtggcaaggcagtggcaactagtgccggtatggtactcgcttataatccactatttttcttgctttgctggctagtattcggtagcctagtctactttacccgaatggtcagtgttgctagcacgttaggaatggtgatcattttcggattatcgtttttcttccacgatccactactcagcagtgttgcctttattctgatgtgttttatcatctacatgcatcgcgataattttaaacggattcgcaacggaactgaaaataaagttccattcgggttcggttatcataagaattcgtccaaataaaaacgaggctcaggcctcgtttttttgttgctaaaatgcacgtcgttgatgagcagtgatcgtaaaactgccagtaaaatcagcaccggctgctaattggttgatccccattttttccgttaattcaccgctagtctctaaattatcggcaattccccaccacggttcgatacaaacaaaattaccagtagtcggataaggtgaccaaatacctgtataaggtgcatcaggaacgctcaccgaaataccttgatgattatgatcatttttcagcgtaaatgtgttcggctgatgtagttcataaatcaaagcgtcaccgctaaataaatcgtgcgacaaatcatgatcagtatcagttgacgctagtgtcttgtgtgcagcatcattgaatggtccgaccaacggaatttgtacccgagatttctttggttcataactgatgtaatagtcttcaaacttattttcatccgttaatggaatgttaaagccgggatgaccaccgacggagaagtataagtcttctttttcagcaggattatgcacgaaataagtgacttcaagttcgttgtcgactaattgataggttactgtaagctcaaacgcaaatggataaatttgccagctttgttcatcatcagtcaattgaaaactgatcgttgtggcttcatgattgactaccttaaagtcacggtcgcgggcaaaaccatgttgccccatatggtaagtcttaccttgataatgatattcgtcattttttaaacgtccgacaaaaggaaaaagaatcggtgcatgacggccccagatctgcggatcggcctgccaaatatattcagtaccagaatctaatgagatcagattggttaactcggcacctttttcggtgaagttcgcctgtaaaaattgatttttgattgaaagtgacatatttgccctccagctccacaatagtggttgatttttgtatcaaagcttcagatattccagctattagctggatccacccaatagcgatgcctaacaagttaaataacagctactacagaatatagcggctaagatctttattcgccacgatatcaccaattttatcgttaacgtatttttcagtgatcgtaatgtcgcccatttccatgtcgggaccttcatagagaatatcttccaataacttctctaaaatcgtgtgtaaacgccgtgcaccaatgttttcagtttcatgattgacatcataagcgatctccgcgattcgttcgattgcttctttggtgaaagtggtatgaatgttatcagtagcgatcattgccatatattgcttgatcaaagcgttatttggttcagtcaaaatacggacgaagtcttccttggataaatcatctagttcgacccggatcggtaaacgaccttgtaattcagcaatcaaatcactcggtttgctgtcagcaaaagcgccagaagcaatgaataggatatggtcagtattgatcgtaccatatttagttgtaattgcagacccttcaacgattggtaaaatatcgcgttgaaccccttcacgagaaacttcgccgctgtttttttggccatttgccgtgatcttgtcaatttcgtcgatgaaaatgatgccggtattttcggcacgttggatcgcgtcatgataaatatcagcgtcgttgacgagcttttcggcttcttccttgatcaaaacttcgcgagcttccttaacagaaacggtccgtttgatcttacgttttggtgttaacgcacctaaggtctcaccaagatcgatacccatttggcccatcatattattattcatggctacggcttgcttaggatcatccatttcgatggtcacttcttcattttctaaaagaccacggtctagctgttctttgaccgatagccgttgatcacggactgtatccgttacttcttctttctcttcattgttttgcaatgggttttggccattttgcatggcagtgaaagcattcatcaagctttgtatctggttttgttgtgtgggttgttttttgacgccaggaaccaataattttactaaacgtttgtcagcttcacgactagcttcagcatgaacatttttatattgaattttacgttccatttcgatagcaacatccactagatcacggaccatcgattcaacatcacgaccgacgtagcccacttcagtaaatttagtcgcttcgaccttcacaaatggtgccgaaacaatttttgctagccgacgggcaatttcagttttaccgaccccagtcgggccgatcattaacatgtttttcggggtgatctcttcttgcatatcttgagcaagttgcatccgccgataacgattacgtaaagcaacggcaatcgctcgtttagcgtcatgttgaccgatgacatattcgtctaaagcggccacgatttgttttggtgttttttcagctggttgcataggtaaactccttatctctactccacaatagtggttattttttgtaccaaaaatttctaatgttacggacgatgaccattcttgtggcaaagaccgtaccgcaagaaacatggctctactccacaatacatgggtattttatactaagctttcgctacggttattttatagatcttcaacaataatattatggttagtgaaaatatcaatgtctccggcgatgctgattgcggcgtgagcaatatcatgtgcactcatgtctttagcattggtagttaaggctttagcggctgctaatgcatagttaccgcctgaaccgattgctaaaacattatcatctggttcgatcacttcgccattaccagaaaccatcaataattgatctttattcatcacgatcaataaagcttccaacttctgcaaagtttgatcagcacgccagtcttgggctaattcaacggctgcacgagataaattaccgctatattcattgagtttcttttcaaaacgctcttctagattaaaggcgtcggcaacactgccagcaaaaccgacaacaacttcatcgttgtagatacgacgcactttttttgcggtacccttcataattactttttcgcccatggtcacctggccgtcaccagccattgccgcatggccattgtgccgtactgcgcagatcgttgttgcttcaaattttatgcctgtcattgatttgcactcctttatcttacttaaaaatattagtttgtcagcaaaagctgtagataaacgtggctaaggtgcacactgatttgaaatcagtacccgttacctttaagattttgctcgtggaaagtatttccgataatcctgttgtaaatgctcggtggtgacgtgtgtgtagatctgtgtggttgagaggctactatgacctaacaattcttgcacagtccgcaagtccgcaccattatttaacaaatgtgtggcaaaagtgtgccgcaacatatggggatgaatatccgaggtcagactacttttcttaatgatctgattcaaaatatattcaacgccggtagccgtcagctgtttgccataatgattaacgaaaacataatcatgttcagcgtgatatttagtcattaatggggtgcggcaatcggttaaatatcgatccagggcctcagccgcaaaatggccaaacggaacgtaacgatctttgttacctttaccatggatcaacatcacgctaaggtcaaaatcaacggcgtctaaagttaaattaacacattcgctgacccggatccctgtggcatataatacctcaagtaacgccgaattacgtaggtctaaaggccgatctccttgggtagcatcaaataacgcttgcatttccttttcgtaaaaaaaacgcggtaaatgtgcattatgccgctttaactgaacggaagtaaatggattgaccgccacaaaactatttttgactaaataattgtaaaacgaacgtaaacttgaaattttacgcgacaccgaattacgactgtattgctgttcatataagtaactcaaataggttcgtacatctaataattttatcgctttaaaagaatcgacgccaccattgttcttgagaaaattaataaaacttaaaatatcttcctgatatgccttactggtttctggactatattgtcgctctacatttaaatactgaataaataaatcgagccaatttaattcaagcaaaaaatccctcccgacttaatgcattcactgtaacacaagtcggaaagaatttaaaaaggaagctatagttgttgcttaaattcagctaaagttgctaaagaacgctcagctaaagtttgattacgcaattgtttatcgcggattttttgcggtaacgccttaacgataccaaagttagcgttcattggttggaaatgcttagcactagtatgggtaatataatgcgccatcgcaccaattgctgtttcttgtgggaaaacgactggtgcctgttcctgcgccaagcgagcagtattgagcccagccactaagccgctagcagcactttcaacataaccctcaacaccagtcatctgaccagcaaagaataaatcagctcgctttttagattggtacgtcggttcaagtaactctggagaacgcataaacgtattacgatgcatgacgccataacgtacgaattcagcgttttctagaccagggatcaagcgaaaaacccgcttttgctcgccccattttaaatgggtctggaagccgacgatattgtacaggcttcctgcagcgttgtcctggcgtagctgaatggcggcataaggttgtttaccggttcgtggatcttctaaaccaactggtttcaacggtccaaacagcatggtttttaacccacgtttcgccatcacttcgattggcatacagccttcaaaaaacttttcatcttcaaagtcatgcatttcagcggtttctgcggtgatcaaggccttatagaaagtttcaaattcttgcttgtccattgggcaattaaggtaggcagcttcacctttatcatagcgtgatttcagataaactttatcaaaatcaatactatttttatcgaggatcggtgcggcggcatcgtaaaagtacaagccatcgctatcgttaagcgcttggatctgcttggccaattctggtgaagtcaacggaccagtagcaacgactgttggtccttcgggaaaggccgttaattcttcattatgcacggtcacattaggcaatgttttgatccgttcggtcactgaagctgaaaaaggttcccgatcgacagctaaagccccaccagctgggacggcattttgatccgccgctgctaagatcactgaattaagttggcgcatttcttcttttaatagaccaaccgcattagtaatttgatttgcccgcaatgaattggtacaaactaattcagcaaattgggctgtgtgatgagcgggtgtcgtttttactggtcgcatttcataaagatcaacatggacaccgcgttgtgctgcttgccaagcggcttcactaccagctaaaccggcaccgatcacattgatatgggggacattttgtgtcatattcgttcctcatttctatttcacattaagtcgcatttgaaaaatacgactacgttatttttaacgctaatttagcgtaaatatttcttcaacgcctgctatttctggacaggttcttcgtaatcgccatttgggcaaacgacttgcttgccacctttgacttttttctcgactaaataatgaccatctttgggacaatcacggccgaccggcttatcccaggtcacaaaatcacagtcagggtagcgactgcaaccatagaagatccgctttttcttagacttacgttcaaccacttgtccttcgtgacattgtggacaaataacgccgatttctttagtaattggcttggtgttgcgacaatcaggaaagcgactgcaggcataaaacttaccgtaacggccgagtttgatcaccattggtgccccacaaatatcacaatcaaaaccagctggttcgtccttgatctggactttttcgatcttagtttctgccgaggtgacttccttttcaaacggttggtaaaactcatcaacgaccttaatccactggcgcttaccagcttcaatgccatcaagatcattttctaatccagcagtaaagtcaatattgacgatatccgggaaaaaatcaacgataatactgttaacgatttcacctaattcggttggttcaaaccgcttagcttctaacttaacgtagtagcgccgttgaatcgtctcaatagttggtgcgtaagtcgatggccgaccaacgccattttcttccagcgttttgatcaaagttgcttcagaaaaacgtgctggtggctgagtaaaatgctgattaggatcatttttaactaacttgaccgtatcgccctcagctaaatcaggcagcatgttgtccttcttgtccgctttacctgaatcataaactttagtaaaaccagcaaacttcatcttggaaccattggctttataagtgaccccattttgctcaatcgtaaccgccattgtatccaaaattgctggtgtcatttggctagccaagaaacgtgaccaaatcagttggtataatttcatctggtctttgttcaaaacaccttcaagactcttcggtgtccgcaaaacagatgatggtcgaattgcttcatgggcgtcctgcgagccttcagggtttttagttttatgaatcttcaaggccgcaaactcttcaccatagttttcatggagaaaatggctggcttcgtgcttggcaacctgcgagatccgggttgagtcagtccgcatataggtaatcaaaccgactgttccttgccgtccaccaaggttgataccttcgtacaattgctgggccaccatcatggttttccgtgtacggaaattcaagcgacgtacagcttcttgctgtaaagaactagtcgtaaacggtgcttgtgggaatcgtttacgttcacgcttagtcactttaacaatatcaaagtcagccttaggatcgatgcgatcaacaacttcctgggccgctttttcattcttcaaagctttctttttaccagcgataccgtaaaaactagcttcaaattttttcgtcccttttttaaattgcgaatcgatcgtccagtattcttctggcttaaaagctttgatttcattttcacgatcaatgatcagtttcaaagcaatcgattgaacgcggccggcactaaggccttttttaactttcttccataataatggcgaaatcgaataaccaacaattcggtccatgatccgccgcgcttgctgggcatcaactaaatccatatcgatactgcgcggtgatttaaaagcattcttaacggcatctttagtgatttcgttaaaggtgactcgatttttaccagctggatcaaggcctaaaatatgggacacgtgccaagcaattgcttcaccttcacgatcgggatcagatgctaggtaaacgtgttccgcctttttagcatatttttttaagtctttaatcacatcacctttaccacgaatggaaatgtaatgtggttcgtaattattttcgaagtcgacccccattttacttttaggtaagtcgcgaatatggccgagactcgccacgactttgtaattgcggccgagatatttttcaatcgtcttggcttttgatggtgattcaacgatcacgaggtttttatacgccatgacaatcccctttcagttcgtttgtttaacgctaacgaatcgtaaaacatcatatgccaagctgaagcggtttgtcaactgaaagtaaatttttccttcatataatagccaattcttcaagtagatcagtggccgaaagtgccggccgcgcaccggtagcaattagctgattacagccgaccgagagtggttgccacaatgcccctggcaccgctaaaacattacgattagcctgtaacgctaaattagcggtaatcaagctaccactgtggtgacgtgcttcagtcacacataatgcttgacacaagccagccagaattcggttccgctcgggaaagtgatgccgctgcggtgaactgcctaatggatattcggttaacactaggccagttgtggcaatacgctgctgcagtgcttgattaactcgtggataataaacatctagacctgtaccaatcactgcaatcgtcgaaccatgagcagctaacgtggttaaatgtgccattcgatcagcccctgcggccaaaccactgatcgtcacgacttgattagcgactaacgccggcataaattggctgagcacacgttgggtataattagtcgcttgccgcgcaccaactaaagctaataccggctgctgcaataggtttaaatcaccttgatagaataatacagccggcgggcgataactttcacgtaaatattcaggataagcagcatcaagccaggtcaaagtattgatctgctgatgctgacgtacagccatagccaattgtgggctcagccaagcttgttgtaagtgttgagtctgtcgtgcatttaagcgtgctagctgacatatttgtgtaacgtctaattgagctgttggacgttgccgtaagtattcagcaatacgcagttcacccacctggccgattccagggcagagatgcagttttagtaaaaaagtttggggtagcataaaaacgctccttcggttgtttactataaaactacgcaaaggaacgctaaattatgctaaatatttttttaccggtgcaaaactacggcgatgaatcggagtgacgccatattttgccagtccagctaagtgcttggctgtaccataaccttcgttatcggcgaaatcatagcctggataggcctgatcataagccaacatcaagtgatcacgtacgactttggccacaatgctagccgccgcaatactgatactatgactatcacctttaaacatactgatcgtcggaatatcggtattcagtttcacagcatcgatcaataaatgatctggcggtacgcttaaaccagcaatggcctgcgacatggtcaacttggtcgcctctaaaatattgactcgatcaattgttgcgacatcactgataccaattgatacactaaccgcttgctccaaaatttggcgatacagcagttgccgtttggtcgccgataattgctttgaatcattgacatcataaaccgcaaaatcatgcggtaaaatcacggccgcggtcacgactggacctgctaacggcccacggccaacttcatcgattccagcgatttgcggataatttggccataaacgatcctcatattgccgtcgcgctaaaaaggccacttttttagcagctaaagcggcctgctttttttcatattgtagcaagcattgttgcacacccttgcgtggatcagtcgccaactgtgccaaatattcagcagttggctcaatgctaagatgctgcttaacttgcgcgatcgattcagtcattggcagccgcctcggtgacttgatccaatgtataacgacctaacttacccttacggcaatccaaaattagccgctcactagcccgttcgtaatcgtctttcaaacctagatcagccgttatcttcaataatagatcagggtcagttagttcaaagtcagcttcggttaaacggtaacgcttctggagccgttcaggaaagtattgcttgaagaacgcaagtgcatacagcgcaacgtcatcagcgtgatacagcgaatccttgattgcgccagttaatgccaattttttgccaaccaacggatcctcaaatttaggccataagatccctggtgtgtctagtaactctaaactcttgccggcctttaaccattgctgcttcttagttaccccaggatgattcccagtaatcgctacattacgcttaaccaagcgatttaggattgtggacttgccgacgttagggatgccaatacagatcgcgcggatcggtttattcttgatccctctagcttgctgccgggcaattttgtctgctaaaatcacctgcgcttgcttttcgatttgttggacattgtgattgtgttgcgaatcgatactgatggccggtagactgtgttgcttaaagtaattgatccacgcagcatttaacgctggatcagccaaatcggccttatttaaaatcatcaaacgcggtttctgctgaatgatttgatcaagaattggattgcgcgaagctaatggtaaacgcgcatcaacaatttctaacacaatatcaactaaatgtaatttttcttggacttgttttttagctttcgccatgtgaccaggataccattgaatagttgccatagtgtatatcccctttcgtagcaaggctttcaagctcttgctctgataaattttcttaatggtaccacttttgtgccatgtgtcccgttgctggtaccatattattagcattttagcggtaatagctgaactttgtttacaccggttgaagactaataccaaccttcctagcgaacgtatcaattacttcaaccgacttttcttgtgaatgtgaaaggcggtgcgtatagccatcagtcgtccgttcttcaacgtgaccgactcgctcttgcacttctttcaacgttacagaggaatcatcacgcaagacggagatatgaatgtgtcggaaactatgtggcactggatttttcgtccatttgaagccatagcgtttttcacaattcttttccaagtctgctttaattctgccaagtacttcacgaaaactatgtgacgtgatcggtgaaccgtactcggtccgaaaaatcacttgaaattcatgaaaagcatcactcggtaattccttcatccgcctatcaaatacggcattacggtgtatcgcacgcttcaatgcagcaatcgcaaaatcaggtaactgctccacccgttcgccagcaaccgttttgacggtatcttcgtagtactcatcaacccgtaagtcatgtgattgcatggaactagaaatcgtaactgtttttttagcaaaatcgatcttatcagatgttaaccctgatgcttcaccaattcggcaacctgttgcaatcataaatagtgccagatcatagtacgccggattgcggcgttgtgccaattcagtgaacaagactttgacctcacgcgaatcaagaaacttactttccaagcgatccttccgctcgattttttcagtcgttgtcgcttttaaatgcagaacggctgtcggtgaagctggaatgatgttatatagcaccgcatggtcgaaaagtttattgaaagttgatttgatgtgttgcatggtggcaaaactagcgctgtatttttcgcgatagtcttgcaaacatttattgactaacataggcgtgatgttttttaccaaaatatcgtctgcaataatttgattcaaccgcctaataacaagcgcctcgcgcttaattgtcattggtttaacagactgtttccacaaatcaaaccaatcttcgcgtaaatctttgaacgtccatttttgaacgcgctcatcaagtgcttgagctcgctgtgaagttagctcttcgatcttttcatcaagttctcgcgccgcttgtgctttacctctttgagaattagacttaaaacttactgaggcccgtttccgtttgccagttaaggggtcaatataattctcgaaagcgcgataagttgaagttccgtcagcgagtactcttttttgaaaatgcataattttatcctccaattcaaattaataaacaggaaagataaaatgagattaaatagctatttcattttaccatgtcccggcggtgttgtcagacgtttcggatgtaatgatgctgtttccaaaacaagaattcttgaaaggtcgcaaagttgatcaatacaattttgtgtgtaggattaataacgccctgacgaaaagtagcgtcattacgcatttccgaaaaccaccgatttaatgtataaatatttagaccctcatagcgtttcaacaatgcttgcttggttccccattccgctttaccggcggagtcgccactatatggtacacttgtattttccattttttcacttcctaatttctagatgaagtgagataataatcgtagatagattgcttattttatctattttaaggtgtaactacttgctttggtcggcgtagttgcatctttttattatctcaatcgccattatgtttgggttgctgaatcattatttcttcgggactagccaacatttgttgaatcatcacttgttgattttcacttaacttggcctcagcaatgatcgtcattagagtatcctcgcttttagccgaatcaattgccattaacatttttaaacttggcgccacttgtttcttgatccattgaatagtttggtctaaagtgaccggttccggcgaaacggccaaacgtaacttatcggcatatttaccaataaactgtgcccaccgatcgtccaacggccattttgacgttggcttgttggcaatcggcttcacaaaacgcaagtaattattgataataccgaacacggttcgctgcgggttgcgataggccaatagatcggcgaccgtttgctcagcccgttcgtcaaacacacgaatctcaaatcgattcttgattttggtctccgccaacgctttacctaatttaaaatattgctcaatatctttctgataaatacaaaaataaattgcacttttacgtgagccaaaatagagactttctccttttaaattgtctttgtcgcggacaaagtatttacactccctgaactttgtaatgtattcatgacgcatactctttttaatcaagtaatgaaccgggagcacatctaaataatcattgatggctagatcaatgcgtttaactacgccatcaagggccagtgcctgccgtaaaaagtcataccagctctgttcactggccactaaaatgccttccagttcgcgacaacctttccccttcaactcaatcaatgaaccgcgattatcgtcttccggtgaaacaaaaatttccatatcgccatgccgaaattttccactgtagccataacggccataaggttcataaacaaaataaatcggcttgatgcagaaaagtgccacgatcaattcgtcaacatcatgggttggaaatctgatccggacatagtcaaaacaaatgtttaatgcggtgatgccactcagtttgcgaaaggctgcggttaatcgttggcgcatggcctcagttaatggtcgcttactgttcaatagttgattgagataagaacgactgatgcccattgacttagctagctgactttgcttaatttttttatcctccaactgttgccaaaaaatattaagccaatcagcttggacctggtaatcaattagagttaaatcttcattcaagtacgctcacctccaaaatttgcaattcttagtcacggttaacagcaactttgttgcttgaatacctagaaattggcatttcttgctgctggattaattaaccgtttatactttctacccccctattagaacttgggggttgaggcggccggctaaagccgaccgccgctcacgctagcggctttcgcgttgcacgccgcgcgtggcggcggctaatcttttttcctcctttattctgttttcaaggaacgattatgatcaatgccagcaaaaatttgtaagaatatttcacttggcttagatcatataaacatgataacgtaggcctttagagctggtcaatcaccttatgccacctactcaaagaccgtgagtagtcgttgtagttgtctactttaagtaactaagttaagataatcatgaggtaatgataatgatcgaaaactttggtcaaaacataaaaagattgcggcaaaaacaccagatcacgcaagaagacttagccattgccatcgaagttcaaaaacaagcaatttcaaatattgaacgcggtaaaagttatcctagttttgaaaacttggaccgaattgccagatttttcaatgtttccgccgtcgacttatttggcacaccggctgaaattgaaatcagtagcactactgctattcttgatcgcattgatgaatatactgacaaaactgagcacctctttcgcttaatgcaccgcatagatgatttttcaccgcgtcaaattgatggtcttagtgatcaagttcatgaaattatgagctattttcaaccctacacaaaaatcaatgaagatggtaccccagagactgataacaatgatcgaccgatcgtccgccaatcaaaatatcggcaattaccaattaaagaaatcaatgccttatacaataaaatcaataccatcaatgcttatcaccaaacgcaaaaaaatcaccttcaaaagaagatgatcaatgaatgataaaaaatatcgactactgcttaattaaaataatagctgcataatatgcctaatagtgtcactttcaagaatgatcatgatgcctaaaccaatataaataatggccatgatccaatcaccaaaacgatcaagaaagttctttacaaaattcacttgtgagaacttatcaccaaggaaaactaaaaaataaatacaaatggtaaaaacaaacagcgttacgattagctgtaccagtgataatgatacgaagtaaggaacaaaaaggccaatattatccgcaccacaagaagctaccgtaattaaagccaccgttgcaattaaattcttatttttacgcgcttcaattttctgatcaacttctgcggcttcatcttctttgctaaatatatatttgattccaaaggcaatgggaatcaaccctaaaaaacctagtaaccatttggcgggtacgtaatggagaataaatgcaaaaaacaaactaattccaatgagcgtatatgagcctaagaactgaccaatataaatttgtcggcgatgctttgttgaacgatattttgaaaaaagtaacattaaaataactaataagtcgattgcagttgatgtataaagaataatactcgttataattgtcctgatcattttattttcccccaccagcattgatttttccggcatcttcagctaaacaccatgcccgttctaataaaattgccgtacattcatcaatgatctgatattcaatgaagttgccattacgcttcgctttaactatcttttgatctactagacgttgtaactggtttgagatggcttggaccttcatatttagtgatgtagcaatctcactaacggccatatctggttcacgcgttaagcaatgtaaaattcttagccgcgtattatttgcgagtactttaaaaagtaaagcaatgtcagcggcttgattctcatttaacaatgcccgatcagccaaatctggtttacccggacaacagtctacttgtatcattagatcactcctcgtttattaatctattacattatatcatgtaatagtgttgtccccaatttaatttgaatcaaaaaatagagtagctcctatagccactctatctgacattaaccactattcatattcactagttaaattaaaactaagatacaggtcttagttttaatttaatctaccagaagatgccaaagtttcgttactatcattttgcgccattttaattctttcaatataaatagccgccaatcattgtcctcagagtaatctggtaatcatataaaaacagatagtagaaagcttaattaataatgaagtgaagttgttccttcagttataaattaattccttagcgtttcgcattctgttgttcccagttctgtgctgcgatttgtactgcatcccaaggtgatccaactggtggtgaataggataagtctaggtcgctaatttcggctactgtcatatcattaaaaattgccgtagcaaaaatatcactgcgtttagcaacttcactaccgtaatgaccaattaactgcacgcctaaaagccggccacttttttgatcaccagtaattctgatcttaattttttgagcaccgggaaaataagccttatggtcatcaacatcagttgttaccgtgaaaggattaaaccctgcctggatagcctcacttgtcaataaccctgtccgtacaacaactaaatcaaatacctttaaaacttgtgtccccaggctacctttaaaggcacgttgaattccagcaatattaaaaccagcaattcttccttgtttatgtgcagtcgtacctaatggcaagtaggtttcacctaataaatgatgtcttgtttccaccaaatcgccggccgcccatatatcaggtaatgaggtctgcatatattgatcaacctcgatggccccggcaattccagtttcagcacctaccttgaccagtagctcattatttggttgaacaccaacaacgattaagactaaatcatacgtagaagattgtgtcttttgatgctcatttaagccaacaatttccacgttgctaccagtttcattaatttctgaaacggttaaaccagtaataacattgacggcattagcagacaacttttgatgaataattcggcctaaatcagcatcaaccgtggaaagtatttctgaacctcgttgaaaaatagtgacgtctaaatgccgttttcttaaagcctccgccatttcgattccgatataaccagacccaacaattgcgaccttccgaacactatctgtagctatatttctttcaatcgcaaagtaatctgccattgtatgcaaaatacgaactttactatcttgctgttgagcttgcgccaggtccacacctttaatacccgatagttttggtctagcccctgttgctacaaccaagtggtcataatgataagtttttaattcgcctgtaagcgcatgtgctacgacttcatgtcgttgcggttcaattttatctgcaatcatgttcatttgaaattcaataccagtcgaagtcaattcttgtaaattacgatgagctagcaagtgccaatccggcacttctccgctgactgcataaggtattccacaaattgataaatttgggtactcatctgctaataatatctgaacttttaattcaggtttaagttctttagcctttaaggccgccgaaattccggcgtcactgccgccgataattaataatttttccgtttcatttgccatttaattaattcctttcaccgttgttagcgaacaaatgcacgacttaaatcctgatgtagataatctgaaaactcttggaaggttggataatctctttgtttaaaaattataccgttaaccatagtaattggtaatacagtgattccatatttttttaataggtcatttatttgatgattacgaacaaaggcgtccggattttgtgtaagatttctgcgtatgattatattttcaccatctgcattaacatgacgttgaattgcggtagtctgaatcaattctttctttacactgggaccacaaacaccagttgcacaacacatcgcctcttcaaatatttcaattttaatcgtctttcacctcgcatattagacgatgaaaatgttcaaattccttttctatttgtgtataatcacgaaaatagctgaccgctagattatttaaaatcaagtgatttatttgcaaaaaggctatttttaccttatacaagttctgttgtattgttaattcactactgtattttaattcaagcaaattaatttcttggttggcttgaatcaggtaaacagcagaaattgattctatttcagctttcgtggcctgtttcactaaagcatcgactatgtttaatctattagctaatgaatcttgttgtgcatactcagtttgcatcatagcaagtcatcctttctcaaccaaaaagacttagcgataaccataaaccacataatgtaataaataggactggaatcgtgatcgtgatcccaattttaaaataagtaccccaagcaatttttacgtttttttgcgccaaaacatgtaaccacactaacgtcgccagcgaaccgattggtgtgatctttggtcctagatcagaaccaataatatttgcataaactaacgtttggtgcattaaccctgatacattagcgcccttgatcgataaagcattgatcattaccgttggcatattattcatcgctgatgacaggaacgctgccaaataacccattcccatggtcgccacaaaccggctaccagttgccattttggcgataacaccagcaagtaatgttgtcaagccaacattttgtaggccataaaccaccacatacattccgattgaaaagaagacgatgttccacggtgctcctttaatgactgccttagtatcaacgtgatgactttgttgaccaaccaacaagaaaattgcggcaatcgtaagtgcaataaacgaaacgggaatgtttagaaaactactgctaaaataaccgatcaataacgccgctaacacgacccaagagaacttaaataatcgttgatctttgattgcagattttggttcagcaacctgatctgcatcataatgtttgggtaaggccttgcggaaatacaaatataagatactgatgctggcgatcagtgaaaaaagatcagggatccacattcttagggcatactcggaaaatgtaatgccgaaaaagtcagcggaaacaatattgactagattactaacaactaatggtaacgaagtcgcatcggcaataaagccactggcaataataaatgggaaaacctttttttcatcaaaatgtagggctcgcaccattgccagaacgatcggcgttaaaatcaatgccgccccatcgttggcaaaaagtgccgccacgatcgcacctaaaataacgatcaaaatgaacatacgtacaccattgcctttagccagtcgtgccatatgtaaagcggcccactcgaaaaagccgatctcatctaaaatcaatgagatcaaaataatggcaacaaacgacaaagtggcgttccaaacgatcccagtaacggtacccacatctttaaatgtgacgacccgaaatagcagtgcaagtactgccccaccaattgcggtccagcctattgatagccccttaggttgccaaatgacgaataataacgtgagtaaaaatataaaaacagcaaaaaagacttgcataattcctcccaactaccaaaatcagggtatcgctaccctgatcaattgatatctttatttaaatcgttaatagcgtttgttcaaaatctggttgccactgttccactgcaaaatgattggccgaaacgtctttgactttttcgatccattcaacttcattttgtgcccgtgcttgtaaacacggatgcgtggtttgtgtagccagcatgctttgattgaccaaccaccatgtatgggcaatttgcgcccggtttaaatcttcattgagccgcattgattcgtagactggcgttgtttccggtaaagtcaccatcacgatctcggtttgttggggatcttgcaaccgtggcaatagatcaataattgcttgtggcacgtcaccggctgtgcgcttaacttcctgtgcatagctttgagtggaatctaatagtaacaacgtgtgcccagttggcgccgtatcgatcaccaccacgtcactgtcgttttgcgccacaatattagcaaaagcgcggaaaaccgcaatttcttgcgtacatggtgaacggagatcttcggcgacataatcaacgtcagccgctttcatggtttggcgagccgttgccagtacttcagcttgataatctttcaatacctgctgctcgtcaatatggctgatcgtaactgccggatcagctgttttaaagaaatctagatgatcggccggatcagtggtggctagatgaacggttttatgttgggccactaatttctgcgtgatctgcaccgcaaccgttgttttaccgacgccccctttgcccatggtaaaaataatctttttatccgtcttgatcagatcagcaacgatcgtatctaagttgggatagttattggtcagcggcggataggtagctaatgcgggttgtgttgcctgtaacaccaggtgtaatttatttaagccggtaacgttgtaggcgcgtaacggcacttcatactgagcaaatttttttaatacagccggcatttgttgtagatcagcctgttgttgcgcaaaaatagcctgcgaagcgtgatccgtcggtgttttaagcgtgccattaatgatcaactgctgattagtcatgccgatcgcggctagttcttgtgctgctcgtgctgcttcaagtaatgaggctttttgtggccgcgtcaccaacattaatgtggtcaagtccccattgcttaacgttgctaccgcttttgcataaattgcttttttatcacccataccggctaattggcctaagcaagaagcaccgcgatcattttcatctaaataattattccacgctgacggtagctgtagcatgcgcaaggcatgaccagttggcgccgtgtcaaaaataatataatcaaagcgctggtcaaccgccggatcagttaaaaagttggcaaattcattgaatgccgcgatctcgaccgtacaggaaccggatagctgttcttccatatttttaacagcagcatccggcaatacgccgcgataagggccaacaacactttcccgatactcaccagctgcggtcacaggatcaaaattggcggcaaacaaccctgatacaccattgattgcttgcggtttattggttaatgctgtattgaaaacatcctgtaaattactagctgggtcagttgaaacgagcatcacttgattaccagcatcagccaaattaatggcggttgcactggccgtcgttgttttaccaacgccacctttaccggtaaaaaacaaataatgagttaaattagcgttttgtggttgatagtcctgcattgatatcctcctcagtcacatagatatttatctatatataattcaaaagaaatggccgcgccatctcttacctttagtaaaatttagcaacagccaccatcaccgccacagcaaccgcctgtttgctcagctggcacgaaaactagcccagtatagtcagataattcatcgatcgttgggtacgcgcccgttttaacgatctggccgtcaaccacggtgatcggtaaaacagcgtcagcatcatccttgatggccgctaaaatatcggctcgttcactaaaaacattaggattattacttaaattgtaacggtcagcttcaatcgttttaacaccttgtaaagcatcaaaggcagacgtgatcattaagagattttgatcaacggacggaccacaaaccccagtcgagcagcacattgctggttcaaataattcaatttttttcatttgtcataacaacctttcctgaagcacattcttcacaatcaacacagccgtcatcgtggcaaatacagtgatcatcacttgataataattgcgccgtatcctgcttaaaggtcagcataaaatcggggcgtaacgtataatgctgccacttaccttccttgcgtgccgcaacaataccagcattttgcaaaactttcatatggtgggataaagtcggctgtgaaaagtcgaagtgctctaaaatatcacaagcacacaaagaaccacaggaaagcagatcaataatttttaagcgatttggatcggccattgctttcagcatttgaacatacttttgatagtccatttgtaagctcctattccataattaaggtaatctattagttaaatacgctaataataaacattgatgttacagtgatacagactgaacttgctacttttggttttggcttaatcaacaacagaaagccaatcctgtttagcagaaaatattcaacaagcagatacttcttgctaatcagtgttgccaaaacgaatgattatgaccgctttcgtggtgattttagggaacttagttgcaaactccgcaactgcatttcctcaactcaacttgcttcgatcaccgcaagaaacatcgtattttgtaaacatagacgcgcatctatatctataatatagacccatatctatgtaagcgtcaagctttattttgaaataaaatagcagcatctattttagatcatactgaataatcacattcttccatgattagttttttaagccgatagattaaccaacttcaaacttggatcgatatttcgttttgaaaataacttattcaaatccataaaaggaagtccatatgtcccggcggcctttttgcggtaccaattttggtaccataatttgataatcattgcttattattgctcaatcggccaaatttctatacaaaattgggagaaaaagatacctaaactttcaaatcaacggcaaacaaaaaagcccgttttatcaggcttttagctacttaaatctcatattatcccgctgcttttttacaatatctagtcattttttatagtgagcttccagtctaccattgaatagttgccatgtcgtgtaactcctttcgtatcaagggtttgaagccctcaaggttataaaaatcgtggaatttgccataaatttaccatatgtaaagggcaaataaggcatgttttattataagatttttattgctacttcgtttacaaattcattaacttggtacaccgattagattaggtgcatataattccacgaatagtataaaatgcaattttgatcagtaaattctattttaccatttgttgataattttaaatagtggtgttatttccaataaaaatttatatcaataaccaaaaacagctgatagactgagttcgtaacttattttctgaatggtctgaccttacatgcccagttaaccagtattgatgaaagacgacttacttaagtactgttactttaataaagcaataacctactattcagtagtttgccacagccaacgtttttattctatatagcctgaactgatttctctagaatttacaagcttttggtaatcatagattcggaacgtaaaattatgaaaattattactaataccacaataaaaatattccaatgaaaattccgcaatacttggaatgattttcactggaatattaaaacaattgaatgataattttatttttaaatgtagctaacagatcaacgtaatggggtttctgctgatatttttggtattagataattcctagccatctctattctttaatcagcaaacaaaaaagcagaaccgcaaattacggtcccactttcgtcatgatctatttacctattacctaattaattccagaatttagccgcaatcttttgcccttggtcaattttagcccactgttgagcttcactcagttcgttacccgaatcgcatgaagcaaaaccacattgatgcgacaggtataactggtccttattcaaaatttgactggcttgcgtcaataaatgcaaagcacggtcttcgtcgtctaaggtgctggttttactggacagtaatccgagcacgacttcgacgttaggccgatcttcgagtgccttcaaagcggtgatatcccctgcacggtcatcgtcccattctaagaagaagcgatcataatgttgatcgtggagaaacttttgcgcaatcgtattgtaactgccttccgcgaagtggcggctttcgtagttaccacggcaattatgggtccatacttttaagcctaatttgtgaccaaaatcagcaatctcattgtttgtgttcacagcaacatcagctaggtcctgtaggctaatattgcgggtactgaatgggctttgcttgttgtcactggcaaaaatttcccacaaacaatcatcaaattgaatgatctcgccgccagcagctttgtattcagtgagaaattctttgtaagcacctaacaaaccatcgtgtagttcagcaaccgttttataaacttggtcagggccgtaaagcttatcgatgtaaccaaattcaacaaaggcatgtgcagcgctccaaacggttaatttcacgtcattgtcaccggcttgtgctttaagctgtcggtaaatatcaagaaaatgatgattcttaccggaaagtagcgctgtgatctcgatgccaatatctttacgcgtttggaaatcactaccgtcatgatcgcggaaattatagccactgtcagcgatgaaccggcgaataccactaaaaccccaaataaaatctaaatgccacattgatttcgtgtattcaccatcggttaatacatcgatgccgtgtgctttttccttggcaatcacgtccttcaccgctgcagcttcagcggcttgatagccaggaaaagcgtcataaaacggatattgaatatcatcacgatgttcgattttatttttatagtctagcaagctagctggacgaagtaaggaaccgactaattgaaagtgtgtttttgtcataaatataaagcctccgttattaattgatgagattagtataacagtctgctgagaaaatagataagactgattactttgatgatataataggttttacctataaccgaaagcacactattgtaatatttgtgatcagcaataatcttaaggagcttattaacagtatgcgtattcaacaattaaagtatttggaaaagattgcgacgacaggatcaatcaatgaagcagcgaaacagctgtttattagtcagccatcattatcacaagcgatgaaagaattagaaaaagagtaccagattcaactattttatcgcaataagaccggtattaccttaaccgatgcggggcgtgaatttatcaactattcgcgtagtgtattggatcaagttaatttactcaatgaacattttggacaaggaacagtccgtaaacgaatttttagtgtatccgcgcaacattacgcctttgtggttcacgcttttgtcgaattagttaaagaaatcggtgcggatacgtatcaatttacactgcgggaaacggaaaccgaaaacgtactcaatgatgtccaaacattgaaaagtgaacttggtgtgatttacctaaacaagtttaaccgcaccgtacttaaacgcttgattgcggaaaaagatttaagctttgtgccattatttgaagctcgtcctcacgtgttcatcggtcgtgacaatccattgacgcaaaaaaagacacttactctggctgatctacaggactatccttatttatcctacgaacaaggtgacaccagctccttctattttgccgaagaaattctcagcacgttacctcataaaaagcatattcggatcagtgatcgggccacgatttttaatttgatggtcggtttaaacggctacaccattagttcaggtattattagtagcgagctaaatgatgaaaaaattatcgctattccgctggcagttgatgatgccatgaccttaggctacttacgccacaaaaaaatcgagctgagtacaaccgcacaacgctatttagccttattgaagcagcatattcgcggctatgggtttgaagtatttaatgaaaaataagtggttaagtgccgtcatcaattagcagtgatcatccgaatgactaggctaaaaattaaacgcttttaacacattaacgttttattcttccacgccaaaaaaatcctgttaaagacttattatttaagccgttaacaggatttttgtactatcagctaaaggttgaaagtatcaaaatagaccgtaaccattgatgtcaaacggttatggcacggtatattactagtttccacttcattgagcattaccgagtagcctggccaggctattcggtaatgcttttataaattcgtcaaaaataatagttaatgtttcaaccgccatgtcgagtttttcacctagaccagtaattgtttgtatcagccaattcaacgcacttactaacttaatatcag

SEQ ID NO: 618 - DNA, 4374 bp, Unknown
  Metagenome-assembled genome
caagtattcgatcgatgttcaaggcagagtatccatgcgcaaacgccatgccttctcagagtcataataaagcggtggtcaatgcctatcatagttaagtaagattatggctgttctgcttgggtcggcaagaaatgcttacttaggcagaactgccgctactgatctcttgtccatgacaagtgatctaaatctccgctaaaggtgatctattcggccgtgcaaagtgatcttctcaagcggaatatacaaagatctgtgccgatgcctggagtaggatatcggcagggctggattgcttctgcgagctcgtctagaaaaagtacgacagctcagacgatgacgcctcgctttccctgaggtctgcaggctcatctcgaatatcaaggcatatgtcgagggaacgttccacagccttccgaaggcccatatacaagtcgtatgccgactcgttcagctaaagatacagccacagggattctttcgatgcttagtgtcgatctcctcgacgggatgtgccttatgcacatcccgctcgcaggcatcgcaaccacatccacggtgcagccaaagttgtctaagcagcttacagttcatggagcctaactgtgccgcaagtccttagtcattttctagataagtggtggggatttcggtaccaaagctcaacaacttctgataccagtaataggagtcttttaacgtccttgtgtaactaccattaccgttatcatccaaatccacatagattaagccatagcgctttgacatttgtgtcgttgacgccgaaaccatatctgttgacccccacatcagatagcccattaagtcaatgccatcattttggagggaaagaagcatttgcttaatatgctgacgcaaataatctatccgatattgatcatgaacgtaattatttgaagttaaggcatctttagcacccaaaccattttctacaataaacagtggcttttgataacgatcaaatagattaatcaagataattcgtagaccgactggatcaatctgccagccccattcactttcaggtaaatatttattgtaaacacctgtcgtacggttagctttagtaattttcaatcctgtcgtatcatatgctgtgcagactgatgagtagtaggaaaatgcaacaaagtcagctgtattagcttcaagcaaagctttatcttcttgagtgatcgggatgtccacacctatttttttcatatgatccaataaaactttaggataagcacctcgaacttgaatatcactaaaattatagttttcacgcatagtctcagtggctttaaacatatttcgagggtcgctattgtaagggtagaccatcgtactagtaatcatgctaccaactttagcttcaggataattcttatgaatgtaagcagtaatcttagctgaagcaataaattggttatgcattgcctgataaattacttgcgtaaaattttgatcaggaaaacgatcttctactaatcctgctgacgagaaggggtgccgaacaatgctgtcgatttcattgatcggaatccaatatttaactaaattatgataacgatcaataactgttttagaaaatttaacgaagtagtctgccaccttcttgtcgaaccatgcatcatacttcaacacgagatttaaaggcatttcataatgcgataaagttacgataggttgaatgccataatctttcattgtcttaaacaatgaatcgtagtattctaaccccttttgattaggttcagaatcatccccattcggataaattctggtccaagcgatagaaattctaaaggcattgatgtgtgctttagctagtaactttaagtcggaggggtagcgatggtaaaaatctacgccgtgacgcttgccccattttttagtagaatgatccttgatagcctgatttaattctgtagtcgacatgctattgactcttttataatcattcaagtcttgatgcggattgtatctctcacaatcagcaatcgacatgcctttaccatcctcattccaggcaccttcgacctgattagcagaagtagcaacaccccacataaaatcttgcggcactgtataacatttcatattagcacctacgctaagaccataacattatcgccggctttaactgatttagtcatctctttgtcttgtaatgagggtaaaacttctaagaagtccttactatttaagacaatcataatgatagttggatcataacctgcttttttgatttcatcaatatcaaagtcaactagttcttgtcccttcttaacatgatcacctttattaactaattgtttaaatcctgtacctttcatttgaacagtatcaattccaatatgaatcaatacgtcagcatcattatctaaatgtaatccaattgcatggtgagtttcaaaagtagctgtaacgataccgttatctggtgcaaagattttaccttcactaggaataatagcaatacctttacccatcactccactagcaaaagtagggtcatcaaccttggaaacatctttcaatgtaccattagctggactatgtaattcatgcttttgatgatcttgtttaaagttctctttttctttagctgctttcttaatttgatcctcgtcaactggatctttgaatccaatgatccaagttgcaataaaggttgcaatactagcaattacaattatataaattgcttgaataacaaagttttcagtctttgaaatccacattggtaagctcaaaaatgctggagttacataaataaacgcttttaactttaagaaacttgcaacaacaccagcaatagcaccaccaatcatggcaccgtacattggcttctttaaacgaaggttaacaccaaacaaagctggttcagtaataccacccaagtaggcagtagcacttgatgaaagagctaatgatcttaatttttgattttttgtctttaaaccaactgctaatgaagcggcagcttgtgacatgttagagcataaagcgacaacacgaatgatcgggtcaaatccttgcgttgcaactaattgaatactaattggactaagagctttgtggataccgatagaaaccaaccaaggataggcagcagccaaaataggaatagcaaccaatcctgcattgtggtacaaccacattgcaataaatccaataccttgtgaaatccagtttgaaataggtccaagaactatgaatgtcaacggtcccatgattagcatagttaacattggttccaggaaaactttgaccattcctggtgtaatcctacgtataaacttataaacataagacataatccaaactgacaaaatagccgtaattaaagttgatgagtattgaatcaaaggtacgttaacgcctaaaaaatgaaatggcttttcagcattaacgatttgcacccataagggatgctcagttactaaacctagaaaagcgccaagcatttgatttgtgttaaagaccttggcagctgagaagccaacgtaaacaggcataaagtaatatcctgtgtcaaagatcaagttaagcatctggtaagtttgactttcatctgacagatagccagtgattgtcaaaattaaaagcaaaacctttcccataccagcaccggccagtaatggaatagctggcgcaattgatccagtaattatactgataatcgtatcaaaaatattgccctttttctttgacttgttatcagtagaatcggcattgctattatccaaatggagtaattgcattaaatcatcgtaaacatcttcaactgtattaccgataactaactgatattgcccgccctttttgactacctgtaaaacaccttcaatattttcggcttcactatcgttagctttactttcatcttttagaacaaaacgcaaacgtgttgaacagtgaacaacggagctaatattgctttcaccaccaacagccctaatgatttgctcgcacatttttttatatttcatttcttattcctctcatcctgtgcaatcttatcgaattggctgaagtagtgagacacagaagctctattcctcccgaatccctggctttcgcagccttaccattgtaggcttatgcagtctcagctatgccgctcatgtaccattttcttccagcgtgtcgtagctaagcgtatagtggatccgcctgctgttgtagaactcgacgaactttgcgatagcgtccctaagctctggcaggcgtgctgtattttgtctgtctttaggcattcgctcttgagggccttaaaccggtgctttgccagagcgttgtccctccatctcgccctgccgtccatgctctgggatattccctctggatgtgagcaggaag

SEQ ID NO: 619 - DNA, 7607 bp, Unknown
  Metagenome-assembled genome
ctaaataggctattaatggtgtatgcactcgaatccttctttctggattttcttgttgttcgcacaccaagaataccagaaaaagacgttcgggtgttttttaatattcggaaattaataacaaaaatgaggtacgtttgacagtaccattgtggagtaggaggaatctttatggcagaattacaaaatgatctagcacaattgattcgggcgcaaggtgaacaaggcccatttgtctccattttcatgaaagtctcaccttatgagcgtgatattgctgaagataaggcaacgttccgtaatttggtgcaacaggcgaaaaaaacgtttgtcactcgttttactgaaaaaggatgggcggcgtatcaggataaattagcacaagtattgcagcagcgggcactaggcaataacggcgccactagtattgttgtcgtcgttggccagaatgatacctttatctatccgttagcgcaggaagtggctaatagtgcgcatgtcggtgatacagtctatgctttaccgctgatcgccaatgatcaatttagctgggactatcatttgttgaaagttagccaagatagtatggccttgtgggatgttactgaaggggtcgccaccccagttgatttgccagcagcggcacccttgacgcgggaacaagcgttgggtaccgaactgacaaccgggaaaacacggactacacggactggtttgggtgctggtcaagcttcgcacggtaatgatcctaaagaagcaagccaggctagcgatatgcagaattatttcaaacaagttgatgactatattctgaccaattactccaaatcaacgcagaagccgcttgttttattagcggtcagtgaaaatcaggctattttccgtaaattaagtaagaataaatatttgctgcaaaatacgcagatcagtaaggtaccagcaaaactagaccgtcaggcaattgcgcaaatcgttgcgcaggtcaatcaaaagctggcaactgaggtattggctgtattacaaagccaagttgatcgtgctcgttcggcaaaaaagtatatcagtgacctcggtgcgatcacgcagcgggcagccgaaggcaatgtagcaactttatttgtcgctcaaggcgcatatgttgcgggtcggttagtcggtgaagaactcgatactagtagtccagcggccaaagcgactaacttgctgaacgaacttagtgtccaggttttacaattaggcgggcaagtttacgtgctaccggctgatgaattgcatacagatgccactgcgatcttacggcggacggttgaagaataagaataaataaaaaagtaggcactaccccagtagctaatctgaggtggtgcctacttttttactaatgaaattatagtttttaactgaaaaagtagcgtaataatagctaaaacacgcgtaataaatttgagactaaattagttgatttacaatttacagtgcctaatattcatcgggcaaacgcatcaattggcgcttggcttggcgttgaatgacaacttcatcaggtaaaactaaggcgttgtcgatgagttcaagtgtcaagtgttcggcgggatcaaattgttcacagtaaatgtcgcagtgccgtccacgcttcgtaatgataaaagctacattgtaagggaaacgtgtatcttggacgcgtaatgaatcataaaagttccaaagataatttgtgaaataacggggtaattcttcctggacgccatcagatagttgccgtaaaaggggccgttttccaaaaataatatcacatccctaaaataagtcgcttattgttgtttcctattttaggggacttttcaataaaaaaccagtcaaaaagcgcaatgtcatcaaaatgatatattattttaatgttattgggacaattgttacttgttccgattagcgtggcgcatttcgggtaggttattctctaagcgtgactgtagccatacgtaataatggcgatgtaaccaaagtgcaatatgcagccataagtagccaagtaatagcgcagcaatcgtgtcactcgggtaatgggcgcctaggtaaacgcgtgaagcgacaacgagacctagccacaagccgatagcaatcaggctagctaaacgctgccacagtcggggtaatggccgtgcaaacagaaaatacaccaagcttaagatcataacggcgctaaatacatgaccgctggggaaactataaccattttctggcagtaggacgtgagtcgttggccgcgaccgggcaacgataaatttaagtagccaggaaatgacgcccccaataccgaaactgactaaaacccaaattgcggcggcgcgccgctggaaataccagagcgcgccgatcaataccactgcgtacagaactgccattgccggtttagcgatcacactgatcaaacgcatgagaaaagttttagttggcgttacggttgcttgaagcggtgtggtcaaggcttgatcaataaaggtcagcggagccgcttgaaaatgcgctagcagcgccaatagaattaaaattattaaaacaaccaacaaggctggtggccgtttttttaatcgcagattcactcacataacttcctttttaaatgtttagtatagcaaactttttcagttccaatttagcattgttaatgttaaatcacccaagttttagcttatcgtaaaattctaaattttagctaaagttttcgcaatttttccataaacaaagagcgtcgcaatcgtcagagggtgctccctgcgtttgtggcgctctttgcttcattttagaggatttgatcgcaataagctagtctaaattttttaatagtgtttctaattcgttcaaacgttgctcgaagactttaaatgcttgttccaagtaagctggttgcgtcatatcaacgccagccttttgcatgatcgcaattgggtaagcggaactaccagacttcaaataattaatgtaggcgttacggtcagtacgttcaccattaatgattttatcagctagcgttgtggcagccgcaaagccagttgcgtactgataaacgtagtaattgaagtagaaatgagggatccgtgaccactccaaagcaatctcgggatcattttcgactgctggaccgtaatacttctggttcaatttaccatagtaatcagataaatgttctgcagtcaacggtacgcccttagcatcttcggtatgaatgaagtgctcgaattcagcgaattgggtttgccggaaaattgtgcctttgaagccatctaaataataattcagaatgtaggcccgcgtccgtggatcagtttgttgctttaataggtaatcagttaacaaattttcgttggttgttgaagcaatctcggcgacaaaaatagcgtagtcaccatacacgtatggctgattatggtgcgtataatggctgtggactgaatgccccatttcatgaactaacgtgtacagattgtttaaattattctgccagtttaataaaatgtagggattagtgtcgtacatgccggatgaataggcaccacttgttttgcctttattctcaacgacatcgatccaccgggtatcaaaagcttcttgtacgatactggtgtattcacgacccagcactttggtggccttcaatacttcagctttagcttcgtcgtaagtgtaagataggctaggttcaccagtcaaaggcgtatacatatcgtacatgtggagttgatcgaccccaaggatctttttgcgcaaagccacatagcgatgtagtaacggtagatttttttcgacctcagcgactagcgtatcataaacgctttcgggaatatgattggcagaaagggcggcttggcgggtagaatcatagtgatgaactcgcgcttggtagttgtgcatcttaatgtgtgaggacaaagttgaagccagtgtgttacggaactgacggtaaactttatagagttgttggaacgcctgtttacgtacgtcacgattggttgattcgatcaaagttccataaacaccttgtgacaattcaacatcattgccctgagcatctttaacggttggaaatggtaggtcaacatcgttcaagacattaaacgttgcggcagaagcatcaaaaacatcgctagcaccagccaataattcttcggcttcagcggaaagcacatgtttacgcgttgccgtaacttgttctaagtaatgttggtaaacctgcaaattagtgctgctatcaatataatttttcagttcatcagccggaatcgctaaaatttctggttctaaaaaggaaacctgagcagatacttgtgctactaatgcaccagctcgttgatccataccttgataagtggggttatcgttatcttggttatgtttcaaactagcataaacgtatagtttttctagtttacgataaagatcaaaaatctgatccaaaccgtcgcttagatcgcgtgcgctatcgccaagggtacctttaagtttagcggcatcctgccccagcgttgtgatttctttaaaagcgttctcccaatctgtatcactggggtaaaccgtggtcagatcccaagttagttctgtgggcacctgctcacgcgtaggtaatgttttcgttgacatataaaaacctcctatatacataattagctaaaagccgtcaaaccgaacagcgccatctggggcttactgttcgcgcctaacgcagatgttatcgctttaatcatagcatataaccgacgggaaaggcagtcctgctgttagttcagcctaaaaagtgcataaaaaaaacgcccgcaaatgcggacgtttgaaatttcgaatttgggtagttgcttaccaccaaccgttagattgacggaaggcaacagcactgctgacactaccgtaacgtgaagtagcgtagtttaacataccagtagtttgtgaagctactgaaccgtagccccagttttctttagtctgacctaagccatggtaaccgtttggtgaaacggcattagcattaccaccagattcaggcataacgattgtattccataattcggcagtaccaccggcagcgataaattggtcatatgttgaaccacttgcagctgttgtagttgcagcagcagtagttgcttgttgtgtttgtgcggcttgttgaaccgttgaagcagcttgttgaaccgttgaagcagcttgttgtgcttgagctgcactagcttgttgttgtgcttgggctgcttgtgcagttgttgtatctgtaccgtcaggaatttcgtaattctgaccagcaaagatcaaatgagtagtagcgtcaatatcgttagctttttcaatgctatcaatagaaacaccgtatttatcagcaagctcggaaactgtatcaccagattgtgctgttacagttgcggcctgtgcttgttgtgcaccgactaggaataaacctgcggcaccggctgtggtgaacattaacattttaacgcgtttgcttaataaaataataatcactcctaaaggatttatgctttaatttctatataaatttctgactatcgactgacgttgcttagttactatcgattcaacagtgataattatagtggtgtactgtaacaaaccaataccaacgatattacaaaactggccgaaattgaaatatcgttacatgtttgtaacataacgtaattgaaaaatcatgaaagcctaagcctttggccttagaacttgtttaaatatgtgtaaatgtcacataaaaagcgaattttttttgaattatttttagatatttgcttaaaattgcacaagtcttaacataaaatcgaaaaatgacctgatttttgactgaatttaacagaaatatgacggacaatatttgcttgcaatgttcttggagacgcagtttaatttcgtggtcacaacgttatcatgaaaattgtgcgcaatttaattgttatcagatatttagcggtgttaatgaatgtatgaacttgttaatttattttctgtgattctttatgcataagtgtttttaatagatgatttaacagtgttcttgttataattaattttcgcaaaaaggacattatatggaggaaaaagaatgccattcgaattaaaccagaatactaattggcggcttaatttctatttgattttcagtgggcagtttatgtcgggattgacgacgatgatcgtacaatacgcatttatgtggtacatcaccgatgtgcttaaatcagcgacggcgctgtcgctttcgacgttgatgatgtttttaccatggatcttcttggcaccggtggcgggagttgtgatcgatcgctggtcaaaaaaggcgatcattatttcgatgaccatcggccaatttgctggtggtgcattgttaaccttgttattggtggcaatgttaacgcgggcgatcacccaagtctttcagcagccgacgttaaatacgatcgtgccagccattgtaccggaggcgcaattaactaaagccaacggccagattcaaacgttacagtcattgacagcgatcattgcgccagggctttcggccgttttattcggggtcatgccgatgcaatggatcattttattggatgtgatcggggcagttttcggttccttaacagtcttgctggcttacgtgccgcaaacattaccgcaagctgaggatgtttctttcttccataatatgcgcttgggcgttcgtgagttgatgcagcatcgcgggatttttcaatatagtgtgttgtcgctgatcacaattatgttcatcatgcctggtgccagtttgtatccattaatgacaacgcaacattttggcgggacgatcggccaagcggggatcgtggaaacggtgtggtcggttggtagtttgctgggcggtctctttattagtatttggggagctggcaaaaatcggtttgtggcaatttttagtagtttagtggtgatgggagcgacgtttagtatttttggcttgctaccgtcaaatcagcgcggtttctgaatttttgcgggcttaaatatttttgctggttttgggctagcttttatgaattcgccctttatggcgatcgtgcaggagcgaatcaagccggaaatgatgggctgagtgatgagtgttttaatggcgttgacgaatattggcgcgccgatcgggttgatgtttgcggggccattggcggatcaatttgggatcgcacagctgtttattttagctggggtggcgactttgatcactgctggggtagcgttattgctaccagcagtgcgacaaatcgataaaaaatagattgatggaacgtgcgctgacaggcgtgcgtttttatatgaaaccaaactcaatttagcgcgcagtaaccccttggtgtgcaaatgccgaaaaaaactgctatactgtagttatactagcgctagtaacttatattttgggagtcaacgtatcttcagtacgttggctctttttatattcttgcccgaattgtcaaatcaagtgcaacactttctagatttcacttataagtggtctaggtgttggtcatgcaagcaactgttcagctaagaattcattagccgatttgtagccgaagattttacgtggc

SEQ ID NO: 620 - DNA, 15224 bp, Unknown
  Metagenome-assembled genome
gccacgtaaactatttggttataaatcagccaatgaattcatggctgagcagctactcgcatgaccaccacctagaccacttataagtgaagtttagcaagtgttgcacttgatttgacaattcggggaggttaaataattaccggatgcttcaacgctactaaaatatattacaaaaagctacctaaatggcgatgatcgcccatttaggtagctttttaggtcatactattttattttttccgcagttccaacgctaattctaaactccgatcagcaatgatcgattgtgagtcagcaactggatattgatgattaggtgctttttcctgtgctaatgataattccgtacaaccgaggataatcacatccacattcaaatcatgcatcatatcagccagaatttcgtgatacagggtcgcatcgactgcaccttgttcttctttgatcgattgatagatcaaccgattgattttttcctggattgctggtgttggatcaacctcagttaagccggcatcagcgatatatttatgataaacctggctgttgatcgtaccagaagttgctgctaaaccgatgcgtttagcttgtggataccgtttttggagtgcccgtacagtttcttggggcatattcaaaaatggcacatcgctggctgccgctaattcatcatagaaataatgtgcggtattgcaaaccatgaccataaaatcaggcttcaataaattctgttgttgcacgtcttccaataggtcaggtaaaaaattgggctgactatgatctagcaaataagtcgtgcgatcaggcacagtagcgtgattaactaaaatataatttaagtaatcttggtcttttttcgctggtgtgcgttgatttaaaatacgaatataactttcggtggccattgtgcccatgccacctaatacagaaaagaaatggcgcattacatgtcccccttattttctttaaaatagttcttgaaacgaccattataaaggtaaaaggcgtatttttgcaaaacataacgtttcaaattcatatcttgtttatagaaaacagtggtgccataacgtttagcggccaacaattctagggcccgttgtttatccgcattatcccgtgcatattctttaaagaccttaactggcacgcctaaccaaagtttctgttggctttcgttttggttaccgtagaccgttggcttgtctttcaacgcaccggtaacacgatcctcaacgacatattcagctaagttatacccgttcaatgtaacaaagaagctactacggccttggcgtaaattgatttcaaacagtttaaacgtttggtcacgacgatcatacttcatatcaaagttacaaaagccagtaaacttgatagcttcaaggaaatgctggatctgatcgtaaacttgttggttgtattcaggtaaaatcgcaacatagttcccaatatcagctggggttggatcttccaatagtggatgacctaaacacatcagcttgacgtgatgatattgatccacataacaattcaaggtccgcatgttactgtcatcacctggaataaagtcctgtaaaatcagatcagccgtataaccatgatcgtaaatcttgctgacgatatcgtcaaattcagcacgatctttgatccgaaaagcttttttacgtccttcaaatttaatatccaaccattccaccgcgtttgatggctttaaggcaactggatattcgtaaggtacttcaattttagcaacgccattttcatagtcggccttactgataattttagtcaacggatgcggtagatcataccgatcagccatttcataaaaagcttctttactgatcaattgttcaactaagtcatagtcaatgtatgggacaacgaaagttttctccaaaaaggccttgtgcttagagactaattcaacgtaaccatcaccacaagcaatcaatacgactttcttattaacgttttcgtaacgtttagcgatcttagtcatgttctcaataaaaccaggatcttcgctaaaaccagggaatgtctccacattaacgatcttactgtatttagttggtgcgaattgtacactggcgtacgcggtcgatttaatgccataacgctcataaaacgcccgtgccatcccgtaaacgttaatatcgctccctaaaagtacaggaataaaatccatctcactatccattatgcttgcaatcctctcactatttctttcgcaacgaccatatcagttggatacggcgtatcaacaccattaaccttctggaaagcatcgtcgcccttacctgctaatacgacaatatcattagtagtgctagccgcaattgccgcagcaattgcttttttccgatcaacttcaatcgtaacctttactttgctatggtcaatatgtgcatcgatttcttgagcaatttttaagggatcctcaaaccccggatcatccgcagtcaaaaaggccacgtcagcgtactcagttaagactttaccaaagccagcacggcgcgatacccctttgttaccaggactaccaacaactacaataacctttgcatccggctgttggccctcaagaaaactcaacaaagctttcatgctggcatagttatgcgcgtagtcagcatagattgtgccatgatcagccgtctgcaaagactccatccgtccaggaacataagcagtggctaagcctgtcgcaatcgctggcgtcgttgcgccagctagactagccgtaatggctgcagccaccgcgttactttcgttaaaattaccgggcaagcttaactcatattgaccattagccgctaaagcacgggccttatcggtgcgcgcatataatttaaattggctcgccgtcaaatcagcttcctcgctttgatagcgaaaatcgatgatcggcaacgcctgattcggttgaaaatcttgcttagcaaacaaatagatatcttcaggttgactagttgcttgcgccgcacgataaatttcatttaaatggtcggtttccgcgttaagcacacagatacgcgaattgactaacaattgtaatttacaatgtaagtaatcggcaaaattagggtgttcagttggtccaatatgatcaggggtaatgtttaaaaagaccccaacatcaaaatgtaagccatacactcgattctttttataggcctgtgaagagacctccatcaccaaatgagtcatgccagaatcaaccgcggtacgcatatcgtgaaatagatctaatgactccggcgtcgtcaagtgtgacttaaattcctgttctggacgcggtccaacgatccgatcaatcgttgaaaacaatgcggtttgattattagtcgcggtttttaaaatgttatgggtaaaataactcgaggttgtcttccctttagttccagtgtaagcaatgatgaacaagtcattttgtgggaaaccataaaacgccgcactgatcagtgccatcgctttttggatatccgtaaccacaaacgcagctaagcctgctccttcggtaaattcttgctccgccatataggcgctagcacctttttgtcgtgctgccgttaagtattccggcttgaaggcacctttacagaagaaaagtgagttagcactacttttacgagaatcatacgcaatggcgctcacttgcggcgtaaccgcatccgggatcactgacttgaccagtaattgatgttcgttcagtaagttagttatttcggcaaattgtaactgcatacgattaactgcctctttcttgcttttttcattaaattaagtcggcttgaatgtaactaagtacacaaaattagcttcttaattatagcacaaaaccgatggccttaaatacgaccaccggtttccagtttagcatgcaatgacgctgcatactagggtgtgtttcgaaaagaatacaatgttaatttttagcgctaatgtagtccaagcgtagttgaaaaagtcacttttccaccgtacattgatagttattgcttattaccacggcttaaaagaaatcggccacttgcgccttaaataatgaaaaaccagttaattttgcaactgctttttgtgtggttatcttagttgcttgcggagtttgtccaggcaagtagttcaaggttaccggcgttttaatttgtgccgtaccaaccgtttgaccaactgtgattggcgcagtcaacggcgtttttgcactcttattatacgtaatttgcgtattagtttgattctttggtaaccagaaaccaattgtttgcgccaagccaacaggcacttgaagttgggttccaaacttaacggtcaagcggtcctgcttatttggtgccgttcccttagccaaagtttgatagctttgtgtgtcataaactgaattcatgattttagccgtttcaataaaccgtgcattagcattggtatcattttggttagcatgcatcacaaccgtaatgattcgtcggccattctttttgactgtccctgcaaagcacgcaccagctaaatcggtagtccccgtttttaaaccgtctaccggtaagttagaatcagccgcagcttgaccagccaacatataattccaagttttcaaagtcgtagctgaactagttccactggcaaattccatgctcgcattttttgtagtattcaacacttcaggaaaatcttttaacaagtgttgggccacgatggccatatcttgtgcggacattttattttcatcagtagtgctggaaccaggataaacttcgccatctaggtagctattattcaatccacttaaattaacgatatgagcatcagtgatgccccatttttgcaactgcacacgcatttgctcaactgctgctgtttgtgaaccagcaaacgcatcaccaagcatcattgccgccgagttcgccgactggatcaaggacgcatcatacagatcacgtaccgagtacttactgttttcagtcagcggtacattggtcagttccttattttgggtcaatttgtaagccaatgcgcttaccggtacctgtgtgtcccaactgattttgccttgcttgattgcgcttaacgttagataaacggtcaatagcttggtcattgagccaattggcagcacctgtttactattctgatcaaaaagaatttgaccgctttgtgcgtccactgctaatccagctgtggcatcgactgtgtctgctgccaaagtgggtacagcgctacccagcaacatcccaaaaatcaaagtgacacgtataataacttttttaaacataatttctccttcactaaatcggtaattgatcaattaatgatctcggcgtgataatcaagcctctgtgcgcgccggtaactttcccccgtgttttaacggcagccgaataatgaaactagtcagcttttgctctgaggtcgcataaatctcgccatcatgtaaagcaacaatactttgagaaatcgccaaacccaagccagttccgccagtcgcagtcgaacgtgattcttcaacccgataaaaccgatcaaacaattgctttagcgccgcttgcggaattggtttaccatcattagcgaccttgatcaccacttcttgaccatgagcaatagctgataaataaatatggtgaccaccgctaccgtatttcagcgcattactgatcaaattattaaacactcgactgagtttttccgcatcggccatcatgatcagcggatcaggccgataagtcacactgatctgcatttgctttttagttgcttctagttcaaaactagccgcaacctgttccaacatctggcccatatccagcttggtgatcgtcaacggcgttgttgtttgccgcactttagtgtattcaaatagatcctcaactaaactttgcatttgtttcgctttttcaaaagcaatatgcgaatactgcagcaattgcttttcatttttatattgatgttcctcgatcaaaccaagataaccgatgatcgaagtcaacggtgtccgaatatcgtgactcacattggtgatcagttcatccttcgagttttcgattttgcgttcttcttccattgattgaacggttgaagcaaccagtgcattaatacttaaaatcactcgttgcagatcaccacttaacttaaacgagatgcggtgctcaaaatgaccatcggcaatataatgcagctccgcaataacgtggcttaattgcatttgatgataacgccggatcaaacgccaataaacgaccgccgcatcaaataacagcatcaaaaaggtaaagatattttgccaactcattaaatgaaaaccgttaggaccaattgcaatggcgtttttgatctgaaaaataccatcatttaaagcctgattagtttgaatcgcctgattcaaaatcacgatcaccgataagttaagcaataataacaaaatcactgtcacgacgccttcaataaataaggcacttttttctcggccggttaacttcaatttatgttccgcctccactgacaaacctaatgggcttcgactttatagccgacgccccaaactgtttggatcactttttccccattagttgcttcttcgatcttatcgcgcaaatgactgacatggaccatgaccgttttcgctgaaacgatactttcctgttgccaaacccgttcaaaaatctcatccgcagaaaagacacgattagggtgactagccaacaagtataaaataccaaattccagcgccgttaattgaatttgccgaccagttaaggtggtcacttcatgcgaatcttttttgatctctaatggtccaacttctaacacgtcaggagtatcattggtcacttgctgctggctacggcgcagtaatgacttgacccgcgccataacttccaatggattaaatggttttgaaacataatcgtcagcgccactgatcaaaccttggattttatccatatcggccgttttagcggacaacatcaaaatcgggatctgcgaatctttgcggacttcgcgcacaacttccatcccatccatattgggcatcataatatctagtatcatcaaaccggtatccggattggtggctaatttggttaatgcttccttgccatcataagcttttaatggggtgtaaccttcgttttgaatgtaaatacttaataattcaacaatatctttatcatcatcaacgactaaaatcttcatcaaattcggcctcctaaattcggcgagttaattaatctaattatttgttcagcatctattttattatttgacgtcacactcaataatacgtgtctaactcttttaagtgtagcaaattaatcttgatttttctttaaaatcggcgcataaaaaaagaattgcaccgttacagtgcaattcttcaatccgctatttttatttagccgctaatttggcttgataacttttagcgatcgctgcgatcaattcatcgtcagttaatttagtgacttgcttgatcacagttgtcaagtcattatcttttaacaactgttgcaatttaacactttcttcatcacttggttcgtcataggtgaagatcatgccaaccgtgtctaacaagacatcatagtttaagttgcgtgctttcaattcacgaattggacgaatgaaacgttcgtcgaagcctaatttacgaattggtgtccgggcaactcgagaaatatcatcagaaatatacgtattttggaaacgactagcaactttatcttgataagcctttaattcttcaacggtaaagtcccacttgtgactaagtaagtcccgcgtttcggctagcgcaccttccaattgcttgaagatatcagggtcagcgattgcttcaccgattgtcttgtagcctttgtacttaccagtgtaggcaacagtagcgtgaccagtgttaacggagaacaacttacgttcgatgtatggttccaaatcaggtacataaacaacggtatctaatttaatttctggccgtgccatttgtgattcatcaacgacccattctttaaatggttcaacggaaacggctaaaggatcgtcatgatgttgtaatggtacgatccgatcaacagcggcattaggaaaaccaacatgggtatcggcataatccttatcagcaccagctaaatgcttgtagacttcagactttaagaactggctaccaccgatcatattttcgcaagcaatcacatcaagtttagtttcatcatttgctttagcccgtgccttgatcccatcagcaatcaatggtgcgataaatggcaaaattttcggaccgatcgcagtcgtaactaaatcagttttttcaattgctgcaacgactgcttccggatgatctttgttatttaagccatcaacgttggcaacatgaatcttttcatgactagctgcggctagttcaatatcatattcatgacgttgattcaacgcatcaatgatcgtactgttgacatcaacaaaatcaatactaaatccatttgcggctaatgtttcaccaataaagccacgaccaatattacctgcaccaaaatgtactgctttcacactactcaacctctttcaataaatctataatttctgctgctgattgggcatcagctaacttctctacattatgaatgtcactacagaataatgcaatttgcgataataattgcaaatgttccccattcaaaccagcaataccaaaaaccactgtgaccaatttttcatcggctggatcgtcagcaaaatcgacgccccatggcaattgaaccactgagatcccagtttctttgatatactgcttgccatcctcagtcccgtgcggaatggcaataaagttacccatatacacggaaacatcgcggttacgcgccagcattgaatcaatatatggcgcatcaacgtttccattatcaaccagcagttggccggccatccgaattgcatcttctttggtcttcaccgactgattgatgcgaatcagtttttcgtctagtcccttcattcaaggtcacccttttctatcgattgttggttaaggtatttaatttcatctaagaataaactgctgatcaactgataaacgatctgttgactgccagttttataaattgctaaattcaaatcgctttcaataattgagccgctaattttccccatcaaaccattttccgcaaaggtcattttttccggtcctagcattaacaacacccgacttaggccaatcgtttggccatccatcgcagtgatcgttagagtcgtacttaagtcataaatcgagaaaaatggtcgtttgatactgctatccgtggtatggatcaacgccaacggtgagttaggaattcccaccggtgcctgctgcatccgcgccaataacttttctgcgatacgctgaggttcagtcaaaatcaccccagttaagctcgttgtgatctgccctaaggtccccagtaaatcttgcgtttgattatcgatactttgaaccgtgatccgttccaaaatatcattagccgtcttcattgcttcataagctgctttaaaatcatgcgcccgttcatttagttgtggctgcggcggtgctggcttagtctcgaccttgccataataagtctgcaaatactcagtgatttccttgatctcactacctagcaataacgggctgatcattttatagttcaacgaaaagcctggcagtacaatcgttgatagcacgatatcgtattgattaggatctaaatggttcaaatcagccactcgtgatacgtggatcttggttaactccggtatgttcttacgtaaacgtgtttccaaaattttggcggtaccgattccgttagcacagacaaccagtgctgacaggctggaacgtttgactcgcttttcatacgatgatgcaaagtggatcacaacataagcaacttcactatctataaattcaacttgtggaaatactgttgctagcgcctgcgccactattttatacaattgcgcatattcagtcttgatccgctgtaataccggattattcaattctggtaactgtgaatgtgaccgtttcaacgctgccgccaaatgagccattaaatcagtgaatagctgatcatcttggcgaaaatcccatttgaaagcagtagaaacattttgcaccaactcacgaatctgataagacaacgctaaatcataattctccagcaagacattctttggtaacgcaaaactcataccttgaatttgtaacgctagaaattctagctctaacagattaacgtgatcccggatcggtgccggaaattgattaaaaatgtcgattgccacttgttggtatttaaatagctcattcttatcaacatgctttagttcgttcagtgtttgatgtgcagcgatccgcatagcggaaattgttaatacaatgactaactgctgcaactgactgtcagaaaactgactaaaggattgtcgctgatacttttgaatcgcctgataactagtggctaacaaattgggatctaataaatttatgaaataacgggaactgtattccgtctcggtcaccgataaagaatgttgttctaaatactcaaagaactcatactcgttgatttcactgttaagcaccccacttaacactcgacgcaagttactttctttgccagtaacctgaacgccctgcgcttttttacgtaataactgtaaacgataatcagtcaaaatcgtttcgatcgccgtcaaatcttgtgaaatcgtcggcacgctgacgccaaactcagtagccagttgcttcatggtgatcacttgatcacgcaacaacaaacgacaagtttcagcgctttgccgccgatgaacatcaaaatattcaggatgttcagctgttgtgatctgctgttgcaacttctttagcgctgatggttcaccaactaaacgataacgattctgctgtttgatcaattgtatttgtacccgagctaatgtagattccagactggataactcacgatagatcgtccgccgactaacatttaagtttttggatagatcttcacgagtcaaacccgcttcatgccttagtaaaaggaaaattatctctgcttcacgattggagaagtacacgactaaccaacccttctggcaacgtttaaaagcggtttaatcaccaccgcttttaaatgtgcttattttaatttcgagataattttagcatattctgcgtcatctaacaggtttgctacgacaataatttgtaaattaccaaattgactcttgatccgtttagcagtttccttgctagcaagaactagtacttgtggctgatcatttaattcgttaacagcaacgttacgaacagtgatttctttaccagctttacgtaaagcgctacggaaagttgccattgccatcgttgcggaaccaacattttgatcatgatgaacaaagttaacttcttcaacctgactgaaatcaactgcataatcagtggtaccatctgtagtttgcgctttagcagctgctggttgttcagttgttgtgacgtctttagtcttcaaactagtgatgatctcatcatactttggactattcaagaagttttcaactgcaacgtgaaccgcatttggtgtttgtttcaacgcccgatcagctaattcttcttgtgtaacaactaataaaccaggttcgtccttcaagttgctgatagccgtattagtaactgattgatctaaaccagcttttttaactttatcccgcaaaattgaagcacccattgccgatgaacccattccggcatcacaagcaaagataatcttattaacttcgccgccagctaaaattgctttggcatctttagtacttgtgcctttagcatcgctcttcatcgattgtaattgtgcttggctatcttctaaactgacttctggcgtcttatcacgacgtaaaataaccattgagatcaagaacgaaaccactgcagcggctgtaacaccaagtaacacgcttacaaaattacctaagccttttggtgtcatcaataaaattgaaataattgaaccaggtgatggtgaagcttttaacccagcacctaacatattgaaggtaaatgtaccagtaacaccaccagcgataacggataagaataacatcggtttcattaaaatgtatgggaagtagatttcgtgaatcccacctaggaactgaatgataatcgcacccggtgcagatgacttggcattgcccttaccaaataatgcaaaggccaacaaaacaccaagaccaggacctggattaggttcaagcaagaataaaattgatttacccgctttagcagcagcttgaatccctaatggcgttaaaataccttggttgattgcattattcaagaacaagatttttgctggttcaatgaagatattagccaacggaatcaaatgaattgaaatgatgtaatcaacacctgttgctaaccaaccactaacggttgaaacgactgggccaatcgcataaaaaccaataatcgccaagatcatcccaataataccagctgagaaattattaactaacatttcgaagccttgacgaatatgcggctgaactttgtcgtcccacttcttaatacaccagccccctaaaggacctaaggccatcgcaccaataaacattggaatgttcgcaccaacgatgacccccattgttgcgattgcaccaacaacaccaccacgatgtccagcaattgctttaccaccggaatatgcaattaataatggcaataaatacgtaaccattggtgtcccaatcttagctaaatccgcattaggtaaccaaccagttggaataaataaagctgtcattagtccccaagcgataaacgctccgatattaggtaagaccatattcgataaggcactacctaaacgctggactctcgttttaagtgaagttttcttttttgaattatttgctgtcgcttccataacttaaaacgctcctctcttttgtataaatccattgtagcgcttacacaaaaaacacatcaactagaactttggcacactattctgtgccatttctaaaaaacttggttttaaccgacttttctgaaaaaagttcgcaaatgacttgactaattcagaatacgatttataattggactataccaataaaggcaagataacttatgaaaaggggttctaacgtaatgaacgtaattattgttaaagatcaagttgaaggcggccgtaaagcagcagatatggtaatcgatgccgttaaaaatggtgctaaggtattaggcttagcaactggtagcacaccagaaaccatgtataaggacttaatcgccagtgatgttgactttactaaaatgacttcaatcaacttggacgaatacgttggccttgcaccagatgatgaccaaagctaccattacttcatggcaaaacatttattcgatgctaagccatttgctaagagctatgtgcctaacggtttagctaaagatgctgatgcagaaactgaacgttacaataaagttatcgctgataacccaatcgacctacaagtattaggattaggccgtaacggtcatattggttttaacgaaccaggttccccaattgatgctcaaactcgtaaagttgctttgactgaatctactattgaagctaactcccgtaactttgaacatgaagaagatgttcctaagtttgcttattcaatggggatcggttcaatcatgaagtcacacaacatcatcttgatggcttggggtactgaaaaagctgatgccgttaaaggtatgatcgaaggccccgtaacaccagattgcccagcaagtatcttacaaaagaaagacaatgtaacagttatcgttgacgaagctgctgcatccaaattaagcaacaaataaattaaaataattactgaagcaactccatagtgggttgcttttttagtcggtgacaaaacagggatcgtgtcataaatatatttatggcatgatccctgttttactaatctaaatatttaaccttatcagagtgcggatcaccgacttgaactgggtaagttgcagcatctttcttattggccttatcccaagcgtaccaaccaccatcataaagatggatattcttccaaccaccttggtaagctatgaagaaagcagttgcagctcgccaaccagtgccacaataaaaatcaatattactggtagactttatgccccatttttcccaagccggcgcaatttgactgacgtcttttatcgtgccatctttatttaataggtaggcaacatcagcactggtcaaactagatttagcgtatacagcgcctttagattcacctttatctttaatataggaataaccactaacaacaccggtaaattcttgccatgaacgggtgctagccaaaactaaatctggatcttgcttttgttgtgccaccacttcagccggtgttttaatttcatattgtggattagccggcacttcgacaccaaagtcagttgcggtttttggcaacgttgccctgcccgttttcacctgataatcactctttgtccagcctttatatccaccatcaataattttaatattattgacgcccgtccatagcgcagcaaacgccacacgtgaagctgcattaatgtccgttgaatagacgatcaaagttgttttgctagttacaccacgttttaatagtacttttttgatctgttgcgccgataataagttccattgattggcttcagattcaactgcattggtatttaaatgcgttgccccaggaatatggcccttgcgaaagttcttatcattgccgtaagaagcttcaataatacgataatctttaactgcggttttgttatggatcacttgattgacccaatgcggactaacaaaaacccgtggcccttcagtttttgtcgtatcgtccttttgtgcatagtaagcagcatttactttagatgtaaacaccccaccaaataagaaaacgctcactactagtaatagatacccaattaaatttcgctgcataatttttcttaacggcagattgcaagaaataacttgaacaaatttagtaacgcagattacgcaaaaagatctcgatcggtgttcgccaatttaaacatttgagtggtcggcaattcaaataccagttaatttgaatcaattcatcatcggtaatctcatcaatcggttgacctttgggaatgaagcggcgtagtactcggt

SEQ ID NO: 621 - DNA, 6091 bp, Unknown
  Metagenome-assembled genome
caatttttaaatggcttatcgattcaaacttcggcgctgatcacgctgagcatgagcaatagttgaaggttaatttttaggctgtaaagcttggtggactaagggattactcgaattggaactttcacgacttagattaacaatgcttaactatagcgtccagcgtttcaaccgcagttcatgtttacgtcccattactgattcctcctatattaagctcaaactaaagaaaaaccaccatcaaccgttaaaacttgcccagtcacataattgttttgcattaaataaagataagcactcgcaacttctgccactgtagctacacggtgtaatggaatttgctgcgccgtcgctgtttcattttgttgtagttgttgcgtggacaggtctcgccataaaccagttggagtccaagttggtgccaccgcattagcccgctgtggtgccatttctaatgctaaaccttgaactaaagtaccaattgcctgattacccacaattgcgccagaagcatcttgtggatgaccgccagcaccagctgtaaaaatcagactaccaccaggtgctaaatgtttaactgcttgttgtgcgatcatcacattggtgaaaaacttagcttcaactgcagcgcgaatttcacttaatggtgtgtctaagaaaccaccactaagggcgccaccgaccatcgataccacgtgatcgatagggccaacttggcttaagtaagtcgctaaggctgcttcgtcacgtacatcaaacgactgccctgccacacggccaaccaccattaatcgacccaaggcctgctgaaaacgttctgggtcacggccaacgatcatcacttgcgcatcttgttgcaatgcttgccgagctacttcttcgccaaaacccgaagtgccaccaagtactaaaatgcgtttattctgtaaagtctgcatcaatctcatccctgtttctatatggttgattttgatgatcttgctcatcaaaactacatgctaattaaatgtaataaaattcattactttcctagcataccatgattacgtaaaccagtgacaaaattgttaagtaacgctttacaatttgcgctcactttaccgataagttgctagcagcttctgtaactcagctcgtgcagctccatctttggaaaccataaaagtctgatcaaccgttcccgccgtttgaccatcatcagaatattcaccaaaaccagtattcgtgctaactgcggttccattaccagttttaagttcataaaccacaccattatcaccgagcagatacttgctaactggcttggtaaaatccatgttgaccgcatagttatcagcaaatgagccagcatacaatttgtcacggccaattgtgccatctttagccgtataaaatacacagccaccaactgcatggatcgggaattgtcctgcccctggcaccccaaaatcttgtacctgtaccttgccatccggcgtttgtgcataccaatcaccatgacccgcactaccgtgatcaaaataccaatcactgaccgccatttcaccaatttcagcctgctgactcgcccatgccaaaaacgcagcattcactttagctttttgctcatccgtcaaatgtacagactcattttctgattcattagttacattagatgtgctattactagcctctttagtggcttgctgcgcctgctttaatgacgaatttgtcgccttcaagctggctgactgcgcactttttgcacgctttaatgatgcattttctgcagttaaactcgtagttttactgttctgcgctgtattatcgctgctgttttttgccccacaaccggctaggccaaccattactaaagcaatcaagccaaaacttaactcttttttcaaattgccaccccacttttttactattttaacaccttcagcaaaacggttgcataaaattcgctaaccgactatgcagttgctatgctaatttaaaaagaggtgttgcttatgttgcgtgattacatcatgtcagcggctatttttagtctgtttagttttgcctggttcggttgggcgcaagaaactttaccaacacaatgacgttggccagttgctttagctagcggtagcgcactgctattagcaacttatagcggttatctcagttatcaacattggcatagtgcgtctgtgcttactactgaagccaactatcaatggtaccttatttttgtgatcagtgaatttatactggccggtagcggcgcgctgctgttattaaaaaagcaccagtcagcatatgtcgctccttggatcagcttaattgtcggcagtcatttcattgccttacagttcatttttcacgatcctagtctttacctgttagccgcattaatgatcagtgttagcttgggtggtctattcaggcaaattcatgcaagaagcgccttagttggtgttagcaacggggttattttactcgggtttgcgttatttaattttggtcgctttttctggcactaaaaaagccagccacaaggactgactcaaaaatcgcttatttaccagcacgccgttggtaagttcccttttgcgtgttgatttctaatttttcaccggcactgataaagtcaggcacagtgacaaccaaaccagtttccatggttgctggtttgccaccactggcagccgttgcccctttgatcgatggttgtgtttctgctacggtcaaaacaactgttgtcggcaaggttaaaccgatcacttcagtttggtaaaattcaatcttaacttgcatattttctaacaaatatttcatttctggttcgatcgattctactggcaattcatattgttcataagttgctagatccatgaagaaagctgtcccgtcttgcgtataaagatattgggcatctttagtttccaaaacggcttgttcaactttttcttcaggacgcattgttgtttcaacggtcgaacctgaacgaatatcgtataacttcatgcgcataacagtattacctttaccgggcttatgatgatcggctgacaaaactttgatcagcttaccattttgttcaaaagtcatcccggcttttaaattgattgcttcaatcatgtgtacactctcctaaataaaaaatctttcgctacccattttaccacgtcaatcattattacaaaatcatttttcgctgtacaaactaaaaaagccgcatattgcggcttttctttaataaaactgatgcggccgatcataataatagccttggcgtaagttaatcgacagttgatcagccaaagcaagatcttcaatcgtctcaattccttccaaaacaaaatcctttgcgtcagctaaggcaattttttgccgaaaaactaattgcttataattatctgggcgcgctgttgtgaaattctgcaacgcaaactttacttcaacggaaagcggcaataaaggccgcaataagctaatttgattctcaccactaccaacatcatcaagacttagctttagcccatgtgcattaataaaatgagcagcatcaactaatgcagtttccaaaacagaaacaccattactgcgctcggtcaattcaatgatcaattggtggtcaggtacttgttgctgtaccgcaaccaatgcttgtagcatttgtcgatcaacaaattgatcatgatctaaattgatcatcgccttagttttccctggtaaatgatgaatggcttcagctacaattggtgcaaacaatgacggtgttatcagactaaaatccatcggcacccgccactgatcattaacttgttcgcgcatcaacattcataaccgtcaacccaatcgcgccggcgatcataacagccttggcgaaataaacgatattgattcaattgtcgctcctccatcatagtcatcaccgtttcccctaattcgtaatattaaattcaacttaaataaaatatatttcaaattaatagatcataaaatttaatccatcaaattaaagttgtacccataagttcagtatttataaataaaattatacttttaattgctattataataattgattaacacttaaattacaaatatttaaaactatattacgataaaaaaagtaaaaattattgagacaacgctaattgccgactctataactatttttgcgagtgaaattattatatccagcaagttttcaccgttaaccggttttatacatcatacgctttaatcaattctaataatacacgtagctatatgacaccattattgtaaagccattgatcctgggtacgttgtgctatcaaccaatccaccatcagtatcaattagcaactatttatttgctatcaaaagaatagttatctttactaaggtatagcttattgtggcatatttatcaagcaaatctagcatcaacagcttcattataagtaataaattattattattagttataataccttttcaaactaactaaacgctgcagctacgcacaaaaaaacgcctaagttgctttaacttaagcgcatcatttctacttgatcaccaacatatcattctgatcaaattgccaactatcagcataggccacttcccaataataaccgtcagggtctttgaagtagccactatagccaccccaatcaccccaaactagaggttttaccgcagtagctccatttgctaaggcctggacaaaaacttgatcagcttcagccacgcttttagtattgtacgcatgcgttacgccgttaaacgtggtcggctgcggattagcagctgggtcgaggccaatatctttcaataattcagtgtaaggaaatagctctaatttagtgccggcattattaaaaaagacgatctcatcagcgtgctcagtatttggttcaacgaagccaattgctttatagaatttacgtgccgccgccaagtctttgacacctaaacatattaagtgaatgccattcattttgatcacaactccttttattttgaataagttgattatacgcgttgctaaaaaaatactcacccaatttggatgagtattacgcgctaacgactctcagcgtattttgttttaatatagtcggcagaggtttgtaacttagccaattcttccttggtcagctctaattgcaactgttccacgatgccatcgcggccaacgatcgctggatacgacagataagtcccgtattcttcacgatagttagaaactggcaactcagtcaacgcattattcataattgtattggcgaggtacacagctgctgttgatacgccataattagtgtactttttaccatgaaagactttaaacccgccagcacgtgcttcttgatccaattcagcgagatcaagtcctttttcttgggcgatttcagtaattggcttacctagaacgcggaccgtggaccaagctgtaaattgcgagttaccgtgttcacctagattatagccaaccactgaacgtggatcgatgtgcaaacgttcagccaccgaacgtttcatccgtgctgaatccaaaagtgttcccgtaccgataacgtgttttttcggtaagccagtcacttcttgatagatcgatgtgatcacatccactggattagtgatggcaacgatcaaaccatgaaaaccgctggccttgatcttagcggccacttcccgcacagcaacccgcgtaaacggtaactcagcaaagcgatcatcattggcattatcttgtaactcaatgctgccaatagcggaaatgatcacatcagcatccgctaacgctgcatagtcgttcacaacaatattagtgtgaaacggtaaattaggtagtgcgtcctggaggtccaaggcatcagcagccactttttccgctcttttatcgatcaagactaagtcgtcagcaaaaccgccagccacaatataatgagcagccgccgcgccaacattgcccatcccgataactgctaatttgcgtgtcataattataaacattcctttcgcgtaccgctcaaggcacaaaacgcaatgaaaaagcgtttgcctgcagcggtatttctttgtatatttaacttgtgatcgtaccttgtacactacaaatcacgtg

SEQ ID NO: 622 - DNA, 1560 bp, Unknown
  Metagenome-assembled genome
tgaaagttccaattcgagtaatcccttagtccaccaagctttacagcctaaaaattaaccttcaactattgctcatgctcagcgtgatcagcgccgaagtttgaatcgataagccatttaaaaattggtcaatcagtgtcttgatctgcgcagtcatttttgcaggtgatttagtcacctttaggttagtcaactcacctagtaactggccgattgcagtcgccagatcaatgatcggcagtaaggtatccaattgatagaaaatatcgccaatcgttgggtcgcctggttggcgccgctgttgccaagccaacagatcataggtcatcatggtcacagccatatgcgcacaaagcccgtcataatcctggatctgagtctgatcaaggcgtaaatattgtttggcggccttaaaatagttctcaatctgccaacggcgactataaagttgaatgatcgctgccggggtcagattggtttttgtggtcgctaacaccaggtagtcgttggcgcaatggcgtttagcgacaaaaactaagcgtaacggtaactttgcggtagcggcctgaaccacgcaactatataaatagtcggctcgtggttgacgatgcgactgacgtaagtactgatagagcgttttgacggtgtattggcggccacgatagcggtaatagatcttcttggtccgtttaagcatgccaataccgatcaacttttggtcgtttaacgccgcaaacattttaggcgaggtaaaccaactatcgaatagcacatatttagctttgagcccatttgcccgcgcttgcttgatcagttctagtgcgaccgctggcattggccgcatcgcttgggcccgccgttgtccggctaaggtgcgttgatctaaagttttagctggtgtgcccacccgattacgtgctttctgtgacgacaaaactgccgtcgtgactggcaacacgagctggccgttactccaagccaaggtcaaaccacggtaaccttttaagtagcgttgccgatcatgatcgaaggtgttggctaaaagctcggtttgtttcgcattcagtcgtgagatcagggtgtcatcaatgatcagcgcaccacttttgcgggcgtcgagccactgtgctaggccagtgatcacccgttgtgccaataaacaactaagccgttgccaattgatccgaccgtcattcaagatattgtagaccgtgcgtttggtacacatgcctggtgcttctgctcggtaaagtgtccgccgctggaaaataaccttgagtaaccaaatcaagattgcagttagtgaaacgttagaatggcggtgatcattgagcaagcggaccaaagctggtaggtgcgccaaggcacaaaattgggtaattattttaaaacttgatttttcaattttattttgcggtatactagccatagcacaagcactcctttgtatcgtggtttagacgactcaagtatacttcaaggagctgcttgtgtttaatcttgggctaaaataacttagtgcaatcaggtttagctgggttttgaactttcacggtttag

SEQ ID NO: 623 - DNA, 23087 bp, Unknown
  Metagenome-assembled genome
ttctgtccacttaaatgttcaacttaaattttacaatctgccacaataattagttttgcaagagcactattattaactacgtctatttttattaacttgcttgtagaaactaaccacaatcagaatcgggagtgtcaagaagtttgtgtaaaaaggaattgccctttctccataaaattaaatcttttcagtcgaaaagtgattctaatgtatcctcaacttgtccgaatccacgatgaattcgattaaagttcttttcgttgtaactaattacttgcactccaatgaaattgtctaatgatttttcattgggaaactgttcttttgctttagtcttgcgtttaatctttttatttagcgattctataatatttgttgaataaatggttgggcgtattgcggctggaaaagccaaaaaagctaataattccttttcaattgacctaatgtgactaattagatttgtgtattgcttttcccaagtactataaaaatcggcaagcattttatgagcttcagttttattagttaccgaatgaagctgtttgaaatcatttaaaatgacctcacggtcttttaaacggacatgtgtactaatattacgcataacatgaactaaacatctttgaaattttgctttaggaaaagcatgtaacagcgctggttgaagtccgaccattccgtccgcaataattaattgaacctgtttaagccctcgctgcttaagatctgctgccatttccgaccagacttcagcattttcactgggtgcaatgcgataatcaagaacttctttaattccagtgggtgtaattcctaaggcaatataaaccgcttctctttgaactgtgtcacgacgcaaaggtaaataagttgcatctaagaataagcaaacatagtttgctttaatggttcgttgatgaaaagcttcaatctgctcagttacttgagcagtaatgttagaaacagttgtagctgaataataagaaccatacattttctcaatcaaatcagcgatttcacgagtggtaacacctttagagtaaagttgaataattgtagtttctaaagcatcttgacgacgagaataagctgaaagtaaatgattatgaaacttgccttgtcggtcacgcggcacagcaattttcaacttaccatattcggaatcaattaaccgaaagtattgaccattccgataattgttagccttaaaaccattacgttcataaggatcataaccgagtaacgaagttaactcagcttgtaagatttgattaatagctttttcaagttgttggcgaaaaagttctttaacatcgccatttgataatagagttttggttaaatctttggtaaactgttccatggggaatccctccgttttggtttggtttgacgatttaatcatacggggaagggattcccttttcaataggattttatttatttacacaaactattttatactctcatttaagaattcaacaattaaatctttatataaataaagaatgataccaaagaaaataaagaacgcaattgcattaatgagaatgctacttatcaagaaaatacttgtagaagttgccagcaacactgctaagaatactaataattttctacttaattttaacccgatgtatttttttaataatacatatcttcttatatctacaactaagtatcccgcacccaaagccaaactggcagcttgaacttgcaacactccgattgttgcataaataactaggatattaacaatggttcctgccatagtagttgtaaaaagatagcgatttttctttatagcggtcaaagtttcacctaaaaaagcactgattgatgaaaataatgtagcaactaaagcaagagaaataacttttagagatccactaaaagccgcattaacaaaatatggaaaaattattctaattacaggtagtaaaatagctatacctaatgacataaatttaatatattcatttattgcattggaaaaaaatttttcttgatttttatctcccgacccaccttttgaataagaaatctcttgccaggccatttgaaaggcctggtctactaattgaacaattgcggaaaacttattagcaattgcatataaaccattagctgcgctagataaattatttgtcaaaataactcgattgaaggccgttaaaaaccaccaagaaatggaattaattgccagaggtaatgaaaaaattagcatatccatcgttaaattccaatcaaaattttcttttttaaatacagtaaacacattaattccaaaaagtaaaataataatattagacagtgatcctaaaatactggcaatatataaaaattggtatccataatgcaggaatgcaataaataacacattaaacaacatagttatgatagaaccaattaaaccagaaatagcaaataaagtattcttagcaagccctctaataatataagcaaataattgttgtatattcaacattaatccatataaaaatacccaaaatatataattgattgacataatagaacctaaagcaaaagagaacacggcatataagatagtcgataccgagaatattataataccactgagaatcggtttacgtttatctgcgttaagttgataatcaaacatataccgcaaaataccactccagatatccaaaaaaagtacagagcttagaaaagtaatatatgcaatatttacatcgtaaataccataatctgtggggctaagatacttagtataaataggtaacatcagaaatgtgattgcttttgtcaaaacattaccaatcatataaataccagaggttttaataaatctaataaactctttcatcattaattccctattattctttccagtaacttatatatgcatgttttggatgacgcttattttttggtggcaactgcatatagtcaccatatagagccttaagataggtcttatagtcagatattgctctaaacttttttccctgaaactcaatatcttgataatacataaacgtagcatatggcattatctctcgagtagtatattcagatgaaatataaccaccatttttagcattggtgttatcatattgttgcagtttttttaaaactagctcatgccactcatcagtagacttattcaatctgttcgcttttataaatttaggataaaataatacgcgctttatagcttcacgaatccagcttccactactataataatataatcccggaatagacatatacatattattatttaaatctagtatctcattagaaaaagattgttttaattgtttattatcaggtattttatcaataggaaatatatcaataaatacacctagaccatttatattctgatctaatggtgacaaagggttacttatagttcttttatcatataatttagagaatccataataatatcctgatgtatgctcatccataaatccatattgaaaactatctacatttttaaatattttttttactttctcataatttgatctagtcaacattacgtctccatcatcatcccatggtataaatccatgatgtctcaccgcacctaacaagctccctccagatagagaatactcaacgtcatttgctcgacatattcggtcgaaatatgtgagtaattcattaactatagttttattatcacttttagaaatttctttcaagatatttttctccttttaaatattaccaagtatggggaaatgtcgttccctataccaaataaatagaaacattggatttctgtcaagaacgtggacactttttcatagaatttcttttttgatatatttttaattcagtaacaccattcgttaataatctcaaggcaaacctctgcgaggcgcttccagcggccttgacttattaacttcatggtattgttaatttggcaggaagcaataaattgcttccacacaaaaacacaacttaaatacttccacttagagctcgtcgttctgcctcatttggtgtaataaaattaagggctccatgaattctgcgactattgtaaaagccttcaatatatttgaaaagctggattctagctgatttaaaatctttgtatttgtctttttgtgggtaaacatcttctttctttaaggtcgcatgaaatgattctatacctgcattatcgtatggacagcctttatggctgaaagaatgtttgattttaagctctttaagccttgattcaaactcgttacttgtatattgagatcctagatctgtatgaacaatcagattacttggcttatatttaataattgcccggttaagagtttttagaactagttcattagtcatgtttaaactaagattccatgaaataatttttttcgtgtgcaaatcaagaattgatgagagatacagccaaccatcacgcaaggtgtgaatataagttatgtctgttgcccatttttgattaattgatttagttgaaaaatcacgatcaataatattttcccgttcttcaattttttgtttctttggatgccaagtatacttttttcgaatgatggagcacaatcctaattcatgcattaaattgccaataaatttttcagaaactttttcaccacaatgttgcagctttttagcaattttaggtgctccgtaacgacgtccagaagcaaaataaatttctttaatcaattttttaaagcgcttgcggcgcttttcttgatttgatacatgacaaatagaatttttataaaaagtagaacgtgggatcttaagggcgtgacaaacatcacttatattgtgattcttagctgcctggtgagctgcggtaatgattgagtctgaagctaattttttgcgaatatggtcaagactttttttaagatttcattttcctcttgaatcttttgataagcttttttcagtttgagatattcatcctggctgatgccagtttgcttatctttagaataacgtttaatccaagcataaatgtttttatctgaaataccatattcgctagtaagatattctaccaaaagctgtccataatttatactagctccattaatgaaacatagtacaacattctatttcaccaaatttcgatataaattttcccacttttttgattcaatttttgcatcatacccagcagctccagccatagttattccaattttttttctttccgaaaatgtagagttcttactacttttccaaacatggcctattgaatcacaccactcattcacattatcatcattaatattcaagaaactacccagaccaatattcgattccttagttatcttatcactcattaaaacatgcagtcctgcacattgtgcttcaatagccaccattggtaatccttcatatagtgatggtaatattccgatatccatcgcactgtaatattcattcatattattacgttgtccaagaaatacaatccgatcttccaaaccaagttcagtcaccttttgtttaagtgtcgtatctaatattccatcccccaaaagcactaatttaaatttgatatttttatctaccaattttttagctactttcaaagaaaacttatgattcttttctggcgctagtcgtccaacctgcccaattagcaaagtatcctcatcaatactcaactcatttctaattttggttctacattccttgttaaaagcgaatttgttgatatctattacatttttaatgttttgaaatgataagcgcttaaataaaaaatctccagcttcagtagaacaggctagtctaagtgttgaatttttaggtattgaatagctaaaaattttattccggatagttttaaaaaaactagaactaaatctagtattatgagaatgcgttatcctatttggaatttccatctttttcgcaataccaatacacattccccaaggcgatgttgcatgataatgtacaatttgataattttcattcgataagacttgttttattaatttttttatatagtatatattctttgatttgttttcgggtaaccagtatatcctaccacctagttgcaagatttcctcactatagtctgtgtatgccgtttttggaactacaaaatcaaactgaacctctttcctatttaggtttcgataaacattcataattacactcatacgaccatttcttcggtttaatgaattgggaaattgtaatacacgaactggctttttatgtaaactcatatgatgtgtctccttctaaatactatccatgacgttctttaaactcctacttccagaaagcctggtatggatgcttacttttttgttttctctttggtggtagcttcatatagttaccataaagtgcagataaatagtcatcgtagtttttcagtatgcttagctgcaccccctcaaaatcacaaagagtcaattcatcatatacgcttttgggtaacatttcgcgtactccatatgccggcacgcaaaaaccagcccacgtcgattcatcgtacttatattttttcattaatctcatcaattcatattttaaatcacttggctttttgtctctgttcaaccaatgctttttcattaagaaaaaaaatttcactattgatctccaacgtgtagtagcagaatagtaataggtcggtgcacatagtaactgctcttttttattcattaattcttgctgaaaatcttttcgctcttcaagagaatctggtaacccatcaattggaaaaatatctataaaaattccgaggcccactttttgatcaaatttatactttgtttttaaaatagttcttgaatcaaataactttgtgtacgcatagtatgatcctttatcagtatcaagaagtaatttatatttatccttttttttcttcaaaacatcaattaacttttcataatttggacgtgataaaagaatatccacatcatcatcccatggaataaaaccatgatgtcgaattgcacccaataatgagccaccacacaatgaatactcaatactattttgcttacaaatactatccacatatattagaatttgtaacaagatttgtttctgtgttagttgcgaaatttttttcattgaaataacatctactttctatccctgagataagcatacacatatcccaaaacttttttcggtagcaatcgtattatgcctctagttaaaatgttgtataagactgtggtaaggccaaaatatccatgtcgaagtgcctttatttgaaaaaaggtttccttaaaaaaatattttaaacctcctcgtctagcaacaaaattactgtctgctcttgcatgaacgagagaatcctgaacgttatagaatgtaaattgttcagccatcaatttcagccatagataataatcttcaaacagtggtatattcgtatagcaattcaccttttttacagctgataaatcatatacaactgtcatatggttcattggatttctatgtttagcatatttttttattttctcatcagtctctggaactttttttatagaaacttcatcattaactttcgttttaaactcatttgcccaagaacctacaacactaatattgggatttttattaaaaatttccaacatactttccattctatttttcaaattaatgtcatcactatcaaaccgcgcaacaattctgttactacaaatattcaatcccttatttaaggatagagctaaaccgagattattatcatttttaattcatataattatatttttatctctcaaattttacttcaatcaatataattaataaattcatcagacatcaccgagacattatctttcttcctcaacatgtccttatataataacctacgaattttattaggcaataaagcaacacttatctgtatcatcatcgctttgatattaaccaagttttgaattttttttagtttcattagcttcatacgaaaagatataatcgccgcaacatattctaagcctccacgccgcgaataaagattatcgttgatgcggctcattaataatttttggggaagattatgtcctatagccccgttattaatcatcctcgcccataaaaaataatcttcaaaatatgggcatgattgataattaccagcctgtagtacagacacgcgtttaaacataactgttggatggctaaatgggtttcttgagcttaatcttttctttatttctgtatcattttccggtaatggattactttgtaatctatttaaattctctgaaaactcaacactgtttgttcccaatatatcaatatttctatgagatgctaaaaaagcaatttgcttctcaaaccgtttaggtaatgcgatatcatcagtatccattctagcaatgtattcgcacttacattgacttattccaatacctaacgcataccctaatccatggttactttgtaatgagaggatattcattgaaacttcaagtttagctaatttcaatttaaaatctataattatatcccttaatttttgtggaatagggccatcctgaaccaaaactaattcagttggtaaaatagtttgatccaatatacttttaaatgattgcttcaaatactccgacctttccttagcgtaaacagacatcaatacactaaattttggatactctgtcattatctagctccatccccggtcactacaacacgaatcgtttcaaaaaaaatcccaatatcagttaataaaccaaaatgctctatgtagtacatatcattagcaagcttttgtgctggtgtatcgtcgtaaccaccatggacttgagcgtaaccgctcaaacctggtttaaccaacaaacgttgctcaaagccttcgatgtcttcactgaattgttgcgtgaatattggccgttctggtcttggaccaatcaaactcatatcgcctttgactactgaccataattgtggtaattcatccactcgagttttacgcataaaatgaccaacccgtgttacgcgtgggtcttctttctttgcccacattgcaccagattttttctctgaatcactatacattgatcgtagcttagttactttaaacgattggcccattagcccaacacgctcttggctatagaagcacttgcccggtgtttctaacttaactaaaatcataaaaattagaataataattgaagctggaatcatcaatagcgttgcgaagattagatcgaataaacgcttaaatggtaaatagatgtgatgaaacggttgatccaatttagctacaaaatcatgttcatctactgtttgtgtatgactggtttggttttccatgataagattccccctaatccgttaacgattcccaatataactttaacccagtcgtaatatcataatgcggctgatagcctaaactgcttaattgtgtaatatctgcatatgaatgtttgatatcccctacccgttctgctttatgaataatttgtagctcccgattaataatttgttcatacacctgaattacttgattaagactagtatgtttaccgacaccaacattaaaaacttgatgtacgatgttgctacccttcgtcaataggcataatgcttggattacgtctttaataaagacaaaatcacgcgtttgttcaccatcaccgaaaattgtaaatgccgattggtgtttagctgcttgcgtgattaatgacaatactcctgaatacggtgatttaggattctgtcgtggtccataaacattgaagaaccgtaccgccactgttggaatattgtatagttttccataatcaattacaaaccgttcagttgcaaatttatcaattgcatacggtgtcaacggatcaattgttgagtcctcacgtttaggtaattcaggattattgccataaacagccgctgacgaggtaaacaacacctttttaataggtaacttatgttgccgaatgatctctaagataaaaatattcgcttcttggttgatttgatgtgtttcatatggtcgcgcaactgagtcagcaacactggcaatggctgccaatagatagatatagtcgaactgttccttgagtaataagtctttcataaagccatgatcagtaatactatgttcataaaaagttactttaggtgagctaggtatattactggctaagcccatcgacaagtcatcaacgatcacgacctcatcgccatcttgtattaactgatcaactaaatttgacccaataaaaccggcaccaccggtcactaaaactttactcaattatctgtcctccaaatttaactattatctaaacaaccaaaacttctttttctctttaatatggtggtactcactcggctctaagtcgtcgccattaatgatctttttagcgttatcctgcatccaagtgaccatttccgccccattatgctgctccagcttagcgaacgccttctgcatccggaaattacggccctttaagttatgtgcgtcagaggcaaaaacaaagcctaagccggcatcaatgattcgctgcgtaaagtcttcgacctcggaaccaaaaacgcctaagtaactactagcggtgatttgcgtcaagcagccactagccacgaaatcatagagcaactcgtgcttcttttgaataccatgattccgctctggatgaacaattactggggtaattcctgccgcttgcagttcaaaaatcatctggttcgtatactctggcacttcaccgtggggaagctccaacatcaagtagcgattagtttcatcagcgaacaacacgtcatcatttttaatggcttgcattaagtcaccattgatatgcgcttcttgacctggaaagacaactaaatcgattttagcttcatccaacgctgcttgaaattctgcagtccgctgaatcacgtcagccttatgattggtatatttaccgtccatatggtgtggtgttaccaaaatatgactgataccgttatcgacagccacttgggccatcgctaaagcatcagccatggtaggcgccccatcatcacatcccggtaagatatgacaatgtagatcgatcatttcttatcatccgttccgtaatagccaccatagtagccaccataatacccaccgtagtaaccgccagaagctgcatctgtcacgcggttaagtacggcaccgatcaggttagcgttcacctttttgagtaaatcgcgcgcccgtaaaacagcccctttaagagcgataccttggggaaccaccaagatcacgccgtcaaccttacttgctagaatttgtgcatcggtgaccgtattaactggtggtacgtccagaataataatatcgaattgttcttttaagactttcagtaattgatccattttcgaggagttaagtaattcagacggattcggtggcaccggaccgcttggtaaaacgtacaaattcggtacttcagtctcatgaatactttcacttaaattcgcctgttttgccgttaaaatcgtggttaatccttgactattagaaacgctaaaagtacgcgcaatcgttggccggcgtagatcactatcgatcaacaggactttattcccttgatccgcccaagttacggctacgttagaactaatcgttgacttaccttctgaaggatcagcggacgtaaagagcagcgttttcagttgccgatcagcagaagagaactgaacgttagtccgaatcgttcgaaactgttcggcaatcgatgaggttggcttggttacggtgatcaaaccgaccccgtttttcatactgctcgaatccaactgctttttctttttaaataaagccattagttcaccctccgtcgtaattctgcactacgcggcggcaactcatcggttgtttccgcaacccgcgtatgatgttcgtgttgaccatgttgctgcccagcaaaggcccgcttcttaatgtcttcagcgggaatttctgaaacaatccctaagctggtcaaacctgcttcagccaaaaaggcttcatccttaaccgttttatccaacgcttcatttaagaaggccaagccaattccggctaataaaccaagcacaaagccgatggcaatattcaacggcaaccgcggtgaaactggtgattcattgaccgctgccttggagacgattgaaacgttattaacactcataatcgatttgatcttattacggaaagtctgtgccgtgacgttagcgattttagccgcttcttggggatcagtcgttttaacgtcgactgagaacacctgcgagttttcttgactactgatcgaaatttcgctgcttaacttaccaaccgtttgtccattacccaccgtcttagcgacgtctttcaagatcgttggactagtgataatatccttataagtactgatcatttgcacatcagcctgggtttgttgtaaagccgccgtttgttcacttgcatctaatttacgattaaccaataattgtgttgtcgattggtatttaggtgtcatcacgaagaacgtcacgacgaacgccaataacgttacgatgatcgttgatccgataatgatctttaaatgtttgcgcaacgtcaacagaatatcttcaatactcagggttgcctctgaatggctcgtttcgttcatttaaaaagctcctcctattacacactcttaaggtgaatccattagttaaatctactaataaattttagatgttacagttggtgaccatccctgtggctaaaaagtcccacaagaaatatgacccaatcatacatagatgacgggataatttatgcagagcataaatttgaatttttgatttgtttcggctacctaccgaacaagtttctttttgttttatattttctaataagcactatcattgattaaacttattgtttaattcactgtcattatagtttgtttacataacagtttcatgataaacacgtaacaaaacgaatattaattaccatgtgacatactgtgtcgcgttatttccggacaatcgttcgtaaatagtgccttttgtgcgattaattagtcgtttttttgcaccagtttcaaaatggctttcgccgtatcacttaagctgccatctttttgataattgcttagtaatacgacaccagttttaccatcctcggtaaaggctagcgcattgtggtaaccagcaaagtcagctcgactgactaaccggctgccatcaatagtcaaccgtccagtataggcagtccccgctttggcgatggccccttgatgcatgtacttttcaccgacaaaactactactggtgatgtaatgagtcaactgtgccatatcactagctgtagtatagagctgttttgaacctaactgaccattcatcgtttggaaaagcgtgtcttgcgtgaccgctgaagcactgtcactagccttatcataagtgaatgatggggctaacttagattgtaccgcggcgctggtgacaaagcctgtatgtttgaccccagctggttgcaaaagcgtgtccttaatgaatttctggtaggatacaccagaggcttgcgcaatgatgccagaaagtaacgcataattgactgtctggaagttatattgccccgttgtggtcacagtggcgtttgctagattccatgcgatcacgtctttgtttaactcgctagccggtaaaacatccaacgtcaagccagaagtcatttccaaaaggctgcctaccgtgacactagcatcggcattatctaataggtaatatttacttaccggtgtggtcagatccaacttgccatctttgactaactgcatcacggccgccgccgtcagcgtattttgtaacgctccgatttggtactccgtcgtcgccgtcttggtattattttgtggatcttgtccgtatggctgttgatagaccaacttgccatcctgaattaccgctacattaccgacgaactggagctgtttcaattgcgctttcagctttgtttcatcaatggtagaacttgcagtcttatccgttgttgccactggcgttgttttctccgtcttatcagtcaacttgtgaaaataaacgtgagctagactgtttttttgataaattgctgctacagccccaccaccgacgatcaccagcaaaaccagtaagatcgtcacaattcgtcctgctttatgtttcatgcgcacctccgccatcactgcaatcttcataaaaaaatcataaaaatatgcattatctatcacactataacataatggtatatacccaacaacttgaattcaacccttgtcataaggttgtaacaattgatgtcaacaaaaatggtcaagtttttacagttcttttttcacttctatataatagcaatattctttatcgaacatcgtcatttattcgtatcagctatatagcagtcacttcttattagacagttcaataagttatactatcgacttgaaaatattaaaattgactaaataaaaaagcatttgttttttatcaaaatatagtggcattaatttatgtgtattgaatacaattcttcaatcaaaaacagctgacggcagattcgccatcagctgatcttaaaatttcttcacttattccttcgccgccaacgcgctgatcatatccactcgcttcagccggaaatgcgtgacaaccatgacaataacagtgaagacaatagtcatgactgccgcaatgatgtagccttgccagccaatagtcagtggaaagatcacggtactagtagcggcttggcgtaaaataaacgccgttagtaagttgccgagcccgtacccgactacaatgccaaagatcgtcagcaccacattttcccgcacgatatagttagtgacttcgttgtcgaaaaagccgagaactttgatcgttgatagctcacgaatccgctcggaaacgttgatgttggtcaaattgtataacacaacgaacgacaacaaaccggataagaaaatgaaaatccacacgattggatttaatttagcggcttgttgatcgatggcgcgcttttgcttggagataaactcggtatgcacgactttatcactggccattagtttttttgcataggcgttttcttgagccgccgactgcttttgtgttttaactaggcgggtgttgacctgatagcgaccgctaaacaggtgattcaacgtggctttgctcatataggcgaagtggccagcgtaattggcggtgatgccgcggactttgacccgcgcggtctggttatccgagttggtcaccgtcactgtgtcgccagtctgcacgttcaacagcttagccagtttattgctcaacactagcccgttttgcggtagtttggtcgtcaaactaacgtaatccttgaatgcctgcggttgatcagtggcgtctaagctgacttcaccgactttttcttggctggtgctaacactgatcacatcagtgtacaaccctagcgagcgttggtagcgcggattttgcgctaatgtggtggtgacctttttcgcgttatcgtttaggctgaccaccgcttggtagtgcatgatctgctggaactgattgatccctgactggctgatcgagtcgcgaataccgaaaccagtcaggatcaaagccgtgccgccggcgataccgatgattgccatccacattcgcgccttaaaacggaatagattgcgatagctgactttttgattaaaactcaaccgccgccagataaagccgattcgctctaacaggattcgtttgccggctttcggtgcttttggtagcatcaatgccgctggtttttcgcgtaactctttggtcagcacgattgatactgcacccagggtgacgaagaaactgaataacgccgccaaccaaatggcgttaacgggataatccaacaccaccgcggtgtagacatactgggtcatcgctttgaacacgatcaacggcagggtattagcgccgatcaccacacccagtacggttcccaacaatgctgcagcgataccatataataggtagttacgcgcaatttcccatttggtatagcctaatgctttcagtgtgccgatctggccgcggtcctcttcgatcatccgtgtcatcgtggtaaaggtgatcaagccagcaatcaagaagaaaaacaacggaaaaacattggcgatggcagcgatccgcgtcgtcatatcgccataaccctggaaaccaggattgcccgcccgtttggtgtaagtatacgtcggtcgttcaatcgcagtcgcctgttgccgtgctgcagtcaatttagcttgggctggtgccaattgttgtgtcgccgccgttgcgccgatagcttgagtcagctgggctttttgctggtcaagttgctgttgttgctgcttgatctgtgctaatgcttgttgctgtaaattagtttggcgtgctgttgcccggccacgcaaggcttttttaacggcagctagtttgcgctgggcctgctttttgtaggtgctgctgaaactgctgtgattttgtaactgcgggaagtgcactgataaagcagtgtagacgctggccttgaaattagtggccggtaaataggcaaagtaagcgacactaccatcgccaatattggccgcgccgcgttcttcgtcgtcgacaaatagcggcgaagtcacaaaaccgacaacgcgataagtctgtgtttttaggttattatttttaacgcggtaagtgtcgcctagttggtagcctttgcttttagctaactgatccaaaacgatctcgtcactgcgctgcggtaaatggccacttttcaacttcaattggttttgcgtatcgcttttgcggtaagcaaataattgcgccacgtcgctacgcttttggtccaaaatgtagactgacttttccggctgcacctgagcaccgctgacttttttgacgcgctgcacatccgctcgggtcaagcccgcggtggacacaacccgcaagtcgctaagcttttgttggctaatataacggtcagcactgccatacaggtcaggactgaccgccttgataccgacaaatagtagcacgcctagcataatgatcagtacgatcgcgataaaacgacctaacgactgccgcactgaccgccataatgattgacttaaattattcttcattagtttgctcaccactcaatatcggcaactggcgtcggctgcggatttaatttgatcacacgcacttgcgcatcgttgatcttgatcactcggtcagcgatcggtgcgatcgccgcattatgggtgatgatgatcaccgttttaccgcgcttgcgacaaacatcctgcagcagctgcaacacttgtttaccggtggtgtaatccaacgcgccggtcggttcatcggctaacaatagcttagggtttttcgccaacgcccgcgcgatcgccacccgctgctgttcaccaccggataattgtgccggaaaattttctagacgcgcacctaagccaacctcacgcaatgtttccgctgggtctaacgcatctggcgccaccgcactcgccaactccacattttccagcgccgttaaattagggatcaaattatagaactgaaaaacaaagcccacatcagtccgtcgataagccgtcaattgtttttccgtaaactgggcaatatcgacgccatcaatgttgatcgccccttccgtcggtgtatccatcccacctaagatattcaataccgttgattttcccgcaccactgggtcctaaaataatcgtcagttcaccttgttgaatgtcaaaagtcagatcatgattagccacgatctcggtctcgcccatctgataccgtttggattcgtgcttcacttcgatatacgccataattgcctccgtaatttagatattatcgttattatatgggtgtcaaattgcgaatgcaatcgataatggcacgagttaagtgcgtttttgccaccaaattatttcaaatctgtttcaggtaccacgtgtcgcaagccgcatgagcaggcttggccaatagcatatccattaacgcgtactcgtacttttttagctaatcggctgaaatcggtattctgaccataatgttgatccaactgattaaatttgcattgttccatatgaaacataaattcatcacgtgtttaaaatcctagctacccctttctagtgaattttgatacagttaagatggctttaattcaattaagtaagcaagaatttgaaccacgctatttcattcaaaaacaagcaacaacgaaacgacactgaaggcagtgtcgttttttcggcacacaaaaacccgccataacaatagtcatgacgggctaaaaaggagtaaaggtgcgtttatgattgggaggtcataaacgcttttcttttactttggaggagtaaaatgaaaaaatgttagtttcaagctcacacttaaaactgttagggttgttaggttgtttgggaatatcaataaggtgggttccttattgatatgtatctataataatcaataaatgtgaagaaagtatgaatttttgcttgctaaaggcttaagaaacgacaaagaaaccgctacccgtaattataattccataaaaagtagtactagttgccagacgcgaataagtttggcataatgtaagcaattacattatcgctatacatgtgctttcacgtgaacattcacacaataatttattggaaagaagggtcgcgccatgaatccaattatgcatacttatttattagagaatcacatctcgttaacggatatcgcgcgtagcggccaccttgaactgactacagttgaagaagtttgtcgcgggccattgaaccggctaccgatctatttattaaagaccctagctaacacagttgaacaatcgccagcccaggttttggaagatctgctcaagctagaactgcaacacaccgtactattgcgcactgatcttgatcatttaacgatcatggatgtgccctttgccgatcaagccagctataaacgcggccgcgatatgctgctagcctacattcgcgccggcttttcgccgtcagttcgtgacgttaaaaccgtgcgtagcgcattataacgtcagcatagttaacgcatcattttacgcatcgtaggttggcgcttgtggccttttacgtggcgatttttgacgtgcacgtgttggcgcggatcgacaattttaaaatggcgcatttcaccaacaaaggggcggcctaacgccttgattcgtacccattctgccattgcttgggccattgcttgggccgttttagcgcgctctggctggccttcctgctgggcttcattgacaacactcaccgtcaaataggtcatcaacttctgattatagcgcaacaactcatcggtcagcggtgcatccttatattgattaaataacttctcaacgtaccgcatggcatccttagtgtcatgcggttgataataacgtccttgatcagccatgatcgttccttctttcatgaaaacaagtgcaacgccgcttgcataatagccagcgccactaaaataccggcaatcgttaaatatagtcgtttgtgcatcatcatgatcgccgcaaattcgcgtaaaaacgcattcggtaagaaataccgcgccgtccgtgcgccaatcccattagcccgaaaaccagcttgccgcgcaactaagccggcccgaaaaatatgatagccgttagagacaaaaatcgctcgataattagccccaaaacgctgcgtgatcaactgtgctgaaaagcgcatattctccagcgtattgcgtgattgggactcaactgccgtatccgccaatggaatacccagttcatgcaccgcatactgttgcattgccaccacttctggcaggcgttcatcgctgccctgaccgccactaaacacaagtaacggtgtggggccacctacaattgcttgttgccggtagtgcggccgattaagctgatagaccaacgacagcgtcaaaaaattccacacattaaggaaaatatagaacaacaagctaggcatgaagctaaatagcaacactaatggcgagggaattaccccttgtagcaccagcgcctgccaaataacatagacgcttaagcccaacgccaaaagtaagccaagcaaattggcaagtgagtggctctcacggcgccaaacttggcgggcgttatgcaagaggaagataatcagcccgtagattcctaatgcaaaagcgactagtaaaattaggcccagcagtaatataggaattaatagccacatttggccactgttgacagctacgatcaacagccagccaccagcgcaaagcacgaaaccatttaaccagataccattactgagtcagcgacgttcgtggaaatagctagccaagccgatcaccattaatagtaacgccaaactaccagtcaaccaaactgtcggatccatcggtttccccctactccataagcgccttaccagccgccgaatcgcgcgtcatgatctcacccgtactaagcacaattaaatctaacgcatcatcgactttaccatcctcacggcgaccctgaaccacaaaatagtgctggccatctttttcgccagttgtactagcctgccacgtaattttaccatgaccgtcctgttcgccgcgttgctgcttgacccaatcaacagcctgcaccggcgaactgatctggttttggctgatcgattcagccgctgcactcaccgattccgcctgactactaaacgctgcgctcgctgatgacgcttgactgtcagctttttcctgcgattctgattcggcgatcgcctgtgactccgattcagcgatcgaggacgattcggtgctagcgcgcactttatccagtgaactttcacgggcatcaagtacactagcccgtctttccaaacgcgctgaagatgacgctagcaccgctttttccttccgtaactcatcttgcccgcagccgctaagtacaccgaccataattaacaacgtagcgccgagtaaccaacgtcgcatcgcattccctcctttttgaaactctttttaaataggatagcatatcagtcttgcttttttcgcataatttgcagccgttgtgccatgacccacgtcgtcattggcactgtcagaatcacactgatcaatgaaaagagcaccaagatcaactccacatctagcactttattattcagcagttcaccccaggtatactgcagatcagcgaaccaaataaataggcccaaaaagccaccaaaaaagccgaaaaataacgtattgaacgtagtgccaatgatttgttgacccacatgcatccccgcagtaaagagtgcgcgtgtttcaatagttggatgctgctggatcaactcacttaagcccgcggcaatcgccatcgccgcttccgcgatcgcccctaatgtgctcaaaactgcggtggcgatcgaaactttaacaaaattaatgccgaccagtaacgacaagccttctagttcatcactatcttccataccgaaaccttgtacggcggcccagtgttccaccggcacgatcaacgccaataagattagcagtaccgaaaccgccgcaaaaaaggctgtttgcgtagtcattaagtcatcctgacccacaaaaatcgtcaacgccaacattaaaatgcctaagatcagcgtcactaacaatggtgaaaagtgaacggagatcaacacgatggccaagaataaacagccaaaattcaaccatagacttaaaaatgccagcgcccctttgcggccaccgaccagcaccatcactgccaacagcactaaacttaatgccatgatcgtactcatttaactgcacctgctttcgtcaccaataaccggctcgccaggaaactgaccaccggaatggcgagaacaataccaattccgctgatcaaactttgcgccatccctaatgacatggtcatcgaaaaagtataaccccagctgttaccgttttttagtaataataatgcgatcggcatcgtttcggcgatgaaaatcagcagtaaaacgctgatcaagggacccatgattgcggtgccaacttggcgacctgcttgaaatagttccagcgcgctgatttccggtttatcggcttttaattcgaatagagtggcgacaatatcagttgactcatccatcactgcccccaatgaaccgagtaaggtcgccgccaaaaacagcggctgcggtgcaacttgagtcacataatccatcatttcataatagatacccttgtgctgcgtcaacattaacaccagcacgcttaatcccattgatagcacagttccactaaccgtcgcggcaaaagtgatcaccatttgcttggtcggcccgaggatcagccataaagtcagtaacgcaaacaccaaggctaagccaccgaataaccaaagaaatccattactatgtaacaccagatcaagttcaattgccagaaagaaaatcactaaattgagcagaacgctgagtaatgccatcatgccagcacgatgcaacatcagcactagcaaaacgacagccaaccacaacaaagttagtaaaacagtatcgcgttttaaccctttgatcagtatgcttttgcgggtcatactaatgaagacctggtcaccgacgcggtatttttgatcaaatgcgcctgaggccgtgtagacgttttttacgtggatcagctggccgcgctgcgaaccatttagtaagcggccagttaattgttgtgtatactgatgatcacggttattgaattcatcctctgttttggtcatgcgtgtgactttactggccgtcacttgcatgatcgactggcgataaagtggcgccgcataacgggtgccaatcaccagcaacagcccaccaacgatcaacaagattggtcgccaccagcgccgaagttgtttacccatcaaatcatctcttatctctcaatataattttagtctaccatagagtccttacgattgaattaagttctgaataacagtgaactactccgggaataaattcccgggcttctaggaacaccgcatacttgcctatcactctttgaatgatacgtagaggttacggctttttactaagggctgttccagcccatttcagtcggtta

SEQ ID NO: 624 - DNA, 8369 bp, Unknown
  Metagenome-assembled genome
agtagccctagggagccccgactgctgataatcttcaattaaattgagcttctcgagaactgtgaacttagatctggacatacaaaaatccctccataatcatcagatgaattattgtatttcatctgacaaccacaaagggattatcgcattttatgagttttattgatccttaaatcagcatcgataccttgacaaataccttgatttctaatacactgagtgacaattgttttaatcaggtgaacagagagatcaataccggctgtgaattgatccacttgaatggcgtaacatataggttgatcgcgttatagatcattagaggcaattcattgaattgcgaaacttgggtggaacagcgttgaacaaacgcccctagtgcaaaatagtctgcactgggggcgtttttaaataccgaaaaatagtcaccagtcggaaaaatataaggaggagctctcttatgcaagatccacaaaaattatcacgctcgctgaaaagtcgacatatccaaatgatcgccattggtggcgccattggcactggcctatttttaggctccggtactgccattcgtgctgccgggccgtcaattatcttgtcatatctgatcgtcggcgtgttctgttttttcttgatgcgggcaattggtgaactactattatccgatactagtaaaagttcatttctcgattttgttaaactctatttaggcaaacgaatggagtttgtcgctggttggatctactggctatgttggatcagtttggcgatggccgatttaactgctaccggaatctacgtgaaatattggttccccagtttcccccagtgggcaacaccactgatcattatattagttctcttgatcaccaatatggtcaacgtcggcttatttggtgaaatggaatcctggttctcaatgatcaaagttgtggcaatcgttgctttagtggttgtcggcgtcgtgttagcggttatccattttcctgttagcaccggacatgccggcttcgctaatttggttagtcatggtggtttcttcccaactggggcggttggtttcttcatgtccttccagatggtcgtcttcgcctttgttggtattgaaatggttggtttaactgctggcgaaacaactaatccagaaattaacttgcccaaagctattaacagtctgccgattcggatcgggttattctacatcggctcaatggtcgcaatcatgagtgtttacccttggaatcacattacgaccacttccagcccattcgttcaggttttctccagtattggtgttgtcggcgcggctggcatcttaaactttgttgttttaacggccgcaatgtcagctactaatagcgctattttcagcacaagtcgaacgctacatgctttagcacgcagcggtaatgcaccaaaacggttcaccaaactcggccgcaataacgtacccaacttggccctacgcttctcttcagcaattctatttgtgatcgtcattctaaattacttgatgccagctagtattttcaacctaatttctggcgtttcaacgatcaactttgtttttgtttggttgattttactttggtgtcacgttaaataccgacaaaaaaatccccaaggctataccaaatttagtatgccgggttacccaatcactgattatctcagcatctttttcttcgctgctgtacttgttttcttattattcgatccgagcacgagagtttctgtgatcatcgctttagtctggttcgttctgatgtttgttgcttatcaactcatgcagaaaacaagtcgtaaagcttgattaacacgcaaaaaagcttcctaccaacaataaacgaggtaggaagctttttttgattaaccaagtaacgatcctcactatacccgttcaaattgcttgaaagtgatacgtataagtatagaaatcagctttgacccacggcaacgttaagccgacccgcattaattcatcgccaccaaatatttgcccagaatctgttcgataattccgtttcgggtctagataatgtagtttaaaaacaggatattgctgtgctggttgcaccaatttttgaaaaatcaatacattaaattcactttgatcagcattaatgattagccaagcttgataattaatcgctgctgtttccagccgatagaaccggccaaattgcattagcacgcgggtctgtttggctgtgctgatctgttccattattgcttgctttttattttctgatagcttagttaaatccaattcataccccagattaccaaatcgcgcaacatcaaagcgcgtctgtaagctagtttgccgaccgacctgctgattaggcaccctactaacatgcgcacctaaagtgatcggcggatatagcaaactatagccattttgaatcataacgcgactaagcgcatcggtattatcactagtccaagtttgtggcatataatacagcattcccggatcaaagcggccaccaccgctggaacagccctcaaataaaacatctggaaattccttcgtcagcactgctaaaattcgatacaaccccaacacataacgatgccaagcttcgccctgctgtatatcagccaactcagctgcgtagacatcagttaaatggcggttcatatcccatttgatgtaatcaacttgcccagtacctaagtatcgccgaaaaacagtgatcaaatagtcttggacatcatttctagttagatctaaaactaattgacaccgactttccgttgccggatatgccgggacctgtaaacaccaatcaggatgacgatgataaagatcactattacgtgaaaccatttccggctcaaaccataacccaaattgaagcccgagctgccttatttgttgtgccaatcgactaataccggctggaaatttagtttcatccgcaatccagtcacctagtgacgatgtatcatcgttgcgtcctttgaaccaaccatcatccaatacaaataattcgatacctaatttggcagcttgccgcgccaagtcaaggcacttttctgctgtcaggtcgaaatgcatcgtttcccacgtattgatcaaaatcggccgtgatcgtcgtctaaattggggagcaaccaaatttgcttgatataaatgttgaaaattttgactcatcccatttaagccactcgtactataatttatgatcacttctggagcaacaaaggtttcctgtgccgttaattgccaagtaaatgtatccggattcaatcctagctgtgcacgaatattaccatactgatccacttcaactgcccccataaaattaccactatagattaaatgaaaagcgtaaacttcaccattatactcggtcgtttccggcgccataagcgcgaaaaaaggttgatgttgtggactgctagttccgcgcgcactttcaattctttgaataccgggatacagtggatgtcggtttaaattagcttccttcgtatgcgccccatacagtgatagccaatcaagtttttgcggaggtaaatcaagcgacagactttgacaattttcaatcataaccggttgctgaccacaattagtcacttcttgatgcgttgcaataatatcaagtgcctgaaaaatcgtataaaaaagggtcactttcacgttcgcaatctggtcaactaattcaattttcaaagtttccgctgcagctacttgctctacataggttgctggtaatccagttagacccggtttaccagctaaaatctcataaccggcgtagcttaagtcgatatggcggcgttgcccactttgcacaattgttaagacaggtaatctataatcaccagttcccctagtcggacaagccaaaggaagctcattgaccgaaaatttacggtcagttgaatctgggttactggcaaaacccctgtcagtcaaccgcaatgaattactgtcatgaaaactgcgaatagctgaacccaaataacgctgcaaaacgtatttctcacgtataatcgccagcacaaaacttattcggccattactcaaatgaaaactggcttgccgttgatcaaattcaatcatgtgtcgatttcccccaagtattattaaatctagaaacttatttctttactcagtatgaaaatatcctaaaagacaacactactgcgcaactgacttttaggataaacaccaatattaaattagctcaagaataaaggcttcatacggctgaatattttcatccagcgcacaacgatgcgtattatttttaagcttaaagacaaattcggttgtgactaactccgccaaacgagtgatcggtacgatttgagctgacagattagcaacgatcaaccaactttgttctgccgttacccgtcgataaacaaacaactgctgatcagtcggtaattccaattgataccgtccagtagttaaaattggaaactgatgacgtagctgaattagttgttgatagtatttaaaaatcgaagcgtgttgttgccgatccgtagccacattgatctgacgataatttggatttagttgaaaccatggtcgcccgatggtaaaacctgcgttggcactcgtatcccattgcattggcgttcgcgcatgatcccggctaagcttttgcgctgcagccaagaattcagtcgctgtcatcgtctgatcttgttccacatattgccgataattggtcgtgatctcaatatcttcataatccgccaatgcaaacgtagcattggtcatgccgatttcttcaccttgatacacaaagggcgtaccctgcataccatgtaaaaccgttgcaaaagcagttgcactttgataacgatatttttggtcgttaccccagcgcgaaacgatccgcgcacgatcgtgattttcaaagtacagcgcattccagccatgatcgcgtaaattatcttgccattttgttaagctatcttttaattttaaaagatcaaagtgatcataatcccatttaccattgactccaccagctttacggtctgcgcgcatatgttcaaatgaaaagaccatatccagctctttacgttctgggtcaacaaacttgcggacatttgctgctgtagccccaggtgcttcaccaacactcatcatattaaacggcgccaaaacttcccggttcatttcttgaataaattcatgtaaccgtggaccattattctgatcacttaacacatatggtcgattcagcttatctggataatcagtgaagtgctgatctttagagatcgacgagatcacatccatccgccaaccatcaacaccctgcgccttccaaaaccgcatcatatcgtaaatcgcttggcgtactagcggattttcccaatttagatcgggttgttctttagcgtaataatgcaagtaatattgttgtcgttctggcacataagtccaggcagaaccgccaaagttggcggcccaattattcggctcactaccatccgacttaggatcacgccaaatataaaaatcactgaaataattatgccgtgattttttactttcttggaaccaaaccgcttgatctgaggtgtggttggccactagatccataacgatctttaaatgtcgttgatgtgccgcagcaatcaatgcatacatatctgcattagtcccaaagcgctgatcaatttgccgataatcactgatatcataaccgttatcgatctgcggcgaaacatagattgggctaagccacaactatcagttagcagtcccacaacggctgagctcaccaaaaaattttggcaattaaacgccatagattaaggaatgatacacgatggtcaaactaactgacgtcgccaaattagctggcgtttccgctactaccgtttcacgagtgatcaataactacggttctttatcgcaacacactaaagataaagtatttgccgcaatgcaggaactaaattatcagcccaacagtctagcacgttcgctgcaaggtaaggaaacaaaattaatcggcgttattttcccatcagttagtaaccctttttttggtgagctcgtttcattactagaaagccatcttttcgccaaaggctacaaagtcatcttatgtaatagcgcggagaataaagaaaaagagcgggcgtatttacaaatgttgattgccaaccaagttgatggtattattgccggtgctcataatctaggcattgcggaatatgaacgcgtcggtttgcccatcatttcgtttgaccgtgccttatcaaatacgattccgatcgtcagcagcgataattataccggcggcgcattggcaacggaagcattactaaaagctggggctaaaaaaatcgtcatcctttctggaatcaaccagccgaattctccaacgacggaacgcttaaatggctatgccgatactctaaaagcagccgacctacaaccaatcactgctgagatcgattttcatatcgccgctaatatcaaagccttaaagatccatcagttactcgttgatcaaaaaccggacggtgtcttttgtaccgatgatctatcggcacttttactaataaatgaagcgcaaaaattaggcttggctatcccaactgacttacaagtagttggctatgacggtactaaatttattcaagattatcatcccgaattaactacgatcatgcaacccatcgatgatatcgctactttattgattgatctgttgctacaaagaatcaaagaccaccatgtagctttacaaccacgctaccaattgccggtcaaattgatcaatggccaaacaacgcgttaagttgaattaaacacgcaaaaaagcttcctaccaacagtaaacgaggttgcgataatccctccataatcatcagatgaattattgtatttcatctgatgattatggagggattattatatgccaagatccaaactcactgcccttgaaaaactcaaactgatcgaggcgtttcaacagtcaggtatatcgagaacgccacttttgcacgacagcgtggaatcgatgagaaagcgcttggaagaagccaaaaagaacatccactatagcaaggaattgaagctcagaacaaacaaaaaagcaaccctactaaaaattaatttagtaagattgcacttattcgattgtgtccatattcggacatcaataccggcgatcggggtcgaaccgatactcccgcgagggaactggattttgaatccagcgcgtctgccaattccgccacgccggcataatatttatttttaaaagcatggataccattacctttttaatacaaaggcggtaaccggatttgaaccggtgatagaggttttgcagacctttgccttaccacttggctataccgccatcatcaaggttcaaataccttgaaacttttaaactgggatagctggattcgaaccagcgcatgacagagtcaaagtctgttgccttaccgcttggctatatcccaatatggtacaagggcggtatgtgggaatcgaacccacgcgtgccggagccacaatccggtgcgttaaccacttcgccaataccgccatggcagggatagtaggagttgaacccacatcaacggttttggagaccgtgattctaccattgaactatatccctattataaaaatggaggagagtggattcgaaccaccgaacccgaaggagcggatttacagtccgccgcgtttagccacttcgctactcctccataaatggcgcgggacagaatcgaactgccgacacatggagcttcaatccattgctctaccgactgagctaccgagccatatgaaaatattataagcggtcccaacgggactcgaacccgtgatctcctgcgtgacaggcaggcgtcctaaccaactagaccatggaaccaatgttgatggaggttacagggatcgaacctgtgaccccctgcttgtaaggcaggtgctctcccagctgagctaaacctccataatgacccgtacgggatttgaacccatgttaccgccgtgaaagggcggtgtcttaaccacttgaccaacgggccagcatagctgacggagagtaagggattcgaacccttgatacaggcaatacccgtatacatgatttccaatcatgctccttcagccgctcggacaactctccatgactcgactccggctgtcggactcgaaccaacgacattctgattaacagtcagacgctctaccaactgagctaagccggaattataaacagcgtggcaacgtcctaccctcgcagggggtgctcccccaactactctcggcgctaagaagcttaacttctgtgttcgacatgggaacaggtgtatccttcttgctatcgccaccacaccactttctg

SEQ ID NO: 625 - DNA, 12171 bp, Unknown
  Metagenome-assembled genome
gccacgtaaaatcttcggctacaaatcggctaatgaattcttagctgaacagttgcttgcatgaccaacacctagaccacttataagtgaaatctagaaagtgttgcacttgatttgacaattcgggaaaaacattaatcacaaaattaaaaatgccgtaatgataacattttagcgtgaatttttttggtgggggacttagtttttattttgagttgaggttcttatttttatggcatccgtagctgctatggaatgggcatcttcttggaactgagctaaaaattagctcacgatgttaatcgtgagcgatccaaggcactaactttgtttcgggctagtcgaaatcaccgcaaattaagcgcacatttgtttgtctagtgtatagacagcacccacttttttctttacaattagagagatgttcgaattttaatcaatttattttacggcgtgcagacactgtggctagacttttacttagtgattagtttaggatgagcgtagtcaaatggataatgagtatttttaacgataattgccgttaatttatagtaggcagatttttgcgaatacgtttgaaattcatgatcatatatttatagaaaatttaaaattagttattatttgaggaggaacctaacttgtttattgatcaagttaaaattacagccaaggctggccgcggcggcgacggattagttgctttccggcgggaaaagtttgtgccccttggtggaccagctggcggcgatggtggccgtggcggtagcatcattttgaaagtcgatgaaggcttacggacattgatggatttccgttacaagcgcatttttaaggcagctagtggcgaaaacgggatgaacaaaggtatgacggggcgcggcgccaaagatacttatatcagtgtgccgcctggcacgactgttcggcgcatcgatgacgatcaattgctcggcgatttgactgaagatggccaagaattagtcgtcgctaaaggtggtcgtggcggccgtgggaacgtacattttgcctcaccgcgtaatccagcgccagagatctcagaaaatggtgaaccaggcgccgaagtacaaatcagtttggaactgaagttattggcggatgttggtctgattgggttcccatcagttggtaaatcaacgttattatcggttattactagtgctaagcctaaaattggcgcctatcattttacgacgttggtgcctaatttagggatggtcagcttacccgatgggcggagttttgcggcggccgatatgcctggtttgatcgaaggcgcggcgaacggtgtcggtcttgggatcgagttcttacgccatatcgaacggacccgcgtgttactgcatttagttgacatgagcggtgttgacgagcaggacccatttgctgattacgaaaagatcaatgctgaattagctaaatatgatcctagtctattagaacggccgcagatcattgtggcaacgaagatggatatgcccgatagtgcggctaatttgaccacatttaaggctaaattggcggcggctaaggtggacgcccccatcttcccaattgccgcgatcgcccatcaagggttaaatgagctgttaactgcaacggctgacttgttggaagcgaccccagcctttccaatgtacacggaagaagcagtggcagctgagaaacattatgactacgctgcggatagccaacctggctttaccattgagcgtgatcctgatggggtctttgtcattaccggtgaaaaagttgaacgtttgtatcaaatggctaacttggatcacgatgacagcgtcatgcgctttgcccgccaattacgtggtatggggatcgatgaagctttacgggcaaaaggtgccaccaatggtgatttggtccaaattgatgaatttacttttgaatttgttgagtaattttgaattaaaaaaataggttgtggcaaattatggaacataaaaaaagattggcaaacagccgctatatcaccggcatcaatggcttgcgggccattgcggtcattggggttatcctgtaccatttgatcccatttaccgtgcccggcggctttctcggcgtcgttattttcttggtgttgacgggctatttaattaccgatctcttgattcaagaatgggatcaaaatggcaaaattgggttacggtccttttaccagcggcgaatcaagcgactttatccggcgctagtgacgatgctttttgctactgcggcctatatgacgctgtttcagcgccaattgctggcccagttgcgcgggattctctggagtaatttgctctatgtctataattggtggcagatcctgcacggtcaatcttattttgatcgctttgccaataacgagtcaccgttcacgcatttgtggacgttatcgatcgaaggtcagttttacttaatttggccagtgatcattattggcttgttgttgtttaataagcatcgccatcaagccactaatattttacttggtctaggtattttatcggcgctgttaatggcgttgctatatgtgccaggtcatgatccgagccgggtgtactacggaacggatacccgggcgtttgccgttttattcggtgcagtgttggcttttatttggccgagtaccgagttgaaaagtaaacttggtcacgcgcagcagcgtctgctcgatggcattggtttgttgacgttggtggcgatcattggcatgtattttttggccgattcgcaaagcgccttcgtttatcgcggcgggatggtgctattttccctgctagtggtgctattagttgccgccaccgtccatcctggggcccacgttaatcggtggctgaccaatccggtgttcacatggatcggtaaacgtagttatggcatttacctgtatcaatttccagtgatgatcttttatgaaaatcaagtgcacaacatcgcgcattggccatggttacacaactttattcaattggcgctgattctagggttaagtgaactttcctatcgttatgtggaaaagccactgagtcacgttcaatggcaccaaccacgaacgtggcggacaactggctggcagcgttggttattggtcccggcgttggcgattttcgcggttggtttagttggcgctgcgcaagcgccggcccatgcaaccactggtgaaacgccattagcgcgtaatattaagcgtaacgccaaaaagaattctgagcataatgcgaaagtgatcgcacaagctaagcaacgtaaagcggcggcaaagcaggcgtcaagttcgtctgcggtgtctagtagtagtgccgccagcagcagtacgccagcagttggtaatttgaccagtgcacaagtacagcaagcccaacaactatctatcgtcggtgtcggcgattcagtcatgcttgatggtgtggacgcgctgcaaaagatttttccattaatgatcgccgatgcatccgtcggtcgccaggtcagcagtagtcaacagatcttagctgattacaaggataagggcgtgttggctaacgtggttctgatcggcttaggcactaacggggcgtttaccgatcagcaattggatgacgtcatgcgcacagtcggggcacagcggcaagtattctgggtcaatgtccgcgttcccacacggagttggcaaaatacagtcaacaactcgttggcacaagctacgaaacggtggcctaatttaacggtgatcgattggtacaaggaaagcaacaaccatccaaattggttctactcggatcaagttcacccgaatgaaacggggaaacagcactacgctgattttattgcccaacagattctaaccaaggtcaagcattaaggttaatttaagttagtcgttttatactggggacattagatcgtatttggaaaataacgcaaagtgagcgaaaatgtgattgaagaagcagatcattgcgtataaccggaacgttttttttcaaacacgctggataaaatgaggtgggaaaatggttaaaagtgccaaggcgttactcgttgaagatgatgtcgagctatccgctagtgtgcgcgattttatcacggacttcttggatgttgatcaagtttatgatggcgaagaaggcgagtttgcggctagccaagggatttatgatctgatcattttggatttgatgttacctgggaaaaacggctacgacgtgttaaagtcgctgcgcaagcaacacttggaaacgccggtgctgatcttgaccgccaaggatgggatcgacgataagctccacggcttcaacgttggtgctgatgactatttgaccaagccgtttcatcgtgaagaattgattgcgcggatcaaagctttattgaagcgcagcggtcatttctatcaagaaaacgtgctgacgatcgaccagttaagtattaatttgcaaaatcgtagcgttacggtggcggatgatgagattcggcttaacggtaaggaatttgacttgctagtttatttagtcgagaaccaaaatacgatcatcaccaaggaacaaattttcgatcgcttgtggggctttgactccgagaccagcattacggtggtggaagtttatatgagtaatttacgtaaaaaattgaagccgtatcaggcggataaaatgatcaaaacgttgcgcaacgtgggctatatggtggaagtgaccgcatgaaagttgtgaatcgtaagcaacaaatcagattatttctcactgagttgatcagctttgcggtgattttcttatcactggggacgatcgtttatctgtcgtttcagcacgaaatttaccgtaatgtcgatcaaggtctagagatgaagcgcagtcagctgttgctggcgcaatttaaaaataaggcgaagctcaagactaatgataaaagcaaagcggtgcagcagcaaaagcaaggcacaccgccgccagattttcggatcaattttttgatctataatagtcagggtaaagtgaccaataccgaaatgttaggtgatcgctatacgctgctgaccggggtcaaactcaatcctaatcagcgggggaagatcgttaatctgaccaccgatgatggcagtaagttccgttctttgttagtcaaagtgcctaaaactaaccacgcgaagttgtacgctggtaagtacgtgcagatcattcaaaacattgattctgaagatcaagcaattcaaagtttccggagcgttttgattttgacgatgctgtttttctggttgttgtcgattttgcttagctacttgttgtcgcgctggaacatgcggccaattctgaagtcctggcagcagcaacaggattttgtggcgaatgcggctcatgagttgcggacaccgctgacgatcattcagagtaaaatggagttattgctgactaaacctaacgaaaagatcatcagtcagatggagccgatcgcgttatccttagcggaaacgcggcgattaaatcagttgactcgcgatttgttaatgttggcacggtcggattcaaatatgacccagatcacgcgacagccgacaaatacagctgagttcttaaaacaagtgatcgcaccgtattccgaaattgccgctagtcaggacaaaacgtttattgcgcagattgatctgaacacgcaacaaatgatcgatcagaagcggatccaccaattattagtgatcctgctagataatgcgctgaaatacatgcagactggggatcaagttgaatttaaggcttacgtgcacggcaatcgctggcaggtggaggtcgccgataccggtatcggtattgcgccagaaaatcggcaggcgatctttgaacgtttttaccgcgaagataagtcacgtagccggcaaactggcggcaatggccttggcctagccatcgccaaatggatcatcgacagccatcaaggcaccgtcaaagtgaccgccaacgatccccacggctcacggtttatcgtcagtttcccgatcgaacacattaaaaaagaacatcattagaagcgttaagcgcgagaccaagtaccaaataggctcgcgcttattttgtgtgattggcacagccctgattctgttttattctggtgctgacgtatggaacgcgtgcggttttggcttgccgtactagcttaatacaattaactgtgaacgacagtttaatagtttgccactttacaattaaattgcgtggttaactataaacgtcgataaaatgagtttgtgttcctgtatacgactttgtagctggtctttattgaagttgccgataattaatgtatgaatgttctactgtattttgatggaatggagatgcgcgaggaccagctgtgtcgatagttcttaatggtggtttgtgccatttagaaatatgcggtattggcgagatcctcttttatctcatcttttgcatttatctgataaaagttagctcgccaaaccgccatgcgttccgtcctcgcgcatcggaatggcatctagccagctcagtctcgtttccagctaaatttcaattttaatattaattgataactatggtgtgctagacggtaatctgggcgttgtgtaaacgctttggcgatttttatttgcgtaaaatcataaatactgattaaatagatatatttgaggatcacgtaaaattaaaatataattgaaacgtagctaagttaaaaaatgcggttatggccgtttaactgaaggcgtaaattacagaaatggatgaatgaactgatggaactagaatttctcggtactggcgctgggtcgccggcgcgttatcgtaacgtcactagtattgcgttgaaattattggatgaacgcaattcagtttggctgtttgatgtcggtgagggcacgcagcaacaaattttgcggacagcgattcggccgcgtaaagtggaaaagatttttatcacgcatttgcatggcgatcatatctttggtttgcctggatttttaagtagtcgttccttccaaggcggtaatcagccgttgacgatctacggaccaaaaggggtgcgtgattacgtgcaaactagcctgcgggtatcggattcgcggttgacttacccgatcaagtacgtggagatcaccgataatatgctggttttcgaagacgatacgtttaaagtcgaatgccgtaaattagatcatcggatcgctagctttggttaccgggtgattgaaaaggaccacaccggcgaattgctagtcgataaattacgcgctgccggtatcaaaccagggccagaatacggtaagatcaaggctggacagccggtgaccttagcggatggccaagtattgcctagcagcgattttatcggtccggcgcaaaaaggacgcatcgtgaccattttaggtgacacgcgacggacggccaattgctttactttggcggaaaatgccgatgtgttggtccacgaaagtacgtttggcaaggctgatggtcggatggcatacaattactaccattctaccagtacccaagcagcggaagtggcgaaaaaatcccacgttaagcagttactactgacccatatttctgcgcggtatgtcggtaaagcagctcacgaattacaatccgaggcgcggcagatttttccgcatacccgggtgatgaaggatttcgatcaggtgacgattccattgcagaagcagcaaacacaggcaatcgctaaataattttgtgaaagcggggcaaacttaatgaaattagcaaataaaaccgttttgatcaccggcgcttcgagtggcttaggggccgcgttggcgtacgcggcggcacggcaaggagcccagttagttttgtgcgcacgtcgcggcgagcgtttacggcaagtggcggctcaagcacgggcattatccgggcggcgggtactggcggtgcggatcgatttgacccagcccgcacagctcgaccgtttaatgacggtgcttaagcaaaaagttggcaccgtcgatgtgttgatcaataatgccggcattggctatttcgaaaaggcactggatctaccgttagctaaggtccagcatttatttcaattagatgtattaagtttgatgcaattaacgcaaaaagttggcttgacgatggcagcgctgcgccggggcgtgatcgtcaatattgcctcccaagccggtaaattagtgaccccgaaggcgaccgtttacgcggcggctaaggcagcggtgattgcttattccaatggtttacggatggagctgcggccgttaaatattcaagtgttgacggtcaatcctggcccgatcaaaacggagtttgcccatattgcggatcccagcgatcagtatgctcaggcagtggcgggaatcgcgttggacgctgatcaattagcggcgcggatcattcgggcgattgaaacccagcgccgcgaattaaatgcgccgtggcccatggaaattgcggcccggttacggacgctatttccggcgatagctgatcgattgatcgccagcccattatttgatcgtaaataagaggtaatttagtgcgaatgtagctgaaaaagcagcgctaagcgttttttcaacgcacacgataatgttttggaggaagtttaaatgaaaaatcaatggcggcttgttcttgttttattgttagcgttagtgatcgtgatttttgcggtgttaaacgtggcaccagttacggttcattttggttttggtaccgccaaatggccgctgatcatcgtgatcattgtgtccttgctgttaggtgcgttggtcaccgttttagtgtcgaccatgagtgcgttaggtctgcggcggcaggttaaaaccttgaccgcagagaaaaagcagcaggaaaccgcgatcgaccaagcggtggccgaagcaacggctaagttgaatacccagttggcggaaaaagaagatcagattaatgccttgcagcagcaagcatcatccgcggcggcacccagcgataaataaacaagactttcaatcagctggaattttgatataatagtttggttgggagcgtgaagtattaaatgaaatcccgttatacttggcagtatttgccgcagccacgagcggcgttagttaccgagcttgctgaaaagtgtcaattggcaccagcagtggtccggttactgatcaatcgtggactaactgatcaaacaacaattgaaaaatttttaaatccgggagtggatcaattgcatgatccacttttattatttgacatgcaaaaagcggttgaccgtattcgtcaggcaattgaagctaatcaattgatcacggtgtacggcgattacgacgctgatggggtcaccagcaccagtattatgctggaaacgttggaatccttaggggccaacgtcaatatttatatcccggaccgttttaatgagggttatgggccccacgaatcttcgtttaaacaattattagacgccgggacgcaattgatcgttaccgtcgacaatgggatcagtggcaacgcgccgatcgcctatgcgcaagcacagggcgtcgacgtgatcgtcacggatcatcatgaattgccgccagagttaccgccggcatttgcaatcgttcatccacgccatccgcaaggccactatccctttggtgacctttctggtgttggcgtggcttttaaagtcgctagagctttgctcgaggaaacggcagtcgatagttttgatttggccgccatcggtacgatcggggatctagtatcactgactgatgaaaatcgtgccctagttagcctaggtttgcaacagttgcagcagtcaacacgcccagggatcaccgcactttgtgaagtcgcggggatcgagcaagctaagatcgatgaacaatcgatcggttttgcgatcgcgccgcggttaaatgccttgggccgcttaggtgatgctaaagacggcgtcaaattactgaccacctttgatcctgatgaagcaactgagttggctaaatttgtccaaacgcaaaatgaacgccgccagcaatacgttaaagacattgccgcaaccgcaatggaaatggcgcagacaccagaaaatcagcagcggcaaaccttggtgttgacccacgctgattggcatgaaggggtgctggggatcgttgctagtcggatcgtcgaagctaccggcaaacctactttagtgttgacggaacgcgaagatcatacgtataaaggctctggccgtagtgtgcaggcgtttaatttatttaacgctttggaccaataccgtgatttgatgatcagttttggtggtcaccatatggcggctggcttagcggtcacggcggataatttagccgcgttaagtgcaggcctagaagctcaggctgatgcggttgatctgcggcaccaagcccatgatgctttgaaaatcgatttgcagttaccggtgccggaagtgacgactgactttttgcaggcttgtcagcagttggcgccatttggtaccgacaatccggcaccacagatcgccgttacaccagaaaaggtgactgacgtgcgcgcgatcggtgcggataaagcacatttgaaatttaaattgaccgcggccaatgctaatctggatgtgatcgcctttcaaaaggggcaatacgctgaggatcttaccgctgccgatcaggtgacagtggttggcgaattaggcgaaaatgtttggcaaggtcggcggacgctgcagttgcagttaaccgattttgccaccagcggcattgagatcatcgataagcggacgactcatttgacgcgccatttattccagtacactgctacttatgtgttcttctcggctaaattgcagcaacagctcagtagctatttgccggccgacgcaacggcagtttcggcgcatgagtcatttaatgtggtcggcgacaccttagtgttagtcgatctgccgactgatttagcggctttaacaacgttattacaagcgcatcagcaggaatatgacaagctgatcagcttcttttacatggcgcacccggtttatttggcggggatgccgacgcgagctgagtttgcgcgcttatttaaattcaccactacccatcgcggcatcaatctgcggacgcaattgacgacgctggctaattacttacatttgaaaaaagaattattgattttcatgattcaagtgttttctgagttgggttttgttaaaatagttgatggcgtcatggacggcgtggcgcaaccagctaaggctgacttgcagtccgccgccagttaccagcagcgtcagcagcaaatgactgctgagcaagtgctagtttatagtaattatcaagaacttaaaaattggttaaacgcacatattgtgccagatgaaggagcgaaaagtaatgtcagttgatttacatgattatatcgccagcgtgccagattttccggaaaaaggggttacctttcgcgatatttcaccattgatggctgatggggaagcttatcacgaagctacggatcaaattgcggcttacgctaaggataaaggtgtcgatatgatcgttggccccgaagcgcgcggttttatcgttggttgtcccgtagcctacaaattaggtttaggctttgcccccgcacgtaaaaagggtaaattaccgcggccaacggtttcggcgagttatgggttggaatacggtaaatcaaccttatatttacacaaagatgcgattaaaccagggcaaaaagtcttagtcactgatgacttgttggcaactggtggcacgatcgccgcaacaatcaaattagtcgaagatcttggcggaatcgttgtcggcacggctttcttgatcgaattaaaggatctgggcggtcgcgaaaaaatcaaagattatgatatgttagctttattgcagtattaaaaaagggtgtgacataagatcatagacttttctgaaatatggttatagtacaagttgtacgcaaaaataccagtaaaaacagttaaatctgtttttactggtattttgtttagaaatgattcgattgattttaaaattgcgaattactaagcttgaagataatcgcgcgttttataatcaagttagccaaatacttttagctaattgataaaataaaaaacaccaagacaaatctctgttatcattgatgttcctacacaaacaatgaaagaggttattgtcttgatgca

SEQ ID NO: 626 - DNA, 2419 bp, Unknown
  Metagenome-assembled genome
ggcatcaaaataaaaaaacaacggacaagcatcaagctaaaaatgccgcctaacaaaagacaaccagatttctcaaaatcgagaagtttggttgtctttttaaaacgggtgattatttaccgcttactataaaattacttatttttctgcatcagccaacaattgccgcagtggaatcaagccttgtgcttggtattcttcgacgaatgctttgacggctgcagggtcttgggtttctgggtccaaaacaagttgttcaactggtaatggccgttcattggcaatcttaacatcgatcacaactggaccagtggcagttttagcttgttcaaaagccattttgagttcggccaaattagtgactttgtagccagttgcacccatatcctcagcgacaccagcccaatcggcatccagtaaatcgacaccggaatgtggttgtttggtatcatcttgttcggcttcgataaagccgagtgattggttgctgaggactacgttgatgattggtaggtgttctttgacttgagtcagcaaatcttgaacgaccatggtccagccaccatcaccggagattgagaagacttggcgattagggaaagcttctttagcagcgatggcagctggtatgccataacccatggttgcgtaccaagcagaagtagtgaactgttcttgatggttcatccgcaagaagcgcatgccgtcgatcgtcacgttaccaacatcaacttggaaaattgcatctggttctgccatatcgttgatttgtttgaaaacaggttccacccgcattggcgtttggtcactttcttcaaagctgtcgatccacttgcgccagttgaccttattggctagagcagccttgtagaatggtttttcaggaactgcgtcgccactacgttcaaccaaagcacggaatgttttaacggcatcggccaaaatggaaacttcaactgcatggcgtttgcctagtttagcagaatcggtgtcgacttggatgaattttacgtctggcgcaaagaagtacgccgtaaacggaaaatcagtaccaacgaataaaaccgtatctgctgcgcgggaagtttcaacccctggcttgctggcaacacggccggcagaacccatataggctttgtaatcatccggcacgatacctttagctggagccgttgaaacgatcggtgctgataatttttcggaaagagcaatgatgtcgtcggttgcgccgcgggcaccttgaccaatgtagatcaatggtttctcagctgccttcagtaaagcgatggcagcgtcgattttttcagttgcgggtgcgactgtatcgctagtggttgcagcagcagcggtcgaaacaaaattatcgtcgatctcagtccaaccaagatcctttggtatcgtaacaacagcgacaccattatgcttgtaagcttggcgaatcgcttcgtcgaccacgtgcggcaagccagctgcagtggttgctgtccggttataaactgcgacgtcagcaaacatcggattttcattcatttcttggaagtaatcagtgttcattgttgcggttggaacttgaccaactaacgccaaaactgggacgtggtcatatttagcgtcatacaaaccattaagtaaatgaactgcaccagggccagcagaaccaaaagtaacacctaatttgccggttactttagcttcgccactagcagccaaagcgccaacttcttcgtggcgaacttggacaaagtgaagcgtattacagcgattatgcaaagcgttcattgtggaatcaaacgaaccaccaggtaaaccgtaaatatttttgacgccccaatcttccagtaccttgagcattgcgtctgctgcattgattttttctaccattatgaagatcctcctttaaaattgcttacctttataagttgcaatttttgtataatgaactgactaattttgtaaaccctttatacctaatttagcgtttacacaatcttttagcaagtaaaacggcttcataagaaattatggttgccagcaacaatctattctggtttggctgcagatgagcaaactgatcattattgcttgataagctaatttgcagtggtgtcatagtgcagataaataataaatagccgcacataatcaataattgtgctaaaaaagaacgcaggccagagcctgcgttctttatatttaagcttcagttggtaactaaaggttgaaagttaatatttccacttaagccctgatctgttagggcttttttgctacaaaaatagacatgaaaccattcacatctgtatacttaaagcgtctaaacaaaaaccatacagaggagtttcatgcctatgtctactatacaatacaatgacactgatattcatcattcttttgctcatttttcaaaattggtccatct

SEQ ID NO: 627 - DNA, 3568 bp, Unknown
  Metagenome-assembled genome
ggcgatttaactataacagaatcgaggttctttttgtgcacttaaaaggtgttaagcaataatttagtggtgccgcgggctaacaaggttttgcggcagttaaacaggtactgtaaataatctaggtttcactaaatcattttcacataaaaaagctgtgctaagattcttaacaatctagcaacagcttttttaatatagttacattgccatccaagcagcagagagaatattgccgtcaggatctttgatttctaactcatacatttgatcttcgggaatgccgagctcaacatgataatatgaaccaccattggctgccgcttcagctgcgaattctttgactgccgcaacactatcgaaactaaatgccgtcatgctgccactgattttttgcgtatcggccactgtttgtccttgcagaaacttattataaaagtcatgcgttagtaacatgatccagatcgtatcactccacatcatgcctacaccattttcatccgaaaaatccttattctgcttaaaacctaatgcctcataaaacttgatcgaacgctgcatatccgtaactggtaagttcacaaaaaccatttttgccatcgtgcacctcctgaattattttgaatacatcgtcattatcgcaagcatgatcataaatggcaatcaatatactttctcagtataattgggttggaggtgctttcatgccagttatttcaaatgctcaagtgcgtggttttcgtttacaaaatcaccatctagcgcaatcacaaccaataagcgccctatccacaatcgttggtgcttgtggcttacaaaatacgcccccttatgcttggttaactgctagccataatcggttgcccgccatcacacgaacacaactcacacaagctttagaatcgaacaagctactattgcaggcttggagttaccgtggtgcgcccgttatttttccgactgaacaagccagcatttttttaaccgccttgattccagaagcagatgagcagccgtggatctatactcgcggcttattgcctactttgccggaactcggccttacctttgaacaagcactacattacgttatcactgcctgccaccaattacagcaacaaacaattgtcagtaaagctcgtttagatcagcttttggcagcactgattactcccgaattaccagctacgatcaaggctaaatggctgagtgcctcaccttacagtaaccagcaaacattaggtgcagccgttgtttcttttttattacgcccctgtgctcaccttggactcatcgttttcggtcagcggcgcggtaacacaccaacctttactacacctgaaaactggcttaagcagtcgttgatcgttaacaatactgcacaacaacaactcgtacgcaaatttgttcattgctacgggccgacgactcgtcatgctttgcaacgttggcttggttgtggagcgcaacaagctaaacgtttgtggcaagcaatcgcaccagaactacaacgcgttacaactgctggacaaacacgttatatcttagctaccgactatgagcaattaaccaatagcgaacctactgaacgtttattactattaggtgctcatgatccttatttagatttagctgatcgcgaaaccattctggcgccaccaacgctacaacgacaagtttggcgttacagtggtaatcctggcgtgatcacctgtggtggccgcattatcggtatttggcgtagccagcgtagcggtaacaaactaacgcttaatttaaagagctggtctaccttaagtgctgcaaataaaagccaattagaagaactggccaacgctgatgcaactttcaaccagcagcaactggtcaaattagtttttgagcactaattcagtttgctagagctttatcaaataaagtcaaaaattatactgaaagttctattgaatcccttgatggcacgcttcatcccccttaataacctcgttttaatattaaaatcagtttatttttctcttataatcctttatacttttaaaaataagtaaaaaagattgtgagttgaaagttatgtgggaacgtattactagaatttcgctgatcaagcggatcttgattgggatcgtcattggtgccattctcggtgttgccataccaggttggacttggttagaaattctgggtgatttattcgttaattcattgaaagctattgccccattgttagtcttcatgttgattatgtcctcaatgtcaaaacatgaaaaaggcgcacaaacgcatatgcgttcgatcgttgttttgtatttaatggcaacttttgtcgctgctttagtcgctgttggtgccagctacttattcccagtcgacattattttgcctaaaggaactgctagtgcagcggctcaagcaccaaaaggcctagcacccgttatcaaaaatctatttaatagtgccatcgaaaacccagtcaaagcattgactgaaggtaactacctcgctttattagtttgggctagcctgattgggattggtttacgtccgtttgccggtacgactaaaaaattagtcagcgatttttctagtgcgatcaccaatgttgttcaattcattattcaattggctccaattgggatcgttggtttagttttccgctcagttgccgaaactggacttagtggtttagctcgttatggccaactaatcttgctggtcgtcggtacaatggcctttgtcgctttgatcgtttacccagcaatggtgttattgatgacccatcagaatccctatccactgaccttatttacattacgagaaagtggaattccggcattcttcacccgtagttccgcggtcaatattccgatcaatatggatcttagtcgtcgtctaggcttaaatgaaaaaacttatgcgatctcaatcccactaggcgcctctgctaatagtggcggtgcagcaatgactatttcaattatgacactagccactgcgcatacattaggaatcagcgtttctttcccaatggccttcttgctatgtttattgtcggccatttccgcaaccggcgcatctggcattgccggcggctcacttctgctaattccgctagcctgcagtttgttcggtatctcgaatgatatcgcgatgcaagtggtcggtgttggtttcattatcggtgtcatccaagactcagttgaaactgccgttaatgccgccagcgatattttatttaccgctactgctgaatttgccgatctacgccgtgccggtacacccgttaacattgccgagcgcgtgcgcaaagcaaatcaaatggaagccggcgacgttacaacgatcattgaagaacatcatgaactaaaggttgaaagttaatatttccacttaagccctgatctgttagggcttttttgctacaaaaatagacatgaaaccattcacatctgtatacttaaagcgtctaaacaaaaaccatacagaggagtttcatgcctatgtctactatacaatacaatgacactgatattcatcattcttttgctcatttttcaaaattggtccatct

SEQ ID NO: 628 - DNA, 7614 bp, Unknown
  Metagenome-assembled genome
atccagtgagaagcaacacctgaattaagttcgattcatccgtgaacggtgattccatatattaatcgtcatccccccttgaacatccggttttgaacttgggtttcatggaactttagacgttacctatggagtagagaaggcatatttatgacaggctatatttatttaggcatcgcaatcgttggtgaattgattggaacaaacttattgaaagtgtcggcaggttttagccaccttttgccaaccatcggaaccttattcgcctatggcttatgttttttctttctatctctgtcgatcaaaacagtgccccttaatttagcctacgcaagttgggctggcctaggattgatcttaaccacattgatctcaatctatctgtggcatgaaccattaaatatgatcggtgttgtcggtttaattttgatcgtactaggcgttattttattggacggttttggtaccgcctaattgttatttttgcaatcaaattgaaatattaagtttatgccgcatctttgcgttcgctattgtagtcaggtatgatagttctaaagttaagaattagtttattggagcgattaattcatgaagcgattcataaaaatgcaacaattagcgatcattgtcgtgttagccgttattttactggggttaagttaccaccatattgttagtgccaagcaaaccatggcaccgcaagtgacttcgaccactaagtctaagccgaaatccactcaaaaaacgaccacccaaaaggcaacagtacagaaaaaaacgattgattggcgcgccccatcagaaaagaaagcttatcccgatttaaagcagcatccccacgtttggttggacgtttctcagggcaaacaacgggtttacgttaaagacggtaatactgtactttacaccatgtatgcttcaactgggatgaacaacacaacaccaaacggtacttttaccattgaagcagagcggggcaaaagtttttttaataaaagcttaaatgaaggggctaattattggacctcttggtcgggtcacggggtttatcttttccatagtgtccccactgatgccgctggtaattacaatgtgactgaagctgaaaagttggggcacaaggcctcccacggctgtgtccgtttaacgattgctgacgcgcagtggatcaatacctatatcccctatggcactaaagttgtcgttcataattaaaacaaaataaagacaccggcagtgattgtcggtgtctttatttcacttaaaatttattctggatcgtattaatatttttcaataaaactgagatcgtcccatcaggattattaacaaattcaattaagtcccggttttgataaatatcaaccggcacgatcaattcaataccgttatctaacttgaacttttgtttgctgactttggcctcaaatttatgggtcaaatcagccttttgacgcggtacttgcgcttgcgtcacctgctgatcaaattcttgtttagccgctggattttctttaaaaacttggtcactgacgtaatcaacgtccagtgtgttagtttcgttcaaactttcataaacggcttgctttaaattagccgtggtttcaaccggatcctgattatacttttctgccaccgtattaaccgcttgtctaacctgcttgacgctagaagtcaaagttggttccgccgttaccattaaaaagtcgctagccacataaggccgcttctcaccatcaatttggtaagccttatcagccaaaaagtattggccactggcttgatcgataataaccccttcagtaattgcctgacccactgccggcaagactgcctgattaagtacaatctgattagccaccgcttgctcagtataatttaaatagtgaatgaaatcttgccgctgatttagttttaaaacagcaacatagtcacgctcgttttccgtcaattgtgcgatcaataagtccccacttacaatatcactttgtggtagaacaaagttaaagaagcgttgcgctaattgctgactaactggaacaaaatcactgagctgctgacataactgcagaattgggttgtctgctggcaatgttccattttggttatcccgccgtaaaaaacgggtacagagttgttcaatatactgattgatgcccgcttcacttaaatctagtacctgctcagagtaataagcggttgcggttgctggatcaacaatgtgtaaaatagcttgattaatttgcatttaattatacctcaatttcttacaaagtgaataaagtcgcagccaacttcgatcgctggctgcgactttattttagttagtcgtacttgtggttgttgtcgtactcgttccacttgatgttttttgcccagtgttcttaaagtaattactaaacatttcctgagctacttgcgtattatagtgcgagctatccgcattggtagagatgttagggaagaccaccgcaaccgcaatttgtggatcgtccgccggtgcatagcccacgaaactagacgttaatgttgatggtggattggcattattcgggttatctgaatcataatagaaggtttcagcggtcccagttttaccagcaatcgctggtgtaaagcccttcaacgtatgtgcagtcccccaagccatactaccatgtgtaacgttatagaagccctctttgactacattgatctcgtcttgtgttgcaccaatcttattcaatacagttggtgtggtcgttgattcaacattacctaaagtgccatcactattggtactacgaatagcttgaaccaagtacggcttcattcgatacccattattggcaatcgtggaaacatattggcctaactgcatgactgtatattgatcatagttcccgtaagacagatccaaagatttaacaatatccgtagttggaccagcatacccactgacttcaccaggaagatcgaccccagttttaatgcctaaaccaaattgattaaagtagccgcgctccttagcaaaaattgatttgttcatgctgaagtattgattggcttcgtatttagcgttgccttccttcattgccagtcgcatcatgtaaatattagaggatacttccaacgcttgagcggcatttagcgaactataagtaccagcagaataaaccgcctttttcaccaaaccaccagagaaatatagtggtgtatccgaaagtgtattatcagtcggtgtgatcgcaccgtccatcatcccaccaaggactgtggcccctttgaccactgatcccatggtaaaggtttgattaacaacaccaagtgcatcatcagtcgtttctccagttttcggatcgtagcccaaaccggccatcgccaaaatcgcgcccgtcttaggattcatcgccaccgcatacgcgccatcagaatattgggtcattccggccgatttggccgaactgaatacacttttcaaggtggcctcaacttgtttctgataattcgaatcgatggttaagactaaattaccaccctttttaccagcataaagttttttactgctgacaactttattattggcatccatggtgacctgagtttgcgctttggtccctttaagaatattttcgtattgttcttccaaataactagtgccgacacgatcattacgcgaataaccttgggctagatactcattgatcatatcgctaggcaaaccggatttctcggacgaaacgccaccaaaaatactccgcattgaatcgccattgggataggaccgttcccaatccgaagcaatgttgaccccaggtaactcagttaaatgctcactgaccttggctacttcagcctcagttacatccgagtttttaatgtaaactgttgacagttgataagcaccactcattgttttaaagatttgcgctgcctggcgctgcttatcagtaaatttcaggtcttttgccgggacagcagccatttcacgcttatacaataccttttgatcaacttcattgccgttagcatcatacttttgactacggggcaaattattgtagattcgttttaaattctgcgcattagctaaataataatccgccttatcccgatgggttagtcgatcaacatcaacactgataaagccacttaaacggttggcaattttataaatatctgttgataaaacattcgcatccttggtgtaactaatcgcattatttgctttattaccgaccatgacccgcccattggcatcgtagatcatcccccgcggtaccgtattggttaccgtcgttttatcagttcgctcgacctcggcttcaaatttagaaccataaaggatctgcaaataacctaattgggcgatcaatgccgcaaataaaataaaaacaatgaataacaaaaaattcagtcgaaacggaatgctcgactgatttttagctggtcgattagatttttttcgcaaaaatttcactgccgatttctcctctatcttactattaaggtttatgctattacggtcgctgtgactttagcttaccgatcacaaaaaactaggcacgacttcattagtatgaatcacttccataatatcaaaaaccattatttatgtattgctttataatcagactgtggcataactcttattaatactagcatatcgcctaccgattttaaagcgagcaaaaactaagattcatttaattatcaccgcttaattttataaactccgcttaaaaatagcgaaaaaacttgcagccggcaacgggttcacttatgcttttaaccatagaagaaattgttgaggtggaaagattgacacgaatgattcgctttattaaacggcattatccactattacttagtttctggattccctttctattaatgggtggctattttgccgcccgccagatgtttccttttggtcatagtagcctgctaacggttgacttaggccaacaatatattgatttttttgcgttctatcgtgatacgttgctacatcatcccagtcagatcttgtattcttttagcaaggcgatcggtggtgatatgcttggcgtttgggcttactatctgttcagcccctttaatttattattactgctgaccccaggcaaatggttgaccgctggtatcatgttagtgactttaatgaagtatggctgcgccgggttgagttttgcttggttgctaaagaaaaccaaaaccgccagtggcttatatattccagctttagcaactagctacgccttaatgggttggatgattgccaaccaactaaacttgatttggctggacgcagtcgtgatcttgccattgatcattttagcagtcgagcgtttatttaccggtgctagctatataggttatagtctgatcttggcggcggcactgatcattaactattacatgagctatatgatctgtctattcttagccacttatattttatgggcactgacccgccactttaaaaattggcgccagactgggcaggttctgggaaaatttgtactcggttcgctgctgggagccgctgcggccgccgttgtattgttaccgacattttattcgttgacgcaaagtaaggcacagtacacggtaactaagatcaattggaagctagagtacgctccagttaaaatgttgtctaaactagtcgtcggcgcctttaatttcgatcaaatgcccactggctttcccaatttatttgtcggttcgctagtactgtgcgggttcttactttattttggcttaaaaacaattccgtggcgcgaacggatcgttgccggacttgtcactttatttctaggactttcgctgtgctttgaaccactggacttactttggcacgcgatgcagttcccaatttggtatccataccggttttcatttgtagtttgtttttggctagtttggctggcggcaattagtttaaatcatctaacacaactacggttaccagcaggcatcgttctaaccctcctatttggtgccggcttgtattacgtttggacgaatttaaagcatttcaattacttaaaccaaacggctgtccgcttaagtctattattcagtatcattgctttagttttactggttttcaaagctgccccttcgccattagttccatttacgtttctggccttggtggtcgtcgaaatgggtgctaacgcaatcttaagcttaaatcaaatcagttacgttacacagtccgattacgctgactacacggctgctttagtcaaagcagtcaataaagtaaagcaacgtacttcggccaccgatttttaccggctagaaaagacatttatgcgcaccaaaaatgattcgatggaagctaactataatagtgcttcgcattttagttcgacctttgaatcgcggattcctaatttcatgggtgaactaggccagccagctggtgacggcttcatcgcctattctaacggaactttgtttagcgatgctttcttaggaatcaaatactatctcgcgcgcaacgccaactggatcgagcctgccgaacggaacaataatccgttactgccaccacttactgacaagcctgatcttagttactacaatcaagtgacccacactaaacaagtgacgatctataaaaatccgtacgcattgaatctgggatttgccgcttcaaataaaattttgaaaccacagaccaataccagttatccgacgatctatcaagccaatgtattaagtgcactaactggctcagatcaatatgcagcactttttacaccacagctattcgcaacggtcacttacgctaacgtgaagcaacgcaaggcaccactgacccagacttaccggaagatcaataaaaagaaagcagcgacgattacttatacctttacgccgcaaacgaatgatccgtattatctgactatcggctctaatcttaacagtaaagccgtcagctttagcgttaacggtaaagctctgcaacaatatgacactttccgggatacggtcatcgttaatttagccgccgcccaaaaaggccagcccattaaattaacgatcacgttgaatcaaaatgaagtctggctcaaagatttccaactttatcactttgacacaactagctttagtcaagccatccgccaactacaagccgagccgtggcaattaactaagaatcaaaatattaacttaagtggacagatcaacatcacgaaaaggcatcaagtaatgatgacgacgattcctgctgcggctggttggcgagcaacggttgatcaaaaaccagttaaaattaaacgtgcgctggatacctttattgccattccgttaactaagggtagtcataccgttagtcttagctactggccaccttacttaacgctaggcctcgtgatcactggtgtaaccttaagtattgatggtttgtattattattaccgtaaacgccgtgcctagcatcgactgttctaaaattaaaatgaccgccaagacgtgattgtctttgcgataatccctttatggttgtcagatgaaatacaataattcatctaacaactatggagggatttttgtatgcccagatctaaacatacggtactcgaaaaattagcaatcttaaaggaacttacc

SEQ ID NO: 629 - DNA, 6193 bp, Unknown
  Metagenome-assembled genome
agtttttattacgacgtcaaagcgccaaagaccacaacgacatgtcaacttcgacaccactttaccagaaaaaagcaaagtggtgaaccacgattccgtcgaatcatgattcaccactaatgttagtccgtttttattgctaaaaattgataagccacctgtgttttcctgataaaatgagaccattatgtgacttatcattttcttttcattgttagatagctatgctatgatgaaaagcatctaaataacgagttgatagtagcgaaaaactgctatttgacctgactcattggagggggaaatgaattgtcgatcaaagataaaatgtggcaaaagcaaagtctagataaatatctagctaaagataatcaattcatcaaatcaatgaacgcatttgacttgatggcattaggaatcggtgcggtaatcggaacggggatcttcatcttgcctggtactgtagctgccctaaaagcaggaccggggatcatgctttcattcgtaattgccgcaattgtttgttctttagcagccatgtgttacgcggagttttcatccgcgatgcccattgccggttcggcttattcttacggtaatgtgatctttggtgaatttattggctggatccttggttgggcgctgatcctcgagtatatgttagccgtcgctgctgtttcaactggtttttcggcttactttagttctctactacagggctttggcctcgccataccgaaagtactcagcgggccgttcgaccccgtacacggcacttatattaatattgtggcagttattatcgtctggttgattacttggttattaagtcaaggcatgaaacaatcggtgcgcattaacaacatcatggtaattgttaaaattagtatcatcgtcattttcttgttggtcggtgtcttctatgtcaagcccgctaattggcacccatttttaccatttggtaagcttggggtcttacacggcgcttcaaccgtcttctttgcttacttaggttttgacgccgtttcatcatcagccgctgaagttaaaaatccacagcgtaatatgccgatcggaattatcggaactctagtgattgcaaccgtactgtacattttagtttctgtggttctaactgggatggtttccttccgtgaattagatgttgccaatccagtagcgttcgccttacaaaaagtggggcaaaattggacggccggtattatttctttaggcgccttagcgggtatgtttaccatgatggtcactatgatttacagtagttcacgtttgatctactcaattggtcgtgacggtttactacctaaatttctcggccgtttacaaggaaaaaatcacttgccacaacatagtttattactggctacgttgattatttccttcttaggtggattagttccattagatcaactgactagtttagtcaatattggcaccttgattgctttcacctttgtctcgatcggtattattccattacgcaagcacactgagatcacacataccggcttccacgtgccttggtcacctgtgctaccgatcatctcggcattagcttgtattggcttaatgctcactttatctttagaaacctggattgcttctttgatctggtttgccattggtatggtaatttactttacttacggcattcatcatgagaatatctctgattagcaaaattttggatacgccaaacggagctccgacagccaatgtcgcaactccgtttttttatttatgacagccttgcccctttttcgattttttgcttgattgatcacgttcaacaaagcgaaaaaatcttttgccgccaatagcctttacagataggtacttggttgatctcccaatccataataccaacatcccttccctcaggatgtttttaggatagcatgttagtcttttttcattgggcttcatgagcagttttttataaaaaagtcgcttaccaatcacttgcctaactaatttaggataggaaacatcgttaaagcctaagctgacaatatctagtataaatcaattatttactttttttaccctgtatttcttagtaaattcttttttccgtatgacgacgtacaaaaaagtcgcttctactccaatctagaagtgacttttttgattaactttattctgaacgcagcgcgatcgcagcatctttcttcgaagccatacgtgctggtaaatgaccaccgataatcgtcaaaaccgtgctcaatgcaatcaaaattaaagcatgaacaggatttaactgagcaacgttagccaaatcagttagcttatacagcaaactattgattgggaacgttgctagataggcaatcacaacacctaggatgccagaaccgacaccgagaatacccgtttccgcatcaaatacgcgggtaatatcttttttccgtgcaccaagtgcttttaagaccccgatttctttagtccgttctaacactgaggtatacgttaaaataccgatcatgatcatactagttactaacgagatgccggcaaaggccactagaacatacgtgatagcgtccattaaaccacccgttaaatcagtcatcgttcccgctaagtcggtgtaaataatcttatcagctttatctttgccctgattatatttgtccaaataagtcaaaacatgatctttatccttaaaattattcggataaattaggatactgtaaggaatgctactaccacctaaagtagccattaactgtgatttagtctgtgccgttagggtctcgccagtcagcacattagtgttgctctgcttctgtgcttgtacgatcgctgagtttttattatcttgaataatttgtcgaactaacttgtccgaatacgcgattcctggtgccaacagccccatattagtgctctttttagcacggatcaccccaacgatcttcaactgccgtttgctactgttataagcgctggccaagttttgattaggaatgaagttaccagtcggtaatttctgataataatcattattgctggcaactttgatcgttgtcccaataattttactgaaatcgactttttgaccattttttacgtcaaagcctaaatttttcagtgcattgatattcgtatggtttttgctgtccacaacgaccacaatatccgttgcggctttgggataagcgcctttaagtaacttgtaattagattgcagaaaattgtttttaccggccgtcaacggttctggaaatgaagaaacgccaacgcctgacgaggaagataggctttgctgaatgctttgtgtattgccatctgagttagagaatttaacggccgtcactttaccatttacttggcgtaacaaattcatcccagtcaatcgagtatagccaatattattgctatactcgggatcaatgtttttaacataattcaaaaatttagtgttgatcttattgacgtgctgggcactttcactttgatctttagccgccactaaataacccctatttttagccgttttatcggaatcactcacactactttgtgctttagattgatcagtggtcacttgcgaaattgtaatcggaaacttggacagtgtttccgtttgcgtatcattgatttgcttctgaaaaccgttggataaacttaaaacgatcgcgacaccgataattccaatactcgaagcaaatgcggtcaggaacgtccgcccttttttcgtccgaatattgttaaatgataacttgatggcggtggcaaaagtcattttagtccgctttaacgtaaacgcactactagctgcactctcctggtagggatcagaatcttgctgaattttaccatcagcaaattcaacgatccgatcagcgtactggtgcgctaattcaggattatgcgtgaccattacgactaagcgttcacgcgataattcttggatcaattgcatgatctgctcgctagtgaccgtatccagtgccccagttggttcatcacacaacagaatatctggatcgttaacgattgcgcgagcgattgcgacacgctgcatttgaccaccagataattgattaatcgctttgttgatgtgttggcctaagccaacacgctccagtgcagctaccgccttttgttttcgttccgccttaccaacgccactcagtgtcatccccatctcgacattatcgataatgcttaaatgaccgatcagattgtaactttgaaaaataaaaccaactgtattattgcggtaggcatcccagtccgtctctttaaatttcttagttgaagtgccgttaacgatcatatcaccggaatcataccgatcaagaccacctaaagcattcaacatcgttgtcttaccagaaccgctaggccccaagattgcaacaaattcttttggccgaaaagcaatcgaaacatcatctagtgctttagtcagcgtatcgccgacttgataatacttttttacgtgttgtaattcgagcatggtatccctcttctcatctaaaccactgttaaactgcctctgattttaccaaaacgctttacaatcgtcaaatattcattatgattaataattgacgatataaatagacagaagcaatcttaatcgtgaagtagaggagttaactatggcaaatgaacaaaaaaatttaaacacattgtttgaattgatcaccattttaaatcaattgatttttgaaccaaaaatgatccagaaaataaaattatctaaaaacgaaattctgattctaggtttgatcaaagaaggcagccaaccagcaatgtctgaattggccaatagattaggtacctctcctgcccagatcacgcgttcagttaccggtttagaaaaaaaatcactggtcaaacgggtgattaatccaactaatcgacgtataatcaacgttatattgacaccagcaggtaatcaattgattgggcagcacgaacaagcggtacgtactaaattacaaaaacaactagctgccgtttccactgctgactacaacgaactagatcacgcactgcaacaagctgtgactattttaaaacgaacaactttaggaggctaaccgctgatgaacaaagcggccttagaacagcaattacagcagcaactcaaagataagcggctttttcggcacatgttgtttagcgaagacgttagccacgtgcttgcacaaattattttctggcttggacttgtcctactagttttcactgctttaggttggttattattaggctttaatgtactgttgactggatcaactgctatgaaactaatgatcctcaaacaagccggccgtgttttttggctactcccactgcatcccctaatgtctgcaggttggggtggttatctgattctagccgctgacattgctttagtctattgcttaatatggcgctgcggacaattgatgcatcgcaagcaactgtaccaaagcttcagccagcagcaattacggttagtcttggcttcagccgaacaacttaacaacaaatataatttgatttatcaaagcgagcagtcggcagcttcccttacccaggctttaaagtcattgcctaaaaagcaacgtgatcaatgggcgctgctaactcaccgaccaacattttttagtcgcgaacataatgctattgatcagaaaaaaatcaaacaattcttagaaacaaatttcaatggcacctatcaatatgtggatacactattgacagcaccggcagcactgccattttattggtcattaagtactgcccaaacagtggtggccatgctgacagattcacgtggtcactgtcattacttgttacactattttgatcagaagaatcagcgaatcaaagtttcttggcgccaacgtgctgctaatttattacaaattattttatttcggcagattgcaagaaataacttgaacaaatttagtaacgcagattacgcaaaaagatctcaatcggtgttcgccaatttaaacatttgagtggtcgggaattcaaataccagttaatttgaatcaattcatcatcggtaatctcatcaatcggttgaccttggggaatgaagcggcgtagtactcggttgcgattttcattactgcctcgttcatgtggcgaataagcgtgcgcaaagtacagcggaacaccggcctgttcttcaatcaaattgtagttggcgaattct

SEQ ID NO: 630 - DNA, 12988 bp, Unknown
  Metagenome-assembled genome
gtaagttcctttaagattgctaatttttcgagtaccgtatgtttagatctgggcatacaaaaatccctccatagttgttagatgaattattgtatttcatctgacaaccataaagggattatcgcaactcgaagctgatgagtgtgggtcagttatttattcatgtgtattcactactaatattagcttaaataaatactgatatctttagtaatcattttaatactgattttagtaatttggtatacctaggattgttatatttcatgtttctattgtaagttacgccgacgatcttcatgcgaatgaaaatcaataattttatgtgtgccactattattaagggcggtggcatcgatttgaacgagttcaggataacccaaataataaccttgtaataaattagcatgatagtgttgaccaatcgcgatttcggcagcgttttcaaatccttcaatagcaaaaaatttatgatggatctcggtaaacttgcgccagaactgcaataaggggctgatgatcgtactgaaatcagtgtgttggcggaagttctgcagtgcaaacttatattcagtgatataaggatctaactgttcagctaaggttgctgtattatcaccggttcctacgtcatctaggcagacccacaaatgggcgttttggtattgttgtgcggctacggctagtttagcgatagatatattgtggtgatgttctgttaactcgatgaccacctcaactggttcacattgtttctgcacttgttgcatactggcaataaatgtatcatcaacaaattgatcttgatctaaattaattgaaaccatattggttcctttaggtaatgccgttatcgttgcaattgctagtttttcaagttgaagggcggtgaattgggcgaagtttttggggaagatccaattaccattgcagtattgacgaataaaaaattcataaccaagtttttcgtgatcgagagaatatttgggctgagcaaagaaacgaatcataaggctgcctcctaactggcaaactataaaaaaagcccctacttgtctggcacaagtacgggtcgtatccacagatcgtggttgagcaatctttgcattaatttaccttaagtataacattttcaagcttaaataaaaggaaacagcttatttttacgtagtttaaagatggaacctgtgagttaaatcaatagttatgaggtgagtgaaatgttgattgcacaaacacggcagcagatatatataaatagtttggattattcgcgaacgcaattaaaaaaatggcgccagcaagttttttactgtcccgtttgtcatgaacaggtcactttaaaaattgggaccaccattcagccacactttgcccacttggcgcattcaaagtgcacagtaacaacagaaggcgaaacggctgaacatttagctggtaaagccttgcttggtgaattttgtcgtcactggcaggtcaattttgagtatgaggtttatttgccatcgatcaagcagcgaccagatttactggttagtactggtgtccgtcatattgcaatcgaatttcaatgtagtcccttatctattgagcagttacgggaacgaacgagtggttatcggcgcattggttatgaagtggtgtggatcttgggacaacgttaccagcgacaacattggacggccagcaaccacgcttttctacaatattcgcggcagtgggggtggtatcaatggcagcttgatgtgagtcagcacaaactatggttattacatcatattgtgcattatggttacccacagcaagttggttatcagcgctgttcagtcgagcagataaaatcactttataaaacacagcaccaacaattaacgccaactaaattgttagcagaagcgcagcagttatatcgacgcttagctcagtcagcaccggaattgttatcgctgcaacagtcttgttatttagcgggacatcatttggctggcgcaccgctttgttgtcatcaagctagcacattaccgataaatcagcaggctagtattttactagtagtacgtttgctattattttgcgaaaaacatggttgtgtgactactgcacagttggaacaattctgctggacatatgcgaccgcattttatcaactacctttggtcaatgagcattcatggcaattacagtggtgtcggcagattttacaacaatggcaatgtcaggatgtgctgcggttacagggtgctgttctgcactatcatgaggccaaatggtatccagattatttttctaagcaaaaagcgatcaaaaaataagaaaaatgatgagataatactcatttgcttcgaaagttaagtagatattgtgaagttatgagtggtgcttttcatgtaaattacgcagaaagttcataatatatggtgattaattagtgaaagcacattattatttaattgaattttaataaaaaaacgatatttagcttaaaatgagattttaacgtttactttaatttatttttaatatagaatgacaacaagttaaaaagtagtgatacttttcagtgaaagccataataaatgatcaaggtggggattttatgatgtggaagcaagcaaaacgtatcggcttagttgctgcagcaggtttaatggtcgtaccattagctggtaatgctggaacagctaaagcagcaacattggcaaaaaaccaaacgttcaaaatgatggtgccatctgaattaacaacaatggataattctaagatgactgatatttatgccgctaccgtattaaacaataccaacgaggggttgtatcgtttaaccagtaaaaacaaagcggtaccagctttggcaacatcggtcgttaagtcaacaaacaatggcttggaatatactttccatttacgtcattctaaatggagcaacggggatccagtaacggctaaagatttcgtttattcttggcaacggacggttaatcctaagacggcttcacagtatgcattcttgttcgaggggatcaaaaatgcaacggcgatcgctgatggtaagaaacaacctagtgaattaggtgttaaggcagtcgatgactataccttacaggtcaccatggacaagccagttccttactttgatttattgatggctaatccaactttctacccacaaaatcaaaaagtggttgaaaagtatggttcaaaatacgggacaacttcagctaaacaagtttataacggaccatttaagttaactaaatggaacgggaccagcttgaagtggaccttagttaagaacaaggactactgggataagagtaaagttaagttgaataagatcgagtatcaggcagtcaaagatccttcaactgcgttgaacttataccaaagcaaggacttagacgatgtcacattatctagtgaaatggctaagcaatcagctaataacaaggataaagtgatccgcaagatggcttcgacattctatttggaatataaccagaagaaagttaaagccttccagaataagaagattcgtcaagcaatctctttgaccgttgatcggcagaagttagctaaaaacgtcttagctgatggttctacagcggctaagggctatgtgccagatggtttagctaatgatccaaagaatggcaaagattttgcttctgaagcccaaggtgctacagaaaaagccgcagttgattataacatgaagaaagccaagaagttatgggccgaaggtaagaaagaagtcggcatcaagaaacttaacgttgagttaatgggtgacgatactgatgcttctaagaagattttggaatacttacaaaatgggatggaaaaattgcctggtttgaaagttactaaccaaaacttaccatttaagacacggttatcacgttctgaaagcggcaagttcgatatggtcatgacagcttggaacggggactttggggatccaatcacgttcatggacttattgaccagcaccaactcttacaataacggtaaatggagcaatgctagctacgataaggacgtttctgcttccaagaacgaaaacgctgctaatccagatgcacgttggcagaacttgcttgatgccgaaaatactttgatgagtgatgaaggggtcgcaccaatttatcagaagaacgaattccatttagttaattctaaagttaagggtatcgtttatcatcaaactggcgcaagctatgattacaagacggcttatatcgctaaataagtcgtttatcgaaacaagtagggttaggttaaggttagggggaaatcagctaatcgcggccagccttacttgttttttgtgctaaagtcattaattgagctgatcgcctaattcgatgttttggtgtaataaattaggtttatcagaagtacgttttcggttcagaaactaacttatattgaataggagcattgcccatgcgtaagtatattgtgaagcgggtgctgtatatgatcttgacgttattcttgatcgccaccatcaccttcttcttaatgaaactcctgcccggcacaccgtaccaaaatcaggataaaatgagtgcgtcacagattcatatgatgaatgaacagtatggcttgaataagccagtgtggcagcaatatttgatctatatttttgggatggtccatggtgatctaggaatttctttccaattttcaagccagccagtttcgtatttgattgccactcggatcgggccatcattacaattaggccttcaagcaatgatcgtcggttctgttctagggattttactaggagcagtggccgcaattcgtcgaaatacgtgggccgatactttggcgacgttattagcgattttagggatgtcgattcctaacttcgtctttgccgtcttgctgcagtatattctcggctttaagttgaaattattcccgatcgcattgtggagtaattttagctcgagtattttaccgacaattgccttggcgatgatgccattggctgaaacagcgcggtttatgcggaccgaaatgatcgatgttttgagcagcgattatattatgttggctcgtgccaaaggtttaacgcagtcaggggtggtttggcatcatgcgttgcgtaatagcttgattccagtcatcacgctagctggcccgttggcagtcaacttgatgactggctcaatggttgtcgaaaatattttctcgatcccagggattggggaacaattcgttaagtcgatcacgactaacgattatccgacgatcatgggtgtaacgatggtttattcctttatgttagtcgtagtaattttaattgtggatattctctacggaattatcgatccgcggatcagacttagtggaagcgaggttagtgcataatggcagatgaaaaaatgaatttacctaaagatgcctttgagccactaaaagcggacgaacagctaaataatgaacgaattgcggcaccgtcattaaccttcttacaggatgcttggcgccggctaaagaaaaataaggctgctgtgatctctttatgggtcctaattattataattgttttagccatcggttcgatttggttctcaccgcgtaacccgaacgcgcaaaatgcgtcctatgccaatttaccgcctaagatcggtaatggtttctggggttttgatggtaaggcgaaggttgccgggacacttgttgattcctacaagcaagctggtgttcctaaaggcacttattatgtgttaggtactgattatttaggccgtgatctattatcccggattttatttgggacgcggatctcgttattggttgcttttgttgccacattctttgatttggtgatcggggtcgcttacggtatgttttctggctggtacggtggccgtgttgataatatcatgcagcgggtgctggaagttatttcctccgtgcctaacttagttgttgttatcttgatgattgtcgtcttcaagccaggtattttctcgatcagtatggcaatcgccatcactggttggatcaccatggcgcgcttggttcgagcgcagaccttgaaaatgaaggatcaggaatttattttggcggcgcgtactttaggcgagtcaactaagaaaattgccttgaaacatttattgcctaacttatcgagtacgatcatcattcaattgatgttcacgattccaacggcgatcttctttgaagcctttctaagttttatcggtatcgggatcagtgcaccaaatgcttcattagggacgttgttaaatgatggttacaagaccttccgtttcttaccttatcaaatgtggtatccagcggcagtactgtcaatcattatgatcgccttcaacttattagctgatggtttacgtgacgcattcgatccacggacaagggggtaaccaaattggataatattttagaagttaaagatctagccgtcaattttggcacctttgccggggatgttcaagcagtacgtggcgtcagttttaatctgcgtaaaggtgaaactctagctattgttggtgaaactggttcaggtaaaagtgtcaccaccaaggcgatcatgggcttgctggatagtaacgcgaaaattaaaagtggatcgatcatgtttgctggtcaagacttgttaaaagcatcagcgcacgaaatggccgaagttaatgggaataatattgccgagatcattcaggaccccatgacatcgttggacccaacgatgtcgatcggtaagcaagtctcagaaccgctacggatccataaaagtatgtcgaaggaaaaagcaatcgcgcggaccaaagaagttttggaactggttgggattcagaatgctgaggcacggatgaaagattatccacatcagttttctggtgggcaacgccagcggatcgtaatcgcgatggccttagttaactatccgaaaattctgattgctgatgaaccaacgactgccctggatgtaacgatccaagctcagattctgaatttaatgaaggaattacagcaaaaaatcgatacatcgatcatttttatcactcatgatctgggtgtcgttgccggaatggctgatcgggtagcagtgatgtatgcgggtaagattattgaagttggtaccgtcgatgaaatcttttatgatcccaagcatccatacacctggggcttgatcaactcgatgccaacgttagatactaaggttgatcggctgtacgcgattcccggaacgcctcctgacttactcgatccacctaagggtgatgcgtttgcgccccgaaatgaatatgcgttaaaaatcgatacagaaatggaacccccatttttcccgatcacagcgacccatgcggcagcaacttggttattgcatcctgatgcaccgaaagtcacaccgccaccagaaatcgttcggcggcagaagatttaccaagatatggtcgctaaagggctagatcaacccaataatcctgctgtgaaattaaatacgccggcaacggactaaagataaggggataaaatattggctgaacgtaagaagatattacaaatcaaaaatctaaaacaatattttaatattggtaagccggatgaagttaaagcagttgacgatgtttcgtttgatatttatgaaggcgagacgtttggtttagtcggtgaatcaggttccggtaaaacgactgtcggccggagtgttatccatttatacaatcccactgctggtgagatcatgttcaacggtcgtaatattcgtcaattgaaatcgactaaagatcagttggagtttcggcgcgaaatgcagatgatttttcaagatccatacgcatcattaaatccgcggatgaaggtcaaggatattattgctgaaggcatcgatatccatcatttagctaaggatagtcaagaccgtgatgcgcaagttgctcacttattggaagttgttggcttgaacgctgatcattcgactcgttacccgtatgaattttccggtggtcaacggcagcgaatcgggattgcccgggctttggccgttcaaccaaaattcatcattgcggatgaacccatctcagcattggatgtttcgattcaggcacaagtggttaacttgttacaggatctacaagagcagcataatctgacttatttgttcatcgcccatgatctttcgatggtcaaatatatttctgatcgaatcggcgttattcattacggtcgtttgatggaaattgctacctctgacgaaatttacgctaatccgttgcatccatacacggaaagcttactttcggcagtgccggtgccagatccgcagtatgagcgcagtcggaagccaattccgtacgacgctgcagctcatgaaggcgacgataaagagcggcacttggttgaagtggtgccaggacattttgttcgcaccagtgaagacgaattaccagcttatcgtgaaaaagctgagcagtaccgcgcacaattagtttagactgaatttagagtgtcgtcatattaatttatggcggcatttttgttataaaaataccaatgttagcgtaaactttgctaaaatagagcagatgggatcatgatcgtatagtagagaaggaggggtttgttgttgccaaaagtaacttatatccgccggttaccgctcggggatggggttccgaagacgtgcgtgccgttgaccgcgactagattagctgatgtgttgccgcaattggcgccaatattagcagcgcaaccagatttgattgagtggcgcttggattatttagctgattttacagcgaagacagcgttgcttgcaactttgaaacaagtgcgtcagcagttgggtgaagtcccattattagtgacttttcgtagtcaggccgagggcggtaatgcagtcttaagttcaactgattatcagatgttattgcaacagttgatcaatagtgggcacgtcgatgctgtggatattgaattaagccgtggtgagtgcgttgcggctctgtgtgcacaggcacgtgccgctcaggtgcagtcggtagtcagtgcccacttcttccaaaaaacgccgccagttgacgatatggtggcattattagcgcaaatggggcagcagggggcagcgattactaaaattgcggtcatgccaagttcagcgcaggatgtactgaacttattgcaggcgaccttaactgccactcagcagcaaacacagccggtgatcacgatggcgatggggcagttaggtcagatcacgcggttggcaggtggtacctttggttcagcagttacttttgcaactgtcgctgccgcatcggcaccagggcagttgccattagcaacattacaacagatactaccgcttttgaatggcgattcaggaaaggaattagacaaatgagtttaggtatagtggttgtcgcgcatgtacccgaaatggcgactgggttggctaagttattacaaaatattgcaccaacggtgagcacaacagctgctggtggcaacagtgttggcgcagttggtactagtatggatcgtattgaacaagcttttaaagctaatcaagcaactgagttgttagttttttatgattttggtggtgcgcggcgcaatattgaattagctgcggcgtttggggataaaaatacatatatttatgatactgcctttaccgaaggcgcgtttacagcagcaacgatgttagaagctgggcaagatcgtgctgcgattaacgaagcaatccaacgattagtcattaaatagaacacaaaaacagccctaacgatatttttaccgttagagctgtttttattataattaagcgttaagtactttacgtaagaagtcttgggtccgtggattttgtggatggtcaaaaatctgttgcggatcgccttcttccatgatgtgaccgtcagccatgaagacaacgcgatcggcgacttctttggcgaagcccatctcatgggtgacaacgatcatggtcatgccttgctcggctaattttttcataacgtctaagacatcaccgaccatttcgggatcaagtgctgaggttggttcgtcgaacaacatgatatctgggtgcatggctagtgcgcgggcaatcgccactcgttgttcttgcccaccagataaggaagtcgggtaagcgtcagctttttcagctaaaccaacttcagctaatagggactgtgcttcttttgcggccgcttctttagttgcttttttaagctcaactggtgccaacatgacgttttctaacacagttaggtttgggaaaaggttgaagtgttggaataccatgccaataccttcgcgcaccttattcatatcggttttagaatcagaaatatcataaccgtcaacgacaactttgccagaagtagggtcttccaacttattgaggcagcggagaaaggtacttttaccggagccagaaggaccaatcatacaaacaacttcattatttttaacggttaaatttaagcctttgagaacttcgttactaccataacttttgactagatcagtaacgacaacacgattattttctgcagtgctcatttgttgattctcctttcaacggctttagacagccaggtcaatagggtgatgataacgatatacatgatcgcgacgatcgtccaaactttaaagccttggaggttacgggcgatgatgattttaccggtttgggtcaattcgaggataccgataacggataagatcgaggtatcctttaaggtaataataaattgattgataaatgatggaatcataatcttgatcccttgtggtaaaatgacacgccgcatagccttgccataagggaggcctaaactacgcgcggcttccatttgaccacgatcaacggcttgaatcccaccactgacaaaagctgcagtatacgcgccttcgtttagtgttaaggtaatgatacccgcgagaaatgcagagatcttgttacccgttaaattagggacaccaatgtaaataaataaggccaacaccagtaatggcataccgcggaaaatatagatcaatgtactggaagtccagttagcccattttgcagggacgacttgcattaagccgatgatgaccccaaaaattgtcgcaagaataattgaaataacagtaaggtacaaggtttgtaacaagccactacctaaagcacttttattttgctttactaagccccataaactattgtcttgtttcttagcagttgcggtggctttagcaacactagctttgcctaaatatttggcgatgatcttgtcgtactgcccattcttctttaatgcttttaaaccgtggttgaatttggccagtaactcaggattttcaccttttttaacggcaaagccataattaccaccggccgctggtttggtcacgattttcaggtcaataccgttctgaatcccgtaagccataactggataatcttcaaaagcggcaacagaattgccggtgacaacatcattatacatatcatttgattgatcaaattcagtgatcttaaaaccgtacttcttttgcaacgacttggcatagaccgcgccttgcgtcccaacttttaaggcgacatttttgccgcggagatcttttagagacttgatgttactatttttagcaacggccatgacctcaccggcgtagtaataaggatcagagaagtcaaattgttgcttgcgttcgctggtgatcgtcatgccggcaatgacaccatccatctgattggcttcgacggcttggacagcagcattaaagccgactggtttaagctggatcttgatattttcttccttagcgatcgctttgatcaaatcaatgtcgatcccagtgtatttaccattagaaccctgaaaatcaaatggggcgtatgtaatatccgttccaatggtatatgttttttctgcggcttggctggaagtggtggtcgccaatatcgcgccgaatacggtggaacataacagtgcgaaccaaattaactttttacgcataatggaccctccataaatgatgttatatttaataacacagattcatgttattaaatataacataaaaaaggaaggctgaccatgaaatcgacataaaaaatgaccattttttgacagcagcgcttaggtaacgtagacttttaatatacacaactgtactgaaaggaagttattagttatgattcgaccagctgaaaaaaaggatgccgcagcggtagtcccgattattaacattgtcttagaagaaatggaattaccctttttagaccacgttgaccaagcaacgttttttaaagtgttggcgcaagcctttcaaactgaagattatcgttatagttaccgtcacggtttggtcaatgaacgtgaaggcaaagttgttggagtggcttttggatattcagagactgcagaagcgcatattgatgatgcgttacagccatttttaccgcagctaggagttgctgctgatgacaaagtgttcgctgacaaagaagcgtttcctggtgaatggtatttagatacgctatcagtcgccagtgagcatcagcatcaaggtgttggtagtgaattattaaaggctataccagcggtagcacgccaacaagggctgactaaggtgggcctaaatgtcgacgtggctaattcgaatgcccgtaaattatacgataaaatgggttttcaagtagtcggtcaggttaagttggccgggcatgattacgaacatatgcaattgaacgtttaaattaaagtaattattggtagatacgtgtggtgctagtttgtaacatttagaaatttaacaaaaaagtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 631 - DNA, 5624 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccaaaataatttagcataattagcggcataatatgaaaaaaaaggactgagaaacatgcgacaaatgttgggtcaacgtttcggtcggctgatggttatcgcacgtgcggacaaaaaagtcgccaacggaaatattcagtggctctgtgattgtgattgtggtcgccaaatcgtcgttgatggctatcggttgcgctctggtcaaactcggagttgtggttgcttacgccaagctacaagtcgcgaaaatagtcgcaaaaatgcagcctttcagcgtcgtatcggcaacccaagtaacttaatacacgctaatggtatcttcttaaattcattagtcaaaagtaagcgcaacaaaagtggtgtgatcggcgtttccttcgatcagaaacgtcagtgttggtttgctcgtttaatggtcaatcaccattatgttttattgaaaagctttaaaagttacgacgaagccgttgcagcacggcgccaggccgaagccgcctatctacatccccaaaatagcaaaatggactcaaccgctagctttagcagttaagtccatttctatttaccgatagcttactagtcggtttcgccagtattgatcaccggctgcgttcctcgatcggtaatgattgaaactaacaaattattcacgatccgcattttacgctcatcatcaagctggagctggtcatttgcttctaattgactcagcgcatcttcagtcatagaaacggccccttcaacaatgatcttccgtgccgctaaaatagccgctgcttgttgccgctgtaacattgcactggcaatttctgtagcgtaggctaaatgtgtcaaccgagtctcgatgatctccacgccggcaacctgcaagcgctcctccaattcagtggtcaatttttgtgatacttcggtcgtattgccacgtaaagtgatcgcatcaacatccgcaaaagtatcgtaagcgtattgactagccacatggcgtacggcggcttcactttgaatttgtacaaactcctcgtaatgatcaacgttaaacaaagccttcgctgtatcaactacacggaaaacaattaccgccgcaatttctacaggattaccttgttcatcgttgacctttaaaatgtcgctattaaaattacgcactcgtagtgaaatgggttgtttgttagtcagtggcacagtgatgaacaagccgctttcatttattgagccaatgtaacgtccaaagaaggtcagcgcttgtgcttcatttggcgcaataatcgtcaaggcactgaaaaagaatagcgccaccactaaaagcagtataccgataataatgctaaacacaatctgttgaaaaacacccaaaacaatcaatccaccgccaaccaacgtcagtatgatcaagagtacgattccgagataaccattaatataccacgcttttttctcattcatttttctgacccccatttatattgcgcccgttcgccaccaatcaacttgggtcgactgcgtaaataagttgtgtgagcagcgccaactgttttaatgcttgtacgtacaggaatctgcacaaatttaacgtgcatcccgattgctgtatcgccaatatccattcctgcttgtgccgtaatatgctcaatttccactggatccttaaaattctcgaatgctgccatttgcgttgcaccaccagcgtgtaatgctggtacgacactaacaatctcccaattatgtgcttcggcaactgcacgttcaattgccaaagcacgatttaaatgctcacaaccttgaactgctaaatgaatcctccgcggtactaacaagtcttgcagcgtcttaacgactacccgaccaacttcacgacttgaatcttgaccaatgtgttccccttgaatttcactcgtactacaaccaaccacaaaaacatcgccggcctttagctgagcaacagctaataattcactggcaccttgcttgatctgcgttgcaatttcagttagatcaaccatccgcttacctccttttatttggccactaacaaaagacatatttgtccacattatgcgcggtcgtatacagtcggtcaagttaggctagacacgtactgagtttgcggtataatagaacacactattatttggaggtgaataaaatgaaatacaccaaacagcatcgcaacactaatagcacccaacgtgatcaaacttgggaaaagttcaagaaacaagccaatcaactaagcgcacataagcgcggcacgcgccgcaatgggcattaaaaagagccaagaacaattattgttcctgactcttttttgataccgctaataattgttccaatgtggctaaaacacctgcgtgctccgcatcaagttcagttagttgttgtgccacggctttaacaaagtcaggagcattttgcatcgcataactttgaccagcgacttgcagcatttcaatatcattagcgccatcgccgaacgcagcaacttcagctgaggtaatttgccaacgttgctgtaaaaacgccaccgccgctgccttgctaacatcgccacgcacaacatcgattacaccatacccgctgtcatgggcaactaatttaccagcaaaataatcattcaacgctgtgacatgttcagccgcaactccaccatgataagccaaactaattttcttgatcggctcagtaacttgagttaaatcagttggctgtaagttggcgtaaaacttacttgcttgagctaacaaatccggtgctaccccttgattagtgtatgaacgctcattaccggttaaaataacataagcatgttgtaacgccggaacctgcgcctggtacgccgctaaaaagtccgccaattgttgttgcgtcaacgcaccatcaaagatttgctgatcctgccaataaatcgaggcgccattttctgcgacataaattaaattatcagccgtcaacggcgccaacacttcgcgtaaatggcggtactggttgccactgcaaaccgcaaaataggcttgctgttgcgccaaacgctgtagtagccgagcaaggcgtgtatgatccacctgctgcgctgcattgagcaacgtcccattcatatcggttaccactaattttatcatcgagccacttcctctacttcacaattattgattaatttttgtaccaaaaatttttgatgttacgggcgatggccattcttgtggcataaaacgtaccgcaagaaacatggctctacttcacaattattgattaatttttgtaccaaaaattttttgatgttacgggcgatggccattcttgtggcgcaaaacatgccgcaagaaacatggctctacttcacaattattgattaatttttgtaccaaaaatttttaatgttacgggcgatggccattcttgtggcgtaaaacatgccgcaagaaacatggctctacttcacaattattgattaatttttgtaccaaaaatttttgatgttacgggcgatgcgacttggacttgccataccttggcattagtccaatcgacatcggcaagcaagtacggtttggcaaataaggttaatatctgatacttgctaaccagtatggttaaaaaacagcgacagtagccatccttgtggcgtaaaacgtgccgcaaagagatggcgctacttctatgaactacacctctttattctaacgcacgtcagcacaaaaaaactaggagcttcgcactcctagccaaaatttattttacttttaggtcagctaattgggcttcgaccgctgaacgatccacaccagcttgcaataaagctgccgccgtataggcaccttcgactaacgcaacatcatacaagtgcaccggcttatcactaaaatcttgtgctaattctaaattcattttggcactacctaaatcataaaaagctaagatctcggtaccagcattatcgctgattgcttgttgaattttttcgacgctagtaccaacaccaccgtcgtcagttccgccagccactgtcaccgaaacatcagcggcgacttggctgatcagcgtttgcacaccagctgcaatcttatcaacgtgtgaaacgatcacgatacctaaactcatgcagtcacccccgctttcaataattcactgaatagatagccactggaaactgaacccggatcaagatgaccaatcgaattatcgccaacataggacgcccggcccttagtggctttcatcggttccgttgcctgtaccgcatctgtgatcacttgttcagttaaattgccggctttggctgccgcaacgactggcgcccacacatcaaccatcgttttctcaccagttgtcgcgccgccacgcttttgaatacccgctaaaccagccgccaaaagttcagcaacatcttgtgtctcgcgactagctttagccatttctaaaaacgcggtcccatataaagcgcccgacgcaccgccaactttactgactaaagccattgcgatcgtcttcaatgctgcagttaaatcagctggcgcttgcttacttaatgcatcttcgattgccgcagccccacgcgccaaattattaccgtggtcaccatcaccgattggcgtgtctaattcacttaaataagctttctgagcagttacagtcgcatcgaaaccgtgcaaccatttcaaggtatcttctaaagttaatgtcatcaattgatcttcccttcattaaattaaatttcggctaaacaacgcgcattagtcggaaagtcagtgccttggatcatctgcggataagcagccaataaatcagccgtaaactgtggcgtcagtggtttaggcgctgacaacacctgtggcagtagatccaacgggtcatctaagtcaacatcatgggcagtcaagactgcaatcagttgcggtaatgactgaaaatcacgactgacaatgtaatacggccgcccggcgatcttaaacacaagtaacaaccatagcgcagtggtatctgccgctaaattacccgcgcgtaaatagcctagttgcaccgaaccaaccgcatcccatgattcttgcagaaaagttacacctcgctcatcacgcagtgcaatttgcgctttagttaaaatcaaagtactcgctgtgacgccagcggtggtaaaactgaaagtcaatggcgtcaaatgcgtattgattttagtcgcgatatccttagttgctggcgcgcgttcaccagaaaataattgtggctccagcgtgtacatgaaatttcctcctcaagttaggtggtactgtcaaacgtacctcgtttttgttattaatttccgaatattaaaaaacacccgaacgtctttttctggtattcttggtgtgcgaacaacaagaaaatccagaaagaaggattcgagtgcatacaccattaatagcctatttag

SEQ ID NO: 632 - DNA, 11487 bp, Unknown
  Metagenome-assembled genome
ctaggtgaaaaactcgacatggcggttgaaacattaactattatttttgacgaatttataaaagcattaccgagtagcctggccaggctactcggtaatgctcaatgaagtggaaactagtaatatatcgtgccataaccgtttgacatcaatggttacggtctatttgatactttcaacctttagctagatataacaaaacagaaaggtcgcacgcactatgaaattgatccaccaacccattcaataccaaaatgaacccgctgccaaattaactggctaccttagcgacaattcccctgaaatcgattctacgcgtgttcgccctgctgttgtgatctgccccggcggcggttatgaaatgacttctgatcgcgaggccgaaccagtggctttacaagttatcgctagtggttgccaagcttttgtcttacgttatagcgttagcccgacccgctatccaatggcgttacatcaattagcctacagtgtcgccttgattcggcagcatgccgccgaatggcacgtcgacccacaaaagatcattgttgctggtttttctgctggcggccatcttgctgcttgtctaggcgtattctggcatactgctgaactagctaatattggtctatcaccggcgcagatgcaacctaatggccttttactcagctatcccgtaatcactagtggtgaataccgccatcaaggctcctttaacaatttacttggcactgaccaagcagctttagctaagttatctgtagatcagcaagtgactaacatgacgccacccacctttatctggcacaccgttgcggatggctcagtaccagtagaaaatagtttactatttgctcaagccctacgtcgtgcgggcgtcccctttgagttacatctatttcctgatggctgccatggcttaagcctggccactcctgaagtcaatcctgatcaacaatttgatcatcccgaagttgcggtttggtttgacctatttatcacttggttgaggcgtaatatctaaatattgatcaatcggactttgacaatatccgcttgcaatgaaatgtcttccacaatttgcgtatacgcaagctgccgggggacttttattttatagatattagtataaaccgtcccctgtgcggactgctcactgctaaaactaacatccgtgatcttaatgcgttgcgttttaaagtattgtcgcaagtaacgcttagtggctagcttatcccgatacttgatctcgattttctgcaacgtatcaatatgaatgattttctgcaaaaaggctaggacgccgatcaccacaagcgcgctgataatggcaatctcataataacccatccctaccgcgattcccagtccagcaactgcccatagacttgcggcagtggtcaatcctaaaattgagtggcgggtcacaatgatcgtacctgcaccaagaaagccgataccactgaccacttgcgcgatcaagcgcgcttcgtctgcgcgtacaaccccggcatagcgcggaaaggaacgcgcaaactcaatcgcctgaaagccgattttttgctggatcatggcgatcacacaagcgccgacgcaaactaaaatatgtgtccgaatacctgccggtcgattcttgtactcccgatcataaccaatcactcccgcaatgatcaccgctagtagcaatcgggccacaatttcatccgtggtaactctaagcaccatctaatccctccaattattttgtaaaaatatgcttgatcatactctttaaactaggtgcacgaactaacttctccgctccaatatgatcacgcattgtccgcaagacttctttggcatccttagacgcaaatacgtaacgcacattgcgcgttgtctgaatcgtatagcgcttcacttttttacccgcaacttcagtgattacttgttcaatatcagtccatggtatctggactgagttgcgttgcgcccgtttattaataaattcaaacccttgctcaccgagctgaatcttaccgtattgttgcgtccctaaaaataaagtcgccgtcactgttaattcaagctgcgtattgatcgattcaaccattatcctaccccactttttcaactgttattatggataattatagcatttacactaccaatttaacggttacacactaagatatttcaaagttaagcgcgcttgaaatcgcgcttaactacaattattaataaaccagcaactactacgcctcggttcacttcactagcaccacaaaaatagcattaccttcatcaattgaaggtaatgcttatttaacatcctatagttcattcccgtggccagtaattctcttatacaggcggccaaagctgcgttttataacatcgaagaaacttaatgaccgaaccatatgactagggtcaatatgttcacgaataccacgcaataacgcctttgtttttttagctgaaaaggtgaaagtcccgttatgcttagtacgcatcgcaaaacgtggaatccagcgtcccttaaacatgactgacgccaacacataatctagttctgaccatggtatttgaataaaatcacgcttattacggtcattaaaaaattcaaaacctttgtcaccgatcataattttaccgtatttagctgtccccataaaagaggtcgcatcgactactaaatcgactttggtgttgattgattgtactgccatcagcataactccatttctttttcatattctaaaaaacgatccacctatagtttaacaaaaaaagtccgggtacgaagacccagacttaataaagcagttaattacataacgtgtaagagatgtaaaacaacaccgactacgaataaaccaaggataacaatgattggtgatactttcttctttaataaccacatgcataagaaagtcaatagcaatcctgctaaaccaggaattaattgatctaagttatcttgcagtgttgttactttaactttgtccaaggataaaccagcagcttgttgtgttaaagcttccttgatcccagctgaaccttttggtaagttagcccaatcaataaaagcacctttagcttgtttgattgaagaaacaaccggcgtaaatttaacaacaacccaacgattgatcaaagaacccaagatgaacatacctaaaatagttgcacccttagtaactttttgtagtaaaccaccagataaatcatcagaaattgatgcaccggctttgtaaccaaattcctgtgtataccacatgaaagccatccggattacattccataaaacaaaatacaagattggtcccataatattgccactgattgccaatgaggcagccaaggcacctaagattggcttaacggtgaaccagaatactgggtcaccaacgccagccaaaggacccatcataccaactttaaccccttgaatcgcaacgtcatcgattggagcgccattagcacgctcttcttcaagcgccatagtaacaccaataattggtgaagccaaatatggatgggtattaaagaattccaaatgccgtttcaaagcagcggcacgatcttctttagttgtatatagtttctttaaagctggaatcaaagtataagcccagccaccattttgcatacgttcgtagttccatgacccttggataaaggttgaacgccaccaaacagcaatacggtcttttttagttaattcaactttttttgttggttcaattttattatctgccatttttatacgctcctttcgctaataattatcgatgatatcgccaagtgggtcaccggagttagcgggaccaccgttacttgagccactcttttcagaaaggttcaagtagatcaaggccatagaaataccgatagcaccaaggccaatcaaagttaagtctttaacagttgctaagacaaaaccaatagcgaagaatggccatacttcagcagtagccatcatgttgataaccattgcataacctacggcaacgaccatgccaccaccgatagacaaaccatcagttaaccaagtaggcatagcgttcaatacttctcttacagggccagcaccaacagctaaaatcaaagctgctggaagggcaatacgaacaccttgcatacagattgcgataacatgccaagtttcaatacctctgaagctaccttgttcagcgtaacggtccatgatatgaacaatagcggttgcaattgtacgagcaagaattgttaataacaatccggctacggctaatggtacggcaatggcaatggctgatgaaacgccgcctttaccttgaccacctaatactaaaataattgcggatgctacggctgctaaagcggcatcaggtgcaactgcggcaccgacgtttgaccagcctaaggcgatcatttgtaaagtaccacctaagatcatgcaaggtactaattgtcctgttactaagccgattaacgtacatgcaataactggctgatggaaatggaattcatccaaaataccttccataccagcaaagaatgctacgataatgactaatatcacttgaataaagtttaaatccatgatgattaatcctccgtttccttctttttattaagcttgtttatttaattcgtcttgtgcctttttaaggatactatccatgttttcaggagaatcaccgggcactttacgaacatcaaacttgatgcccttttccttcaaagtagcaaatgtatcaatatctttttggtcaaaagctaagactttgttaggttgaactttcccaactgaatgagccattgaaccgatgtttagtgtatcgaatggcactccaccttcgacggcacgcaatgcatcttctggtgtttcgaataataacaatgcacgttggccaccaaagtgttggtcatccttagctaatttgatcatttgatcaaccggtacaacatgggctttgacaccagatggtgctgcctgttggatcaagttcttccgtaagtcatctttagcaactgagtcagaaacaacaatgatccgtgttggattcactgatttagtccaagcagtggcaatttgaccatgcaacaaacgagaatcgacacgtactaagacgtacttcatcttgcctggtgcaccagcactagcacctgatttagcagccgcttttggcgcttcttttggtgctaattcttctggcttgaccttgaccccatctttagctgtttcgataatgtgtgcggcaatttcatgcgcactgttcattgaaagccgtgatgcataagcttcaatcaacattggcaagttcaatccggcaacgatcgcccacttgtctttatgttcttcaaacaagttatttgtttgattgaacggtgtgccaccccagagatcgactaagaataagacttggtcttggtcactgaaagacttgattgctgcttctgcttttgccttaaagtcatctggaccttcgctaggcatcaatgttacagctttaacatcctcttgttctccaaaaatcatgtttccggattgcaagataccttcggcgaattgaccatgactagcaataacaattcctaccatctttttacctcctactaaattaaaataatgaaataagtgcaagagcagtagtttcacccactacccttggcaggaaagccctgccaatattgtttaaaatgaacccagatgcacatctgaattcaattagaaaccatttcttagtagcagatcgcttaaattttgcttgcgatctgccggcaccttttgcgcgtatacttccagaccaacttcatcatgcagataatgaattgcctctgcttgtaccggcccgatggcaactgaattcgttaccattttcatcccctcatgaaacgctaagctaccaatatcaacgccgacttgcgataagtcgaggccacctttgaccaaacgagccatatcttccacagtttctgtcagcaacaatggcttaaaaacatcaaaccgtagatcgtgataaatttggatcattttatctactgtaacgacattagcacggatcccaggtggtgctgcctgagtgatcaaggttttacgtaaaacatcgtgcgccactgtatccgaaacgatcaagattcgatttggcttcacgcttctagcccacacggtcgcaatttgtccatggagcaagcgactatcaacacgggctagacaaatggccatcgtcatccgcagcttacctcctaaaacgtgttcagttcaagatgtttaacgcctgctctagccgtctcctcgagatgggaaacgatttcagaaacagacttatctctaactgtatacgattctaaaagcattggcaagtttaaccctgtaatcagcgcgtacttgtctaaattttcagcaacaatttgacttgccacgttaaagggagacccaccaaagagatcaattaaaaacaaaacctgatcatcctcatcaaaagtcgccaacgcgtccttaaactttctcgtcaagtcatcagaaccttcattaggcatgaatgttactgcttgaaccttttcttggtcaccaaaaatcattcgcgaagattgtaaaacaccttcagagaatttaccgtggcttgcaacaatgattgcaatcacattgtcacctcccactttgacctacacttatatattaagcaaataccgtgccaacttttgtgtatcgcttgcaaacgtctataccacttgcttttcaaccacaaaaaaagtagtgatacactatcgatacagtgtatcactacttaatttttccttaagacacacttttttgggcttgtgtatcgaaaagttgctcaacatagtaaatttcatcgtcattaaggcttaattgtagctgttcttgtaaaattgcattactagcttggatgccagtgtagtaaggtgactgtttgatcgttgctcgctccaccgccgttgctgtaaccgtttgccgcaataatgttcgttccagcgcaccagcaacgtgcaaaattaaaccgatccgaaaagtttccgtaaaacttaattttagtgtatcgcttagcgtgtcagcgtaacgccataagatatcgatcagcttatgcggatttaaatacaagaagtaatccttcatataagattcgcataattccttagttaaattaggcgtcgttgcctgtaactcttcatgatcgatttctgtcatcacttgttcaaagaaatcacggccgtcatcctgaatcagacggtccagtgccacaaacggtacttgtagatctggcttaacgatcccagttgcggcaatgatatggtatttttggctcagatcgtacagcgtttgtttcatgttaaccaccgaaattgggattactgccacatcgtcgatcaactgatcaactaattgctgctcaatcattttttgaatccgcactgctgtcccttcaccagttgaacaaatcgctaccactgcccgtggcaatttttgttgcgctggctcggcagtcaatgctttaactgatggtagtgtatcgccgttaaccttggagtagccgtggaattcttttagctcgctgtaaatgatattcagatcattgtcaatcagttccgttttgcgaaccgcctccaacaccagtgccgtggtgaccatatcgatcgtctgtactttgatgccagtttcttcgtaaatgcgctccgaaaaggttgacagcgagcccatgtcgacgagcaatatgacgccattgccgttatcggcttggcgaaccttttcaacgatgccctgataggcgatctgcgggctcatttcgatcggcatatcgtaggctagtaagttatcagccgacaataatttattgacaacttggaccattgatgacgcagtgctactaccatgggccgccacaacgacaccaactttgccggcgacttgaactgagcgcagcgacgccagcaaaatcgttaagtaatacacttccgacttaggaatcggtacattgtaatgggtctccaactcctgtttgatcaggtaggccgcttccaattctttcgggtaatcagcaaccatccctttcagatcttcactgatattgcggactaatttaccagactggattcgtttgacgaaggaactaatgtgcaaactgaccgcataaacaaagttccgtttaaaggtgtaacccagtaactgctgcactttgccttggatctccttggtcagatcgatgatatcgtgatcaacgatttcggccagcttattgtccgcctgctcgtcgatcgccgtttcatggtaaaaggatttcaaatgcaaattaatatcggtggtgatgaaattgttgatatgctcctgatctaagccttctgacttgagaatcgccgccttatcgccaatgatctcatataaattatatggtagctcatacgcatcctgctgcagcgtcgctgacgtctgatcaggaccgatcaccatcaccggttccaataatttggtcacttcgcctaactcatcacggttagaagccaaggtggcgatacctgcttggatcgttgccggtaggtcttcagctgtgatcatgattgaatcgtcggactgcatatgccgcaaaaagccttgggcacaaaccaattgaatattcgacttcaattggccgacgttcccgtaggtcacactgccgagtaacgccttgaccacgtcttcgctgatctgcacctgcttgtggatccgattggcttccaaagaaaacagtgactgcaataattgcaaccgttccttggctggccgctgattaaacgctggtaattggattgtgatcgggatccgccgcacaaacgtttctaataagctactttctggattttccgtggtcgcacaaaccaaacgcacattagcatgatgggttttagccgtttcacctaagcgactataagtaccgtgatccatgaagtagaaaatcatttcctgaccttctggcggcagccgatggacttcatctaagaacaacatgccaccctcagcctcctgaatcagcccatctttgtcctcattagcaccggtaaaagcgcctttggtgtagccaaataaatgcgacatcagtaactccgggttgtgggcgtaatcagcacagttaaaggtgattagcggcttttcagtatcaatgattttatggacactggaaaattgatacattccgtggacgaaaaaagttttccctgacccagttggcccaatgatcaacgtatttaaccctttaggcggataaagcattgccgctttagcctgctcgacttgatttttcaagctaccttgtgcgccaatcattttatcgaaaaaatcagtcgtcacttccgctgctggcggtgttttgaccactgtgggcacgggcgtcgatacacttgctgcctttggctgctgcgccaattcaggcgtgatatatcgcactggccgaccagtcagcttgatcaatttaccagtgcgcaccaagtcatttaacactttggagacatttggccgcacgatccccagatcagccactagctgcttcgtagtcgcgccagcaccgtgatcgatctcctctggcgtcagttgttgcgaaattttgacaactcgggaatagatccgctcaattcgtttcaaaataacttaccccttaattttagcgtgtgttcattcaggtcgcggtgaccgtttttctaacacatttcggctaactgattagtgacgagcaattatatttttagtgtatcacaaagtgatacacaagcaaccgaacagttgaaaaaaactagttaaaagggctggataccttctaactagtttctaagatcatatattctatttaatcagccagctagctaatttcggttgcttgttctgcaaccaaagcataggccgagtttgtaataaccaccgcttaaagcgcggtgataacttttcaatactgatcaaggctaaaattaaaaatggaataccaggaatgatcggaaaaatcaacccggctaccccgagcaacaaggacgttaaggcactaaaactccaaaaaacttttaacagtaagaatgtcattcacatcagcctcccaagtcggtcatcaataggttactagtcaatcatagattgaatttcaccacttcagccaccaaacgcagcgccagtgatattaagttaacataaacccagctgaaaaagtaccatttagcctagcattaaggaaaacataataactattctagcaaaaatccttgccgttgtagcacttgcagcaactcagcccgtttttctggttgtaatgacaaacgttgctgcacctgatttgtaaaagtgtcaacgcgccgatttgcgtcgcgcagatcatagtattcgtgcacccgcgcgtcatagtcggctaactgcggtttcactggcattggcagttgataagtattttcaaaatggacaaagcgttccggcaagcgcggctttaattgcggcgcctgatccggccagccgatcgccaaacccaacactggaaaggtcaattgtggcaattctaaaatatcaatcagctgctgggcatcgtttaaaatactacccaaaataacggcacctaaacccagactttcagctgccaccacagtgttctgtactgccaagcttgtatccgaccacgcctgtaaaaaacgatcggcgccacctaaatgattcgcggtcgtgcccatttccgcaccaatctgctggttacgatgctgatcagcgatgaaaacgaacaaatgaccattgtctgccacataaggttgttttgaaatcgccgcgatctgttgcttcttggccagatcagtcacactgatcacactgaatgcctgctgaaaattagaagtcgctgtatgttgtgccaccgcgatcaattcgctgatcatttccggcgccactggctgattcttaaacgcccgaatcgtgcgatgagccaattgccgtgcaaccgttgagttctctatcatattaagacctgctttctgctgaaggatataagttaattataactcacaccaaattctgcagacatggtaacttatttttccccgtcgccatatcgcggtgggattttttgtttaataggccaattttgtgataatcgccgttgcttgcaagtatcttaacttctgctattatgagtatataaaaagcggacaccattggccggtgcccgctaagcggggagtgtcaagaagtttgtgtaaatgaaaatcccttctcctggcaaaataaagtattaatcgaaaagatttaattttatggagaaagagcaatcactttttacacaaactttggatgtaagctgattcctgagacaacttttaagagagggtataatgaataaatcatctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaa

SEQ ID NO: 633 - DNA, 28876 bp, Unknown
  Metagenome-assembled genome
tcctactgggtgcattgagcgattagctcattagtaacacataaaaagtttcgggaaatagctcagcttggtagagcacctggtttgggaccagggggtcgcaggttcgaatcctgttttcccgattagatccaaagtatcgcggtgtagctcagcaggttagagcgtccggttcatacccgggaggtcgggggttcgattccctttgccgcgataggtttaaagagcttggacctttagctcagttggttagagcagacggctcataaccgtccggtcgtaggttcgagtcctacaaggtccatctttgatggatgttgttttaaaccatctaagttttatataatattatcgcgggatggagcagtctggtagctcgtcgggctcataacccgaaggtcgtaggttcaaaccctgctcccgcaattggttccatggtctagttggttaggacgcctgcctgtcacgcaggagatcacgggttcgagtcccgttgggaccgtttaaatatggctcggtagctcagtcggtagagcaatggattgaagctccatgtgtcggcagttcgattctgtcccgcgccatcatattcagttattctatagtatgcgggtgtagtttagtggtaaaaccacagccttccaagctgttgtcgcgagtccgattctcgtcacccgctttactatgggcctatagctcagctggttagagcgcacgcctgataagcgtgaggtcgatggttcaagtccatttaggcccattttggggaagtactcaagtggctgaagaggcgcccctgctaagggtgtaggcgggtaacaccgcgcgagagttcgaatctctccttctccgttttttattttttgtatggcccgttggtcaagtggttaagacaccgccctttcacggcggtaacatgggttcaaatcccgtacgggtcattttcagcttggaggattacccaagtggctgaagggaacggtcttgaaaaccgtcagatgtgtaaaagcatgcgagggttcgaatccctcatcctcctttatattatcgcgggatggagcagtctggtagctcgtcgggctcataacccgaaggtcgtaggttcaaaccctgctcccgcaatatggttccatggtctagttggttaggacgcctgcctgtcacgcaggagatcacgggttcgagtcccgttgggaccgtcgtaccgtgttaacggtaagacggctgatgaagaacaaaagcaatttgcttttgttcttttttattcatgagtccttttaaagactagaacactgtgctacactagtttatggtttatatttaggttcccgaaaggatttgtagttcgactacaaaggtgccttgtaaccgattattttaagggggaatatttttcttatgcgagaaagacatttatttacttcagaatccgtttctgaaggacatccagataaaatcgctgatcaaattagtgacgcaatcttagatgctatgttagaacaagatccaaaagcacgtgtggctgttgaaacaacggttacgactggtttagtactggttgtgggtgaagtttcaactagcgcatacgtggatatccaaaaaaccgttcgcgatacaattaagcggatcggctacgatcattctaagtacggttttgatggcgataactgtgccgttatggtggctttagatgaacagtcaccggatattgctcaaggggtcgatgattcattagaagcacgcgaggctgatgaagatccattggacaagatcggtgctggcgatcaagggatgatgtttggttttgcaattgatgagacacctgaattgatgccattaccaatttcattgagtcatcgcttaatgcgcaaggtagctcaattgcgtaagactggggctattaagtatttacggccagatgcgaaagcacaggttaccgttgaatatgatgatcagggcaaacctagtcgtgtagatacagttgttattagtacacagcacgatcctgatgcaacacttgaccaaattcgcaaggatatgatcgagcaagtgatcaaagcggtggtaccagctgatctattagatgatcaaaccaaatactttattaatcctacgggacgttttgttttaggtggaccacaaggtgatgcaggtttaactggacgtaagatcattgttgatacttacggcggttatgctaagcacggcggcggtgcgttctctggtaaggatgcaactaaagtcgatcgttcagctagttatgcagcacggtatattgctaaaaatatcgtcgctgctggctttgcaacgcgttgtgaagttcaattagcttatgcaatcggtgttgctaagcctgtgtcgatctctgtcgatacacaagggacaagcaaagtgtctgaagcggcattagtggctgctattcgtaaggtatttgatttgcgaccagcaggaattattaaaatgctagatctacagcggccaatttatgaacaaaccgctgcttatggacattttgggcgtacagatgttgatttaccttgggaacgacttgataaagttgacgcattacaccaagaactagattaacgagtaaaagaggcgacccttaccaatttatttggtgggggccgtctttttttctgcgatggttataaaaaatgagaggaagtcgttatgcgtaaaaataaaacgaatgtgatggtggtgacggttgcgatttttatcgcgacattcatgtcagcaattgaagggacaatcgtatcaacagcgatgccaacgattgttggtgatcttcatggccttaacatgatgaactggattttttcaatttacttattgaccaatgcgatgttaacgccgatttatggtaaattggctgatcgggttggccgcaagcccgtatttattactggcttggcaatttttattattggctccgccttatgtggtttagcgcaaaatatgatcacgttgatcattttccgggcgttacaaggaattggcgcgggggcgatcatgcccgtatcatttacgatcattgccgatatttatccgttacaaaagcgggcaaaggtccttggctttaacagctcggcttggggtattgcttcggtagtggcgccgttattaggtggttttattgttgaacggttaagctggcattggattttctttctcaatgtgccaattggcattattacgatttggttgatctggcaattcttagatgaggaacgtaaagtcacccatgcgccaatcgattattggggcagtatttggctaatgctgacgctattgacgatcatgtatgctttccaagtcatggaacaaggcttcacattctggctgatcgggttgtttattttggcagttggctgtttttggctatttattcgtactgaaaaacatgtggctgacccaattatttcgttagatctatttaaaaatacgacctttaatgtgcaaaatgtggtggcggcgttagttagtggctttttaatgggctttgaagtgtatatgccaatgtggatgcaaggcattttaggcttaccggcttcgatgggtggttttgtggtaacgcccagttcattgatgtgggtggtagcttcgtttattacaggcggtttattggctaaatatcggccgcggttgatcttgttctggagtctactcttattgacgattggcagttttgtgctcgctatcgtaccagagacgacacaatttgctttattcctcgttattgctgctttccttgggcttggttttggtgtgacgatcacgacgaccaccgtagtttcccaaaattcagtgactaaggatcaaattggtgtggcgacctcatttaatacgctttgtcggacgttggggcagacactgatggtctcggtttatggtattgtgattaatttacacttagctagtggcgtccaacaatatcgtgatcgcggtgtgactagtgatatgatgaaccaattggtcaatccgcaaacagcggttgatctacctgctaaattactgccaacactgcggcagattttatatagcggcttacacgtgatctattatgtttccgtcgcgttgatgattgttgcgttgttaattaatgttttggctgatcgtaaacctaataaaaacgctgcttaatcggcagcgtttttttgcggtaataaattgaattttaaaaataaccaccaggttaaacaaagtccagcaaatccccatgtccaaccagctagcacgtcactagtattgtggacgccgacgtagatacgacttaggccaatcaagagaatgagaagcgccgataaactatttagtatacggcgctttttaaaatcggcaactaggtagtaagtgatgacgatcagtgcgccgaagaaggccatactaccagcagcgtggccactgggaaaactgtacccgccagcgtagactagatgagtagcggcggttggtcgtggacgcatcactaattgtttcactaaatgattgccgaggccaccgactaaagcaacattgactaggctaaacaatgctagttgctgctggcggaaactgagcagaataatcaaaacgactgcgtttaacagtgcgctattactgggattaccaaaattggtgatggcaataacgctaggattaagccaagtggtacgcaaattagtgaaccaagcgttgacggatagatcaaattgagtcagccaagggacttgctgccaaactaagcaaaaaaacagggcgaagataaggtaagcacctaagctataatataatagccgctggcgaaaagatttcgtggacatggaaataactcctattttataaattaagtcggtttattcgtataaataaggatagtgtaccatgttatggtaaaacaatcttgaattaaaaaattctttttggtatgatttgagtattaataagaaatgttgatgaggagtagtaacttatttgcgactagccagcaagcgattggttaatggaaaatcgtagcgggaataagtgaactcaccttggaataatcgattgaactcaagtaggtcggttcgtgtgccgcgttatggcaaagtgttgcgtttttagcgcaaaatgtaggtggcaccgcggtccattcgtcctacaggaattatttcctgtgggacttttttcttatcatacagctgaaagggagttaactcatgagttacaatcacaaagtggttgagcgtaaatggaatcaatactggttacagcacaatacgttcaaaacaacagaggatccagagaaaaagaatttttatgcgttagatatgtttccttatccatctggtaaaggcctgcatgtaggtcacccagaaggctatacggcaaccgatattattgcgcggatgaaacggatgcaaggctttaacgtgctgcaccctatgggttgggatgcttttgggttaccagcggaacaatatgcgttgaatactgggcattcaccagctagctttacccgcaaaaatattgaaacgttccgtaagcaaatcaattcgttaggtttctcctacgattggggtcgtgaagttaacacgacggatcctaatttctataaatggacacaatggatctttgaacaaatgtacaaaaaaggcttagcttacgagtccgaagttttggtcaactgggcgcctgatttattaggcggtactgttgtggctaatgaagaagtgatcgatggtaaaacggaacgtggcggcttcccggtttatcgggtaccaatgcggcaatggatgctgaaaattactgcttatgcggaacgtttattggatgatctagacttagttgattggccagaaagcattaaagaaatgcaacgcaactggattggccgttctgaaggggctagtgttacttttagtgttgccggacatgatgacgctaagatcgaagtcttcacaacacgacctgatacgttgtttggtgcgtcctacatggtgctggcaccagaacatgatttggttgaacaactaacgacaccagaccaaaaagacgcaattgcggtctatcaagaagaagtttctaagaagagtgatttggaacggactgatctggctaaagaaaaaacaggtgctttcactggtagttatgcgattaacccggttaatggtgaacaaattccgatttggatcgccgattacgttttagcttcttatgggactggggcaatcatggcggtacctgcacatgatgatcgtgactatgaatttgcacggaccttcgatttgccgatcaagcctgtaattgaaggtggtaacatcgacgaagcagctttcactgaagacggtccacacatcaattctgactttttaaatggcttggataaaaaaacagccattgcgaaaatgttggattggttggaagaaaaaggtattggtgaacgcaaagttaattatcgtttacgtgactggatcttctcgcggcaacgttattggggtgaaccaattcctgtgattcattgggaagatggcgaaacgaccttggtaccagaggatgaattaccattgatcttaccaaagacggcggacgttaagccttctggtagtacagaaagtccattggccaatgttgaagattgggtcaacgtggtcgatgaaaatggccgtaaaggtaagcgcgaaaccaacaccatgccacaatgggctggtagttcatggtatttcttgcgctatattgatccgcacaataaggacatgatcgctgacccagaaaaattgaagcagtggttgccagttgatctttatattggtggtgcagaacatgcggtcttgcatttattgtacgctcgtttctggcacaagttcttgtatgatatcggtgttgttcccacacctgaaccattccagaagttgtataaccaagggatgatcttaggtaacaaccatgaaaagatgtctaagtccaaaggcaatgtcatcaatcctgatgatatcgtggctgaatatggcgcagatacgttgcggttgtatgaaatgttcatgggcccattagacgcctcgattgcgtggagcgatgaaggtttaaatgggagccgtaaattcttggatcgggtttggcgcttatttgttgatgatgaagatgaattgcgtgatcgcgtgacgacgattagtgacgatgctttgacgaaggtctacaatcaaacggtcaaaaaagtcactgaagacttcgaacatctgcatttcaatacggcgatctcacaattaatggtcttcattaatgaagcttacaaagctgaaattctaccagtagcttacgttgaaggtttcattaaaatgttgaacccaattgcgccacatatgactgaagagttatggcagaagttaggccatgatgaaagtatcacctatgcggcttggccaacttatgatgccagtgcgttggttgaagacaccgttgaagttgtcctacaggttaatggtaaattatgttccaaggtccaaatcaacaaggatacctctaaagacgatatggaaaaactagccttagctgatccaaaagtgcaagaatttattgccggtaaaaccgtacgtaaagttattgcagttccacaaaagttagttaatatcgtggctaattaagctatccgtataaaaaagaaggtgctgatttatgccagcaccttctttttgcacgttttctagtatctaatgcgcgttgaaaatgataaaattaaatttggtcgagttttatttgaccaaaaaaacattggcggcggcgtgacggatcacgtagctggcggtcgcaccgagttcaccgtcttcaaaggcgttattcccggtggcaccaaggaagatcagatcagtgggttgattatcgcgactataagtgacgatttgttccttcggataaccatagaccattgcttgttgcacattgatatgctgctgttgtgctgttttttgataagtgttcaacagctcttcggctaattgatgttcagcgtcgatcaggcgtaaatattcagcttcaaaacgctgtttatcatagccccgatcattgatcacatataaaagggttaattgtgcgccagttacggttgctagatcaacagcggcctgaaaagcccgttcggcatttttagagccatcgactgcgactaaatatgttgcttgctgcataagatcgccacctttacttatttacttcattatagaagcttcttgcatcaagcgtcaaagaaaaggcgctgtgcaagcattgaatcaatggctgtcggccagcaacaggaaatcagttggaatatgccagcatgacatgttcgtgaaacttagtttgtgagggatatgattatggcaaagcagccagaagaaaagacaaccacatcgaaagaaaaaatgctccgtggatcggcctggatgaccgccggtagtatgttttcacgtatcttaggtgctttgtacgtgattccgtggatgatgtggttcggccgagatcgagggcaggcgaatgccttatttgcgattggctacaatatttatagtatttttctgattatttctactgccgggattcccggggcagtggccaagcaggtctcgcactataacgcgatgaatgaatataaaactgggcgtaaattatttcgtagtgggctgtatttaatggtattcatgggcgtcatttcggcggcggcactttatttgttagcaccgtggatctcaactggggataaggatgcaatcccagttattcggtcattggcgtggccgttattagtgattccgatgatgagtctattccgaggctttttccaaggttatcaggatatggcaccatccgcagtctctcagtttattgagcaggtggcgcgggtgatctatatgttggtgacggcttattggatcatgcaggtcatgcacggtagttacgttacagccgtggcgcattcaacatttgcggcctttattggcgcggtggccagtttactggtattggcttggtattatttgcgtaaacgtaaagagtgggatgttttagcagataatagtgcggatacgttagatatttcgactcgcgatatgctgatggaaatggtgcgtcaggcgattccgtttatcattttagatgcggggatcacgattttccagttagtcgatcaatatacgttcttcaatatgatcgatgattttgtcgtggggacacgggcgacatttaatacgttgtattctttatttgcctttaacgccaataaactgatcatgatcatcgtttcgttggcggcatcaatggcgatcacttcgattccattgttatcggaggcctacacgaaacgtgatttccgtgatgttcgtgatcaagtcgataatacgatcgaattatttttcttcattatgattccttcagcaatcgggatggcggcagtggctaagccgttgtacacgattttttacggttatgactttactggtacgttagtattggagttctcgtcttatacttcgatcgtgttaggactatttaccgttttagccgcaatgctacaggggttataccaaaatcgattggcaattgcctactttgtcgttggcttagtcgttaagattgttgttcagtaccctatgatttatttgttcaaagtatttggtccattgatggcaacggcaattgggttcatggtcgctagctatttgatgatcaataccatgaacaacatgttccatttgaaagttgccgagttgatcaaattcttctcggagacgttgttgtttgcgctcgtgatgtacgcggtttgcattggtttgcagcaggtattgtatttattcctaaatccagctagccgggttcagagtatgctggtgatcgtgttggttgctggtgttggcgcgacgttgtatggctatttggtactgaagagtcggttaggcgatcaattgttaggtagtcggatcgccggactacgacggcgtttacggatcaagtgaggttgaatcatgcgtttagataaatttttagtgcatgctggcgttggtagccggaaagaagtgcagcggctgattcgcggtaagcaggttcagctcaatgcggtagtggttaccagtagcaaggcaaatgtggtgccagaacgtgatcaagttgacgtggctggtgaaatggttcattatcagcaattttattattatatgctgaataagccagcgggtgttttgtcggcaacgactgatccacagcagcggacggtgatcgatttattagtggctaccgaccagcgggctgatctgtttccagttggtcgtttggataaagacaccacgggcttattgtttttgactaatgatgggcagttggcgcatcaattgttaagcccgcggcggcaagtggttaaaatctatcgggcattgatcgcgggcatcgttaccgcggctgatcagcaacgttttgcggctggtattacgacgaaggcaggcaatgaatttgcgcccgccgatttgcggatcttagcggttgatccagtgcagcagcaaagtcagatcgaagtgaccttacatgaaggtaaatttcatgaagttaaacgcctcttccaagcagtcagtaaagaagtgctgacgttgcagcgaatagagatgggcggcttgcagttagatacgacgttggccgctggtgcctatcgcgccttaacggatgccgaaattacattattacaagcagcagtttcctaagggagactgcttttttgatctgaattaattaaatagtggaggaaattgttatgcgaactgaacatattgaagtgattccttatcaagccacttggccgttggcatttaaacaaatcgttgcccatttaatgcctagtattgcgggttcatttacacgcattgaacatgttggtagtacagcagtacctggcttggctgctaagccgatcattgatatcgatattgtgatcgcacaagtcagtcaactgcaaacgctgattactagcttagcaaaattaggttattactgcgaaggtgaattaggcgtgccccaacgttacgcctttagttatgagcccacaacgtcggttttaaagttacatcatttatatgtttgcttagctgattcactggcgctacgccatcacttagcgttacgtgattatttgcggacacatcgggctgcccgggagcaatatgcacagatcaaactgcaaggtgcgcaactgttcgccaatgatattgaacaatataatcgctataaagctgactttatcgccgatatttatcgcttagctgccgcggaaaaataaggtgagttaatttacttgcttaagcaaataaaatagcttatactacgcgaggaggtggataaaatgcaatcaccgattaagcgttggacgatcttatcagttattggtttgtttttcttcatggtgatcgtcgatggcagcatcgtcgcgattgcgattccggcgatcgcccgggatttatcgatcaccacaggcgcaaccacgctgatcatttctagttatttgatcaccatttgtgcgacgttactattgtttggtcagctaggtgatcagtttggccgtagtcgggtatttaaatggggcacattagtctttttattcgggtcatttttggccggtttaggcggttatttggtagttgtattgctgggccgcttagtccaaggcattggtgctagtatgacgatggccaatagttatgcattggtgactgatacttttccaccagaacaattgggccgcgcctttggaattgaaggtatctttatttcgctaggggctttagctggacctggcctaggcggtttgatcttggttcagttaccttggaactatattttttgggtcaacttaccattagggttgctgtgtttattggctgaactcgtgatttttccgaaaaataagtcgcagcacagtgggcgaattgactggctgggggcgctgattttggccttggctgctagtacattgtatgtggcaacgacgcaagttagttattggtggctcatgttgttattgaccatgggtttaagttatgtattttggcggatcgaacggcgggttacgttaccgttgctagattttaagatttttcgttaccatttatttagtcagagtctgttagttgcgtttttgagcttcattatttcgtatttcttcacgattttagcaccgttgtatttgcaattggcgctgaaatactcaccaggggtcaccggagtattattaatggtcacgccgatcgtctcactagtggcgtcaccattggctggttatctttccgatcgttatgatcagcgcttggaaatgttgatcgggatgacgattttagtgggtgctcagttgaccttggcactgtctacagcacagtatgaaccgacttattttatttttaattcggttctgatcgcgatcgggacggctgttttcagcacgccaaacaatgtgatcgtcatgcaagcagtgcccaataaaatgcggggattagctggtgcgactaactcgttagtgcgtgagtttggcttagttttggggacaacgctgtcgactttgattttttatcggttgttgtcatttttcagccaccggtcagtcagtacggctttaggggttgcgcggcacttttgctccgggctcagcgcggcacttatctagtggcgtttatgttattggcggtggcgttagtcatattgattcgggcacgcagaaaggaaagaagtgaggttgatgatcgatgaaatggacagttatattcggcaattcaatctggtggcgcaaaaaattcgccaatatttgaatcagcagttaaaggacctgaatttaacggccagcacgtattttttcattttgaaagttggtgagcgggggactttatcgcaggaagagctatttaaagtcatctatttaaatcccagcaacgtaactcggcggcttaatcggttgatcaaactcggttacgttgtcaaagaaaagtcaccgacggatggtcgtagccgcgtgattaaattaacagctttaggtcagcagcaataccaacagttgcttcagcgcttaccgcagatcaatcaaacgttggtcgattcatttgacgcccaacaacgcacgattttacagcaatttctagggatagttgatcgtgatctcgatcaattattgtcaaataagggggacgaactaaatggctaatcatgtattgatcaaacaacgcgcggttccggcattaattattcctgatggatttaaattggtcaccacagaaacgcaccggcgcaatcgcgaacaggttcgggtggatcgttttcaaatgacgccggatttcagcccgaataatgcgcacgttacgctagtttatggcgctgatgagcgtttgatcagttacaatcgctttttcgttgctgcggaacaactgaaattaccgatcaaaggcgacgtggtgtatatagctgaacagacgtggcaaacggttgatcctgattatgcgcggggattgcactatatgcgtacggacacgttgcccagatttttcattgatgatcaaggacagcgccaatcctttaaagtacagtgggtcaaatttgcccacgataatggctcgtataattgggtgtcggttggacctggcggataggtgatcgaattagagcgtgagtcacggtgggattatttccaatccagacgagcaaccgaagagtggaattatgatgattgggtgttggctcgtaacggtcagggcccacaattggcggcgccagaagcattggcctagcatctgtgcttagtttttgaatgtagccattaatagaagctgaggtggacttaatgaatgatcgtgaatatgaggatttgatcttacaattaggtaatttacgtgagcacgtgcgttagttagccgaaacggattatgtgaccgccttgtataaaggttacagtgcttcagggcaaacgttagcagaaatcaacgaagaaatcagcacgaccgatgaagagattcggctgctggagcggcagatcgacgatgatgaagtggattacgaataaactaaaaaatggtcgttgacatccaattaaggtgtcaacgaccattttttagttgcgattatcttttaacttaacgacgcaaaattggcttctttgttcatgtattgaatgcgcgctttaaaaaaggcgccatagtcgaaataaagtaacttgccgtgacgtaaccaagtttacgtttatacgagtagatcgcgatttttacgattccatttttaaaatcaaggtataagttgtaacataaagagagtaattatttggaggaagaagcgaattttttgtcaaaacggaatattttaatcgtaacttgtgcgctactgttatcgaacgcgatgagtggtttggacagcacgatcatcaacacggcgttgccagccatcatttccgatctgcatggactcgaaatgatgggctggatcgtagccgttttcttattaggtacagcagtcagtacgccattatggagtaaacttggtgaacatatcggcaataaacgcagctaccagttagcggcgttgttctttgtcgtaggttcgttgttgcaagggatggcaccgaatatcgtttttctgatcattgcgcggacgattgctggcattggtaatggtggggtcgtctcgctgccttacattatctacgcgcgaatgtacactaatccgcgcaaacggatgcaggtgctgggtttcgtgtcggccagttacagcacggcaacgatcattggaccgctagtcggtggttttatcgttgatgcctttacctggcactgggtattttatctcaatgtgccgatcggtttactatcagcgttactagtacaaatttattacaaaaaagaaaaaacggttggtcagactaagccagttgattacttaggatcgattttaatgacaatcgggctaaccagcttattggccggtattgaaatgattggcagtgccagcacactttttgtcgttgcagcactagtggttgcagtgatcagtctaggcagtatggttcactttgaaaaaggggtcgctgatccgatcattcctagccgtctattcaaaaatcgtgatttgatgatcgactttgcgttatttaccattatttggggtgcctttgttggtttcttgatctatagttcgatgtgggcgcaaggattgctgggtactacggccttaattggtggggcgacgcagattcctagctcgttcaccaactttattggttctggctctgtagcgccgctgcgtaaatatttaacaccgcaaaaagtgttggctgccggtattgtaatgttaacgatcgcctttgttttgttgatgggtggtgttaaaacgccgtattggctgctgttggtggctggggcatttgaaggtttaggtaacggcgcttgtttcaatgaactacaggttaaggtgcaacaagatgctgagcaacaagatattcccgtggcgacttcgtttagctttttgattcgaatgcttagtcaaacttttaccgccgcgatttttggtttagtcatgaacaatgcgttgcgccagggggtcactaagtctggtggaacgatcacaatgaaaatgatgaataaattaagtgatgcgactaatattgattcattaccgagtcatctgctgccgcaaatgcgattgattttacatcatggtctacacaatatcatgttgttggcactgatcttaatgttgatttcgttggggatcaatatttgggcccagcatttagaaaaacaggcagcacgtaaaacggcagcttgagtgggttaattatagaaagaagtgatcaagtgtgtcagtttggttgatggcaattattttattagtcagtggtgccgctgccgggttagtttcttcgattgcgggactggcttcattagtgtcatacccggttttattgatgcttggcgtgccaccgatcagcgctaacaccacaaatacggccgcgctaatttttaccggtttaggttccagtgtttcctcggtaaaggaattgaacagtagtcaccgaactttgtggcaagttgcagtgtacgtgttagtgggtagcgttattggcagtgttttacttgttgtcgcgccggcaaaaacttttacacgggtggtaccattcttagtctttggtgctggtattttgatgctgtggtcgcaatttcaccagtctaaaattttagatgcgcctaagcctgccgggcgcggggtgacgttttttaaaaatttagcgattttgttagtcggtgtttatatcggttattttggcgcttcggcggggatgatcttgttatcgattttgatcgtcacgttgaataaatcatttgcggtgaccaatgcaatcaagaactttacttgtttgttggccaatgggttatcactgttgatctatgcgtttaccaccaaaatttattggtggatggtggtaccgatggggatcggtatgtttattggcggctatattgggccagtggtcattcgtcacgtgccagtacggccattgcgcgttattattgcattttccgcatttggtttggccggatatttattttataccgcgtatctgtaaatgggttaagtctgatttcgggcttagcctttttatattagagtataaaaaaaacagcacttattcaataaagtgctgcttcataaaacgtttattcacttaagcgggtgacgagaatcggactcgcgacttcagcttgggaagctgatattttaccactaaactacacccgcaatttcaactattatagtatagcatatctattttagtgccgccagctttttttgaatttttatgcgtcattatttgtgctgcacgcaatttgtactgggccaccaattttgccgaattgtggatgtacagcgataaaatgggttaaattattttttaactcggtagccaggaactcgattgagccagtgtttgtaaatgtcggatatagactataaaattcatcgaccgccgcttgctggccaattgcgatgtatggtgttttagttattgtctggtgactaatatgccaaactgaattatttttggccagaataaaatcattgctagctagattagtgttggctagttcttgctgtagtgaattagttaagtttgcggcagttaaatcgggatggcgcgcggtaaagttaagtaggaactctttaattgagagccactggttattaaatttaagattgtattgacctgctgtagccagcaaacaatcattgagctgaaaaattttagtcgtagcgtcactacgtaaaaatagacgatgctttaactgcatcgtcagccgtgaatcggtcgcaataatgctgccgttactcgtactaacgccaattgcaatggtcatggggacctccttatttattataggtatgcatatttctgtcgttcattattggttctaacgtatactaaggttatcaaaaacgaaagaggtgccgatatgtaccaaaacattttagttccgttagacggtagccgtaacgcagaagtcgctttgaaagaggccattgaactcggtaaaaaatttgctgcggaactttttgttgcttccatcgtcaatgagcaacaatttgtcgcgtatggcagtatggcagcaccagcccaattttattccgacatgcgcgatcgttctcaacaaattttgaacgaagcggaagcagacgctaaagcagcgggacttaaggtcaccacgatcttagctaacgggatgcctaaaagagcgattgctgaagaactgccagaaaaatacgatatcgatttgatcgtcatgggtaaaagtggggtcgatgcgctatcacggatcatgcttggctcaacaactagttatgttgtccggcacagtatgaccaaagttttagtcgtcaacgacgaagccgatgacactgaagataatactaccgaagcagaataaccgttagcgtctaggtcaattacctaggcgttttttatagccagagtaagatgaaaacaatcgtggccggtaacagttgcaagccaaagattttcttggtcgccgtcaagccgccgtcaagcgcaacgatcatgataaaaagcatcaataatttaagtaaagtagtcaaagtggtgccagcgaaaataaaaagactacttaggatcaataacccaagtgcaccgttataaataccttgattagctaaagcaatctttgcgtttggcaatttcacaaagttaagcggcatgtcaaacgctttagcctgacttttgggtccggcgaatatttctagtgccatgattcccaggtgctctaagccaatgagtgcggctaaaataagggtaaaagtttgcataatgtcctcctaatgaaactcagtattcctattataaagcaggtcaaacgtgagcgcaaatgtttgtgtttaactggaattggttatttatactttttacataaaagaaacttgacctaactactggaaaaatgctaaactatttaagtgctcaagtaatttgccgctgtggcggaattggcagacgcgcagcattcagggtgctgtttccttcgggaagtacaggttcgacccctgccagcggcactaaattaatcataatcaaacgctactttcttaattgaaagtggtgtttttttgtattaatgcaaaaaaagtcgtacagctgaggtgaatggtgtgataaggaaaattgaagtcccagcgtggtttgatcagttggcaaaagtacatcgcgcgcgcaaggcttttttagatcaggattcacaaacactttatttagtgcggtgcatttcgagttcagagacggcaggcgatcacgtgctgacggctaccgataaaatttggttaatgcgggcagctctagatggttatatcgtggtggaacctaaatatttactgccactagaagcaactgaaactactgagccacgtgggcagacctatgctggaatccgcaagaacggtcagtggtttacggcacatttaagtgctacgcaagccaaatccagtgcgttttatgtcacccgtacccagctggaagctgcaccagcatgggtcaaagcaattgaaccgattgcagctgatcccaaatagtttgtaggggtcgctgccccgatttacttggctagatgctataatatgagtagttatgcaaatatttgtaagggggagtggtgagggtgcaacagattacaaaatcgcttgtgcaacaggtgattcggccacgaacacaagaaagccataaaggcaactttggccgcgtattgacgatcggtggtaaccaaaattttggtggtgcgattattatgagtgctagtgctgccgtttatagcggtgccggtttggtcacgtgtgccacggcaccgcagaattttatcagtttgcatgcccgcttaccggaagcaatggtggtggattatcaggatgaaaagatgctggctgagttgattccgcaaatggatgtgatcgtgattggccctggcttaggcactgacgccatcgccttggctattctgaaatttgtttttgctcaagtacagccgcagcagaatctaatcattgacggttccgcgatcactttggttgcacaggaaaaactagccttaccgcaggcgcaaattattttcacaccgcatcaaatggaatggcaacgattatcgggcattcccgtcgcccaacaaacgccggctaagaatcaagcaatccagcaaaaattagctgcaaccgtgatcgttaaatcccatcggacagaaatttatttaccgggttcaacgaggatttggcagaatccagttggttcagcggcgatggcgactggcggtatgggcgattgtttgactggaattttggctggcttcttggcacaatttcctgctgatcgcgcgcaaacgattttagcggcggtttacactcatagtgcgatcagtgatcagttggcacaaaagcagtatgtaacgttgcccacgcaaattattgccgcgctgccagaatatatggcacaaatggcgtcctaattagcgggttacgtcctaattatcagcgtgctataatgcaactaatataaaacgaaatgagggatctgtgcgttgagaaactaagtcaatctggtaaagctgtttatactttaaccgtaaatcacgggtggagtctacagattttcagaattggcttagtcgatcgatgcgtgggtctctttttgtgtgctcacttttttagctaattctgaaaacggtcatttaagtttggagtgagcttatgtctaaaattgaaattaagaatttaacctttggctatgatgggcaaacaaaaccgttgtttgaacaagccaattttttactggatagtcaatggaaattagggttagtcggccgtaatgggcgtggcaaaaccacgttattacgcttgttacaaggacaactgccttatcaaggaacgattcagcaacaccaacaatttagctatttcccgcagccaatcagtgataaaagtcaattgacgttttatgtgttggcagaaatcagtgacgctgaacagtggcagatcgagcgagaaatgagccagcttgggttagcagcggatctattgtggcggccgtttaatacgttatctggtggcgagcagactaaatttttgctggcagtattatttatcgaggatggggcttttccgttgatcgatgagccgaccaatcatttggatctgcaagggcgtcagcaggtcgctgcttatttgcaacaaaagcgacagggctttattgtggtcagtcatgatcggcattttctcaatgaagtgactgatcatactctggcgatcgagaaaaatcagatcagtagctatcaggggaactttgctacttacgaggcacaaaagcagttaagtgataactttgaacaggcgcaaaatagtaagttgaaaaaagatatcggccgtttgaaacaaacggcggcggaaaaagcgaagtggtcgcaagcccgtgaaggtgataaatacggcgatccgcgtaaaaagggtagtggcgcagtttacgatactggctttattggagcgcgggcagcacggacaatgaaacggtcaaagcatttagcccagcgaatggaaaatgagatcagtgaaaaagaacgcttgttgaaaaatattgaacaggttgatccgttgaccatggcgtttaccccgagccatcaccagcgattattgacggtggagcaactacaattaggttatgaacagccattatttcagccactatcgtttgaattgcagcaaggccagcgtttagcgctggtaggacctaatggagcaggtaaatcaacgatcgtccgtcaattactcggccagtttacgggaagcgtgagtggtcaagtacagcagccggcacagctgcagatcagttatgtgcgccaagattatgaagacaatcagggcacgttgacggattttgctgaagcgcaggggctagattacaccgcgtttttgaataatttgcataagctggggatgccacgagatgtttttaatacgcgaatcgaattgatgagcatgggccagcgcaaaaaagtggagttagctaaatcgctgtcgctaccggcagagttgtatatttgggatgaaccgttgaactatttagatgtgttcaaccaagaacaattggaacaattaattttggtggtccaaccgaccatgctgctgatcgagcatgatcaaacgtttattgagcgagtagcgatcaaagtagtggcactagaaaaggcagaccaataaggtccgcctttttttgttacgctaagtgttgttcgcgcgactgtaaaaagttttccagcgctgtagtcaagtcaatgtcgttggcgtcggctaaagcgctgagccaccaaatcgattcggcaattttgtaagccaacgaaaattctgtttgttcagtcggccagctaccttgttgtgccataactaagcgaccgaccagcccagcgtcggtcaaaaaagctaacgcgtcctgctcggttgtccacggttgtccatcttgtttgatttctaaatcatgataagcagcacgaattttgcgtgcgcgattggtcagttcattaatttccataagtaacctcactttttttaaacacttgaagtgaattgtactcgtttgcgtatattatagatagtgactagctttttatttagaagtaatctacagtcgctggccataagactaacgaaaaatgtcaaaatagatgagaatatgagctggaagttgacgctaaatgatgcggcttgtttttaagaatgaaaattttctgccacaactgactgaaaacgagtataatattcattaaattgtattaagaaagtagggaatgttttgcgggaagattttaatcaaattgttaaaaaaattgcagtatccgatattcgccagttcgataatgaggtcagtcaggtgccagggatggtcaaattgactttaggtgaaccagattttaatacgccagagcacgttaaacaggcggcaatcaaggcaattgaggataatcaatcacattacacaccaaatccagggatcccagcattgcgtgaagcggctgcggcctactataatgaaaaatttaattggcattaccaggcagaaaatgtgattacgacagttggggcgacagaagggatcgcggctgcgttacaggcaatcgttaatccagatgatgtggtgatcattccaacaccaattttcccgatctatattccagatacgttgttgaatcacggtcaagttgtgttcatcgataccagtgcggacggctttgtattgaccccagaacggttagaagcaacgatcaaagcgcagggtgacaaagtcgttaaagcgctagttttgaattaccctaacaatccaaccggggtcacttataaccatgaagaattagctggcttagccaaagttatcgctaaatatcaattatgggttgttagtgacgaagtctatgctgaattatcatacagtgaaccccacgaatccttggctaacttcattcctgagcaagtgatcgtggttaatgggttgtccaagtcccacgcgatgactggttggcgcgttggtttcttattggcgcctaaagcagtcactgatgaaatcatcaagtcacatcagtacatggtgactgcaccagttactttggttcaatatgctgcattggaagcaatgactaatggtaaagaagatagtcaggtcatggctaagcaatacgttgaacgccgcgactacttgatcaaatcattagaaccactaggttttgaaatggcacggccagatggggccttctatttgttcgccaagatcccagctaattgcccgcaagattcatggacatttgtacgtgaattagctaaaacgcaaaaattagctttgatccctggtatctcctttggtgccggcggtgaaggctacgtacgaatcagttatgcagccagcatggaaaacttgcataaggcggttgaacgcttaacagctttcgtccaagcgcactaaaactgagcgtgaaatgatattttgaaaataagtacaaaaaatgacgttgaccaattttggtcagcgccatttttactttaaagaatatgactgataaacatcccaccataaacgagggcgtaactgtaagccaagatcgtcgccggtttacctaataaaatgatcattgtaaaagttttgaatgacattttagtcagaccggctaacaaacaaaggacgtcgtctggggcgactggtaagaaaatcgcaatggcaaataatttagtgaagcaattttggttatctaaccagccaatgtagcggtcgtaagttttttggctgatcaggtgatggatcagtggcttgccgaagcggcggccgaggaaaaaggcgatcagtgaaccgatcacaataccgatgtagttgtaaacgaagccttcaatggggccgaagatcaagacaccagcagctaaactgatcccaccagggatgatcggaattacgacttgaacgatttgtagggcaataaacaatagtgggccaaaaaattcggcgtggccaactaagttttgcagcgctgcagtatttttaaagacgccgagatgaaaacaataaattgtaaaccataccgagacgatcagtccagctagggaaataatgttaagcagtcgacgtgatgttgcagtactcatacgcaggtcctccattttgctgaattacaaatgttataccatattttagctaatttgccgataaaaaagcttcggtcaaaagtcggaatttctaggtggcttatgactgagctttttgctagatataaaataaattaaaaaataaggtttacagttacggtaaatagtttaataattaatactaatttaataaatggtgttgaagagaagagtaagttagttcgctttttccagcaagtacggttgatggaagcgtacaaaagcaggttaactgaagatgagctctgagctaatggtgggttaacgcccatgattcgtcccgcaagcgatatattgcccagtataatcagttttgcgttaaatgggttggtgttttctgactagtttagcggaaacgtgttaaaaataacagattattgcatatagctacacttgatgaacgatccacttcgtgtatcttatcatcaagctaggctatatttcataatctaaccgttatttttaacactctgacgtactttttgaggtttctatcgtgaggtagcggcaaataagggtggtaacacgaatgcgttcgtccctgggtttttgaatccagggggcgggcgtttttttatttaaggaggtggtgcgctttggcgggcgtgatgtggccgcaatttattggttcagcaagcgcacttagtggtgcgcgatatattatttgggggcgttcttatgacaacagctttgacagttttaatcgtgatcatcgccggtttgattttagccggcttgtacgttttgcaacggcggcaagttaagttttctaagcaagtttttctcgcgttaggtttggggatcgtgtttggcttgatcctgcaattatcttttggcgcaaccagtaaaattattaccaacgcgattgattggttgaatattgtgggtgggggctacgtggcattgctgcaaatgctgatcacgccgctgattttcgtttcactggttggcgcatttattaaattgaaattatcgactaatttacggcgaatcggctcgacggttttggtgactttattggcaacaaccgcgattgcagcggtattaggtgtgctaagtgttttcctatttcatctgcaaggtgctgattttgttaaggctacagccagcaaggctaacttagcgatcttaaaggagcatcaaacagcggttaagggggctaagcatcccgcaacaaatcgttagctttttaccaagcaatattttcgctgactttgctggcacacgggcaactagtacgattgctgtggtgatcttttctgccttcgtcggtgttgctttcttaggcatccgtaaagatcatccggaagaggcagctgtatttgccaaaggttttgaagcgatccatcaaatcgtcagtcgcttagttcatcttgttttgcaactgacaccttatgggattttcgctttgatgactaaagcgacggcaacggatagtattgagttgatcgctaatcttggtgttttcatcatcgcagcttatattgcattgatcggcgttttgttattgcatacgttgattttggtggcgcatcacattaatccggtgatctattatcgtaaagcttggccggcattgctcttcgcctttacttcacggactagtgccgggacgttaccattaaatgtggagattcaaaccaaatcattaggggtcgatacaccaacggcgaattttgcggctagttttggtttgacgatcgggcaaaacggttgcgctggtgtttatccagcgatgatcgtcacgatcattgcgccaacggttggtatcaatgttttctcactacaatatattttaacgatcattgctgtggttacgctggcttcctttggggtcgctggtgtcggcggtggttccattttctcaacgttgatcgttttagggacgttgaatttaccgatcggtgtgttaggcgtcttgatcgccatcgatccaattgtcgacatggcgcggactttagccaacgtcaacgatagtattttagccggcgtgatcactgctaaacgcggtgggacgctggacgagacagtttttgacgacgccactcatgtggtcgaatcgacgctttaagtttggttgcacctatcgtaaaggtaggtgctttttggttggatcagtggctgaaataagtgcgccgtgttaagctatttaatgaacctaatcaaggaagtgagcttacgaaagcattgattgcaattgattcatttaaacaatccttcactagtttagcggcgggtgaaatcgtcgcgcagcagtttgtacaagcgggcatccccagcaccgctgttgcgattgctgatggtggtgagggtacggtagcagcgtttttgcacaataaggctggtggcgaaaaaatagtacggccagtgcatgatccttatggcaagcttgttcaagcagaatttggttggtacccggcggaaaaattagccattattgaaacggcagccgcttcgggtattcaatttgtacaaccggcagcaacctatcagttggcctcatctcaagggaccggtgagctgctgcgggcggcaattgagttaggcgcccagcgcgtgatcgttggtttaggtggtagcggcaccgttgatgcgggtgtggggctgctggctgctttaggtgcgcggtttttggatgcagcggggcagcaaattgcccagccgttggcgcatttagcagaaattgacgccatagatactgagtcagttatgacgaagggcgtgacgttattaagtgctagtgatgtaacgagcccgctgacgggtaaaaatggcgcggtgcagctgtttggtccgcaaaaagggctaactggctcggcagcagtcgagttggaacaacaatttacgcagttggcccagcgacttgatccgcagcagcaaggccaagttgctggcgatggggcagctggtggtatcggttttgcgttgcgtttgatcggcagtcaagtccattctgggtttgatttgatcgcgcaagtttgtcagtttgaacagttagtgcaggccgctgacgtggtgattacgggcgaagggcaaatcgatgcgcagagtttgcagggaaaggtgccggtcaaaattgcgcagatcgcgcaacgccagcataaaccttgtcttgcctttgtcggtaatcaagtgggggatttggcggccttccaagcgcatggtttaaccagtattttcccaatcgttgatcatgtgaccacgctgcaacaagcgttagtcgatggcaaaatgaatttagcccgcacggcccagcgtgtagcgtcagtgttggcgatatgaaaaagtgaaagcggcgtagtggcataaatgaggtcactgcgccgcttttttgattggaatcaagtgagcatcggcaagaaaactttgcttccaggcggtggccgtttacaaataacttttgccgaattcatcgatcaggccgtgaaattcttgggcttgtgccggcgtaaaatcagctggtaattgaacttggcggtaaagctgctgataattattgctcgaccaaccgagctgggtgaataggcggcgggcgtaattatcggcaataaaggtgggcacgtcaaaaatatagacgaggaaaacgtcggcggtttcggcaccgattccccgcaattgcagcaggtcgtgacgcaatcggtcaccgcgggcttgtttaatggcggttagatcataatcaaatgtcgcgagccagttaaatacagcggcgatcgctttgcttttattatggtagaaaccgctggaatggatcaggggttctagctggttggcgttaagtgcgtgaattttcgccggcgcaaaagcggtggcggcttttaaattagtcaacgcggggacgacgttgcgccagttggtgttttgtaccagaatcgcgccgagaatgatctcccatttagagtcggcgggccaccagccttgtgggcccatggtggtgtacatcgtttggtagagttgtttaatcatgagttgcatgtgtggccttcttttcgcggtattgacggggactgatgccaatttggcgtttaaataaggtgctgaaatagttggcgttcggccagccacagcgttgggcgatcgcgctgatgctcagtgtggtggtggtcaagaaatgacgcgcgtgggcgaggcgaacttgagtcaaatattgttgcggcgtttgcccggtgactgtggtaaatttgtggtgcagatagtaaggagcgccatgggcaagttgggcgagttcatttaagttcagctcactggcgtaatggcgttcgatgatctgtttgatctcggcgctccaagcggcgtcacttagcggccgaccagtaggcgtacaacgtttgcatggtcggaaaccagcagccagtgcttcagccgacgttttaaaaatgcgcacattttggcgttggggtagacgcgaagcacaggatggtcggcaaaaaatgccggtactggcgacggcgtagaaaaattggccatcagcgtggtggtcgttagtttggatcgcgtgctaacgtttagcggtcaggcgatagtgagtcatgtacagcacctccttgatattaaggtactgtcaaacgtacccgattttgtctagttttaattattgtttctaatggttttgtattatctaagtgaaattaaaaaacacccggaccaattcttctgttatccttggtgtgcaaccaac

SEQ ID NO: 634 - DNA, 2199 bp, Unknown
  Metagenome-assembled genome
ggcatcaaaataaaaaaacaacggacaagcatcaagctaaaaatgccgcctaacaaaagacaaccagatttctcaaaatcgagaagtttggttgtctttttaaaacgggtgattatttaccgcttactttcatactagtaattatagcactttttattaacaccatctacaatagcccttcgggcaataaaaaagagcaattcatcacgtccttgaaagaacgtgtttccttgctccgttccaaaaatgttactttccctctatataagggtaaagaatttgtatccacataggtcacctttcagaattgataacataaaaataaccaaagataatgacattaatattttaatatcggtgcttttacctttcgtattctgagcataaagtaaaggatatagcaatcccatacttataaaagtagctagaaacgttagtcgcattggtaccgcatagcttacaggaagtgtcattatacaaataagtaagacaatatccgaatacctaacaagagatctattaatagttatacaaccatgttttattaactcatgactctttatgtttacatatccaacttgcatcatagctattatactaataaccaattgccatacatttcgatactctgtctcattgtcaatatagccgctcccgtactgtaaacttcccgctatagttccccaaaaagctataactaaagctacccctactagaatcctaaatattttttttaaagcgctactttgccctataaccaagaatataaatctaattattatcaatagagccccaattgagtgtagaaacagagcgaatacatacaagggagcatgtagaacaaggctcttaccttccacagtttccatatatatacaatagaacacgattgtagttgctaatgctgatcttattccagaaatcgtctgtaaaaagattgcaccattagccattaaataaagtagtataacccacctatttttagcctcaactttgtttattttatattcatttcctacaatacggaacagtaatccaaatactatacaacacgtcaccgtttgcaacatgtttatattcccagtctgctgtaatatccacgaatacagaacccacgttggttggctattacttatggcatacttaacgaccccatcccaacttaaatatgaccaatacgctatatactgccttactctatatagatcagccgttatatatggattgtaaaaatatgcaaaggaacataaaatgataaggtatattaatagtacagtttttattcgccttgctcttacacagctgataatacagcatataattatcaacgataatgtatacactgctaaactaactccacgttcgtataaaaacataattaactccagttatattaatgcttcacttttttagtttcaagaaacgtttgtaaataggtcaagtccaaaatgttggtgtaaattaaattccgcgaatttatcatttcacaagcttaagcataccggcactcaaatatttaaattggcgaacaccgattgagatctttttgcgtaatctgcgttactaaatttgttcaagttatttcttgcaatctgccattttagtgcttaataaattaattaaatttgtaaaatatttgttggcccaattacataatcgattttcaaaatggccaaataatctttttctgatgtattccattaaagaacaaatagaaaaaattaaaacacaaacgagcaatacataaagcaatacataaaatattgtatatgctggttgtaaaagcaaattattcatatgtaaggtctttaaccataataacggccttgcgtatgtattatcatggattaaataaatgggagtgtaaaatattttgtgtaaatgagtattgaaaaagggaagaccttccccgtatgattataagcgtctaaaccaaatcaatggagaccttccccgtatgattataagcgtctaaaccaaatcaacggaggtcttcccctatgaatcagtttaacaaagaattggcaaatgtactactatctcatggtgatttaaaagaagtttttagaaaagccggatttacaatgtaagtgcaacaccaaaataactagaccaaaaaggccatgaagccttaaacttataagtgacaaaaccaataagttaggacggacttcatgacccaatctaaagataccatca

SEQ ID NO: 635 - DNA, 10286 bp, Unknown
  Metagenome-assembled genome
gcgaaacagcacggctttagggtaactgcttgagggaggtcaaattctgaggtttacccacctttatttaagttggccttttttcaattaattaggttgactgctaatatctgtttttttcaaactttacctcttagtaatttctgtctacaataatcatcacatatggctaatttaaactattaatagccaatttctagacaatttatttgcaatcaaccggtaatacgcgtaacatatttcgggtgcgaatatttcgtgtacgaattattgtgacctatttaaaggagttttcctgtaatgaatgaaaatgcaacccagatcaaggacctgattttttcactgcgctcactgcgtaaagaaacgcggcgaatttttgcttatcaggcaaaaaaacagcaattaactgaaacctggatcattgcgcttggcgccttgaccagcaaagatcccagttcactggaagaactagcccaagcgctccggctcagtaacagcacgacctccggcattgttgatcggatgatcgccgaaggattagttaccaaagcgcgcgctgaagacaataaacggcggatcaacattcgccccacacaaaaaggtcgccaaaaatatgcagccacttataccgatttttgggaaaaattagcgccgcttgaagcaatcgagcgcgctgatctcaccaatttattagccactcaggccaaacttttagcaaagttagaaaggatcaactagtgaccactaaaatgaaaaataatcgtcgcatcatgctggtactagtgatggggacttttctagcgttcttgaaccaaacattgatgaatgttgcgctaccaagtatcatgcgctcatttaatatcaccgccgcagccggccaatggctatctaacggctatatgctagtcaacggcatcatggtgccgctgaccgcttacctgatccaacgtttcaccacgcgccaactttacttagcggcaatgactgtttttgccttgggcacgatcatcgcgggaatcgcacccagttatttaatactgatcaccggccgcatgatccaagctgctggcgccggtgtgatcgcaccactgatgaacgtttcgatcatgaacatgtacgccgctaacaagcgcggcaccgcaatgggttgggtcggtctagcactaaactttgcccctgcgctaggaccaacgatttccggttatttagtcgaacaatataattggcgctggctgttctatacaattgcgccgctgattattttagatatcatctttgccgcattcatgttgcgcaatttaggcaccaatcaaaaattaaaattaaactggagcggcgttatcctttccagtatcggcttaggcaccctgctattaggcttcagtaacgctggcagtctgccattattctcgggaaaggtactcggctttagcttatttggtttaatcattgtggcgatttttgtttaccaacaaacccatactactaatcgcttgctcaattttaatgtgttcaaaagtcataacttcatcatcgccgtgatcgtcaacgtttttttaatgatggcgctgtatggtggcatgttgctactaccactctatatgcaaaatgtgatgcattatagcgcgctagcttctggtgtcgcaatgctgccgggcgcagttgtgattgctgttatgtcaccgatcagcggccgtatgtatgatcaatggggcgctaaatacttatcttttagtggaatgatcgtcttactgatcggcaccctgatgttgagccgcgtgagcttgaattccagctttgcctgggtcaccaccgcgcaggctgttcgccaattaggcttatccgtggtcaccatgccgattcaaaccgaggcgttcaattcgctgccccaagaaatcatccctgacggctcggcaatgtacaccacgatccgccaagttgctggctccttcggtacagcgttattgatcggtattatgagtgtgctcgaaaaaaataatatcgcccaactgactgccgaccacggtttaaaattagccactcaattaggttcactgcacgcaatccaaaccacttatttagtggccgcgatctgcgttttgatcagcggcttactgacattaagcttccgcaaacgtgatttgactgcggtgactgaaaaagatctgatttaggctatttatacctgatcaaacggtaaaaaggcgttcgttttagctaacgaacgctttttttattggcaccaatcccatttttttagacacctaaccaatcattaaattgctggtaaatttttgtgatcattattggtagtatcatcccttgatcacgactgagctgctcacttactactcggtagaacgctaaaatatttagcagactcattttagtttcggctaaagaagtttgttgaattgcggcccgcattgccggcacaccaataaaattcttgcacatgcgcttgaaaatcagcttgatctaaatcagttagtgtactcatttgtctgccataaattccgccactgcggctttaagcgcaccccgactattatacagtttagccttactcaagcggctaatatatattttacttaaataagccagatattctggttgtaatacccgatcagatttaagaggttctctttctgaaaaaaggcttaactgaaaaagatattcattgagcactccaatcgttacacgatcaaaagctgcgttgatttgtagcgcgccagcttgtgtcagataagcagtgactgcttctggcttgattccagcgatggcaaaagccatgcgaatgcccgaagtaaacgaaacatcaagcgtctttttcgcttgtgcattcatgttattgagcagaatcggtgtataggtcaaatcattgactagcaacacatactttttacgatcggcagtaaaataattcgcgtgccacgagaaaaattgatcagcttgtgcctgctgtttggcaatcgccttatcagctacttggggtaacgcactgaataggggcatcgatttcttggttggattaattagcatgaataatcaccctccgtagttcttctgttgtatacgtatacggtacatacgccatttctggcacctgatcccaagccaccggatagccagcaccatgggcacaaaaaactgaatccggcgtattgggtaaatcagacactggtgcgtatttcatcgtagccaccacttcatcggcattgtggcacggccgataaccgtcaacaatacattccaattgaccttggccatgagtgtaggcattaacctctggcgcgtagtcctgcatttccgcaactggcgcagtccctgttaaaactgccgtcccgccagccgtcatttctggtgcggtaaaatcaccgctcatccgctgaatatcagtcatcgcacgacctacttgttcttgaccaacctccaatctaaattgataccatggctctaataactgacagccacccttttggcgtagcatcattagcccttgtcgaacagcgcgccacgtcgcttcacgaaaatcaccgccgactgaatgcacaaggctggctttgccaccgaccaacgtaatttttacatcggtaagcggcgaacccgttaggacccctaaatgctctttagcccgcaaattagaagtgacttgatgctgccaattacggcccaatacttcaagactgcactgcgcgtcaaaagtcagtccactaccacgaggagctagttgcagcaacaaatgaacttcagcgtaatgacgcagtggttcaaaatggccaacgccttcaaccgcttgtgtgattgtttctttgtagagaatgctaccttgatcaaaaccgacatccagcttaaaccgttccagcaatagctgctgtaaaatttccaattgaacggcacccatgatctgcacatgaatttcctgcaaatggctagaccatgtaatatgcaattgcggatcttcgtcctctagttgtcgtaacgccgccaaacaggcatgaatatccgctgcttttggatccagcgcataattaagtactggttgaataactggcgtagcaccgtcactttccttaccaagcccctgacccggatatgtgtcggtcaagccaggaatcgcgcagacaacaccggcagcgacttccgctgcaaccgtatatttagcaccattataaatgcgtaactggttggctttttgttcacttaatagcacgtccttagtccgcaaattaccaccagttagccgcagccaggtcaagcgttcgcctttttcatcgtaagaaattttaaaaacacgggcaccaaaatcttgcgtatacgttgtcggtcgtgtccaccgcgccatgccagcaagtagctcatcgacaccggccagtttaagcgcagcgccaaaataacagggaaaaacttcccgctgctgaatcagctgctgtacagccgtatccgcaagctcacccgtcgtcaaaaagtcctccagcaccgtctcgttacgcagcgctatttcttcattctgcgccgctacgtcagtcgtgctaaaatcaatacacccagcagaaaagacgctttgtaactgatctagcagctgctgtttatcgacaccaggcgcatccattttattaataaaaataaaggttggcacctgataacgctgcaacaagcgccaaagtgtgcgcgtatagccttgaatgccgtccgccgcggaaatcaccagcactgcataatctaatacatccagtacctgctcggtttgggccgcaaaatctacgtgtcccggcgtatccaacaaattcagcgccagttcgccatatttcaagcgcgcttgatgtgaaaaaatcgtgataccgcgctgtttttccaacttttccgtatctaaaaaagcatcgccgttatcaactcgccctaattgccgcagcgcgcccgctcgataaagcagcgcctccgaaagcgtcgttttaccagcatccacgtgggcaatgattcccgctgttatctgcttcatgcgttatttctccttcgactattatttataaaactagtatacacgtatactggtatgactaaaactgaacagataattctaatcgtattttcccgaataatttttcataaaaaaactacatttagctcatttacaaagtagtatgctagatgtaattaaaccaaagaagaaatacattatggaaaataactattggcataaaatggttgtcctgactggtttgactttattgcccagtacgcttgcactgactagtgccattaaaaaaatacacactagtgcccgcctccacaaacgcaatattgcctttctattagccgctggtgccgccgtgactgatatctcaatcagccatgccatcagcattcacgaagatctaaaacaaagatagttaaaaaaccatcatcagcgcttaacttgcgcttgatgatggttttttcgatcagtcgttggccgctaaccactggtcgaggacactaataaattcatcatgttgatctaacagcgctaaatggcggctgttagcaaataaatgccacttagcaccaggaatgtgatcataaactgatttggcgattaatggcgtacacaaatcgtcggtaccgttagttactaaaacaggcacgtgaatctttttcagctgatcggtaatttcaaaatcactgatcgtgccattctcagtgaattcgttaggcccttcagcaatcaaactggcacgcttaccattagtcggccgccgcaacggttctggcgagttttcatcgggatcatcccagcagtaacgctccatataacgatcattggccgctaaatatttcggtcctgaaaaatcgccagtacgctcagcttcagcgatggcttcacgatcttcataacttaaataagagatcaaacgatgttgttcttgggtccataatttgattgaagccggtgagccatcgatcatgacacttttaacgccggtttggtcgtattgggtcaaataaagcatctccagcatgccaccccaagattgacccaacatatgcagttcatcgagatgcagatatttacgcaaagcgatcaattcttccgcccaagtctccttgacgtacacactttcgtcctctggcagtgatgacttaccacagccaacttgatcgtacataatcaactgccggccggtttctgcataatcatccattaattcaaaataattatgtgaagaacctgggccaccatggatcagcagcaacggtgctttatccttgctgggttcaccaacgatccgataataagtcttgtaaccgcgaaacggcatgtaaccttcttcgatcttcatccaatcagtcctttgattttagtacttctgactttgattgtactactggaagtggtgtggctcaaatgccgatttaggcgcgatcattgcggccatagtcgcctgctgcaactgaccgatcagttcatgcatctgcgctaaagtttcctgctgccgattcagtagccactcacgccaaatcgcgtacacgccagcactagtgaagcagtttgatgaaccaaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcaaggattatataagaaaacccgaaaagaaggcactctcttcgggttttcggtctgtactgaaatcaaggtattattgggaatcccagcttaaatcatagataccgtaagggattttattctttatttaaaactttgcaacagaaccagaaggacagtatagtataaaaattaatgcacaatatcgactttgtttttcagttgagaatcatagtgattttaccaacgtcgaaattattgattattaccattaaaaggagtgaatatatagtcatgaatcataatttcagctttagggtctataatccccaaatcacccctcgaaaagactattaaaatagcccccattatctgactagtagataatgggggctattttaatttatttttttataagtgcccctaaactatagctattgattcaagatttcatgggagccagttgcaaccaataacaaaatcaattcatcatgatctagctgataaataacaatccagttgtcataatttttaccatagttgccatatctggcagggtgaaattcacgatagccacgccaatttccttttaatgcatgatctttaatctgtttcaaaacaagtacatcttgttcaacaattgcttctaaataaggcttcaagacagttattcggtaagttttaacaatgtaaaagagcaggatgaccagtgaaaccatgttgatgacgcggttgatggtgtcgattggggacatgaaggactccttttcggtttattgacgtgtcgcacaccacttaatgttatgaatgtttaactttacgcgttttaacatttacttctgacaaatcatgatcactgccagctaacaatcgtttgatgtgttgtacccgactccaagcgctatctccacctgcgtagacggcaacgtcagaatcacctagttgccggtaacgttgatctgcctcgacttcattaacatgtttaacaaggctttcatcactattggccatggcaaaaaagttagatgggtcagcatcccacaggaggtcaatcagttgattgtataaatcagtccaacttttaatttgaaccacctgatcatcaacaaaactgaaagcaactggcttagtgccggttgggttggcttctagaatcatatccaacgtatcccatgaatttggatcgtctgtcgcaagctgagttgacacattgggacgtggccaaactgttaacgctcttgttaacaaatcagcctgccgttcttgtaaagttgcttcatcccacttatcgaattgcgctacccattggttaagtttaatacctgacttacgataaccgtctgccatatcccgcttctcaatataaggtctattgctcatctgaccattaaacccagttaaagtcaggttagctagtcggttcaaccaaacattgtggaccggtcgccaatcggtccccaaagccttctgccaactactattcacaacttgcggcataatatgttcaatcgagtacttaccagattgcgccgcatcgaataagtcctgctcctcaccactcgcattattcagttcatctagaatgaaccacagtgacatagaactcatgtggtagtaatctttctcgaccaacgcgtcttttaaagatttatctgttggaaaacgtttattttctttaacgatctgcgtcaacactaacttcaagccttcaacataatcaaccttagcctggtcaacataatgctccacttggcgatccagcgcggcaaacagcaaattcagcccagtggtggggacgccaataaaaagccgccgggccagataggcaagcaaaacccgcagtacttcaactaactgatcagccgatagcgcgccatcacgcgtttttgcaaacacctgcaataagtacggcaccaaaatatcgttattcaaatgaccgagtctaatcaaaagtgatttgactcgttgatctttgatgtcaacagtcgctggcgccgtgatttccgcaaagagtttggctgccgcctgctcctttttcaattgagcaatttgatcaaaatctttggtcaagcccacaaaacggcgataatcgctataaatctcattttctttaaccggctttgagctccgagccaaagaggtcaagtactgccgatagaaccgcgagagctcctcactaccaactaggcgctcgttctgttgccatagttgaaaagccgctgcttgttgatcgcccttcaagcccatcagcaaaaagttccggatcttgtctgattccgttaaattcataccagtcgaatttaaactttcaaagatcaattgagcgtcatcgtactgatcaacaacgatgttcataacttgcaaccgctgttccaataaggaaagccactcacgaactgttaagtctccctgctgcaaaacattccaaaaataagcgtaggtgcttttgaaaatcgtatccgcagctgaaataccattaactagtacatcgacatactgttcctcatcaccaggtaccggatgcaaccgattcttcgctattgaatcccgatcaaacctgtctattaaaaacatttcgttaactcgttgataatccacatcacttggtcctaaaaaatcacggatagcaatcaagaataacgaaacagtggtcagtcgttgctgaccatcaatgacatctactgtactagtgtcaccagtggcgttcaaaattaaacttccaaagaaatatcgctcgcgttgattcgcataagccgtcttcaaatccgcgacaagccgttccaactgttcccgccgccaactatagcgccgttgataaactggaatattgatagtcctattattcgcaatcacctgactgacgataagctctgcattacccttcaaaattgtcaccccaaagtagtattttgctggctggttcaaattgattgacactaattgatcgctagcattctctgggtattagcataccagagatgtggggttgtggcgaagtttggttgctgatgttcttggagtttgcttggaacgcttgggaaaagcgtaagttgggtgaactttataagaaaactgtcgaaaaaaatgatggaacatttagtcaaaaccaaattatttcagttgcaagtatgtcttggaatatgttagatcaaattgattttggttagttttctttgggtttttagttgttgcctaaggcaacttctgagacagattttaagcacaaaactcccactaaattttagtggggtgtaagtgcgcattgacctcgtttcactcggtctgctgataaccatacaatcaatttttttcgttatttaattgagcatatttttaattcaatttatgtttgcacctaaactaagattgttatgctaaaggttgaaagtatcaaaatagaccgtaaccattgatgtcaaaaggttatggcacggtatattactagtttccacttcattgagcattaccgagtagcctggccaggctactcggtaatgcttttataaattcgtcaaaaataatagttaatgtttcaaccgccatgtcgagtttttcacctag

SEQ ID NO: 636 - DNA, 4075 bp, Unknown
  Metagenome-assembled genome
aaaaagatgctgtagtgggtggattttttaggtgcgaggcttatgggccttttttattttgcactaaaaaatcctgctaatagattaccatgttaagtaagctatcaacaggaaaaagtatagaaccatttttatgatcaaaagaatagcaaaactcgtgccataaatttagatttctgaaaatgtaacacaaatgtaacttatgcagcgcgtctattttatgtatactgactaatgttgcttaaaaacagaaattgtgaaataggagataattatgccacgtaatttgaaagaagaaattgtttttacagctattatggctggcttgatggtgttcgttatggtttgctataacgttgtattagttcaaggatttactgaagggttcttattgaactcgatcaaggaatatcctggtggtttgcttgttgcgattattttagatctattaatcgttggccccattgccaagggattagcctttaaatatatcattaacgattacatgaagaaaaatgtagttctgattgggatcacgatctcagttatgatggttctaggtatggtttcatgcatgtcattattcgggatgatcatggcacataacttaggtggcaatgtattagccacttacggtcatacttggatcttcaacttaattatggctttgccattacaattgattgtcgttggcccaattgctcgcggtgttttaggtaaaatgcaagctgctgctgacaaagccagcgcaccacaagaaaaaactgataaagaaattgactaaataggcgcgctgttgtctttagagacagcggttgatcatatgaaaaagcccaagctgttgtccagcttggactttttttacttattcgacgcgtagatcttcgacttcgggaaccgtgaattctttgcgctgtaaatgatcaatgatcttatgcagggtttcttcagaagtgcctgaaggaagcgtgaataaagtccggcgaatcaattcaccaggttctgaatcaagcgtgatgcagttagcgatggacacatagcgcgaaataattcgtgacatatcggttagatcgccgcgttcgccggtggaaacaacggttagcacataactaccaacattaacgttccaagattgcgataacatggtcatcaaatgattatgcgttaaaataccgtaaaagtagttttgctgatccaaaactgccacgtaaggtaaatctttgattgtaaagaagactttgaaaaagggtgcgtcaactggaatatatttagtagcatttttaagtaaatgcgtcactggcagatccatggcaccgccgcgggatttatggcgataaatatgcattttgtaaatattgccgcgaaaaatctgaccagattcattgaggatcgggacgcagcgataaccagtgtcctcaaggatggtcaatgcttcagccaaagttgctgtttccttgatgctggtgatttgttctttagtttgcaccattgattttaataacatggttttgcctccagattaaataattctcattttacgtctagcatatcataatatataatcgaataatagactactattcagtttgaaaaattagagaaccttaatgaaagcaggcaattaatatgcacaatgaaatgatgcatcgtccggtggtcaaacctgcagtgctagattttttacgtcaaggtacaacacagttaacgggggcactcggtgaattagaacaacaagcccatgaaaaaggggttccggtgattcctcacgaaacggtcacgtttatgcagaccttgtttaatctgaagaagccacaaacagttttagaagtcggtacggcgatcggcttctcggccagtttgtttgccacttgtatgggtgctacagggcgtgtgacctcgattgatcgctacccgctaatgctggaacatgctaaagaaaacatcgcacatttaggcttagaagggcaaattaagttactggctggtgatgcggcggatattttaccaacattaacccccagttatgatttgatttttatggacagcgccaaagctaaataccttgattttctagatgattgtttacggttattagcggccgatggggtgctgttgattgatgatgtcttgcaagggggaaccgtttttgctgatgcagcgacggtcccacaccgcaataaagctatttaccgcaaactaaatcaattgctgacccgtgttttcaatgattcaacgttagtggcgaccttgttaccattaggtgacggtgtcttgatgatcaccaaaaaataaattaagataacaaaagagccacgacagataatttctgtcgtggctcttttacatcattagaagataacaactggcgtgccggtatcaacgagtgaatataacttagccattgtggttggtggagtattaacacagccatgtgagccatgttctttataccaatcgccgccaaatttaggttgccatgaggcatcgtggatcccaacgccagtataatcgacaggcatccaatagctgacaggtgaggcataagcagaaccgtcatcgttagtacctttcaaagtagcattggtttgtttgttccagataaagtcaacaccagatggcgtatcctgaccaggtttaccagtcactacatcggtatcaagtactaactgaccatctttgtaataccacatatgctgattagttttatcaacttcaatgtaagtattaccgatatcgtttttgtccgtgctataaccagagccttgcacaattggtgtccgggtaaagtctttacctgctaacactttagcgctaagtgcggtcacttcactggcagtgttgatgctccaaccgtaagttccggctggcactgtaaccgtaccacgcttagtactcttgaactggcgatctttattaattgttgcatactgtttgttgaggctaacaatataagccttaacttgcgctgcatctagactgactttaccgtttgtgtaagttagccaactataaattgttgcctttggtacagtcactttatcgccgttgatcgcataagtgatcttttcgttatgcaatttttctagcttggtgactgcttgcttgagactgctactatcagcgttcaccgtaggcttagcgtaagctgtcttaaccgcaatctgaccattacttgacgctagcccttggcgaatcgttgttttcagctgtttagcggaaagtcgattaccgctgactgcactgctgatggtaaaactgccattctttttaacgattgtggcgtttttactagcggtgcgtccttggttgagctgtgtgatcgttttatcaacaaactgattgaatgttgtttgatcaactgtcaggctttggctggcttgtgccatacttgtaccctttactaaatgccatggccatgaccaaggattttgttgttgctttaaactagccaacttttgagtgaactctggcttaacaccagctgttttccccgtgaagctcactagtttcttagtgccatcaactaaggtgaatttttgctgttcgaaatgcttctgtaataactgattggcctgggcctcagttttaccgcctacatctacgccggcaacattagtgcgtggtagataggtgtcacggtaacgctgactttgaaaaatataaagtccgaaaaccgcaatgagtatcacgctgatagcaatcaccattcgactgcgttttttcattggatacggtcctcctattaattattctttagctgagtgtagcattcgtgcagtgaaaatgatagcgaacgaacctttaatttagcttaagtatacagcaaataataccaaactttgtttattttggcagattgcaagaaataacttgaacaaatttagtaacgcagattacgcaaaaagatctcaatcggtgttcgccaatttaaacatttgagtggtcgggaattcaaataccagttaatttgaatcaattcatcatcggtaatctcatcaatcggttgacctttgggaatgaagcggcgtagtactcggttgcgattttcattactgcctcgttcatgtggcgaata

SEQ ID NO: 637 - DNA, 28219 bp, Unknown
  Metagenome-assembled genome
aagtatcctttgattcggtcccactgagcatcttccagttcgtatcgtttaggtgttgtcatcggaatgcctcgattcgtttttcctcagattatacctgaatttttagttttcagacagtccctagtttaatgacagttctatccccattcaacatccttcattttagtcgataactaacccactcgtcaaaaaaatagcgcattcaaaataaattaatccaaatactaactaaatctccgctaagattaggaggttctcttgcagttttactgtcgccgttcctaaaagtgcgctataatagtgaaagtaattttacacggcaaaaaactttctacaggagcgtgataacgtcaatgacgccgattaaggaagattatctgaaaatcatttttgaattaggcggcgcaaaaaaagaagtctctaataagcagatttcattagcattaggtattgccgctggttccgtcaccgagatggtcagcaaattaaaaaaagaaaagttagtcactcatcgaccttaccacgatattgcattaactaaaaccggcttagatcaagctattttattgatccgtaaacatcgtttatgggaaacttttctagcaaacgaccttgcatttgcgctaccagatattcatccagaagctgaagttttggaacatgttaccagtcccaagctactagcacgcttagataaatttcttggttatccgaaacattgccctcatggcggcgttattcctgacgctgatggtcactttcaagaagaaagttacaccgtcctcgcacagatacccgatggccaaacggttaccattgaacgtttcatcgatgaccatgacttgttgatttaccttgcggatatcaaattagaattagaaactcaggttacggtgcttaagcatgaaccttttgacggcccaatcagtgtcactactgcagagggtcaaaaatttaatattagcttcaaggcagcccataatatttttgtcactgataaaaatggcgcatcgttggagccaacaaaaaaagcgtgaatctaatcacgcttttttgtttacaatgaagttgttaccacgtggcgttcaaatggatctgaactgataccttcttcaagaatctttttgcaccattctttagctgagaacaaggaatgatcacgataattaccacagctcgtgatatcggttccttggacgtcatcccaagtagctgggcccgcaataaattctagtgagcctttcaaagcagcggcaacatcttctggtttatgccgcccccaaaggatcaaatgaaaacctgtccggcagccgaatggtgaacaatcgatcacaccgtctaggcgatcacgcaacaaaccagctaacatatgttcaattgtatgtaaccctgctgttggaattgcgttttcgttaggctgaactaaacgtagatcgtaattctgaatttcatcacctttagcgccggattccgttgtaatcaaacggacatatggtgcttttaccttagtatgatctaaagtaaaactttcaacttttgccatgtttaattcctccaattagtcatttgagcgatgtgctctgctatttattgtaccgcgcaagcagtaattttgaaaatctttaattcaatttctagaacgtacgttaaaaaatcaacgctggaagctaactcacgacttagtatagttgccggactaaatcagccactgcgcgaccgcgatgactgtactgggcacgggctttagctggtagctgcgctaaggttttccctagtgcaggtaagtaaatcaaccgatcaaagccgccgctgagttccccctgttcctcaactgccacttgagcagtcaaacaaccatgagcacgcaatatttgtgtgcccacacgtaaaaccaaataactatgcaccgtaatttggcaatcatgcacattttgcaagcgcgccagcaggtacttatttgctggcagtggttgctgggctagcgttcgtgcagtataaacgccaaattcagtaggaaaagccgccaactcaattccagaatcatcacctaaaactggcaaatgcgtcaattgggcaacctgatcggctttatgctgggcattttgccaatagtcagcgccttctggtgcaaaagacaatcgtggcaattcagtcgtataactgcgtaaggaaaattgctgttgggcaaataactcacgtaactccgctaacttaccttggttatgtgaagctaacaaaatcggctgctcaatcatctggcaacaactccttaactaagtaaaacgagccggtgacaacgatcagatcgtcaactgcagtttgttgatgtgctagacgcaaagcttgttgcggtgctgcacaaatactaagtggtaagtcgggggcaatttggcgacacgccgctgccaattcatttgccggtaaatgacgctgcggattatccggagtcgttacaatcacgcgctgcgcacgcggtaacagtaattgcagcattttccgataatttttatcacgtaacatacctaaaaccaaagtaagcggtcggtgcggagttaaacgctgcaacgttgtcactaacgcttggctaccatcaggattgtgcgccccatccaaaagtacggttggccgctgaccgatcacttgtagccgtcctggtagctgaacttgtgacagcgcttgtcgaatgcatttatttggtatagtgatcagttgctgtaacacgtgaactgcagttagaactgtcgccaaattggccacctgaaattcaccaactaacctcaaagtcaactgggaccatgtgaaccattcactagtcaaactaaccgtcattccagttaaatcaaatcgttcgatcgtatactttaattgttgtggttgccaataagttgcccgattatgctgtgcagcttgccgcaataccatttcagcttcaggcgcctgttgcgggtaactgatcactggcacacctggccgcatgatcttacttttagtggtggcaatcgcagttaaggtatcaccaagcaaagccatatggtcataagcgatttttgtaaaaattacgagctccggttgatctaaagcattggttgcatcaaattcaccacctaagccggtttcaatcaccacccaggcaacttgttgctgctgaaaataaaccattgctaaaataaagtaccattcaaatttggataaagccgttggtggtaatattaattcgcctaaggcctgtttgacttgcgcaaatgcagttaaaaaatcagcggcagtgatcatttgaccatcgattgtgatctgttcaaacggacttcgcagataaggactcataaatgcgccactccgataacctgcagtcgttaaaatcgttcgtaacatctgtgtcgttgaacctttaccgttagtccccgcaatgtgaataagcttaaacttattctctggatgccccaactctgctagtacttgccgcagtaatcccacccgatcaccaacttcgtacagcattccttgggtcatttctgcctgtgcggcggcaacttgctgttcgatcgtcattagtgcaaccgccgctcaaattcagcaatccgcactggatcatctaaagcaccagtaaagcgcgtagtaaccgtttgactacctgttttttgaataccacgcatctccatacacatatgccgcgcttccaactcaaccgcaatcccacgtggctggaggattttttgtaattcatcgactaattgcgaagttaaccgttcttgaacattaggtttatgcgcaacataatcaactaaacgggcgattttgcttaacccaatgatctgaccatcagccggtaaataagcaatatgggccgtgccgaaaaatggtaataagtgatgttcacacattgaataaaacggaatatctttaactagtaccatttccgcatgactatcggtttggaataatttgtaattcgtaaattctggttcacgtaacgaactaaaaatttccgtatacatccgtgcaactcgctcaggagtttcaaccaaaccagcccgctcaggatcttccccgacagctactaaaatttgtttgaccgcagcgatgatctgctgcttctgttcatcattcatccttgctcatccctaatcttggtcacccgctgagcggcgggtaacgcttgtaataattgctcaacttgcttttgttgctgaccagtcgtaatttcttgtaatgggactaaaacaaatgcccgcttagccatctctgggtgcgggatcgtcaagtcagccgtttggatcaccacatcatcataccagagaatatctaaatcaatggtacgcggtccccaatggatcaagcgtcggcgtttttgattttgttcgatctgctggatacgctgcaaaagctcagttgcgcttaagctcgtctctaaatagactgcacaattataaaaatcatcttgcacaacaccgccaaccggtgccgtctcataaatactagacacacgtacaacgtcgattgccgagtcagcttgcaacgccgcaattgcctgttgcaactgtgccttacgatcacctatgttggatccaatactaagatagacttgatgcatcaacgcttcacctgcacttcaatttccacattatcaaaaatacccgcaatcggtacactatatttacgtacgcgtaattgaacggcttcaaccaattgatattggcgtaacaattcttggctgatatgattagccaagctttcgatcaattgatattggtgtgtttgcgcaatcgtaacgatgctatcatacactttagcatagttgactgtttcattgagttgatctttagtccctaacctttcaatcgggacagttagcgccacatcaatttccaaacgttgtcccagtcgattttcctctggtaaaacaccgttatatgtataaacctgaatattatttattttgattaatcccacagttggtcctcctattattcattaaaataataaagacagttgaaacaaggctctaacggctaaaactacgcttgatcttatccataatgcctagcgtatatttggtttcagcaatatcgtgtgcccgcatgaagttgacgtctaaggcggctgaattagcaaagatcgccatcgttggtaccaaacgttcctcaaccggtaaatctaataatcttccgataaacccttttcgtgatggcgcaattagcgtagccacccctaaatcattgaaataatctagttcacgcaataatgtatactcttgttcataatttttaccgtaaaccgaacctaagccaacatcgatcatgagctgacgtcgttcgatgccatagtgtccagcaaaatcaattgcagcagcaaaataatcgtgaatatcttgagctagatccgtatattgatccccattttgcgtatgcatgatcactaatcccgcatccgctgccgcgactgccgccaacaaacgtggttcatcctgtactggacgcacatcattgataatatctgccccagcagctaaaactgcctgtgccacttcatatttataggtatcaaccgcaatcggaacatccactacaggccgaattgcttccagcaccggaacgactcgagcaatctcttctgctggcgtcaattcttgataacctttacgagttgactgcccgccaagttccaatacatccgcaccctgtgctaccatttcctgtgcccgcttgattgctgccgctggtgtaaagtagcgaccaccatcatagaatgaatcatcagtaatattcaaaatcccataaacacgtgttttagcctgtgtatccaaatcaaagcgccgagcatggaacaaatgcgactgtcgtaatttggcggccgcccgctgcaatgcatcaatataatcagcaattgcaacaggctgctgtgttgacgtgagccatttatccattgttaataacaagtatttgtctacgatcagtgcccgtgctgataaacgcgtaatttgtaattcatgttccagctgacgtactgcttgatcagttggtagatcgacgtctgccactaacatgatcatcgttggtttaaatagctgtgcgggcaacgtcgtggttgccattgattgttgtttaagttgcaacgctatcgtcctaactattattaatttgattagcccaatcttacccagaaatgagcccagcgtcaaacaattatcgtgtactaaaaaggagcggctacgttcgccgctccttgatcttatatttcagcatcacgttttttgaaataagttgtcattgcgtaaatacctttttcaattgccccaacatgtggcactaaatgttccgagtgtaattgataaggttgatcaacacctagccagaacatcgtaccatggatcttagcaatcagaaaaccaaaatcttcaccagtcattgctggctcagtttctacgtattcaatggctggatcagtctgcatcgtttcaataaacgcggcagttgttgtcgaatcattttccaccggataatacccgccctgatggaggtctaggtcgacctggcaatcataacttagtgcaataccttcggcaatcgtccgcacccgctgctggatgtgttgattcatgacttgcgtcaacgcacggatcgtaccatcaacctgagcactgccactgatcacattgccaatcgtgccagcatgaaactgacctaaagtgaccacgccactttgaatcggatcaacattgcgactaacgattgtttgaatttgattgacaaattgtgccccagcaacgaccatatcattagccagatgtggataagccgcatggccacttttaccactaaaatgggcgtggatctcacaagttcccgcaaacaaagtgccttgacgacaaccaatcgcacccgttggcaattgtggattaatgtgtaagccataaatttcatcaggcatccagtcatccaacgcacccatttcatagaggcgtttaccaccactggcattttcttccgctggttggaacaaaaataacatattattctgtggttggttggtggcaaaataagacaataaacctagcgccaccgtcatgtgaatatcatgaccacaagcgtgcatcataccttcatgcttagaagcaaaaggtagccccgtttgctcttgtaccggtaaagcatcaatatctgtgcgccaacctaaagttgcgtgtggtgcttgcccactaacaaaaaccaaggttgccgtctcaacttttttaatggtcaaccaagtttgtggtaaactggcgatcactttaagtaaataagtctgcgtttcaaattcctttaagccaatttcagggatttggtgcagatcctgataaatttgcgttaattcgtctgttgttaatgtcatctgcgcgcctcagtttacaactgccgtagtgcatcaagaatttcagtcttgctacgcgttttgtcatcaatatctttgattttacgcgccggaacacctgcaacgacggtatatggtgcaacgtctttcgtgacgattgcgccagccgcaaccacggcacctttgccaacgcggataccttccaaaacaacggcgttagcaccgatcaacgcatcatcttcaacaacaactggttgtgctgaaggtggttcaaccacaccggctaacacagcgccagcaccgatatgtgcgttcttgcccactgttgcgcgaccgccgagaacagcgcccatatcgatcattgaacctgaaccgacaacggcgccaatattgatgacggcacccatcatgatcactgcattatcatgaatttcaacttgatcccgaataaaagcacctggttcgatccgggcattaaattgttttagatcaaccattggcaccgctgagttgcgagcctcattttcaacatggtattcactgattgccttttgattagccgctaaaaatggctcaacatcagcccaatcaccaaataacacaccactatgggcctcaaaaaaagtttggatcgagccagggatcgttaattgatctaaatgccccttcacatataccttaactggggttttcttctttgcttcactgatgaaacggatgatttcatttgcatccatgtcacgcacgcacctctccataaattatcatttttcactctcgcttagtggatacgcctgatcaaagttatgtgccaagtagttaacactcttcatgatctcccgtcgcgtcacaatgcccgtgaaatcaccttcgtgactgacgactggcagaaatggattatccactaataaatgtaatattaactcaatatcataggggttttcaactgttggtacatttttttcgcaaacatcgccgacacagagccgatttaattggcttaaatcaaaatcatctcggcccaacatcgtgtcggtgatcatcggtaacgaaattaaaccaacaaactttgaatcgttggccaataccggaattttagcgtagcgaattttagttagcactaaaaaagcatgatttaaattattgtcgacttgtacattggccactttttcagctgggatcaagaaatgagctttattttgtaatagaatatctaaaatcggttgacttatcaatgcggcacctccgcttactgtttatgtcggttgctattttaaccagtcacgccaaactttttccaaattacgtaatgcattaccacgatgactgattttatttttctcatctgcagtcaattcggctaaactcttatctaattcgggaactaagaataacggatcataaccgaacccgttgtcgccgcgaggaatacctaagatgtagccattgacttcgccatctacgaccagatcattttctggttgattaggtttggcaaaaactagcgtcgtgtgaaaagtcgcgttacgcttttcttttggaacgccagttaattcgtataataatttagcgttattagcagcatcgttgtgatcaccagcatagcgagctgaatagattcctggacggccatgtagcgcagccacttgtaagccggaatcatccgctagtactggtaaattaagaacgcgtgcaatcgtgtcggcctttaaacgggcgttttcttcaaacgtcttccccgtttcttcgatttctggcaaatcaggaaaatcattcagcgtcttcacttgaagaccatcagtggcaaacattgctttaaattcgctagccttacccgcattacgtgtggcgatcacaacggtattttgggacaaatcgctggtatcatacggatgttgcagtttatcgaattgatagcgttgtgccgtgatcaattgttcaatacctttggtccctaaatataacaattcgtttaattgactaccagaaaaagtggcttcttcaccagtgccttgtaattcaataaattcgccttgtccagtcatcacaatattcatgtcaactaacgcctgctgatcttcactagcttctagatccaacaccggaccaatttccggtaaaatacccacgctgattgctgctaaatcgtcttttaaaggattctcaggcaagactttattcgccaccagtttagctagtgccagctttaaagcaaaaaatgctccggtaatactagctgtccgcgtaccaccatccgcctggatcacatcacaatccgccactaatgagcgtggccctaatttttctaaatccaccactgcccgcaatgctcggccaatcaagcgttgaatctcgatcgtacggccagtttgccgtcctttcgtggcttcacgccgagtccgttccttagtcgcccggggcaacatactgtattcggcactgatccaacctttttccgttccgcgcaaaaacggcggctgactgtcctcaacgctaacactacaaataactttagtggcacctaaagtcatcaaaacagagccttctggatttttcaaataattagccgtgatttcaaatggacgcaattctgcagccccgcgattattatttctttgcatgcttaacctcgctgtgtttaattaattccgttaaatcaatatggcgaacatctaaatcatttaattctaaccagtcccccgcgattcgctggaacatttccggattaccggttgtataaaattcatgttgtggttgtcgtgccggtgctgctaattgatcaaattccaataacgcagaaagttgattgaccgtttcggcaccagaatcgatcaaagtaacttgatcaccaattcgattttggatcaaatgacgaatcaagggataatgcgtacagcccaaaatcaaagtatcaatatgctgattatcaaatggtgtcagcgattcggcgactacttttttagcaaccgccgatttatattcgtcactttcaactaacgggacaaacttaggacacgcgacacccgttacttcaacttgcggtgcttgccgcgcaatcgcttgcggataggcctgactcttgatggttccaatcgttccgatcacaccgacctttttatttttggttgccttgattgctgcctgactacccgccacgatcacaccgatcacaggaatatctaaagctgcctggatttctggtaaagctgcagcagtagccgtattgcaggcaataacgatcatcttaacgtgcttacttaacaagaaattagtcatctgccacgtaaattctttaacttgactagctggccgtggtccataaggattgcgtgccgtatcgccaataaaaataacctgttcattcggtagctggcgtaacgcttctttcacaaccgtcaggccacccacgcccgaatccatatagccaatgccttgttgtacatttaccatttatttattcctctttctattcgtccaagctaacacatgctaacttataggcacatgtatagatctagtttgaaaactaccaaaccacacttgccctgctgaccttttgcaataaccccgatcacaaatagacctacatatgattttcgccttttttacaactaagttcaagtgaatcgctagggttattcattttttaataaaaatttgttggatgcccattagtttaattatttttgctataatgaaaaggaagaaaatcagccatatttttgatgagtgagtttatggtcaatcaacgattaccattactcagcgtaacaatacaccaatgaattcagggtacttaccatttcaactaagtaatagattgcttgtcgttgtgggttaaccttgctttagattaaaatcaaccacaacatcaaaaatttttgaccaaaaaattaaccacgatcgtggagtagaggtgattaggcttatgccagagaatcattatgaaaatttattacgggcagtgtctacgccggaaacactgggttatgagctattgcgcgatatcttattgcctgatctcctaggacaggaagcacccggtattttgtattgggcgggtaaagatcttgcacgccgcctgcctctaagtcagttagatgatctgccaacttttttcgcgcaatttaattttggcgagctaaagttaagccaacaaaccaagaatcggtatatttaccagttaggcggccaacaaattgcacggcgacaaaaggcatttagcaatgcggatttccaacttgaaactggctttattgcccaacaagttcagcaactgacgcaaacgattgctgaaggtcagcttgaatttgatcgtgataaaattacgatcatcgttcaaactgatcatacagatgtccctcaagctactgcgatcgataatccgatcacgttacatcattttggtagcactgatgcacctgcagaaaagcccaccacagacacccgtacaagtgctacaccagttaccgatttaatgccgaaacgcacacaacgccataaacgcggctggttcagccgtaattaaaaagcatgcctatatttgcggcatgctttttcaatagctgcgttgatcgcctaatccaaaatattgccattggctgaataacggttgcgcgatcaagtcatcaatagtcacgaattgatacccttgcgcttgcaaatagctaataatattgggcaaagcggcgaccgttgccggttgaatatcgtgcaaaagaataattgcacctggcgtagtcgtttgctgaatcattctcaaaatcatagctgcattttgacttttccaatcttcgctatcaaccgtccactgaataattggccgtcccgcaatggcaacgctagtctgatcaatactgccatacggtggtcgcattagccgtggccaagttcctgtcgcctgatagatcgctacatcagtcatagttagctcttgatccacctgtgccgctattaaattgggtaactgcagatgatcgtacgtatggttgccaatttcatgtccagcctgagcaacacgccgggccaactgtggataagtggtgacattacgtccaaccataaagaaagtcgcatgaatctgtgcttgggctaaaatctgcaaaacttgcggtgtagtgtttggattcggtccgtcatcaaacgttaaagcaacatgcttaccaggacttatttgtgatgtcacgtgccaagctgtcggcaaaaaatagcgcagttctgtaaaatcaaccgatactgcacttaactgttgctgcgcagtttgtacatagaaaactaattgttgctgattgattgccaaccacggatttaatggctgggtcataaagttttgcctggtttgtgccaaagttgccggctgcggttgcactacttgtagaaccgcattgaatatttgcagttttaaggcgtttaatgtggtcgcatcattcgtaatttgggctaaagtgatcacctgatcttgcgcatcattcactaataattgtcgccgcgtcaatggtaatgatatgctcgttcgttgtcccgcgcgatcaatagcgaccgccaccaagttataaccaactaaattgccagcacggctgacgctagttggataaatatctatcgtcaccgcggtggacggtattttaagctgctgggcaaaaattttccagaaatcagccgtcaacttagaactaaccactaatttttgtggcacaaagaaatgataatgcacttgaccaatgctcagcgtcttttgcccatgaacatatttagtttgtatgttgattgtctgcttcttattttgctttgacttaactgtgagttgagtagcccgatcagccggcggatcattcgactgatcatttatctctaaaataattccaccaacaacaaccagtaaaatagccactaaaatccgcctaactttacggcgcatcgtcatcatcccactttataaacccatttaaatcagctcccaatatttcactcacaatatagcagtatcaactattataatcaattatttttaattatgaaattaagtgaaaacaaaaaagccacgataactacagttatcgtggcttttcatttaacaaatagggtcaaatcgtaattgatttatgcagtatattgttttaatacttgatctaactgatccttggtatgataaccaactagggtctcaacaacttcaccgtcttttttcactagtaaagttggaatactcatgataccgaaactttgagcagttgctggattagcatcaacatccattttagtgaatttaacttcaccatcatagtcttctgctaattgttcaacaacaggtgattgcatccgacaaggaccacaccaagttgcccaaaagtcagttaaaacaacgcctttatcagtttcttgactaaagtctttatcagtaattgcttgtaccataaatttctacccctctactccacaatttgtggttaatttttgtaccaaaaattcttgatgttacggtcgatagccattcttgtggcaaagaccgtaccgcaagaaccatggttctactccacaatttgtggttaatttttgtaccaaaaattcttgatgttacggacaatagccattcttgtggcaaagaccgtaccgcaagaaccatggtcctgcgatatgttatattctagcagaaaagccgattaacaacaatctttttgcttactaaaaattagaagttccgactgcttatattatttaaaagtaacaaccgttgcaccgtcaccgccagcatttgccggtgcaaattcgaattttttaacttggcgatttgtttttaaataattagtaattccttgccgcagcgcgccagtacctttaccgtgcacaattgtgacctggccatagcccgctaataaagcagcatcaatgtaacgatcaacatcagctaaagcatcttcataacgttcaccgcgtagatctaaagttgagctaacgtgattgccggtatgaaccgttgcaaactgccgctgtggtttttctgctggtacgccagccgttttttctagatcatctacagccactttcattttgagaattccgagttgaacttcccaatgctttttgtctaattgattgagtaaaacaccatgctggccatacgtagtgacaataacatcatcgccaaccttcaacgcttggcgccgtttttcatggcgcaatactttatttttcgccaatgctttttcttgtttcaaattggccaagcccgtcttagctgcgatcaattcatgttctttgaccgtttgttgttgctgtttttgcatttcgcgcagatcatgaatgatgcggtcactttctttttgcgcatgatccacgatctgattagccttatctttagccttgtccagttgctgttcccgcgcggaaataaactctgtgctagcactagccaaatcagcatgcaattgttctgcctctgtcaataattttttagcttgtagccgttcattttcagcagctttacgttgcgcttccaagtcactgatcatattattcagatcttgactatctgctgtgatcaattgcttagcttgagccacaatgttatccgccaaacctaaacgtgacgcaatctcaaatgcattggaacgtccgggaatcccaatcaacaaatgataagttggttgcagggtttccacatcaaattccatactagcattgatcgtacccgggcggttatagccgtaagcttttaattcaggataatgtgtggttgctaagacataactgttggtagtccctaactggtctaaaatagcgatcgccaacgcagccccctcttgtgggtcagtgccggcacctaattcatcgatcaaaactaaactacggtcatcaacttgcgccaagatcgacacgatattggccatatgtccagaaaacgtactcagattttgttcaatcgattgttcatcaccaatatcggcaaaaatattatcaaaaacgccgacttgactttcttcaccggcaggaataaacaaaccagcttgtgccattaattgcagcaagcccattgttttcaatgtaattgttttcccaccagtattaggaccggtgatgatcatcgcccgataatcctgacctaaaataatatcattagctacgatcttagccggatcgatcaatggatgccgggcttgacgcaaactaacttcgttgtcgagattcaacaatggctccgttgccttaattgcctttgcatagcgcgccttggcgttgatgaagtccaactgacctaaaatcgtcgcgttctgtgtgatctcatcttgataaggcgcaatagcttctgataattcagctaatatccgctgaatttcttgctgctcctccaactgtcgctggcgcaaacgattatttagatccatcacgctttgcggttcaataaataaagttagaccgctggcactttgatcatggacaacgccaccaaaatgagcccgatactcttgttttactggaataacgtaacgatcattacgaatcgtaatgatcggatcactcaaatatttggcactattgccacgcgtgtaaccggtcattttttggcgaatctcaccttctaattgatggataccgttgcgaatgccttttaatttaactgaagcatcatcagttacgtggccatcttcttctaatgataaacgtagccgcttagtcagctccggtaaagtcactaattgcgcctgaatcgcatcaacctgacgcagcgtgatctcctcatcagcaaactcaataaaaaagcgatccactgcattggctgcacgaagaacgcgcccaatttcagccagttcgaccccattcaaagtcccaccaatcgctaagcgctgcatatgagatgcaacactagctaattggggaatcggaattggtccctttaaacgcagaatatctgcaccatctttagtttcatcaagttgctgctgaattgctttactatcagtcaatggcgtcaaagcagccacttgtgcttgccccattgccgaaacaatatattgttgcaacgcttgtttgattttagcaaactctaaaatcgctaaaattttcgaattcaatattaaacctcctctgctctacaatagtgagtattggataccaaaaataaccactactataaaagaaaaaagatagcctgtttattcagcctatcttcccataaactcaacttaaatcgccgctaaccaccaatgaagcgctggtattggcgtaaatcgtatcatcccttgcgttaacaatgagtgacttagcaatgactgcaagccagttgctggaatcaacgcaagtaccgtcaaaaacaaaaagatcccgacataaaccgttactgctgacaatacaccgccaccaattacgctcagtcgccgttccattgggtaaaaagttaaatgatgcaataagatcgctacaaaacgagtcaataaccaaccaaaaaataagatcagcataaacgcaattgcagcataaaaggcattatctaattctaaaccagttttatgactaaagaaagcaaactgactggcttctgttgctgattgataaggaatcaacaaagttaatttaggcgcggtatgtaaatagcttaaacgcgcaacgataaaggacagcaaacaaccaatcgtatagacagcttgcatcgctaacccgcgccgggttcctacataatacgcataggctaaaaagattataataataagtgataacattagtttcctctttgcttgtgttcaaaattaattttggtcggccaactgttgcttcaattgttcgttttctttttctaattgctcaatttttgcttgtagtctcaattgatcagaaaccgtattgattgccaataatacagcggtctgttcatcgtctagcgttgttgctaatgatttaatctgggccagctgatcattaactaattgagtgaccgcttgaatatgcgcatccgaagcattaccaatgatcacatattgcttgttatcgatcacaactttaaaacgccgtttctgctctgccatcaaacgctcctccttatcttttcattattaaaattatctatatttcagaaagtaattcaacgcattttattttagcatgaaaaaacgtaaataaacagcgctttaagaaaatgttagacggcacgccactagtttaatgaaaaaagataattgatgtaaaaaggatcggtgcaaaattttcgtttgcatcgatcctttagtgtcgctattcttggtcgtcatccgccaaaaaagtattcaaaacttcttcaaccatatcccattcagcatccgattcgattgggaatagatcaccttcagcaggatcgcctttatcattggccttgtatgagaaagcttggatatcgacgtcttcatcttctggggtgccagccggatacaataaaacatatgatttaccgtaatcctcggaatcaaaagtaaagagaatttcatataattcttcattaccattttcatcaactaaagtaatttgtcgttcgtcctcattttgaggtagttgtttgtcagccatgtcagtctccttaagattaatctcggctcgcgcagcacttacgacttaagatgtgattcgcgatccaaaaagttttgtaaaatcattactgccgccagcttatcaatcacttttttacgtttcttccgtgatgtgttagcctgactgatcagcatccgttctgcttcaaccgtggttaaacgctcatcaataaaatggactggtaaaccaaaagttgccgtcaataaacgaccataagcctgtgaggcttcagcccgtggtcccagggaattatccatgttcttaggtaacccaacaacaaaatcagtcactgagaactctgttactagttctttaacacggtcgatgccaaattcttcttcgtcttcattgatgcgaatgatctccacaccttgggcagtccagcctaatagatcactgactgcaatacccaccgttttagaaccgacatctaagcctaaatagcgcattcttagcgctccttcttcaaataattacgcacaagttcttcaatgatctcatcgcgttcatgtttgcgaatcaggttacgcgcatcattatagcgcgggatatacgctggatcaccagataataggtaacctacgatctgattaatcggattgtaacctttttcttctaatgcttgatagaccgtttctaaggtctgctgcacattttttggctgctcacgcccaaaatcaaagctgaccgttttatctaatgaactcaccgcaaacaccttacccttctcacaaatctctatattgtcactatttatcgtttctatcaagaaaatctatcttgactccaacctacattctactagaaaagccggttagatacaattttattttccttgtaaaaatgtttgggcagcttgtagcgcatctgccataccagctggatttttcccaccggcttgggccatgtctggacggccaccaccaccgccaccaaccttaggtgcaatggctttgatcaaatcaccggccttgatgcccttagcgataccatctttagtcactgcagcgatcaaattgactttttcaccaacgatcgtgcctaaaactaaaacatcagaaaccgctttttgcttccaatcatccgctaactgacgtaattgattcatgtcagcaacgttgacctgttccgcaactaaagtaacgtcattgatggtttgtacattttggaaaatattagctgcctgttgttgagctgctttagcctgtaaactttcaatctgcttttcagcctgttttaattgttcttgtaattgttcaactttgccaactacattttgcaattgtggtgctttaactaaactagccgttgcttgtaaccaattttcacgttgagtcatatagtcaaaggcggctttaccagtgacagcttcgacccgccgaacaccagcaccgatccccgtttcgccggtaaacttgaacagaccaagttctgcagtgttattagcatgtgtcccgccatcaaactcgcgggagtaatcgccgatagaaacaacccgtacttctttcccatacttctcggtaaagattgcaatcgcacccatctttttagcggattcgatatcagtgaccacccagttgattggcaatgctgcccagattttttcattaatgatctgttcgatctgttttaactcttcaggtgttgtctgccccgcatgcgtgaaatcaaagcgtaagtaatcaggttcaactaatgaaccagcctgatgaacatgttcacctaaaacatcgcgtaaagcttgatctaataaatgggttgccgtgtgattccgtgaaactgcttgccggaaagccggatcgaccttcaattgataagtagcatccttagtcattggtgctagcacgtcaactgtgtgtaagttttgtccattaggcgcatgttgcacatcagtgacagtggcaaccttatgcccagcctgatcaaaaatatcaccgtgatcggctacttggccgcccatttccgcataaaatggtgtttcatcaaagatcagttgcgcttcaccagtcgtaacttgttcaacaattttgtcattagccactaatagcgttaacttcgcatcgtctttttcaagatgatcccagccaataaacttacttggtactttaacatcaagcaataagccattttggacacccatcccgttatcttgactccgagctgcccgtgcgcggtccttttgttgctgcatttctgcattaaaaccagcttcgtcaacttgtaaaccttcatcagccgcatattccttagttaaatcaaatgggaacccaaatgtatcgaataacataaagacagttttgcctggcaaagtttgttcattggcttttttagctgctttgatctgtttatctaataattttagaccgtcagttaacgtattgttaaagcgatcttcctcagacttgatgatcttagcaatataatctttttgcgctaaaacttcggggtaatagctttccatgatttcaccaacgattgggactaatttatataagaacgcttcgttgatacctaatttcttaccatggacggtagcccgccggatcaagcgccgtaaaacataaccgcggccttcattagaaggtaatgcgccatcgccgatcgcaaaagtaactgctcgcgcgtgatcagcgatcactttaaacgaaatatcagctgttttatcaactccataacgtttgccgtcactcatttgttcagttgccttaatgattggcatgaatagatctgtttcaaagttagttttcgtttcttgtaccaccgaaactaaacgttctaaccccatgcctgtatcaatatttttatgcggtagtggttcgtaagtgccatctggtttatgattgaattcggaaaagacgatattccagatttccaaataacgttcattttcaccacctggatagttttccggatcatcctcggccacgttattaaatttttgaccacgatcatagaaaatttctgaatcgggaccactaggaccttcaccaatatcccagaaattatcttcatcttctaagatatgatcaggtttaacaccggtttttagccaaacttctttggcaaccttatcttttggataaacggtaatgtataacttttcgggatcaaaagccatccatttcggactagtcataaattcccaagcccacggaatcgcttcttttttgaaataatcaccaacagaaaagttacctaacatttcaaataaagtttggtgacgagcggtttttccgacattttcaatatcattggtccggatacttttttgcgagctagtcaagcgcggattttctggcacaacgcggccctcgaaatactttttcattgtcgcaacaccagaattgatccacaacaaactaggatcgtccaccggcactagtgacgccgatggttcgatcgaatgacctttttccttgaagaaatcaaggtacatttgacgaatttgactactggataattttttcatgagtaacctctttctgaataataaatataaaagaccatataaaaacaccgttgcttttcaaggacgcctcagcgcggtaccaccttgattgcaacgatgttcatcgttccctctcgaactcgataacgccgagtcagcgatacgacagggagcactaccaataagtgtgtcgccacgctcacagtcaaggcgtaactttctgcagacacaatgttattagagcatatccggtctagattgattttctgcaattattatagtcatctggcaagcaactgtcaaataaccatagcactttgaaaaagtgttcaagctggatgagcattacactaggttcggcgccttaatcaaaggtaacgcgaatcaccttgcgataagcatattgtgccgccggtaatgcctgttcaagcgttactgctattggtaattgataataggctgaatgaggcaactgacgttcaatcaacgcctcaccttgacttgcagctggacctaacttcagggcgcctaaatcatcagtcaattcataactgtgatctgacgcaaaggtcaaattaaacccatttttaaccgcacctgtatgcacaagttggttgccccacggaaacaacgtggtttgcccactgttagccaaatattcccattcagctggcgttggtaaatcaaagccgcgctgttcgatgcgctgcttaagttcgccataagtcgtcggaattagttcacaagcctgataactgaccccatcagctaatacgcgcaagctcacatgctcagtaacttgagcttcaactgcatcagtcataaacggattaagtacatctgtttttggttgtaacgccaacattaattcacgacgatatttatggaagaaactttgatcacccgtaaaccgtcccgtaacgctatgatagatcccccgcacctgacgatcaaccggtaaagcactttccgcaactaataacggtgccaaagcggcttcgcgcggcgcactagtaaattgttcaacgtactgctgtactgccgcaatatcagtcaattcagttgccgtagtggtcggtttaaacgttgtccagtcaattggtgcgccttcattagcccaaccaaccatgagcgttgactgtccaggaacaaagataaaacgctcaccttggatccatgttgccaacgtggtaattcgctcaccgctgatcgtaaaattgacaaaatcagtttgaccaatttgtagcagtggattgacgtaatacaataaaatctgattaaaaagttcgcgctgctggttgcgttcgagctgccgccagttagctaacattaaactttcttgcatattcattgaagtgacctccacctaactgattttagcgattagcatcgcggttcttacgtttttgctgccgcatatcttcgcgttgtttgacccgccgcttaaaccattcatctttggcgattgctgatttgatccgctttttatagccaggtttatgctgcttcttttgctttttaactaagccgaccattttcgtatccaacgcttgcttcgtcttttcacgtttagcacgccgattacgatcatagccatcaataagttgcccatctttcagccgcttcggttcaaacttgatacctaatttttcaagttcagtgatctctttttcttgtccaggctcatatagcgtgatggcgatcccagataagccattccggccagtccgcccgactcgatgaatgaaaaactcttgatcagctggtaattcagtattaattacatgcgaaataccggcaatatcaataccacgcgctgccaaatcagtagccacaacatactgaaaatcaagtttttgaatttggcgcattgtcttcttacgatcacgcggtgttaaaccaccagaaattttggcaactttcagtccttgcttagtcaaataatcagcaatttcatccacgcgtcgtttcgtattagcaaaaatcaacgctaaataaggattactatttttagccaattgatagatcaattgatttttatctttaccttgggtcgaaaccaaataattactaattgttgggctgatgatcgtttcagtgggaatctcttcaatcactggtgaattcatgtacttacgtaagaatggttccaatttttgtggaatcgttgcggaaaagaccagcatctgtaagttagccgggaaagtggccgcaattttatcgacttcatttaagaagcccatatctaacgtcatatcagcttcgtcaacgacaaaagtagttgccgtgtaactctttaacgctttactcttgatcaagtctagaatacgacctggggtcccgatcacgatctgtggttgatgatgatggagtttctcaatctgtcgttgtttatcagttccaccaacgtaatgctgaatgttcaatggttctggactgaacttagcaatctgttcggcagcctgatagatctgttcggctaattcacggctaggtgccgtgataactgcttgaacttcatgattttcttcttgtaattgattaaaaatagggattaaaaaagcatgtgttttaccactaccagtttgggactggccaaccacacttctgcccgccttgatcaacggaattaatttttcctgcactggcgttggctggataaaacgaatatctgctaacgcttgtagaatatagggcttcaatttgaagtctttaaatgtactcataactacctcttctatttcacttgattaagataggagttgtgacataagtcgtttatgcccgacgccttcttcacacttccgaacaatatagttaaaacgtgtttcataaggcaactttttccgcttagctacgatcgtcaaataatccactgtgtgaattattcgccgctctaagctaatgctcaaaagctgggcgccttatgtcacacactctctgatgttcatggctctatttgttattttgcgctaattggtcaacaccagcgataatcgctttgatttcagcctcactatacgcccgcgcaccactggccaacggatggccaccgccatcatgagccttagctaattgattgacgattggtcctttagaacgtaagtgaacgcgatagctagctgaggcttgttgaacaaaaacactccaaacttgtaccgcagcaattttaccaggtaatgaaacaactgcatgcgcctgcgcaacacttacgtttaacgcattcaatgtttctgtagtcaacgtaacataagctgcgccactaggcaacaccgtcatatgttctaatacataagccgataagcgcgcctgttcaagggttaatgtatctaaattgcgattgatcattgttggatcaaagtctgcctttaccagctcaccagcaacattaaaagtatgtgtactggtattagcaaacataaagcgccctgtatcaccgacaataccagcatataacaattgtgctgccgtagctggtaactgtaactcagcgctagcagcttgtaaatcaaaaattaattctgatgtactagaagcttgatcatcaaccaattgaatatcgccataagcatcatcatttggatgatgatcgatcttgatcaattcttgtccttgatcaaaacgttgatcatcaacccgcggcgtattcgctgtatccgtgacgatcaccaacgcctgacgataagtttcatcagtcacttggtccattgttgctagccaatctaaaccttcagtatttgccccaacgacgtaaactttttttgctggaaaactggcccgaataatctctgccaaaccaacttgtgagcctaacgcatcaggatcggccttttcatgccgatgaataataatcgtttcaaacgctttaatttgtgcaatgatctgttgctgtaattctgctttttgcatgtttattttcctcgatgtccttctaataattgacaaacaataattgccttagcaactaagccgccaccttgttgcacattaacatccaatttagccgaatgacgaccactttccataattaccggcgtgatcgttaattcagtatccaattgaatcagccgtaaataatgaagatcgacctgatcaatcgttgaggggcgctttagcttggtgagtaacaaacgttgacaggtattaacgactaactcactcagtacccccaacgagatcgtccccaattgattgatcatctgcggcgtgaccactagctgataaacaccgccaattgtctccttaagattgctgactacctgatcataaaatgtgtcgtgtagttgcaatggttcttgatgactgtccagtgtggccataacatcttggcgactgatgatgccgagtaaatgcattcgattatcgactaccgggatcaattcatagccatcatagaccatcatatggctaacactagctagactagttgtctcattgaccgttgccggagttgctgtcatcaccttatcaatcgttgtttgcccaccatgatccaatatatctttgctagtcaccacaccaaccaattgttgtcgctgggtgatcacaggaaaacgggaatgattcgtattgcgattcagtcgtttatagtcggcaaccgtttggcggctatatagatattgagtttgcgctaatggaatataaatatcggccacggtggcgattttatgcttgatggcctgatctgctaaagcacgattgatcaaactggcaactgtataagtatcaaaaggtgtcatcaatactggcaaagctttttggttggctaattcgataattgcaggactagcacccaaaccaccagtaattaaaacagccgcaccattttctaaggctagacgctggatctcctcacgattaccaacgatcaataatgaatctttagtaatataaggaaccatccgatcacccgtcattgcgccgatcaaaaatcgatgcaataccttattcaatccagcatcaccaccaagcaccacaccattaataatttgaatcaaggcatgataatttaaagtctccatttgcgctggcagcatttgatcgattcgcaccgtacctacgcgctcgatcgttgaaaccaaaccccgatcttctgctgttttgattgcctggtacgcggtgccttcactgatttctaagtcgtgtgctaacccgcgcacagatatccgctcaccaatttttagtgttttgatatattctacgccttgctcccgcttcgatgccataagctacctccactattcagcacttctacgcctataatcgaaaccaagtataccggttttcagtctaaattacaaagttacctttagttacacttttgggtctgaacgcgcaaatagcggcaaactgatttcttcaaatgctaaaggatccaacgtggtgatcgtgattcctaaaaggcgtatccctttacttaaactaccattttcatcccataattgttgcgcatagtaggcaattgccgtttcatccgcaatataatcgctcaatgttaaccgtttagtggtagtttcaaaatcacgattacgccattttaacacaattgttttaccatgtttctgtgttttcgctaagttattcgctacaccgcgtgccaatacgcgtaactcagtgttaacttgcgtatcggtacttaacggttgcccaaaagtagactcacggccaacggatttacgctgccgctgatattctactggtcgcaggtcaactccgtgaacgtgccggtaaagttgatcccccattttgccaaaacgttggatcaattcaaattcactaagttgttgcagatctgcacccgtatagatatcaagttcatgtagcttcggtaccgtcttcttaccaacgccatggaacttttcaatcggcaggtcacgaagaaatataagggcctgttctggcatgatcactgttgtcccagccggcttacgataatcagacgccattttcgctaaaaatttattgtaagaaataccagttgaactggttaagtgagtgacttgtttgatctcagtctgaattttccgcgccagcaatacggcgctggccaagtcagccttattagctgttacatctagataagcttcatccaaagccacatattcaatgacatcagtatattttttaaaaatttcgtggacctgtgccgaaacactacgatacaacgtgaaatctggctttttgaaaattgcctttgggcataactccaacgctttttgcgctgccatcgcggaatgcacaccgaactgtcgtgctgtatagttagcggtggtcacgacgcctttaccaccgttatcactgggatcccgggcaatgatcagcggtttaccgataaattctgggtgctcacgctcttcgattgaagcgtaaaaagcatccatatccacatgaattatttttcgggataaatcattggtcaatggaatttgtaaaatacctaaatttgccactacgcctaccctcccacttagtgataatcgaatcgttgtttacaattaattatattgtaacctaaatcacgatttcaagactagcaaagctagccacagataacaaaaaagccagagctttcactctagctttttttattcttaaattggatgatcattaaaaacaattgattattgtacttacatttatctatatacgtgtggtgctagtttgtaacatttaaaaatttaacaaaaaagtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 638 - DNA, 55826 bp, Unknown
  Metagenome-assembled genome
tattgtatccacagctgggacagcgcctgagtgtgtaggtaagctctgcctggatgaccaaatactttttgcgacccgagccccgaccatgaaattcctcacgagtaccgaacacctgaatgtttgtatctgtaattcccagtaatttaagtgtattatctagttgagacatctattcctaccccgcttatcttgagtttcgtcgcttaaagcatagcactagggaggcttagatgcctttttttgatactggttaaaggcttgatgagatttacttaagattaaataataaatgtaacagattacttgctatgtgaggtggaacgcgttactttaaaggcgtagagcaaacgttttattaatttattataaggagggtttatcatgttcaccagcacgaaaccaattaatgattatgaattgttgcagcagttcaagggctttttaactgatcacaaagcgcagatcaaagattaccctgatttggaaacctatgtggctaatgcacatgcaggcttttacttcacaccactgcaaacggacaaaatcccggcacgttacaatcgggtaattagacagctgacctctagtgattatcagcaattagctaaaatgttacagttatagtttcatgccattattttggagcttaggacaatacctaggctctttttttatttaattgccgcggttactagcttattcttgtatgcgcttgcgattattaggtgtttttaaggaactagtgctcaacttattgtataatgaaatcatactttttattggaggcatgaaaatgaacgtacataaagcagtgattcctgccgcagggttagggacgcggtttttaccggcaactaaagcaatggctaaagaaatgttgccaatcgtcgataaaccaacgattcaattcatcgtggaggaagcacaagcctctgggatcgatgatattttaattattactggtaaaggtaagcgaccaatcgaggatcatttcgattccgtgcccgaactggaacaaaacttgatcaaaaaacaaaaagatgaaatgttgaaagttgttcaagaaacaaccaacatgaaagttaatctgtttttcattcgccaatcacatcccaatggattaggcgacgccgttcgtttggccaagtcatttattgccaatgaaccatttgtcgttatgcttggcgatgatttgatggaggataaagtaccgttgaccaagcaattgatcaatgattacgaaaagactcatgcgtcaacgttagcagttaagcgagttcctcacgatgaggtttctaagtacggtgtgatcgatccagaagccgaagagtttcctgggttgtacaatgtgcgccaatttgtcgaaaaaccagctgccgataaagcacctagtgacttggcaatcattggtcgttatctgctaaccccagagatcttcgatattttggaaaatcaaaaacctggtgctggtggggagattcagctgactgacgcaatcgacgaattaaataaaattcagcgggtgtttgcccatgaatttaagggtaatcgttatgacgttggtaataaatttggttatgtgcggactaatattgaatttggtttacgccatctagaagtgaaggatcagttgaaagactatattattgagctttcaaaaaaattagaagctgagaaaaaagcagctaaaaaatagtattaaaaaacagtgaggctttattcctattttggaataagcgtcactgtttttgtctgcttatgaaattgcgtcgcgcatgtaagtggctagttctgtacctgttttaccgctagacaaggcgactaataatttgattcgtgctttttgaccgtttaaaccctggcaaaagatcaagcccattttggctagttgctggccaccaccttcgtacccgtaaacgggttcggccacgccattaaagcagcgtgaaaccaaaacgattggaatatgccgtgccaataacttttcgattgcgggtaaagtttgtggtggcaagttaccagcaccagtaccttcaatcactaggccgttagtttcagggcgatctagggctgcaaataaagtgccatccatcccggcgtaggctttcaataaatagacttgatcgatcacatggtcgattttacacagtgattgattggtgagttcttgaaagaatttagcaccatctttttccataataccgatcggcccaaaagttggtgtacggaaagttgctacattagtcgtatgggttttagtgacgaaacgcgcactatggacttcatcattcattaccactagaacgcctttaccacgtgcaccaggcgatgcagctgtttttaaagcgctggttaaattatataggccgtcggaaccaatttcatcagatgagcgcatggcgccagtgatgacaactggaatcagcggtggtaaagttagatcaagaaaataggcagtttcttccagcgtgtcggtaccatgggtgataacgacaccgtcgataccatctttttcagcagctacgatacgatctttgagttgcagcatttctgttggggtcatatgtggcgagggtagattaaaggcttcttccacagttagattgtatttaccttgaaacaagttattataggccattaatgggttggctgcaccaggtgtaagtgcgccactttcattttcggccatggcgatcgtaccgccagtatgtaaaattaaaatacgttgcattgctcatcgactcctattccacgattaaggtcgtttcttctataaataaataataagcattattggcagaggttcaactatgctaaataaaaaaagaacatcttcgggcggaagatgttctggggagagtcacttcttcgggggaagaagtgtcgaaaaatgaaaaaggtttggtttgttttggttacatgattaatataaccgatagaaatgaaaaatgcccgtgaatacactcagaaaatgattaattttcgctcattttattattgccagtaatttttacgtcaagtatggttaaaaaccatatccgccattacaggtaagttttggtataatgaattgttagaagtacaaagagctggcgagctgaaaccagtattgatttgtgctaagatgaggaaattaaaatggttgttatgaactaaaataacggcgttagcgaaaacgtatttgaaaaggaagttcgagatgttagttttagcaattgatacatcaaatcaagcattgacggtagcattggcaactgaacaacaattgttgggcgaagtgacactgaatgtgaagcaaacgcacagtgatgggttaatgccagcgctggaatatttatttaccgcgacaaaaaagcagcccaaggatatcgagcgggtagtcgtagcgcaaggaccaggatcgtacactgggattcggattgctgtaaccaccgcgaaaacgttagcgtggacattgaataagcagttagttggtatctcgagtttggcggtgctagccagcaatttaccagccagcgatcagttgatcgtgccgctatttgatgcacggcggcaggccgtttttactggtgcttaccagtggcagaatggacgattagtcagtgtgctggcggatcgtcacgttgctttagctgagtggttgcctgaattagtagcaacgaagcagccgctactctttgttggtgataccgctgctttcagtgagcagcttagccaagtaggcacgatcgctacggctaattttgcgttaccccatgctggtcagctagctcagttagggacgcaggcaaccccagttgaggatattcatggttttgttccaacttatttacgtatgactgaagccgaggccaactggttgaagcaacatcccgacaatgaaggacatgagccctatgtggaagaaatttagacaatggtataacaatgagacgatgacaccaccactaagttttactgcccaggaaattagcctagggggtaagccgtttacactgcgtcgcgccaccgaagctgatctggacgaattgttggaagttgaacgtcactgttatgcaggtacaacgccgtgggaccgcacatcgtttacgaacgaattgcgtaaggtcaatgatacgttatatttggtattgattacgcacgatacgattattgcgttcattggttgttggtttacgacccacgaatcgcatatcaccaatttagctgttgagcccgattatcaaaatgctggtattggccgctttttgatgacgtggatgattcggcaaagtcaagaactaccttcagccaagctgactttggaggttcgtgttagtaatgaaccagccaagcatctgtaccgcaaactaggttttcaggatggtaatatcaaaaaagcctattacgtggccgataatgaggacgcactgaacatgctattgccgctgcgcacaacgccatgatcgactattattggcctgataaggaagaactcgcccagcgtgcagtaaggttaggcacttggtgctaccaagtaagtgcggccagctatcccaatggcgcgccttggcatgaagggacgtttcgcgctaatttaactgcaccgcaccagtattatttatttgcggttgttgctggtcagctgtgcggctttattagttatacggccatttttgatgaggttgagatcaccaacgtggtcgtagcgccccaataccagcgtcagcacgttgcttggcagttatggcaaattttattgcaggcgcaaacacagccggttcatttttatcttgaagtgcgtgtcagtaatttaccggcacaaaaattatataaaaaacttggctttgcggtgatcaatcgccggcgtgcttattacgcgactccggtggaggacgccttgatcatggcattagaatggaaggaatcgaataatgatggagaacaagtcgcagcaacgcgagttaattttagcttttgaatcaagttgtgatgaaaccagtgtggcagtagtcgaaaatggggacacgatcctatctaatgtgatcgcctcgcagatcaatagtcaaaaacgttttggtggcgtggttcctgaagtcgctagtcgacatcatgtggagcaggtcactttgtgtgccgaagaagcaatgactcaagcaggtgtgacttatgccgatttaacagcggtggcggtgacttatggtcctggtttagttggtgcactattgattggtgtttcggcggctaaagcagtcgcctttgcccatcaattaccgttggtaccagtcaatcacatggctggtcacatctacgccgcacgtttagttaagccattaacttatccgttgctagcgctgctagtttctggtgggcacacggagattgtttatatgcgcgcagcaggggaatttgagattattggtgacacgcgggatgatgctgcaggtgaagcttttgataaagttggtcgcgtactaaatctcacttatccagccggtaaaaagattgatgagctggctaagcaaggtcaagatacatttgatttcccccgggcaatgatcaaagaagctaattacgattttagctttagcgggttgaagagtgcgtttattaatactgtgcacaatgctgaacaacgtggcgaggagctttcacgcgcagatctagctgctagttttcaagctagtgtgatcgatgtgatcgtgactaaaacaatgcgagcagttcatgaatatggtgttaagcagttggtcatggctggcggtgtggcggccaatagtgggttgcgggctcgtttccagcaagaaattgccgcgcaaacgccggatgtagatttcgtagtgccaccgctacgtttatgcgccgataacggcgcgatgatcggtgctgcggcgcatgttttctaccagcaagggattcgtgcggatggtcatttaaacgccaagccaggtctgtcctttgattatatgacgcccgcacgacaggcggaattagttaaatagcatgcaaaaaaagattgccacaacggcaatcttttttattctgcatgtaattcctccagcgccaagctttgttgttcccactgatcctcaactgtttgttgttgctggtgaatggcttccagttgttgctgcaagtcgtttagtttggcagggtcttgtaaagtatcgggttgggtcatcgccaattgtaattgttgatcttgctggtccaactcttctaattgttgctctaatgcggtaacttcacgttgtaatttgcgttcttgtttttgttgttccttatttaactgatattgttgttgatcagtgcttggtgccgcactggtagcagtaacggtttctggtgctttttcggcagcaatcgcagcagcctcagcttttttatccaaataatagtcataattacctaagtaagtttcagtaccttggcgcgacaattcaacggtcaaggtggctagattattcatgaaataacgatcatgggaaacgaaaaggatcgtgccatcgtaatttcgtaatgcttcctccaaaacttctttactatcaatatccaaatggttagtcggctcatctaagatcaaaaagttattatgattcatggctagtttaaccagcattaactgtgcgcgttcaccaccggaaaggctggccactgatttttcaacgtcgctaccggtgaataaaaagctaccgagaatgcggcgaatgtcggcttctggcatcattgggtgttcatcccaaatttcgcctaaaacagttttctgattgtgtaaattctcttgctcctgatcataataaccaacgtccacaccagtgccaaattgggctgcaccgcgtaaaaagctaatctggcctagaatgcttttaagcagcgtcgatttaccgaccccgtttggtccagtgatggcgatggcttggtgacgtttcacttgtaagttgattgggtcagccaaaatggtatcgccgtaaccgacagcggcattagttaccgttaaaacctcattgccagaaggcttgtctgcggtaaaactaaagcgaaccgttttatcatcattttgtggtcgttccagtcgctgaattttttctagttgtttccggcgactctgcgcacgcttagtggtggaagcacggacaatatttttgtcgacgaaatcctgtaatttagcgatctccgcctgttgtttttcgtacgctttccattcctgggctaaattagcagccttttgttcacgataacgggtgtagttaccacgataatgtcgtgtggtatgttggctaagatcatacacttcagtggcaactttatcgagaaaatactgatcatgggaaacaatcagtagggcaccggcatagccttgtagatatccttcgagccaagtcaatgtatcaatatccaaatggttggtcggttcatctaagatcagtaaatcatgtttttccagtaaaagtttggctaaagctaagcgtgatttctgtccaccggaaagatcactgacctgatgttcataatagtcagcgtcgaagccgaagccatgcaaaacgttgcggatttccgcttcataaccataaccattacgttcggtaaaggtatgctgcagttgttcatagcgtttaagcgcttgttgataagcctcatcatcagccaataattgtttgtcgccgagttgagcttctaattgatgcatttgctgttccatttcacgtaagtcggcgaaaacggtcaacatttccgcaaaaatcgtgtgctccgagtccagaccagtatcttgtgataaatatccgatactaacgcctttactggtaattacttggccttcatcaggtggattttggccgatcaaaatttttaataaggttgatttgccgataccgttacgcccgactaaagcaacgcgtgcgttactttgaacttctaattgtacattttcaaacaaaacttctgcaccgaagcgccgggcaacgttttgtgcttgtaataatatcacgaggttcgcttctttctgaatgaattattcgcttatttaaatggtagaacaataactgtaaattgactattccttggttaaatcactacaattattaatgacactttacgcaaatatttatttagcggtcattgagcaatttttagatactctttagtctaccatatcttgttagtttcaggactgcatgcgcaaaatatgttgtgagcaatcaattgcttttcacaagtaaatacagtatgataacaagtgttattaagaaattaattcacaagtagaaaaaaacatagtttggagttgagcgaatggccgaagcaaaaatacctaaggcaacagcaaaacggttgccaatttattatcgttacttaaatatcttatttaatgccggtaagcagcgcgtttcttccacagagctttctgaagcagttcaagttgactcggcgacgattcgtcgtgatttttcatattttggtgcactaggcaaacgtggctatggttacgatgttgaaagtttgttaaactttttcaaaaagacgttgaatcaggatcgtttgactaacgttgctttgatcggtgttggtaatttaggtcatgccttgttgaactataatttccgtcagaccaatagtgtgcgtatcagtgccgcttttgatattaatgaagagatcgccaatacgattcaaagtggggtacctgtctacccaatggctgagatgaaggaacaactgcagattcagcaaatcgatgtcgctattctaacagtaccgattgaggacgcacaaaaagtggcggacgaattagtaacggccggcgttaaaggtattatgaactttaccccgatccgcatttcggtccctacgacggtgcgtgtacaaaatgttgatttagctaatgaattacaaacattgatttatttcttagatcattatggtagtgaaaatgctgataattcaacgactgattaagcgcgcgataggccatttggctatcacgtgcttttttatacttcattgcggcgcggagataaaaagtatgataggatagagatgaatgggtttacagtcatctatctggagggatttagatgctatatttaaaacatgggctgcaaggttggctacttagtggtagtattctgctaggattaggcttatggggcacacaaacgaatgcagcaataacaccagcagtggtgccgacagcacctgattgtgccgaagttgtttctgaaccgcagcaatcgttaatggcagattcggtggcaccggtgactaatgcggtagcgccagcaacggataccgcagtaccggaagctaaagcagctactggtgcattggataatgcaactttgccagtgacaccagcaacaactaccgggtcggttaatgaatctacggtagttccgcaaccagaagagtcagcgactacttctacagctagcagtgcggcacctgcagctgtgcaatccgctgcggatactaaaaatgagaccgcaacttcaactacagcatcaccggagagtaaaagctcatcggtggcacaaagtacagcatcaatggcaacaaccagcgaagaagcagctaaaagtagtgcacctgtagctgcacaatcagcagcaaattctgatactaagaaaacagtggcagataaaaagacggggcaagctgatttattcgccgatttagaatccgctgaatcagtttcagggaagccgactgcaactgccgctgcacaggaaaataaaaaggatactccatttaaggttgttcaagatgtaacggcaaaacagagtagtaaagctaaattagccgtaacgacaccaactgaatccacaactgcggcacaagtaactaggatgattgaagtggcacagaaggctaaacaaaagcaaacaacttctattttagctgctttacttccagcaactggcgaacacattaactttttattgagtctggctggaattgggttgatcagtagcgcaattatcttgttaaaacgtaattgggcacattaattgcataaaaaatcaaatttataattgacagctagctgttttttcggtaaactattattcgttgatgagatttcacatcattgggtaatagcgaaatggtaacgcaacggactctgaatccgtaatttctaggttcgatccctagttacccaatcagagggttacaaaggttgttgttagtacttaaaagtgctgacaacaactttttttattttttaagaaaagtatttaagatcagctatttgcagtttttatacaggtgcggattttttacgcaagcaccgagcgttgccgataaagcaactttgatgcagtactgatttgtcattattatgctgaaatcattgaggatttactgatagttagtaaagctagctaggtgaaaatcatggcaaaaaatttatgctattaaaaaagtgtcgctgaaccattattggtccagacggcacttttttaatggacatacttagctaaaaattgttttaaatgttgttgataagctttaggttgcttgctaaatgatttaacatgagcagcgcctggtactaaccacatctctttaggtgagttggcggccttgtaaagtttctttgtcatatagtggggcacaaaggtgtctgcggtcccggtgacaaaatagatcggtttgtgatttttgtggacttgcttaaccgcactagcttcaccgaaactatagccagcccgaatacgggtgactagactagtaattggcactagcgggtatttcggtaaattgtattgttgtttagcttcataagtaatttcgtcttcaactgatgtataaggactatcaactgcgtaagctttgatctgtggaatttggtgctcgccactggccatgaccattccggcggcgcccatactaatgccaaacatgacgatttcactattttggccatttttagcaacgacttggcgcgcccattgtaaataatcgcggcgatcaagccaaccaaagccgatcacgttaccttgactgtcaccgtgaccgcgattgtccggtagcaaaacgttgtagcctagtttatgaaataatgccgcataagcacccatttcttccttgcggctcataaagccgtgggcgatcactgctgttttatttgtcttcttagccgctgggatataatcggcatccaatttaagcccatcagcagtagtttcgtaccaatggctcttcttggtatcaatgaaccactttttttgctgatacagtggatcgctggttttcagtgtcggtgtgctgccgagaaaagccttatgtccgggaaccacggcaacgtgataaaagtacatccccgcgccaaacaaaccaatgatcacgaccccaattatggcggataatgttatccagatttttttcaaaatcgtcacttcctgttcaatctttttggcgtatgaaataagatacgctagctaattttggggtttaacttatatataatagccttagtggtagggtggtgacaagtttttgtgaaaaaggattgtcctttaagctattctgccctacaatatagggtatgcatttttgcaactaacgagggggccaatcatggtgataataacagcagggatgatcggtgtcggcaagaccacgctgaccggaatgattgcggaacatttaggcacacaagcattttttgagccagtcggcgataatcctgttttaccactttattattctgatccaaaaaaatacggatttttactacagattttctttttgaataaacggtttgcgatgatcaaaaaagcgttgactgacgataacaacgttttagatcgttcaatttacgaagatgcgttgtttacacgagaaaataacaaggaaggcaacattagtgaccaagaatttgagatctaccttaaattattggacaatatgatggctgaattacggagtattcctaagaaggcacctgatttgttagtgtacgcctacgctgattttgaaacgattttgtatcgaatcaaaaagcggggccgtgattatgaacaggttgaaaacgaccaaggtctttatgattactactttaagatctggagtgcctataaggaatggtttgaagcttacgacgaaggccctaaaatgcgcgttgatctgcaacagtttgacttagccaaaccagataatgcgcaaaaagtgttacagatgatcgacgataaattggccactgttcggcaaacaacttccttaactaaatgatctgcagaaatttttttaaattaattgcgtgattagtttgctattaacagggggatatgctactatacttatagtacttctttgttcggaatattttggtttcaagtttcatcgtaaacttcttccaatgtacgcctttcacaagatttaccaaattatacaggtcgattgacctacaggaggatttttacacatggaatcaggtacagttaaatggtttaacgcagacaaaggttatggcttcattactcgcgacaatggcagcgatgtattcgtacatttctcagctatccaaggcgaaggttacaagtctttagaagaaggccaacatgtaacatttgacgttgaagacagcgatcgtggcccacaagcgactaacgttgttaaagactagttactagtctgatgaacagtctcgagtaatcggggctgtttttttgtaccttgaatatcattttggcttagggcttgagtttctgttggcttctttgttaaaatcaacatagtaagttgccatgatgcggaaggggttcaacaaacatgaaaaaacttttcggtgttttattagtcggggtcactgcagtcaccttggcggggtgcaataatggtggttccacggactcgtccagtgaatcaagccagcaaacgagtcaggttagcaagaaagctagcagcaagaaagcgcaaagctcaagtacagcctccaattcagctagcagtagaaaaaccagcagtgctgatggtaatacagctggtacgtcttctacagcgattgctagttcttccagcgctaatgctggaagttcaacaagctcggtagccagcagtcaagctgctggtcaaagtcaggcacaaacggctacgacagtcaatggactgaacttaacaactgcgcaagtacaggattgggtcgcacaacatgttagtggtaactatcaatcagatgatttagggtatgaaatgagcaaggatgctaatggtgaattagtgatccaagtacgcgaaaatcataatagtgctaatatgcaagcacagggggctgacgctgggaccgcaccgacaattggctggttcaagatcaatagtcaaggccagttacttagctcacctgatgctggtgcttcgtggagtgttgtgagtaacagttacaataattaagtgtataaaaatagggatgcggcaattatgccgtgtccctatttgtttaagctgtttttttgttttttgcttgttgatcgcgcaaacgctgctctctactgaattgaatcataaaggcagtcaaattacgactgattgcttgatcagaaagccgccgaaacggcaattcaggttgcttttgtttttccatattaacgcctacctactatattgacaaaactaacgacgtttttcattgggttgaaaaacgcttaaatgattcgcttaaactggaaccgcaacattgttcgcagctaagtacgagctcagttaaatactgagaaaaagtgacttgcccacaaaaaactgaggacgcctacatcttagctttctcagctgagtcacatttttattattcatgcagaccactgcacaaactcaccactatttactatacaccatttatgcgaaagttactaatacttgaatttacccattttaccttgttcggcgggcaaaagttatgtctttgccggtcattaatcgttttggtaccagtcaactggatcaaactcatttagatgtatcctaaataaacgtcccttgacagcacgtttgaaaaacttatcgaactaacacttaaatcgccaagcacaactgcctagggtcatgccgttgctcgatacatttgaagtgcctcataccactgacatcgaatttcaggatcgccgctaagccacgaatatagcgataaaacttaaaccttaccgcttgccgtaaacactgtgctttgcggtataagatttcattaaatgatagcccggcttcgatcttgatcgcgtgatgacctaataaatacgtgatcaatcggtgaatcagctgcagtgaatttagcgaaagtgtgcggattttttccaagtgatattcctgcttctgtacccggaatagttcttcgatccgccagcgggtaagatagcttttgacgatccggagcacgtctgctttactcgtaattaccttattggtcaggagtctcattggcttttcaccatatccataaacgaccaccataaaaaacgctcgacctttaaacgcgggtaaagtcactttgatatgactgatctttaaatgatagtctttgcctttgatctgactatcaaaggcgatcttgcccttgcgtcgctgcgccaattcagggactttataagccttatcctggtagtggacccagcgtttgtcggttaagcgcataatgaaatcagtttgcttttgcatcaaaaaggtaatgatatcattcgcatcataaccgcgatccatcacgacggtatattttttatcaccaaagagttgatcaacgcgatttaagccgcgataggtttcaatgttagtactgataaagtcagtttcctcagctgaaaataaatgcgagtatagcggtagtggctgctttgtttttgatgttgcgaccgtaatattggttgtgaggtagcctttttcggtgacaccttttgaaccgtcgtgtacccggcctaaagcttcaaatttctcaccataaggcttggtaatatcagaattatcaacgatgactagcatatcgtccttaagctgcggttgtaccgcggccaaataattttgatccaacttggcataatcatgaaaattcgtggcgttgcggctcaaacgtttgagcgtacccaaaagcgtaatatcctcattcaacgcacggctgatttccgctagtaatggtgaacgtcctttcgctagtccataaagcatgtccataacgaaattagtcgtaggtttagacatgccgagcgtgagctttttggcataattaataatttctcgttttgcttgatatatttccgttgatttaatgttaaaataaccttggtcctttcttttgttagctttgttctcgttattttgggtaaactcaaaactaatataatcccggttaagtgattagcgtggacaatcgggagcaagtgtccgagtacgatcattgcttttttatattaagaatctataatgtagttgaaatgtagttgaatggttgatcaaggattttttagctaccataactgcttatttcagtaacttttacaaggaggtcagcaacatgaataataaacttgtttgtctaggcgctacggtcggtttgatcacggctagcgttttgtaccttgctaaaaagactggtttttttgaggatgatcgtcatttgtacgatgaatttgaatcacgttaagatgtactggaaaatctttagctaatattactgacgaattttggtagtacagcgtgtaatgcgttgagctagttaatgatcggaggaattagtatgcggaaaaataaagctatcatgatcggtgccggtttagccaatatggctgctgcggtttatttgattcaagaaggtcactggagtggtgatcagattactttttattcactggatgatcatggttcaaatgatggcgcgccaacaaagagcgtaaccgatgaatattggaataaaaatcatcccttagaaaatcagaaaggctatgttgctcgtggcggacggatgctgaattatcggacttatgttgatttgatggatctacttgatcggattccatcggcgacggaaactaatatgactgcggctgaagatacgcgtgattttgatgctaaacaccggacctttgacaaggcacggctgcttgaaggtggtaagggtatcattaatggcagtcatttaggcttaaataatcaggatcggctgcatctaactaagttgattgcgatgccagattcggaagaagaaaagctggataacgtcacgattgctgattattttagtgatgatccccatttcttcggcacaaatttctggtttatgtgggaaacgacctttgcttttcgtgtacaaagttctgctcaagaattacggcgctatatgcaccaaatgatttacgaatttactcagatcgagcatctagtcggtgtcaaccggacgagatataatcagtatgaaagcattatgctcccactggttaattatttacgtgatcagggttgtcacattatcttgaatcgtctggtaactgattggacgtttaaagatacgccgatgcaagatgagatcacagttactggtttgacagttaagaatacagtcaccggtgtcgacgaacacgtcacggtcgatgacgatactgcggtgatttttactaacggttcaatcactgattcagccactttaggtgactttaatacaccggcgccagaaaatatggattatggtgcagcagctagtctatggaaaaaagcaagtgagcatttctataatttaggtaatccggataaattttttgctgatcggaatgccagtgagtgggtcagtttcactttaacgactaaagatcatttattattaaatgaaattactcggatcacgactcaagtgccaggaaatgcactgaattcgtttatctcgactagcccgattacaacgttagggcataaagatgtgaatatgtcgatcgtggttcatcaccagccccatttcacaacacaaaaaccaaatgagacagttatttggggttacttcttatatccacggcggcgtggcgagtttgttgataagccatacatcaaaatgacgggtaaagaaatgatccaggagttgattggccaattgtctaaagtagatccaggtcccggcaatattcgcgacaaaacggatcagatcatggctagcgtgatcaataatattccggtttatatgccttatgcctctgcattattcaataatcgggctaaaactgatcggccaaaggttattccacaacatgccactaatttggcctttactggtgaatttgttgagcaaccttatcagatgatcttcactgaacaaagtgcggttcgttctggtgaaattgcggcgtatcatttcgctggtattccaatgtcgcatttagttaagacaccgcgttatgataaagatttgaagacgttagctaaagcggctaagaaaatgtttgattagtgtagtttgtttaaatgagcattaaaaagaagataaacgatgattgtttatcttcttttttgctgtctaatcagcttgaactgcaaaagtgatagggtggtatggattgggtcgttataaaaaaagcttgaccagcaccttaagtttctgtagaataatatatgttccaaatgttgaccttgcccgttggtcaaattggttaagacgtcgccctctcaaggcggagttacgggttcgatccccgtacgggtgataaaataatttttctaagccgaaaagactgtcagatcagtcttttcggctttttttatgtctgcaagttaataaaaggctaatcagcgcagcataactaaaatggtaggctaatttttagctttctcaagtttggcggtaatggacagagcgggttatctgccattttagtaaagtggtgattacagtaaaacgctgataaaagcagtagataaaaccacttttatcagcgtttaaagttgtagtttacatttactacatagcgtttagaccagtgaataactattacggcagaatggtaccgactaaggctgttcatatataatttgatggctaaactttgtgggtagctatataactcagtttaaatcgacttaaatttgagtacaatgctaaacgagtgctgctaaggtgttatttaaaatatgcagcgtgatcgacgcctttaaattcttggtgcgactataaactagtgccaaaaccaagccgagtaagatttttgacaaccaataaattggatcgacttgaccgctggagagatcaacgtgaaaggtaccgaagatcactgagcttaagccaatgcttagccaacgacggtgtgggaaaaaccaatttagaaaaagaccacgaaaaagaatttcctcaagaatcgggccaatgaaagcaacgaacaataacatgaagaaagtgaagctttgtagcaagctagttaaactatctacgttggcgttaccacttgttttaacgaatggaatggtagcagcgttgattagtaacatggcaatgaacccggcagcaactaaaagccaatcacgtttatgtagtcgttgttcaaattcattgttattgtcagtcaccgctttacgatagacttgccaaaataaaatcgtgatcaaaatggaaatgatcaggaataaactgcctaatacataagttaattgggtttgctgtgtgccggctattgcgctggcgaagcttaaaccagttaatggtaattgttcggccaatagaagtaagcagaaatagcctacgtggcggacggtcgcccagccagaattatttgttttgataatcgtcacctcacgaatttaagtaacctcatgatagcacgaaatttgtttttagacgtgtgaaacgtctggcttgcttttcaatttaaaaatctctataatgacacactgtcatataagcgacaaagtgtcataaatttaaattgattaatggggaaaggaggaagcagatgccaacacgcactttttttaatttatcccaggaaaaacaacaacggctgctagaggcggcacgcttagaattttcgcgggtgcctttacatgaagcgtcgatcagtaaaattattgctagtgcggacattcctcgcggcagtttctaccagtactttactgataaagaagacctttattactattacgctgattatttacgcaagcaagggcaaaattcactattaagcaatttacaggcggtcgacggtgatttatttgctgcatttcgccattactttactaaattagttgatgaaatcattaatggacctaatgcggttttctacaaaaatatgtttttgaacatgacttataaaaatggtcgtaaagtgacctcagcaacacaaaagatgcacccacaccatggacatgatgatttttatgcggccgttgatttttcggttttaaaaatttcaacaccgcatgagttaggtacattgatgcatattttaatggcgacgttatttcaaacgttgggggcctattatttacggcaacaacatggtgagcagatcacggtggcacaattaaatcaagaatttgaacaagccttaggctggatcgaacatggtgtggcgatcaattgatcgttttgaatcaatcaagtattttaatgtaactttttattttaattaaggaagtgagtagatgcttaaaatagcacgtggacgaatgtcaatttgggccgtcactggcgcttttttatttatgatcttacaagtgatcagcagcttaaatctaccaagtttgacggctaatatcgtcaataatggtgtcgctaaaggcgatatcaattatatttggcgcgtgggtgctgaaatggtcgggtttgcgcttttgagcgtgttggccgctgtgggtaatgtttttttggcagcacggacttcacagcatttaggccaacaactccgttcggacatttatcgtaaggtcattggtttttctaacgatgagtttgatcaggtggagacctcgtcactgatcacccggacgaccaatgatgtggtacagattcaaaacgtggccatgatggcattacggatgatgatcatggcgccaatcatgttgatcggtgccagtgttctggcatacaacaaaaaccagcgattgacgatgatctttttaattgttttaccggtactagctatttttattggcttagtgatgcggtttgccgtaccgttattccgcgcaatgcagtctaaaaccgatcgaatcaatttgatttttcgtgaaggtttaactggggtccgggttattcgggcgttccggcgtgataaatttgagcaaactcgttttgaagcggccaatcaggattacacacataatgcaatcaaagtttttagtatcatggcgttgatgtttccaattatgactttgatgatgagtgcgactaatgttggaatcacttggtttggggctaaattgatcgctgatttctcgatgccagtcggtaatctgatcgcctttttgacctatgccatgcagatcttaatgagttttatgatgttatcaatggtttttgttttcattccgcgagcgcaggcttcagcattacggattcaagaagttttagcgcttgattcaacgatcaatgataagcctgaaccgaaggcattaccggccgattttgatcatagtgaattgaactttcagcatgttgattatcgttatcggggtgcggaaaatcgcgccctgacggatattgatttcagcgctaaaagtggccaaacagtagcgattattggtgggactggctccggtaaaacatcgttagtcagcttactaccgcgcttttatgatgtggaggctggtagtatcagtttcaatggcacggatatccgtgattttacgcaacatgatttgcgacaagctatttcttttgttccgcaaacggcgattctatttacggggactgtacgtgagaacatgcaatatggtgatccgaatgcgactgatgaagccatttggcgtgcgttgaagattgcccgcgccgatgattttattgcggctgacgctggtttagatacccacgttgaacaaggtggcggtaatttttctggtggtcaacggcaacggttagcgattgcccgggctttagtcaaagacgccgcggtgtatgtgtttgatgattctttctcagcattagattttaaaactgattctcagttgcgcgctgaattaagggctgatagtcggatccaaaatcgaatcgtgatcattgttgcgcagcggattgcgacggtagctgatgctgatctaattctagttttagataatggtaaattagttggtaaagggactcatgaagcgttaaaagcacacaatgccgtttaccaagaaatcatggcttcccagttaaaggaaggagaggaggcgcaacatgagtaaagaaacaccaacacggccaccaatgggccatggtcccggcaatcatgccggcctagttgaaaaaccacagcactttttgcggacaaccgatcgtttgttgcgctacatgtccaatcgtttatttgcggtggcagtggttttaattttggcgatcacgtcagttattttccaaattcggacgccgaaaattctcggtgaggcaacgacggaaatttataaaggtatcatgaagggcgcagcaatgaaaaaagccggtgaaacggtggctaagttgccgatcgattttgataagatcaagcagatcatcattattgttgtcttaatgtatttagcctcagcgttgtttagctttttccagcaatttattatgacgcgggtctcgcaacaaacggtctatcagttgcgccgcgagtttaaggaaaaaatgaaacgggtaccgatcagttattatgatacacatagcaacggtgatattatgtcgcgagcagttaacgatatggataatatcgccagtaccttacagcaaagtttaacgcaggcagtgacgagtactgtgacttttgtcggcacgatctggatgatgctgacgatcagttggaagctgaccttgatcgcgttgatcactattccattaagcctagtgatcgttggcgtgattgcaccacggtcgcagcgttattttgcggggcaacagcgtagcttaggcttgttgaacaatcaggttgaagaaaattatagtggccatgtggttttaaaaagttttaacaaggaacaagccgcgatcgatacttttgaagaacaaaatcgtaactattatcagtcagcttggaaggcacaatttatttccgggatcattatgccgttaatgattttcatgaataatattggctacgtcttcgtggcaatcatcggtggggtgcaggtcactcacggtgcagttacgttaggtaatgtgcaggcctttttacaatacatgaatcagttttcccaaccaatttcacaattagctaacttaatgaatacgatccagtcaacgattgcttctgcggaacggatctttgcggtgttagacgaaccagaaatgagtcctgagccaactgctaagccagttgttcagccgaacgcaaactttattgattttgatcatgtacagtttggttacaacaaaggcgaattattgatgaatgactacaatttgagcgttaaaaaaggtcagcgcgtcgctattgttgggccaactggtgccggtaaaacgacgatcattaatttactggaacgcttctacgatgtcagcggtggcacaattcgtttggccggcgttgatactcgtgaattaagtcgtgaagacctacggcagcattttgctatggttttgcaggatacatggctgtttaccggtacgatctacgataatctgaaatacggtcgtgaagacgcaacggatgacgatatcatggcggcagctaaggcagcccacgttgatgaatttgttcgccgcttacctaacggctacaacaccattttgaatgaagcggcctctaatatttctcaagggcaacggcaattagttacgatcgcgcgagcttttgttgccgatcctgagattttgatccttgatgaagccactagttcggtcgatactcggactgaagttcatattcagcacgcgatggaacgcttattggctaaccgcaccagtttcgtggtggcccatcggttgtcaacgattcgtgatgccgataatatcatcgtaatgaatcatggtgacgtgatcgaaactgggactcatgaccaattaatggcccaaaaagggttctacgctgatttatacaatagtcaattttctggcaatattgtgtcgtaaatgcgttatagtaaaagcaaaggtgttcgctgcctttgctttttttattgggctacgtttcaatttagcgccttttaccataattgtgaaattggagttggtacgatgtatccacaaactgaacaaaaaattcaaactttagtcgctaatgggatcgttcctggtgttagttatggatttattcagcagcagcacacttggacgaattatttaggtgctagccagttgttgccggaaaaaaaggccttacaagccggccaattgtatgatctggcgtcattgactaaagtagtggcaacgacgactttaattttaaaattacaagaacaaggtcgactagccattactgatccagttcaaaaatatttaccagaatttggtgatgggcgagtaacgttacggcatttgttgacgcatacttcgggtatcaccggctatattccgaatcgtaaccaactggcagcaccggctttgactaaagcattacttggcttaagtgtcggcgcagattttgggcgcaaagtggtttatagcgatacagggctgatctatctaggttggatcatcgaacgcttgttacaggagccagtacaaacggcgttgacacgtgaagtgttgcaaccattacatttaaatacaatgacctttacgccggaaaaggcgcgctgtgtgcccgccagttatgaaccaacaggccgcggtttgatccagggcgttgttcatgaccccaaagcctttatcttaggcaaacattgtgcctcggctggtttattttctaatttagctgatctgttacaattttgccggttcatgttgggtgactctacggttaaccaaccaccgatcagttcagcaacgattgccgtattgtaccgtgattacaccggctttgatggcggtcgtagcttaggctggcaattgttgcatgcagcggacgggcatccggttatttatcatactggttttgttggtcattttatgttgatcgatgcgaccaagcataatgctgtcgtttttctgtctaaccgcatccatccaacggcaccaaataaaccttatcttgcattacgtgacgaaatcgttgccacttatctgcaggaagctaaatgaaacggtgattaaaacacacgaattagactcgacgtcactaactgaaaacggtaaaataattagcggagcatttgagaatattgaaggagtgattattttggcagaaccgtatttcttacagccttattttcaagaaaaaatttggggcggaactaaattacatgatgaatttggctataccttacctagtgaacgtacgggcgaatgttgggcgatttccgcgcatccccatggacctagtaccgtcgctaacggtccatatgctggtcaaaccttgatcgaagtttggcgcgatcatcgcgatgtttttggcgatgctaagggggatgttttccccttattgactaaaattctagatgctgaagctgacttatcggttcaggttcaccccgatgacgcttatgctgcggaacacgagcatgaactaggcaaaacggaatgttggtatatcattgccgctgatccgggggctgaattgatctatggccataatgccaaaagtgaagccgaattggccgatatgatccattcagaagactggcagggcttgttccgccatgtacccgttaaagccggcgatttcttttacgtccctagtggaactatccatgcactgggcaaagggattatagctctagaaacgcaacaaagtagcgatacgacttatcggttatatgactatgatcgagtagatgctaagactggcaaaaaacgtgaattgcatattcaacaatcaattgacacgaccacggtaccgtttgtggcgcctaagttagctatcactagtcaacagtttggtgattctaaagttaccactttcgttaaagcaccatacttcacagtttacgaatggcaagttaaaggtgaactagaattaacccgccaaagcgcgccgtatacattagtttccgttttagctgggcaaggtgagatcaccgttgatggccaaagttatccgttagctaaagggcaacactgtttattaccatttgcagtcaaaaaatggcaattgtccggtgacttacaaattatcgcttccgaaccgggtaagaaagcataaagaatggatttagcggctgaatttagtcgctatttttatatcattttaaaaaagcgctttcatttacagccaaacaagactaaaatataattgttcaagctaaaaatattttaggaggctattaaatgacaggacgtttaattggcaaagttgcgctggttaccggcggaacaaaaggaattggtttaagctttgcacagcgttttgtagaagaaggagcgaaagttgttattactgggcgccatgtggatcttggtgaagcagcgttagcaactattaacgcaccagatgcactgagctttatgcaacaggatacctcagatgatcaagagtggccacagattattaaggctgtccaggataagtttggtaagttggatattttagttaataatgccggtatttgttttttcaaagacattgagcatacaactgcagcagaatggcgtaaaatacagtcgatcaatttagatggggttttctttggcactaaatacgccttgatcgcgatgaaagatcatgggggttcgatcattaacatatcgtcgatcgaaggtttgattggcgaaccaatgttggctgcctataatgctagtaaagggggtgtacgactattttctaaatcagcggccttgtatgcagctaaagaaggttacaatgtgcgcatcaacacagtccatcccggttacattcacacgccgttggttgattgcgcaccggatgtggtgacccacgaagagcaattaacaccaatgggtcacttaggcgaacccgtagatattgcgaatatgtgcgtattcttagcttcagatgaatcaaaatttgccattggtgcagaatttgttgtcgatggtggttatacagctcaataattcattgttgtggtcaatggttaatgtggatcaaattatttcagtaaatgactgaatatacaacgaaacattaataatacgacttcattgaatgagcaaataaaataagcttgggtaactttttcaggttactcaagcttattttttaatgcttacggttagctgcggcaatgaaaccttgcgccgcaaatttttcgcgtaattgaaggactgcggtgtaggtggctaatacgtaaacttgttcagttggcaaagtcttaattttttccgcgacttcgcttagatccttgatctgttgtaatttatcttctgggacaccggcaacctgccaacgaaaggcaatatcagtgactcgctcgcccccagcaataaagctgggaatcgcttgagtcgccattttttcaaaattaccatcccagatccaactagtatcgataccgtcagcgtaattggcgttcagcaaagtgaccaacgaaaaaggttttttattcaataaaattaaatcaaatacttgatttaagcccaccggatttttgactaaaattaaagttacagccttatcgccaacttgaatcacttcttgacgaccaaaaactttttcgtcagcatcgagtgcttgcgcaatcgcagtaggttcaataccaaaataacgacctacactgtaagcagctaatgcgttatagatattatacgtgccaccaatattaagtttgattggctgaccatcgatcacaaaactagagctaaccggcgtttgctcagttaattcagtgactcggtgttgtagttcaggacgggcaaaaccacagttaggacagtagtatttacctagattactgtaaactaatgatttgtagtgcagaatatgattgcagactgggcacaaaacaccatcagtattgtattcagcttttaattcaccatcaggctggttatcaaagccgtaatagatgaacgggttgggcaatttacgtgaatggaaaattggtgcatcaccattggcgatgactgttgcctcaggtgcgttagccacaccatcaagaattttctgataggtggtatataattcgccataacgatccatttgatcacggaaaatgttagtgaaaacaaaggctgttggtttgatatatttggttacttcgatcacattagcctcatcaacttccaaaacagcgatctgcttaccagagcgcccacgcttgtgggttaagaaggcggtgatgataccttgcttcatgttggaaccagttgggttagtcaaaatatcactgtattttgcgtgtaatactttgacagttaaggctgtggtcaacgttttaccgttagtacctgtgatgatcacgacttcataatcacgacctaacgttgccagaatatctggatcaattcgattggtgattttacccggcaaagagctaccacctttcatgaaggtgtgtaaaaaccagtaagccgagcgaccagccgtcgcggcgaaagaactttttaatgacataatgagtctcctattccacaattaaggtgattttattagcctagtgcgctaataaaatttgctatttcaaagggtgcaactattttggtttgatccaattggcaataaactactgtttagtatggaaagtataagtcgcattaaataacaataactattttgacaacgaaaagtgtgcttgtcaaaagataacctgcgccgacaatgtttataaggcgagcataacataacttgatgatttaattcgctgcaatgattaaaaccaatcgttttctaactaaaaataggcagtacaaagattgcttttttacttgtcactaatttgcagatgaatttttcactaaaatcgattatactgaataagaatgtttatgaaaaggggtaagaacaaggatggcccagttgttttttcattatggcgcaatgaatagcggtaaaacaatcgatattttaaaggttgcccataattatgaggagcaaaataagtcggtgatcattatgacgtcaggtctagatgatcgcgatgagatcggctacgtttctagccggatcgggttacgccgccaagcgttgccgatttttgctgaaaccaatatttgcgatgttgtgaaacaagaaaatcccaatgcagcgtgtttattgatcgatgaagcacagttcttgcaaaagcatcatgtgattgaactggctaaaattgtcgatgagctgaatataccagtcatgacgtatggtctgaaaaatgattttcgcaatgaattatttgaaggctcaaagtatttattgttatacgccgataaaattgttgaaatcaaaacaatttgctggttctgcaataaaaaggctttgatgaacatgcgtgtcgctaatggtaagcctgtctatgaaggcgaacaaatcgaaattggtggcaatgaagcttactacccagtttgtcgtaagcattattttcatccaattttaagccaattaaaagcatgaatgtgttagtgtatttagctaataaaataaccttaattgtgaagtagagccatgtttcttgcggcaagtattttgccacaagaatggacatcgcccggaacatcagaatttattagcgtattctgctaataaatgaccttaattgtgaagtagaaaggaaactaatcatggacgaaatgtttgaacagttgcaagccgtggttgatcgtcatgaagaattggaaggcttactttccgatcctgaagtgatcagtgatacacagcgcttcatgaagctgtcgaaagaagaaggtgagatccgcgaaacaacggaaaagtataaccgttacaaggatgttgtcggccagatcgccgaaaatgacgcaatgttgcgtgaaaaacttgatccagaaatggacgcgatggtcaaacaagatctagctgaattaaatactgaaaaagaaaaattagagcatgaaatgactttactgatgctacctaaggatcctaatgatgataaaaatattatcatggagatccgtggcgcagctggtggtgatgaagccagtctttttgctggggacctacttaacatgtatatgcgttatgccgaaaagcaaggttggaaagtggagactgtcgatgaaacaccaaccgaagtcggtggctttaagagtgtggtcattatgatctcaggtgatagtgtttactccaagttgaagtttgaaaatggtgcgcatcgggtacagcgcgttccccagactgaatcacaagggcgcgtgcacacctcaacagcaactgttgcggtaatgccggaatatgatgcggttgatttggatattgacccgaaagatattcggaccgacgtttatcgttcgtctggtgccggtggtcagcatatcaataaaacttcctctgcagtacggatgacccatttgccaacagggatcgtcgttgccatgcaggatcagcgttcacagcaacaaaaccgtgaaaaagcgatgcaaattttgcgggcacgggtttatgactattatgaaagtcaaaatcaaagtgaatacgatgaaaaccggaaacaatcagttgggactggtgaccgctcagaacggatccgcacctataactatccacaaaatcgggtgacggatcaccggatcggattgactttaaataagttggatcggattatgaatggtgaattagaagagattattgatgcgttgatcttacatgatcaaacggctaaattggagcagctccaaaatggctgagccaacattttttgaggccttgcgttgggcctctatttttttagaacagcggcaacaagaagacgcaggtcgttttttgttattagaacgacaaaattggacaagtacacaattgctgctgcgctatcgggaaccgatgccagccgcaatttggcatcagtttcaagctgatgtgcaacgttttgctaaaaatgaacccgcacagtatattgttggtcacgcgccgttttacggacatgaatttaaggtcacaaccgcgactttgatcccacgctcagaaacagaagagttggttgaatgggcattaaatgaattgccagctacaccattgaaaatattggatctaggaactggcagtggtgcaatcgcagttagcttaaagttagcgcgcccccagtggcaagtttgggccagtgatatttcggcagcagcattagctgttgctgccgacaatgcgcatgacttgggtgcagccattaattttcggcaaagtgatgtttttactaatttagcggtcgaaaaatttgatgcgatcatcagcaatccgccttatattgcccctagtgagcgtgatgtgatggatgccagtgttttagcccatgagccagcaacggctttgtttgccgctgaagctggtttagcaatttatcggcgtattttgactgacttaccgcaacatttgacgaccaacggccagttttttggtgagtttggttatcaccagcgaccagcactggctaaaatggttgccgaattattaccagcgagtcaagtgaagttccggcgtgatctagctggtcatgagcggatgctccagattaaactatgaatgaaagaaggaagtacgttgcaaacaaaagtttttaaaccagatcaattggcggccgctgctgctgaattggctgctggtgaattggtggcttttcccacggaaacagtctacggtttaggtgccgatgcaacgaatgaaacggcagtaaaaaaagtttatcaggcaaagggaagacctagtgacaatccattgatcgttcacgtagctgatgtggcaacagtcaaaaaatatgtggctgattttcccacaacagctgaaaaactgacccaagccttttggccaggttcgttgacgatcatcttgccattgcaacctaatgctttctcgaaaacagttactggtggcttgaatacagcggcttttcgtaatccgcgtaatcaagtgaccttggatctgatcaagcaattagggcggccaattgttggaccgtcagctaatacttcaggaaaaccaagtccaacattggcagaacatgttttacatgatttggcgggtaaaattgctggtgttgttgatgatggtccaacgggtgtcggcttagaatcgactgtgatcgacttgagtacagcaactcccacaattttgcggcctggcgcagtgactaaagaagatattgaagcagtgatcggttcgatcgatgctgatcatcataaagtcaaagcagatgaagtccctaaggcaccgggaatgaaatataaacattacgcgccgaatgcgcaagtttatatgacagcggctacggacttcaaggcggcggccgcttgggcacgtgaacagggtgaaccattcggcttattggcaacggatcaggtgttagctgaattttctgctttagcaccagcttatcgtttttctttaggtgattcgatcgtaacagccagtcagcatttatttgatggcttacggcactacgatcaattacctgaggtcaagttgattttagcagaggaattcccagcccaaggcttaggtgttgcttacatgaatcggttagctaagtcagcaggtcaacagcgctttacgaaaagtgaacactaattataattagtattttctagacgtgtctagctaaatggttgttaagtaacaatcaaacgcttcaagacacgtctattttgatatggtataatcggcttattcggtgaggttaaggctggctcattgattacgcattaagcgtaaatatcagttttggaggatgatgcgcaatggattttcacgttgatgatcaggaagtttggcaggcaattcgacaagaggagcaacggcaagaacataatattgagttaattgcatcggaaaatattgtttctgatgcggtacgcgctgctcagggtagtgtcttaactaataaatatgcagaaggctatccaaaacatcgtttttatggtggctgtgaatatattgatgtgatcgagcaattggcgattgatcgtgccaaagaattattcggtgcagagtacgctaatgttcaaccgcactctggttctggggctaatatggcagcctattcggctttactcgaacccggtgatcgtgtgatcgggatgagtcttgctgaaggtggacatttgacgcacggtgcaccaatgagttttagtggtcaaacttatgacttcaaaagttatggggtagatgctaaaacgggtcggattgattttgatgcagtgcgtcaattagcccatgattttcaacctaaattgattgtcgctggtgcttcggcttatagccgtgagatcgactttaagcaattccgtgaaattgctgatgaggttgatgcgtacttaatggtggacatggcccacattgctggtttagtagcagcgggcctacaccaaagccctgtaccatatgctgacattgttactacgaccacccataaaactttacgtgggccacgtggcggccttatcttggcaaaagagcaatatgctaaggcaatcaactcagcagtctttcctggcatccaaggtggtccgttggagcatgtgattgctggtaaggcaattgctttgaaagaagctttacagccagagtttaaggcctatgcccagcagatcattgctaatgctcaagccatggccgaggtttttgctgcggatgagcgcataaaaattatttccggtggcacagataatcatttaatgttattggacgtcacaaaatttggtttaacaggtcgcgatgttcaggatctgctggatacagtcagcattactgtcaataaaaatacgatccctaacgaacaaaatggcccattccggactagtgggattcgggtggggacaccggcgatcacaactcgtggtatgaaagaagccgaagctaagcaagtggcacagttaattttacgggcaatcgagcaacgcgaagatccaaatgcattggccgaagttaagcgggatgtattcgctttaacggaacaatttccgatcaatgcaaaaagatttgaattttaactagccatagcgactataattcgctaaaatataagtaatcaaattgggaaaacgggacacgctgatttttttggtgtgtgccgttttctgcagtctgcaactaatatcaataagaggagcgtaatcatgggagaactacatgtaattgaccatccgttagtccagcacaagttaacgatcattcgcgataaaaaggtggggacacaacaattccgccaggttgtcaacgaaatcgcaactttaatggcctacgaagttactcgtaatatggcgacagaagatgtggtcgtcgaaaccccaattgcaaaaacaacgcaaaaatcattaaccggtaaaaaggtggctattgtgccaattttacgggccggcttgggtatggtcgatggcttcttagaattgattcccgcagctaaagttggtcatattgggatgtaccgtgaccatgaaactttgaaaccagtcgaatactttgtcaaaatgccgactgatattgatcaacgggaattgtttgttgttgatccaatgttggctaccggcggttctgcgatcatggcgatcgatgccctgaaaaagcgcggcgcaaagcaaatcaaatttgtcggcttggttgcagcaccagaaggcgtcaaagccttgcaagaagcacaccccgatgttgatatttacgtcgctggtctagatgactatctaaatgaagatggctacatcgttccaggtttaggcgatgctggcgatcgactattcgggacaaaataacgtgaactttaaactcagctgatctagcaatgcctagattagctgagtttattttgttgtgagctacttacaggtgcctaactaacaaaaaaagtagctatttcacaaacaaagttccagcactataatcgctagcgggccaaaatagctggaagctatttgatttatttgacttagcggatcagaatatttttggctgcaccgtaaccttgaatttatttcctttgtatctaatattatggatattaaacgtaaaaaataaattcatatttatttttttcatgaaaaactgtgcattaataggctttttatgattataaatcgctttcgtatgtcgataatcaattttgtatttttagtgtattggtggtattataacgattgtattttagatgggtctgcaacatgtgctgtctaaagtcttttctgcaaatgtgctttgatgcggtcttagttttatgatacactcagaatacagtgactttgtgtacatatgttttaaccgtgcaacactgtggaagcaaatcggttgtgaaaagaggtgagattctgtgaatgaagagagttacgttgtaaagtttttggggattcccttcaacattaccaacgttgtctcaggattgatagcaatggtcatcgtattctgtttggtttggttcttgtcgcgtaatttggcattacggccaaaaggcaagcaaaacgtgttggaatggatcattgattttaccaatggtattgtctcgactaacgttcctggtgagcaagggaaacggttcaatttattagcttttgtactgtttttatttatttttgttgcgaaccaaatggggctgttagtgcaagtcattattggcggcaagactttgatcaaatcaccgacggctgatccaatggttacgatgtctttagctctgctggtcttattagtatcacattattttggtgttatgatctttggtttcaagggatatttggtcaattcctacatgcgaccagtaagtttcatgttaccaattaatgtgctggaagagtttactaatttcctgacgctagcattccgtctatacgggaacatttttgccggtgaagtgctgctgattctgatcggcggcgtcgcaaagtctcacggcctcgtgacaacaattgtcgcgttaccgctggagatgatctggcaaggattctcaatcttcattggtagtatccaagcttatgtattcgtcaccttgtccatggtttatatctcgaaaaaagttgaagtcgaagaatagaccaacaaaccttagggaggaaagttaattatgaattttattgcagcaggtattgcagccgcaggtgccgctatcgccgcaggttatggtaacggtcaagttatctccaaaacaatcgaaagtatggctcgccaaccagaattatccggtcaattacgtagtacgatgtttatcggtgttggtttgatcgaagcccttccgattatcgccatcgttatttcattcatgttgatgtcgcgttaatcgctgtaggcagcattaagtctgccttttttgattgaacagaaatttctgcgaattaagcggtgtccgtgccgcggaacacattcttacaaaggaggtgtcaatagatgctttcacatttcgttattggtgctgccagtggtttatacattggtgatctattgttttatgccatttcgttcattatcttagttgcgttgatcaagcactttgcttggggaccagtgactaaaatgatggatgaacgggccaacaagatttctggtgacttggactatgcggaaaagtcccggaatgaagcgactgaattagcggctaaacgccaagctgaattagatcgctcacaaacagaagccactagtattgtgacaactgcgcgccaaaatggtgaaaagcagcgacaaaccatcattgaacaagcacaaactgatgcaacaactttaaaggctaatgcccaaaaagatattgttcaagaacgtgcggatgcactgaagagtgcccaaaatgatgtcgctgccttatctattgagattgcttctaaaatcattcaaaaagaactgaatgccactgaccaaaaggcactgattgattcttatatcgaagggttggggaagcaaaatggcgctagataagtatacgatcgggcaacgttatggcaaggccttatttgatctagcgacagaacaaggaacgatcgatgcggtttatgccgacgttgctgcattacagcaagtatttgctgatacaccaactttggcggccacactgactaatgcgacgttgaccttagaacaaaagcaacctattttaactagcttgcaacaaggtgcaactgacagtgttaaaaacttgatccaaatggtttttgattatggtcggatgaatgaaatgccatttatcctagctgcatttatgcaacgttatgaccaagttaatggtattgtccatgctaaagtgacatcggcagttgctttgacgacggagcagcaacaggctttatcgacacaattagcgacccgtttaggtgctaaacagatcacaatcgataatacggttgatgaggccgtgatcggtggcgtgatcgttgaagctaataatttggttattgacggcagtattcgcagtaagcttgcacaagttcggcaattactattaggttaaaaggtattttgagattagtttaattagcgttttgcgacaatttgtccaaaaacggtttatttaaaaagaggtgaaccctatgagcatcaaggctgaggaaatcagttctttgatcaaacagcaattagctaactattcagctgatttgtctgttgaagaagtcggtaccgtaacctacgtcggtgatggtatcgcaagagcacatggcctcgacaacgcaatggccaatgaattgctggaattccaaaacggttcatatggtatggcgcaaaatttggaaacaaatgatgtcgggatcattattatgggttcatatgacgacattcgtgaaggcgatacggttaaacgtactggccggatcatggaagttcctgttggcgacaacatgatcggccgggtcatcaactcattaggacagccaattgatggtcagggtgagatcaaaacagatcacacacgtcctattgaatttaaggcacctggtgttatggatcgtcaatccgtctatgaaccactacaaacaggtttgaaagcaatcgattcgttagttccaattggtcgcggtcagcgtgaattgatcatcggtgaccgtaagacaggtaagacttcaattgccatcgatacgatcatcaatcaaaaagatcaggacatgatctgtatttatgttgcgattggtcaaaaggaatcaacagtacgtgctcaggttgaagcacttcgtcgttacggtgcattggattataccattgtcgtaaccgccggtccttctgaaccagcaccaatgctctacttggcaccttatgccggcgcggcaatcggggaatacttcatgtacaacggcaagcatgttttgatcatttatgatgatttatcaaaacaggcagcagcttatcgtgaaatttccttgctgttacggcgtccgccaggtcgtgaagcgtatcctggtgatattttctatacccattcacgtttattggaacgtgctgctaaattaagtgaaaagctcggcggcggttcaatgactgctttgccagttattgaaactcaagctggtgacgtttccgcttatattccaactaacgttatttcaattactgatggtcagattttcttagatagtgacttattctattcaggaacacggccagcaatcgatgccgggacttctgtttctcgtgtcggtggtgacgctcagatcaaggcaatgaagaaagttgccgggactttgcgtgtggatctagcttcttatcgtgaattggaaagctttgcgcaattcggttctgatttggatgcagcaacacaagcgaagttaaatcgtggtcggcggactgttgagatccttaaacaacctgtgcataagccattacctgttgaaaaacaagttttgatcctttatgcactgcgtcaaggctatctagacagtgtaccggttgacgatttgagccgttacgaagctgaattattcaatttcttcgatggtagtcatgctgatgttttagccgcaattgctaagaccggtaaattacctgaggacgattcattagatgacggtatcaaggcttttgcagccacatttaaagcgagtgcaactgcagcagccgcgaactagaaggagatgagattatggctgaatcattaactgagatcaaacgccggatcgcatcgactaaaagtaccgaaaaaatcacccaggccatgcaaatggtttcggcggctaagttgaatcagatcgaaaagaaatcgaccgcttatcagctatactcttctaaaattcgtgaaatcgtgacccacatggcagctgcacagttgttggcaattaataatgccaatgatctgcgtgaaaaaaatgatgagccacaaaccactcaggatcagcttaaagtcagcagtatgctccaacagcgaccaatcaaaaagactggttacttggtcattacttctgaccgtggtttagtcggtagttataacagtagtgtcatcaaagccgttactgatatgatcaccaacgaccacaaatctgctgatgaatacgtctttatggcggttggtggtacaggtgcagatttctttaagaatcggggcatgaatattgcctacgaatatcgtggtgttagtgatgtcccaacttttaatgaagtgcgggagatcgtaacaactgcggtttcgatgtacgattctggtgtatttgatgagttatacgtttgctacaaccatcatgtcaacacattacgttcagaattccgtgctgaaaagatgttaccaatcactgatttagatgttactgaagtgcaagatcagcacattgagtacattacagatccttcacaagaagaagtgctggatgcaattttaccgcagtatgccgctagtttgatttttggtgccttaatggatgccaaagctgctgaacattctgccggtatgaatgcaatgcgtagtgcaactgataatgccaatgatttgatcgataaattgacgttgacctataaccgggcgcggcaaggtgcgatcacacaagaacttacagaaattacggctggggccagtgcattagaatagtcctagtaattaaaaatgacgggaggaacaaagcaatatgagtgctggtaaaattgtccaagttatgggcccagttgtcgatgtttcgtttcctttagatggttcactccctgatatcaataacgcactgctagtccgtaaagcaaaagacgaaacagtgacgttggaagttgcgttggaattaggcgatggcgttatgcgtacgatcgctatggaatctaccgatggattacaacgaggtatggtcgttgatgatactggtagttccatttccgtaccagttggtaaagcaactttagggcgtgtattcaacgttttaggtgaaacaatcgattttggtgataaattcccggcggatgctgaacgtggcagtatccacaaaccatcaccagattttgaagatttaagtacatcttcagaaattcttgaaacagggatcaaagtaattgatctgcttgaaccttaccttcgtggtgggaagatcggtttattcggtggtgccggtgtcggtaaaaccgttttgatccaggagttaattcataatattgccgaagaacatggcggtatttctgtctttaccggcgtcggtgaacggacacgtgaaggtaatgacttgtattacgaaatgaaggaatccggcgttatcgacaacacagcgatggtgttcggtcagatgaatgaaccacctggtgcccggatgcgggttgccttgactggggtcacattagcggaatacttccgtgatgttgcgggccaggatgtgctattgtttatcgataacattttccggttcacccaggccggttctgaagtttccgcgctgttaggtcgtttgccatcagccgtaggttatcagccaacattggctactgaaatgggccaattgcaggaacggattacctcaacgaaaaagggttctattacctcgattcaggcggtttatgtccctgccgatgactataccgatccagcgccagcaactgaatttgctcatttggacgcaacgactaacttggaacgttcattgacacaacaagggatttatcctgctgtcgatccattggcttcttcatcaagtgccttggatcccgaaattgttggtaaagagcattaccgtgttgccactgaagttcagcaagtgctccaacgttaccgtgaactacaagacattatctcgatcttagggatggatgaattgtctgatgaagaaaagattattgttgcgcgtgcgcggcggattcaattcttcttatcacagaactttagtgttgccgagaaatttactggtcaaccaggtgcttacgtgcctgttgctgaaacagttaagggctttaaagaaatcttggctggtaaatatgacgatcttcctgaagatgccttccgtggtgttggcccgatcgaagaagttgttgaaaaggcaaagaagatgggttacggtcaagatagtgcgacggctgctgaacctaaaaaagctgcagctaattaggaggtgcacaaatggctgacaaaccagttttgacagttaatattgtcactcctgatgggatcgtatacgatcatcacgcaacgatggttattgtgaaggcccttgatggacaattggggatcatgccgaatcatgaaccaatcattgcaccgctacaaattgatgaagttcgcgttaaacgtgtagataatccgggacacgaagatgcaattgccgttaatggtggtttcatggaaatgtccaataatgttgcttcaatcgtcgctgattcagcagaacgagaacgtgatattgatgtatcacgggcacagttagctgaacaacgcgctgaagagctgatcaaaacggctaaagcaaagcatgatgcggatgaattggcacgggcgcagattaagttacgtcgtgcggtgaaccgaatcaatgtagctaaacattaagttttttataaataagccaacggtaaattcgtttactgttggcttattttttagttagactgatttaatgcgatctttacgaaacttaaactcgggcgatctaagtcgttaggtacagtaaatgatgataagcactgatataataagcttatcaggaaaattctgacaattcgattagtctatgatagaatagtgacaggaaaaacagttggatgcaatgctgctttgaggttgcatccatttttaacggcctaatctagttaaaatggggataatagcatgcagaacatcggtattcaagcagtaattacattggcgtcttattttatttttaccggtgtggcgttttgggctttacaggcggtacgctttgatcatttactgcgtgccggtcatgtccctcaggcgcagactttgtttattattttagctgctgttttaggttatctatgtactagctttttcttaagttttatcgataacacccgtaacttgattttcttgttacgttaatctagtcagtgtgacggagggaaattccatggaaaaattgatcgtgcgcggtggtcaaacattgaacggaacggttgaaatcgaaggtgccaaaaatgcagttttacctattttggcagctagtatcttggcttctgaaggccagatgacattggataatgtgccgattttatctgatgtgtttacgatgaatgaagttttgaatatgttgcaactgaatttagaatttgatcagttgcgtaagacgatcgtgctggatgcgactggggagttatcctttgaagcaccactagagtacgtttcaaaaatgcgggcatcaatcgttgttttaggcccattgttggcgcgtttaggtcatgcgcgtgtggctatgcctggtggctgtgcaattggcacgcgcccgattgatctgcatctaaaaggtttcgaagctttaggtgcgacgatcgaacagcatgctggttatattgatgcatgggcggacaaattagtcggtagtaatatttacttagattttcctagcgttggggccacacaaaatattatgatggcagcaacattagctgaaggcactactgtgatcgaaaatgttgctcgggaaccggaaatcgttgatctagctaacgtacttaataaaatgggtgctaaagtggttggcaccggaactgatacattgcggatcgaaggcgttaagtcgttgcatggttgcagtcacagcattattcaagaccggatcgaagctgggacatttatggtggcagcggcaataaccggtggtaatgtgttgatcaaagatgcaatcaaagaacataataaaccactgatttctaagttagaagaaatgggtgtcactgtcgtcgaaaatgatgctggtgttcgaatcatcggtaatcaacagttacggccaactagcgttaaaacactgccacatccaggcttcccaacggatatgcaagcacaaatgactgtgttgcaattagcagctacgggaacgagcttgatgacggaaaccgtctttgaaaatcgctttatgcatttagatgaattgcgccgtatgaatgctgattttaaaattgaaggcagttcagttttattatatggaccgactgaatttaatggtgcggaagtggccgcttctgatttacgtgcggctgctgcattggcaatcgctggtttggttgctaagggctttactcgggtcactaacttaaaatacttagatcgtgggtactatcattttcagcaaaaattacgtgcgttaggggctcagatcatacgggtgactgaaccagctaatcaagagcgtctggatgctgcttcttttgctaaggaattagcttatcaacaagaacaggatcgcgtgcagagtttagcaacaatgatcaagcgataattttaaagctattcgtcggttttaaagccgagaatagcttttttgataaaatatttacttttaaacgggttatggagcgccaagtgaggttttcgtccttatgaagttatgctataattcaatattgattgggctagtgaattagcccgcaaccgaagtggaattagctgctcggttcatgtgagaggagaaatataaatatggcgaaagatatcggcatcgacctaggcaccgctaatgttttgatccacgttgagggcaagggcattgtgcttaatgaaccttcagttgtggcaatcgatacaaagagcggtaaggtacttgccgtgggcacagaggcatataaaatggttggacggacgccaggtaacattcgagcaatccggccgttaaaagatggtgtcattgctgattttgatattacggaagcaatgctgtcctattttattgataaattaaatgttaaaggggtattatccaaacccaatattttaatttgttgcccaacgaatattacttcaattgaacaaaaagcaattattgaagctgcagaaaaatccggcggccgtaatgtttacttagaagaggaaccaaaagtagccgcgatcggtgccgggatggatattttccaaccccaaggcaacatggtcattgatattggtggtgggactagtgacatcgccgttttatcaatgggtgatattgtgactagtcaatcactacgactagccggggataaaatggatgctgagattgctgcatttgttaagaaagaacatagtctgttgatcggtgaacatacggcagaaaagatcaagatcgaaattggtgaagtgtacggtcaggatgctggtaaaaccttggatgttcgtggccgtgacatggtgactggtttaccacggaccattacgatcacttctaaagagatcgaatctgctttacatgataccatgatggttatcgtgcaagcagccaaagatgttttgaatcaaacaccaccagaattatcagcggatattattgatcatgggatcatgttgactggtggcggggcattattacatggtatcgcccagttatttacggataacttgaaggtaccagtcatcgtggctgaacggccattagatgcggttgcattgggtactggcgtattactggggaacattaataagaaacggtagactgaggtgatatcatgaataatgattccaatcgatttgatatttttgttaagccagttttgattcggatcctgttagtggccattgccatgacgattgctatcgtaattggtgcaatgatcggttacgcagttggtggtggcaatccatttcgggttttcttacctagtacttggggtcacttattagactttgtgcgttaatgaattagaggctgagcattagcttggcttctttttgctagaaatatggcgtaaaattggtctaggcgtaatccgcgaatccaagaggcaaaagtgaggtttaagtatgcggtatatagtgatcaaattaatcagttggtatcaacatttttcagcacagacgccaaatcattgccgctactatccgacttgttcgcattatacgcaaacggcgatattgcgatttggggctattcgcggcggtttaatgggcattagtcgaatcctacggtgccagccgcttagtcaaggcgggattgatccagtaccacaacgatttactttattccgaaataaaaacacagtagatatagcgaaagcgagtgagaaatattatggcgaaacagcccagcaagattgagcttagtattgaagaagaaaaacaggccggcgaaacgatcaatgctgtttatgatggtaaacaccggatcggtagtattcggcccgaggcaggtcagtttgttattgaattgactaatggtgaagtctatcacgctaagacctatgatgaaggtttgaatacattgatcatgcaatatcatttacacaagtaaaaatgattatcagttgagaaaatagatctgttaaaacaatattagaagtaaattaccatatctttaacataaccgtgcaatcctaaaaatggcacttagtttggtaagtggctgtgtttatttgccagactctaagtattaccgttaatgttgaatttatggtataaaaattgtccattattgtgaagtagaggaaaggtgagttgatgaatcgacaaacagctcgcgaggaacgcgagaactcacggatcgattacggtattatatttccgatcatgatgttagcattggttggtttagcctcaatttatgtcgctgctagtaatgatactaaaagtgttaacgttgttagaatggtcgttacccaattgatttggtacgtgatcgggatcgggatcgttgccgtgatgatgcaatttgattccgaacaattatggaagatcgcaccttatgcttatggcttcgggatctttttgatgatcatcattttggttttttatagccgagcctatttcgttcagaccggggccaaaagttggtttgcctttggtccgtttacgtttcagccgtctgaggtgatgaagcccgcgtttatattgatggcagcgcgggcggttcgcggacataacgataagtatccgcaacatacggtacagacagatatgctattgctaggtaaattgattttatggattttgcctgtcctactatcgttacatttccaaaatgatttagggactacattagtctttttagccatcctaggcggtgttattctggtttctggcgttacttggaaagttttagtaccgttgatttcaacggtcacggtgattggtggaactgccctagcttttgttaccaccacttgggggcgtaacattttaggccgtctcgggtttaaagcttatcagtttgcgcggatcgatacatggctgaatccatccaatgatactagcagttccagttatcagttatggcgtagtatgaaggcaattggttcagggcagatttttggtaaaggtttcaaccatgttgaagtttatgtgcctgtacgtgaatctgatatgattttttccgttatcggtgagaactttggctttattggttccacgttattgatcttattgtatttcttgttgatctatcaaatgattcgggttacttttgatactaaaaacgaattttatgcttatatttcaactggcgtcattatgatgatcttgttccatacctttgaaaatattggtatgaacattggcctattgccattgactggtattccgttaccatttgtttcgcagggtggttcagctttgatcggaaatttgatcggtatcgggatgatcatgtcgatgcgtttccactatcacagttacatgtttagtgccgacagtgaaaagtttaattgatgcgaaattggtaatttaacggttgtgacttgacactgatttgtaatctgcttataattggaaataattcaataaagcacatcgaaggaaagaagctaagtaaacattcatagtgagctgttggtcagtgggaaacagtaatgtacttagttgaatggttctggagtgctgctaggtgaaagtaagtaagctagcacggggagcgaccgttactcgttgagtctatgactcattaaggttgatggagcaatctatcaacaaattaaggtggtaacacgtaaagttaagcttttcgtcctttgacagctatttagtcaaggatgaaaagctttttatttttctaaacaccgcatgaaaattattaagagaaagagatgattaacgcgtgattgaaattaaggacgtcagcagaatttaccgtggtaagaaaaaaacgatcacggccgtaaaagacgtcaacctaacgatcaatgatggcgagatttatggtatcgttggctattctggtgccggtaaaagtactttagtccgaatgcttaatgggttagaaacgccaactagtgggacagttacgatcaatgataccgtgatgagtgatttaaaaggcaagccactgcgggaagcacgccaaaaaatgggaatgatctttcagtattttaacttattgtggtcgcggacggttctagaaaatgtgacttttccattagaattagtcggtatgagcaaggttgatcgcgaagctaaggctaagaagttgatcgatactgttggtttgcagggacgcgaaaatgcttatccaagtgaattatctggtgggcaacaacaacgggttgccattgcgcgggcgttagcaaatgatccgcagattctattatctgatgaagccactagtggtttggatccgaaaacaactgatgaagtcttggatttactcttgaagatcaaccgcgagttaaaaattacgatcgtcgtgatcacccatgaaatgcatgtgatccgtaaaatttgtgatcgtatggcagttatggatgaaggagcagtggtcgaagagggcaatgtcttcgatattttccgtaatcctaaaatggaaattacgcgtcaatttgtttctgaagaagaaacgccgcagctaaacgatacgactgtggtgatcaatgagttgctagcgcaagtaccaacggggaaaatcgttaaattgactttccacggtgatcaggctaagttaccgatcatttctgaaatgttgcgacaatttcccaatgttgatcttaatattgttgacggcagtattcatcaaacgcaggaaggatcaattggaactttgtatctgcaattgttaggtgacgatgctgaaattgcaggtgcaaccgattatctgcataaaatgcgtgtgggaacggaggtgattcgtggtgagtagtacaacaggtttctcctcatacttccacttttcgcaagttgattggcccagcatgtggtcggcaacaatcgaaacgatttggatgacgattttctcactggttttagtcgctattttaggtgttttacttggcttgttattattcgaaacaaccagcagtactaatttctgggctcgattggttcatggtttgacggccttattcgttaatgttttccggtcggttccgtttattattttaatcgtgttgttattgccactgactaaaaatttagtgggtaccatcattgggcctaaggcggctttgccgtcattgatcatctccgccgcacctttttatgcgcgaatggttgaattggccttccatgaaattgatcatggtgtgatcgaagcggcggaagccatgggcgcaacgcggtggcagatcgtctataaagtgttgttgccagagagtagtcccgcactggtttcagggattaccgttactggtatttccctgatcggttttaccgcaatggctggtgtgatcggggctggtggcttagggaacttagcttacttagacggtttccaagctagcaataatacggttaccttagttgcaaccatcattattttattagttgtttttgtttgtcaaacaatcggtgatttcgtggtcaaacgactggataagcgagttgccaattaagttttggttataaaatgttttatgaaaaatggagggattttttatgtcaaagaaacatcgtttaattaagtttgtcacggctgcggctgtacttgtgctaggggcgagcacatttggttctacggctgaagctgcaactacattgaaagtcggtgcaactaaaacaccacattcaattattttaaatcacgttaagcctcaattgaaaaaagaaggcgtcaatctaaaagtaacggtcttccaagattattccttgattgataaggctttagtcgctaaaaacttggatgttacttattttgcgcacaaaccttatctagaacaagaaattgcgaaaaatgggtataagatcagcgatattggtgctgtgcatttggaaccaatcggtgcttattctaagacagttaaaagtttgaagaacgttaaagatggtgcaacggtcttagtttcaaataaccggcctgattatggtcgtatcttacagattttgaaggatgcgaatctgatcacaatcaaaaaagggactaaactaacagatgctgatttcacggacattgcgtctaatcctaaacatctaaaatttaagcacaattatgatccaaaattaatgcctgaattatacaagaacaacgaaggtgacgtaattttcatcaacgctaactttgccgttcaaggtggtttgaatccgaaaaaagatgcaatcgctttggagaaacaatcatcaccatatgctaatattcttgaagttcgtaaaggtgacgaaaacaaaccagctattaagaaattaaagaaggctttgcaatctaaatcaacacaaaactggatcagcaaacatttcaaaggtgcagttttaccagctaaatagaactaaggaaaactacgagaaatcgtagtttttttgtttgaattaaagtaagcgttaccaagctaagtaatgttaaaagcgactatcaggatattcttaataaattctcattttacaaaaataagtcttggttggcggaattataaagcataacaacttttttgtggcaagaaattctttaaggaactcgccaagggttattgaaaaaggttctcaattaagttagaatgagtattgtttaatattggaaacgatttttctcttaaaacgttttcactggataaaccagtaattcctgatatcggaggagagcacatgtcaaagttagaagtaaagaatctacacgttgccgtcgttgatgaagataaaggtcagcaaaaagagatcctcaaaggggtcaatttaaccatgcaaaccggcgaaattcacgccatcatgggaccaaatggtactggtaagtcgaccttatcacaagcaatcatgggcaatcctgcatataaagtcactgaaggtgacgttttgttagatggtaagagtcttttagatatgccagtagatgaacgggcacgtgctggtctatttttggcaatgcaatacccagctgaaattgccggggtaaccaatgtcgaatttatgcgggcagcaattaatgctcggcgcgccgatgatgatcagatcccagtattagaatttatgaagttcctcgataaaaatctggatatcttagatatgaccgacgatatggttgaacgttacttaaacgaaggtttctctggcggtgaaaagaaacgcaacgagatcctacagttaatgatgattcaacctaaatttgctattcttgatgaaatcgattctggccttgatattgatgcattaaaggttgtctctaaaggggtcaattcgatgcgtggacctgaatttggttcattgatcatcacccattatcagcgtttgctgaattatattgttcctgataccgttcatgtcatgatgggtggacgaattgttgaaagcggcggccctgaattagctgaaaaattggaagctgaaggctacgctggtgtacgggacgatcttggtttggatgtcaaactaacagacgaaatctaaggaggcgcaggttatggaaacacaagcagaaattgagtttcaatccgcagtgtcggccttttctgcggcccataatgaacctgattggttgcggaagttgcgcctaacaatgctggctaagtatccagaattagcgctacctaaatttgaaaaaattaaataccaacgttggccactaacggctgtccatgaaccgactattatggattcttcagcagctgacttatcggctttatcattggattatgctgatgccaaaaacgttttggtcacagttggtgaaacggtgcttacaactaaattggatcctgcattagctgctaaaggggttattttcacggatttatttacagccgtgcatgaacatcctgacttagttgcgaaatactttatgacaacagccgttaagccggatgataaccgcttgactgcgtttaacgccgcttttcttaacggcggggcctttctgtacgtacctaaaggtgtcaagatcgaggatccgatccaaggttattacatccaagatagtacgcggacacaagactttattcatcatgttttagtagtggctgatacgaacagtcaagttacttattcagaaaattatgctactgttggcgagcaagctaatttagctaatattattgttgaagttgtggctgccgatgatgcccatgtgcgtttttcagcggttgatcagttaagtgctgcgacgacaggctatatcagtcggcggggtaacttagctaatgatgctaagctagattgggcaatcggaatgatgaatgatggtaacgtggtggttgatttcaataccgatctagttggccatggcgcgcacgcggaagttaaagttgttgcggtcaccactggtgaacaattgcaaggtatcgatacgcgcgtgactaatttaggacagcatacaatcggtcatattttgcagcatggggttattcttgagtcctcagctctgatcttcaacggtgtaggacatattgttaaaggcgctcgtggttccgatgcacagcaagaaagtcgtgtcttgatgttatcgacacatgcgcgcggtgatgccaacccaattctattgatcgacgaaaatgatgtgactgctggtcatgcggcgagtgttggtcgtgttgatgaagaacaaatgtattatttgatgagtcgcggaattgataaaaagcgggcagaacggctagtcattcgtgggttcttgggcaatgttctaaccgagatcccagctaaacgtgttcgtgatcagttgaccgccacgatcgagaggaagttagaaaatgggcaaaaatctgaatgatatccgcgctgattttccaattttgaatcagcaagttaatgatgaaccattagtctacttagataatgctgcaaccacgcagaaacctaaagcagttgttgaagctttaacacattattactataacgataacgccaatgttcatcgtggtgtgcacacattagctgaacgtgctactgaaaagtttgaagcggcccgcgaaaaggtccgtgcttttatcaacgctcgttcaactaaagaagtgttatttacgcgtggaacgacgaccagtctaaactggatcgccgctagttatggtgaagctaatattactgccggtgatgagatcgtgatttcttacatggaacatcacagtaacttagttccctggcagcaattagctatccgtaaacaagcaacgctcaaatatatcaaaatgaacgctgatggcacactggatatggccgatgcacagcaacagatcacggataaaactaaaattgtggcgatcgcacaggtttccaatgttttaggtgtggtcaatccaatcaaagaattggctaaaatagcccatcaacatggtgcagtaatggtcgctgatggggcccagtcgttacctaatatgccagtagacgttcaagatctggattgtgactttttagctttctctggacataaaatgcttggtccaacaggaattggtggtttgtacgcaaaggaagctctcctaaatgaaatgccaccgattgagtttggtggcgaaatgatcgattttgtgaatttatttgatagctcatggtcccagttgccgtggaaatttgaagcaggtacgccagatatttctggtgcaattggtttaggtgcggcgatcgattatttgaatcagtttgggatggctgcggttcatgaacatgaacaaaagctagttgattatgtgttacctaagttgttagcgattgatggactgaccgtttatggtccccatgacccagctaaacataccggtgtgattgcttttaatttagatgggctacatccccatgatctagcaaccggcttagatatggaaggtgttgcggttcgggccggccaccattgtgcgcaaccgttgatgaaatatttgcaagtaccagctacagcgcgggctagcttttatatctataatacgaaggcagatgctgaccgcttagttgatgcaattgtggcaacaaaggagttcttcaaaaatggcactgtctaaattagataatttgtatcgccaagttattcttgatcactcagcacatccacatcatcatggccacttgcaacaagcgactaatgagatcgaattacgtaatccaacttgtggcgatgtgttacaactggaagtggctttgaccgatggtaaaattacggatattgctttttctggcgatggttgtactatcagtcaagcctcggctagcatgatgactgatgctgtggttggaaaaacaccagctgaagcagaagaaatggttcaggttttttcagaaatgattattggcgataagcctggtctggatacaacggcgttaggtgatgcggcaattttagaaggtgttgctaagtttccagcgcggatcaagtgcgccactttagcttggaaagcattaaataatgcactaactggtgaggacggtaaaggaatggctcatttgttgagctcacatgaggattagttatttaccgtttgaaccatatattgaataagggggacagcttatgccaatgcctgaaactgaaaatacaaaaaataacgctaccgttgctagtagcgttgatgaattaggtttggataaagattatgactttggctttcacgatgatgtcacacctgttttttcaacgggtcacggcttgaccgaagatgtcgttcgcgccatctctaaggaaaaagacgaaccgcaatggatgttagattttcgtctgaaatcatacgaattatataaaaaactaccaatgccagcatttggtccagatttgtcaggattagatttggataatatgctttattatcaaaaagcaacggataaaaaatatcgtgactgggaagaggttcctgaagatatcaaaaatacgtttgatcgcttaggggttccagaagcggaacgtaaatatttagcgggttcctcagcacaatacgaatcagaagttgtttatcataatatgcgcgatgagttcaataagttaggaatcatctttaccgataccgatactgccttgaaggagtacccagaattattccgtaagtggtttgctaagttagttaaaccatccgacaataaatttgcggctttaaattcagcagtgtggtccggtggttcatttatttatgtgcctaaaggcgtgaaaacggacgtgccgattcaatcgtatttccgtttgaatgcggaaaattctggtcaatttgaacgaacattgatcattgttgacgagggtgccagtgtacaatatgttgaaggttgtaccgcacctaattattcctctgacagtttgcatgctgccgttgttgaagtttttgcccaaaaggacgcttatatgcgttatacgaccattcaaaactggtccaataacgtttacagtctggaaacaaaacgggcacaagcgatggaaaatgccacgatggagtgggtcgatggtaacttaggttctaagattaccatgaagtatccgagtgtttatttagatggcgaaggcgcaactggaacgatgctttcgatcgcggttgcgggccataatgttgatcaggatgctggtgcgcggatgatccataacgctaaaaacacctcctcatcaattgtttctaagtcgatctctaaagacggcggggcggttgattatcgtggtacagtgcgttttggtcgtcattcagatggttctaaagcacatattgaatgtgatacgatcattatggatgaagaatctagctcagatacaattccgtacaacgaaattttgaatggcaatgtatcgatggaacacgaagcaaaagtttctaaaatttctgaagaacaattgtattatttgatgagccgtggtatttctgaagccaaggcgactgaaatgatcatcatgggcttcgttgaaccatttactaaggaattaccgatggaatatgccgttgaattaaaccgtttgattggttatgaaatggaagggaccgtcggctgatgtcttaacgatatggttggttaagaagtatcgttgttttacacaaaaagcagctcaataccctaaattagggtgttgggctgcttttgtgtcttgaatttatactttaagtgcaacaaaaaaccggcgttaagccggtttttcgattacctaagcttcgcgcctgactgatttggcaatcagtgaaaagaacttaagtgaataaagtgcacagatcccaacaacaatatacacgattttagagagtagtgcagtttgaccgccgaagatcgtcgcaactagatcaaagttgaataagcccacaagcagccaatttaagccaccaataatcaataaaccaagtgcaatgctatctaaggttttcataaaatgcgctcctttctaaacaattacttttgggacaattaaagtgtatcaggtgataggtctatgagctagaaatatgcaaaacgaaaagtctagtaagcattgaggatgaggaaaacataaataatgccgtaaattattttagtggcgatgatgaatttatagctccccaaattgcaagaacaaattagccacacgataaatcctattaaatcagtattttcattaatattcatattttatggacttaacttaaccggcggaagcagcggagaaaagtgctttgggtgtttgatagccagtttgccggcgcggtaaattgtttagctttgactcaactgcttggatatcatgaggacccaaaatatccatggatagacccttgggtacatcgcggcggatcattcgattatgcgcttcgttagtcccacgctcagag

SEQ ID NO: 639 - DNA, 3714 bp, Unknown
  Metagenome-assembled genome
aagctaatggtataggccaaagcaataattaccgccacccaaacgataaaatggtaagctaacagtaactagtaaagcaattacatttggcgaaatgactcattaaaggaagtcctcaccatggcccgttcaactcacaaacaacttaacgccctcagcatctttttactgggaattgacggcatcattggatctggtatttttctaatgcccagccgggtttacgcaaagctcggtgatttgagcatggttgtcatgccgcttgctgggattgcaattttatcgatcgccctgtgctttgcaaacctcgccagcaagattcccggggatggtggcgcctggttatacacctacacggcattcgggcggtttgccggctttgagatcggtatctttacctggttactagggattattacgatggcaacggaaatatcggcctttgtgaccagcttacggagcctttttccggtgcttaaccagcacgggccatatctgattaccgcccttggcattttagccgcgttaacgggtctgaacctcatgggatccggattcatggactgggttgacaacgtttcgacgatcgctaaagtgggggttctggtggtctttgtcgtgattggcctgttctttattcatccggcgaaccttggaaatttaacgggaagtccagccgcgacgccacttttcagccgctttaaccaggtatttggcatggtattctacatgttcactggtttttcgttcttaccaattgccgcgtccaagatgaaaaatcccgaaaaaatgctgccccgagcactgatcagcgtgctattaacggctgccggactctacttagtggttcagctgacggcaattggcgtggccggtagtggtctggccgccgcaaacgtgccgattgccgtggctttcagtcactttgccggcacggtggggtatgatctggcattgatggggatgctgatttcgattctcggcgttgcattgtcggtttcgttttcaaccccgctgattgccagttcactggcctccgaacatcaactgttgccgcgaacgctgggcaggcagaataaacgcggggtcccgctgcagtcactgatcctatcggttgtgatctgcgcgttattcttgttgtccggcaactacttatttctggcttcctgcattgtcttcacatcatttgtgcagtacgtgccgacaatttttgcggcgatcaaattacggcatcatagtaaattaccggtgggcttcaaacttcccgggggactcacaattccagttctggcactgttggtaaccatgtatttgacgctcagcttttcagtcaccttggttttgacggggttggggattttcctggtgagtgccctgtggtacttatacgatgatcgtgatcgaaaggcaaacggcttggaacgggacatttcggctaaggatcggccattttaaatgataaagtccggctttcattctgtcaggattggacaaattgaattacagcatccacatcgttggctttggcaagtttattggccgtggcttggatggtcgcgcgtgacttttgaccgcgagatgttaattgaatcgcaattaactggcgcttgtgattggccttatcgaccacttcaccggtcaacacgttggtaatttggcggggatactgcttcaccaaatcagattgcacctgattcagtgacttattttcgggcgtctgcgaattcaccgctggggtcgtttgggaattattctgcttcatataatcttgaaattctttggcggtaatatagttcccccgggtaagctgcttaattgagagtgcatagtgatcgaggtggtaaactttaagtgagcgatccaggcttttaaccttctgatcactgaggtgggtgccgatcaccgttagctgaattgtttttcccgtcactgactgctgggcaatgtattgatcaggaagcttatcctcgacaaattgggatagttgggcggtcacgtacgatttctgcacgattgaataggcggaaatggaacttggaataatgacaataatggccacaatcagcatgatgacttcctgcttgacggacacgtttaaccgctcactgctgcgaattctaaagaagatcgttcccacagcggttgccagggcaatgaagaacgcgttgatgagaaataggtacccggcgccccacacaaatgaccagttcagatgactgatgccatacccaatggtacacagtggcggcatcagcgccgtggcaatggcaacgccggggaccacgtttccgccgtctttcttggcggaactaatcaccccggcaaagccaccaaaaaaggcgattaaaacgtcccacagggttggttcggtgcgggcaagtaactggtcagtggcggcattcaacggtgaaacaaagaagtaaatcgttgccccggtaacggcaatgatgaactgcgcagcaaatagccgagcgccccgggaaagaaggccggagttgctatttcccaacgcgtacccgatgccaacgattgggcccatcaatggggagattagcattgccccaatgacgatgggcgctgagttggtattaagtccgatacaggcaatgatgatggcacagaatagaattgcctgagttgaccagtttagcgtcaggcccttgcgaacattttgatttaagacgtcagttgaaatttcttgcatgataactcccccataaccagcattttaatgacattttaagaatagcacacccgccgaaaatgctcattaaattaggttcacctggctaattgttacggagggaaagttgcaccgaggaggttgtttaaatggcagagaattatccagaaaacatgacagaattaaataagcagtatcttgaggagcagaagcgtgatccaacaatcacgaagcagcagctgattcgtcgtgccgtcgccgatgcctttcaagacttcttgtctgaggctgaagagggccattatgatagtggtaagttggttggcaatgaaatacaggtgtttgggatcaatcaaaagctgcggcacgtgatcaaaccaatggggacgtcatttgagagtgactttgagaaggatggcgccaaattgatgtggtatctggaagagcaggccaataagacgattaaataggggcatgccagcgaaagcaggttactcacaaaatgttttttaaaattgaaaagaagccaccagctcaagcgcgtaaagcgttgggttggtggcttctgtcatgttacaaaagttattcagcgtgggtagttgatcggcggcgcttatagatttggaaccctaaaaataggatgattaacccaagcgttgtcaacgaaattgtgagccctaagctcaagccaagtgggaagtaggtgaatttaacgacgtggtgccccttgctgaggttaatcgccataaattcatgagcccactgttttggcgtaacggttcgaccatcgacagaagcgtgccacccctttgaatacggaatggttgtgaccatcgtgccgttgtcccgtggcgaatcaatcgtcccggtgatctccgaattggtgtactttgtgatgcggtacgggttctgcttcaaatgattggcaaatgtggcaaccttggtgttatccacactgtacagataaacgttttgcagtggggcccgattgacgttggccaggattttaaaatgaatggtcttgtcggttc

SEQ ID NO: 640 - DNA, 5126 bp, Unknown
  Metagenome-assembled genome
tacagggtccataagttttcacgtcctttaaaaaagatgctgtagtgggtggattttttaggtgcgaggcttatgggccttttttattttgcactaaaaaatcctgctaatagattaccatgttaagtaagctatcaacaggaaaaagtatagaacctatttttacggcaacgtttaattagataccttaattgagtgatatttctccaactcagttagcgagttcggcaataaccacgcttcaagtatgatttaatttaaataaagaagctaaacaataatatccctaaaagaccaatgatagaaataatcgaggttaatgccgtccaagttttaaatgtcttgataagcgacatattaaaatattccttgataatccaaaaaccggcatcgttgacatgtgagaaaccaacactgcctgcaccagctgccaacgtcattaattcaggactaacccctgttgctacagcaacaggggccacaattcctgccgcagtcattccagcaacagtagctgagcctaatgatacccgcaatacggcagcaatcagccaagtcagaattaatggtgaaatagctgatccctccatcagatgtgctatatattgatcgattttactatcgatcaacacctgtttaaatgcacccccacccgcgataatcaataaaatcatggcaattccagaaacggagttagcaaaagaatccattaactctttaattttatgaccgcggttcaaccctaatgtaaacaatgaaacgataaaagtgatcaatagcgcagtccctgcattaccaataaaatcggtataactccgcaaactagaattaggccaaactatctcaacaattgttttgataaaaataaatataataggcaacgttgcactgagaatacttaaaaagaaactaggcatttctgcttcagtaaactttttctctgtatataatcccttaggaatttcgacttctaagaaactttttttaaataacctagtatatagtggtccagcaattataatcgccggaatagcaattggtaatcctaacattaaagttttacctacactagcatgaaggattccggcaaccgctgttggtccaggatgaggtggcacaaaaccatgcattgtaattaatgcagcaattacaggtaatcctatatataaaattggaacttctgctaccatcgcaattgaaaagactaatggaatcaatacaacaacgccagtctcaaaaaacatagcaataccaacgacaattgctgtgatcacagcagcggcttgaacatgttttttaccaaacacatgtaccatagttaaagcaatacgttgcgcaccgcctgtatcagttaataacttaccgactgctgctccaaaaataatgaccagcatcagactacctgccgatgatcctaatccattttgaattgaggtcatcacatcattcggcgacattccttcaagtaaaccgaccgctaaagacgacagaaccaaggcaataaacgcattcatctttaataccatcatcaaaactaacagtaatagtaccccgaggataactgaaataaatggcataaatatactcctttgctaacctttttattagtctaacaaggcgactatctcacgtaaggtgttcttttcgccaacattacccggaaatataatatatggtaactgtgggaatttagaatcatctccggtataccaaactggaataccaggtttaacttgtccggccactaaagcgtgatcaacagctaagccaaccgtcccaatatcgcttgaagtaataccgcctttagcaataatgaatttaggccgtaatggcaattgtttaactaagtttgtcaatgccttagaaacatttaccgacagtttcaatacagcttccttatcgtcgcctaggtctaagcgttgacgtgaagtataaaccgtcaccgttcgaccttgcttcaaggctgcattaaccgcctttgccacgcgttgttcttcctgcactaatgtactctcagccaaaactgttttgacatcaaattcaataaacaagacattatttaattgttgcaacgccttcaattgatccgttgttttttgaacatgagaaccaatcactaccagaccgccagcagttgtcgttgaatcgatcaggtctgcttttgttaacagtggttgattgctaacgccgcctaacactttagttaatgctgcagcactacgaaacataaataatttaccttgacgaagcgcccgtattaaagcgattacaaatacttgtacatcaatataatcaacggcattgacaataactttattgaaatccgtaacttgcatcagttgattagtgatcttagcgagatttaagttgcgtagatcagtcagtgaaattgaagttacattagctgcctgatattgtccatcagttttttcctctatccactgttttaagttagacgcatggtaaccaaaggtcttgtctttagcaaattcggtttccccagctggtactaattgatcatctatctgaacaaaatgagtatcatcaattgtaaagcggccaccttccttaaaaaagggtaaaataacctcaccatcaaagatactacctgtttcgtctgttaccacttttcttagtatttcggtttccaacggataatgtccccgtaaagtagaatcacttcgactaataaaaagaaattcttgtttagtggcttgagcaacttcactaactcttgtcgcgatttcgcgatgaacttgttcggtttccgcagctgtgagactacgcgaattagttagaataaaaaacattgaattttcttcggcaaatccttgctcaatgctagattttttccaattggtatagacagatatatcgtgcactgtttgaacacctgttggatcatcatcgagtaccacaatttttttattcagctgtttcaattccgaatttaataattcgctgacctgttgctggctaggtgctgtggggattttcgtaaaagcttcttgcaccggaatattactcattatcgtcacctctgttcacttcaacattggctattttttcataatattgaacaataccaccatgatcgttcattaccttaccgtcagccttcaaagcgtgaaaaatctctaatagctgactagataatggtaacggaacatccaaatcatgtgcagtttgcatcacattagttagatctttcatgttaatggcaattgtcccgccaggtttaaagttacgatctaaaatcagtggaactttagcatctagtacagagctacctgctaaaccaccgcgaatagcatgatacattttttcaatatcaattcctgccttggccgccaacaccaaagcctcagacattgccgcaatatttaaattgacaataacttgattagccaatttagcagtaaccccgctaccatgtccaccaacgagtacgacatctttaccaacaccctggaatactggcaaactttgcttaaaagtctcttgttcaccaccaaccataattgatagtgtccccgcaatagcccccggttcaccaccgctgactggagcatctaaagttgcgatttgatattttttagcttcttcagcgaaggcttgggcatctgttggacctattgagctcatatcaataacgactaatccagaatgagcattggcaaaaacaccatcagtaccttcaagtacagatcggacatgcttagcggcaggtaacatagtgataataaagtcaactgattttgccatttctgcagccgtactggctgttgccccatctgcaaccaagctatcgactgcagtagtattgatatcaaatacagaaacagagaaaccagcttcaattaaatttctcgccattggtctacccataatacctaaaccaataaaaccaattttttgcatctaaatcactccttttagattatatataaagcgctttcttattaacaagctcagtataacccaccttttttaaaatgtatacatttttttattttttgtatactatgttaaaatgtgagctttacgcgtataatgtaaaaaactaacaaaaggagcagccttatgaaaaaaaaagaaacccatatttacattcacgcctacgaacttttacgcgatcaaatattatctgggaaaatagacgctagtgttaaattaactgaaaccaagctagctgacgatctaaaaattagtcgtactcccgttagatcagcaattgcaaaattagaagacgagggactcattaaaaataaacatatctatgtaccaaccgaaacggatatccgacatatttttcaagttcggtctattttagaaggttacgcggccagatattgctctgagttcatttctgacgatactttgcagaaactttctaaatgtgttgatactggtttccatggtaataatgaggaaaaattgcaagcaaattatttatttcaccaattaattgttgaagagactcataatcccgaaatcgttaaaattatcaatcgaatgcaatcaatcattcacctattacgtactacagtaactttgcacaaacggcctcaattagttgaagaacatcaagaaattttattagcgatccaatcaaatgatggttgcttagctgaaaaattaatccacaagcacttagaaaaagatttggaatttagcgttaatcgcttgcctagattagaataaatcttgtgtccttaattgatgtaacgtctcttgacgattggatcaatctaaataaccagagctttattatattctaagcgacaccttttattacaaaaatggcctaccttaaaacatgaatgttttaaggtaggccatttacttttgagaatttatgccatatatttttttgctattttgaagacgatgccaagcctacacaactattctaagatttcaaatcataattgtggattgaagtcaatatttgagacagattttaagagacattcagaaccgcgtttaccttccagggttcaaataaatcattaatcgcgattaataacttatttgaaccctggaaagcattaaatcaggcggccatttggctcgtaagtgttgcaatttcaacttgtaagggggtctggtagcccagtgaacta

SEQ ID NO: 641 - DNA, 21098 bp, Unknown
  Metagenome-assembled genome
atgcgctatcacattatacaagaggtaccttagggctggtcaatctcttttgcagaacttggtcaatttcttcgcttaatggggtaaaattttatgccgaagggggtaaatgggaatgccgtcatcagtaaagaaaaaagaaagctgattatatcaactttcccttgactaatggtagaaaagaccacctgaaaagcagtgttacccgctgtgtaagcgaatactattacagtatacagaaggtcagattgttttggcctattcttcgcactatggggcctatttcttcgcaaaccatggcctattagattacattatgtggcctacgatgatgctttcttcagaatcctcgcatagcaaacctaaacggcgtaattatgcgaggattttataaaatggacgattatatgaccgaagtggacgattcggtggcacgagtggacgattttttggcatagctggacgatttccatgtccgccttcactttcttcaacgtaacgtttcgctccttctctaatatcgtgtctaacatcattaacctcctcgattgagatgtgattaatggtatcaaaaaatgtaggaaaaccgacaatttctcaccgccattttcctacatttataaccgccgtttacaatcaatcaaactttattctaggcttaagtctaatttcgagccaaccagcataaactatcaaaataactaaactacctatagtaactaaagcacctaatttcaatccagctggcacatatctaagctcaatatgatcggtgccatttccagtcggttgaactgccattagtccgtctagtgcatgcttaatcttaatttgtttaccattttcaaaggcatgccaaccggaatcataaggtaagctcaacatcacagcctggtgttccttcagctgatctgctttaactgaaaatgaaattttagatgttgagactttcaactgctggacttgattttgcttaattttagtcaattgtgcagctaccttggccgaatcctcttgataaaccactggctttaatgcattgatttcatcaactatattatttttggcacgaatactcagaccaaccgtctgcccagccttaaaatcacctaatgcggcgataccgttttgctgttgaacattgattttagagaaacgtcgaccattaacatataattctgtattcaagttctgtaacccatcaatttcggtttttgttgtattacttgtaggtaaataaaaatatagttgaccaggtttattcacttgaatttgataatcatagcggcctgtttgctttgaatcaatagtcgtcactggaacggcgtgatagattggtgtaatcgtattagtcacttgattaaagatctgattcaaatattcaaatggactcgcactagtatctctttgtattgtatcggacgacaatacccgattagaaactaaattggccaatcctaaggcatacttgttttgataaatagtataacccttatgcgtataaacatcattacgatacggcgttatataattcaaattatatccgcctaattgtgagccagtctcatttaataatttttgcaaagaatgactattattatgaataacatatttaacgcctaacaagctatcggtcataaaagtcgaaccattattgaaattagtccagcgccaccaattatgattttggaagtaacctaatttttgtaaaaagttaatcgtatccggactttcggccgaactataattgcttaacccatagtaatcaaataataacggatcatcattggaacgttcaaatgtcgtgccaacacgataaaaatcgcgctgcttatctggtaattgcttcaatacgtgattaacttgattggtatatttcgtaaaactagttgtttgaatcccagtaacgtaggattggcgataagcattgaatccaaggtcaacaaaaatcagtagcgccaacgcaattattgataactgcttaaatgtctgcaaataatagagtgataccataacacccgcaaaaaggataagattaacaataattaccggcaccgttaaaatgtcggagctaaacatgcctaaaataaaagtacttaaagtatagataagaactaaatttgtcagttcttttaaagtaaatttaagcgtgccactcaacaaaatctcgtcagcaaccacaatcaaaaagaacgtaaacaaaaatgcattccgatttggcataccattgggtgaattaaaaccatgccaaatctgataggtaccttccacaatttgagatagtaacaaaaacatcaaaaaaacggccgaagttattttctctggcaaagtaatcttcttaccagcaaaatacagaaaacacaaaacaagaaccagcataccgccataaaaatatggatacatttgattggcttgaattcctgaataaaattgatggaaaagttctaatggctgaaaccggccggttagttggaagtgatacgggttactttttagagtcgatacggccttcaagcctggtaaaagaataattgctgataaaccgacaccaagtacgctagagatcagtagcttgaagaagctcccacgtaattgttctttaatcctagtatttaatttgaatttatttaataaaattcgatagacataataaatcgccacaaataagcagaccataaaaccgatataataattaaataagattgcaaaaaacaatgccgcaatatacacatatggtcgttcgccgtgcatgattttctctaagcctaaaatcacaatcggcaacaaaataattgtatcagtccacatcaaattagtcatgtacgcaatttgataggacattaaggcaaaggaaattgccagaaaaacattaagttgcgctaataacccaacaactttaccttgttgtgcctttgaatgatagttaagatagcaaagcatacttacgcctagcaacccagtcttaattagcataataatggtaattacaaccggcagcttagcaactgggaaaagtaaaacgagcagatttagcgggctgatcaggtaataagcgaaaataccaaaaaagttcccacccatgcttaatgagaacgaatagaacaaatcatgcaagttactaacgtgattcttgaaataagcaaaaaaactaatgtattggttattcaagtcactcgtgatcggcgcgtgtccgccgaatggaaagattcccttcacgctaaaaacaagtagcatgatcagaatgggtagtgcaaatgcactcaaatactcaacaactgtatgccctaacttcctgttttccctcattttgctcctctttctctaaaaatgacgaccttactaaaggtataattcaaaataacaattacaaactgcgtcagtaccttagcaacaacaccatctattttcaacaacgaaaccataacaaacattgagcccatatcgaacacaccagataaaacccgcatccataagaataggaaaaattcttttaaaaatggttgccaaccggtcgtgcgtgatttaaaaacaaaatacttattagtgaaaaaagcaaacacaaccgataaaaaccacgcaattaagttagcgactaaataatacaaatgcaatggcgtattggccacccagaaaacaactaaattaactgcagtcgtcagcacaccaaaaatcacataattgatcaacgccatatgagtactaattaattgcttaattttatccattgattacctaccgtctttcttgtctttgctcttggaatcatgcgtgtagtagtcctcaataaaataaagtggtcgttgtttagtttccacaaaaacgcgcgccaaatattcgccgattaacccgagcgagatcaattgaaccccacctaacagtaaaataccgatcatcagtgatgcatagccggaaacatcacctaaaccaaaaacacgttgaaaaagaacaatcagcatataaacaaaaccaaaaaatgaaactaacacgcctaaatatgtcgaaagtcgtagtggcaccgttgtataagcagtcaacccattaaccgccaatttaaacagcttcgagaaatcccatttagtcacgccactttgtcgcggctgagcaatatacgaaatcgcttttttcttgaagccgacccagccataaagccccttcgtataacgtgcttgttcgcgtagtgccgatagagcatcaaccactttacgatccaataaacgaaaatcgccagcattaggatagactttttcctgggtcatcttccccaataatcggtaataagttttagagaaccagattttagctttaccttcacctaagcgctctttacgaatcgcgtaaacgtcatcatagccttgttgccaatacgtgaccatttctttaatggcctctggtggttgctgcagatcagcatcaataataaccactgcatcacctttagcatgatcaaaaccagcagtcatagcgacttctttgccataattacgcgataaatctatgtacgaaactcgctgatcttttgccgccaactgcttaaccatctctaatccattatcagaactaccatcattaacaaacagcatttcaaaatcatacgttgctaattccgttaatgttgtcgttaaaatgttataaaactcctgtaagccgctctcttcattataaaaaggaacaataatcgtgaccgttttcattctatcctccgattgttctgccagacttatatcaacaaatgaaaaaatgattgtcttttattttacttattacccgttccagaatcatataaaataacgccctttacacgaaaggctttctgataaccaagattcggaaattcatttggatctttcccaatttcctctaatccatagttaatagcgtatttagtagttggtaaataattcaatctaggaattttaatgattttattgctacccgatactgctctctttttcaagattgagtcatatgaagcacgaatagcccgatctgccttcattgaatcaatgagaccattagagatagtcaatcctgaataacttagtaaacagatggctatcagttctatgaacatcttactaaatctatccaagtcaattaattcattaggcagcaattgacaaattccgataatgataaaaataattccaccaaaatatgcacggccaccgtcttgtcccattggcgcaaatgataaagcataaatcgtcgcagtccctgaaaaaatccatatgccactattaattaacttctctttagagaaccagtaattcagcatcaaagcaaacaaaacgattactaagaatagcaacggcaggtattgatcaataattgattggttaactttgtaaaatccatttaatgtccgtataacgatgctttggtttaaatagtctttacccatggttgcaatcgttctatttttatttcctggagaaactaaaagcattgcgtagccaattaaattagccacaatgcctaaccaataagggatactaaatttagctttgttataatactgaatataggtgttaagcagaatcactagtaacacgccaccagaagtattctcgtttgcccaaccgaccaataccgctagtacaataaatagtattaatagaaaacaattaagcactgtaatttttttctttgggataagaaaatcagactttacataaataaagatatagaataaagacaacaccattgtccatagatagttaccagctccagctcgccaaagaacagtttgtccaaaggctggtataaataaaagcaacaaaacaagagtcgtaccaaatttaagactaatattttttagagaactaaatcctaatttcagtactaatacaacaagcaatatgaacatgatactgtttacaaacgaaactaggatttgattgtttgcgtttaaaaaacgcattacagtttgccccacaatgcgtccattccagtaaaaatagtcactgtatccctttttcaggatttccataaaggaactgtcagtgttgtataaatcgtccgcatactgcggtgttaataaattccatacaagtataacgagaaaagaactacccattaaaaaataaaaagctttattttttttcttcatatccgcactcaccttcatcaacattacttgactaattgattgattcaacaaccttctctataattttaattttttcatccactgaagagtcaaatttctcccgatttaaataactatgatcactaaaatttaatttagcatcaattaataactcaactttcgtatataaaaattaaacctaattgcttgatcctaacgaactgacccgattttaattgtcaggatttttacaaaaaaaccgcccatttctctataattgaatgaaccagaaacaataatagaaagggtggcttcccatcatgttaccgcacaattcaatcaaaaatcaacttcctactaaaacttatgcaactttccaataattaaaaaattaaaaatcttaccagtgctaaaatcgattggcatcactaaacttaaaggcatttcaactgccgttctgtttgtctttctttttgccatgagctttaaagacaaagctatttttcaccaaattactatctgtgaagaaactgaactgatgggtaacgataccttattttgcttcatgaacgcgcacattatatttggcggcgattcttgttgaaagtcagtacttttaccatcgtcaaattacattacctgacctctgtaactaatcatgttcgtgtattgattgtcgatgattctagctattagcgcaatcgcagcaaacaggtcaataatctagcttggcaattccacgctaaacaaactgcctacaaaagctcccgtctattgaccttaggcttttctgatggcgctagctttgtgccggttgattttgcactgttatcaagtaagaatcaactggctcaggaaacgatcgataagcgcaccgctggtggtcagcgagctaaagaggcaacaatctcgtaactgaaatggtcgcacgtgccttaaatcgaggtatctacgccacccacgttttaatggataaatggtatacgaaaccaaaactagttactcagttaaataacttaggtatttatgtgattggtatagtaatcaatagtaagactaaatatctttatcaaggacgatcagtcacatcgagaaccctttataaaaaatcagtcatcattgaccgttccagtaccatcgtctcccaagtcacggctcatttaactaatggcacgccaattcagatcgtccttgtcaagaatagccgcaaacaaagtgagcggttagcgatttctcactaccgacattgatttatccgcgcaagaaatggtcaaaacttaccgcgttcgctgggatattgagaccttttttaaagccgcgaaatcattactcatactagccaaagaaactcaagcaggtaattataatgcgtttatttgccatacaacgatcgtcttcatctgcttatatcattttagctggtaacagcgctgttcgaacgatgagcatacgctaggcggtctttttatgaacttatgtgacgagttacctgaacttgattgaacccatgcattagctgaactgtgtgaaacgtttatgcgcaagttaatttgcgtacccgtaaactaatttcaaagcaacttttgaattggtatgccacactttccagctatatcatggcttgcctacctcattgatgtgcgaaagttgagttcttaatttaagctgccttacagacttaaatcatctttaattttcgttgtcgaaataccattagttctcggcaagtaaataacctcacaataatcctttagaaaatcaaattgtcctttccaatcatcacccatgacaaacgtatcaacatgatatttcttcacatcggtgattttttgatcccaatcattttccggaattactagatcgacataacgtattgcttctagaatatatttccgatgttcataactatggtaggcttccttatgtttaaccgcattaaattcatcagtggataaaccaacgatcaatttatcccccaatttgctagcccgctctaataaacgaatatgaccccaatgtaataaatcaaatgtgccataagttagtactgttttcattacaactctcctcgctttacttgaaatattgatctatacagcctaatcagccgatttaattagcgctatcgcctgttcaaccgccgttttaatgtaaaaaccagtcgttaacttatctgccaaacgactggcagagcgtgccatatcgacatattgtgcatcagttatcgttgctaattcccgatctacatctgctaatgaatcaaccaaaatgccaacttggttctgttcaataaattgcgcaatagcagcaccgcgccagatcacaacaggcagaccagctgacaaatataatgatgctttatgcggattattatactttaagtattcgccaataagtccctttattttcatggaacttttaccgtcccatactaaaccataaccctgattaagctcccctaccaattcttctggcttgaaaaggccacgataatcactttgccgtggtaaagcctttgaatgatcatatagaccaaacaaaaccaatttagtttggatttcatctggaaaatcatataaaaattgtgatttagttaaattaccggcaaagtttaaagactgacgatgttctggtaatcgactatgcttatagtcatgatagtaatcaaatattttcaagtccacaactggtctggccaaacctttttgcttgagtaaattcgacataacagcattggaagaaataaccacatcatattgatttagatctataacatctaaatctaaagacggccgattaggcatttccgcttccgtaaaacgtaatgcgtctaggtcatggatcagcgcaaacaaatgaacgccacgttttcgtaaagaaactaataatcgattttcaaaacggcgacctagataagtaggaaattgtaataataatacatcccccttttttaactgaccaaatttagttttgatgatgtacggtgtaagtactagcttttcagccttatttctaaacttttgaacgttgatcgactcaaaaccaacttcgtttaaaaaatggtttatatcatcttttgctttggacattgcgttataactatttggttgcacaatattgatgacgtactttttcaagatgatcctccataagatctatattctaattctagccttaactgattgctgtactacttacctgcttcttggcaaatttaaatgcgacgatataaaagaagaaaatgacataatttatattatccttccaagaaaaagtgaacaacgctaatatacccagcataaatagtgaatagaagaaactttcaatcaagacctgatacagtctaaatttatcactatccaccaaatcaattgctttataaagcgacaatgcttcacgactcttatagtaaataaagataacgatcggcacaataccaatcaaaccaaagcttgccaaccaaccaccccaaatactttgaacaggataaccagtctgcaagaaaatatcttgaaattcccagttatggatcgtattcgtcggcacaaacttgaaattatagaaactagtaaacccctcaccaacaccagtaagtgggtaatgtaagaaggtcataaataaaccaactgtcccgccaagacgattagaagtaccttgttttttaaataagtaatggttcaacagttcctgaatataaggcacactaatatacagaacaaccagtaccgccagcattaataacgcaatcaaaacaagctgtttacgtcgtttaacatccaaacgtaccaacaatatcaaaatagccaataaaatgacgatgaagccagttgttgttttcgcgaaaaaaaggacgaagaaactgattgctaacagtaaccaataatatttagttgtttttaaatcaactcgattttcaaaaaaggaaaaattatatcgaattgcggctaaaaataacggtataaacacgattgccaaaaggacagccaaaaaactagcttcatttgaaaatccattcactcgatgttgggtcgtagcgtaactacccagccaataaaaatcattccggccgacgtgccgcgactcaaataatttaccgatcaagtttacccaaccatcaagaaaatgactaaaggtcgcaacaacttgcggtaataaaacaaaaatcgcaaaaccaataaacgttttgattgttccctgaacaaattttaagattttatcctgactatctaatagaactactagcaaataatagatcaaaaaaatgtttgccgcaaaaagtaccgtattcaccgagccattaaaaatgccacgtgtatcttgcggtctaatagttttaacatagctgtagccaatcattattaactgatccagcacaactataaaagaccaaaacgtgactttagaattaaaaacaatttgatcgattttagttggttgtaaccaaagttggcgacaaaagataacgaaataaagatataccggaattgatgcggcgacaaccggaattgattccccataggtctttgaaaaaagcccaattaatactagccattgtgccaaaaagtaagccccctatcaaagatatcaattagtttgatctttacgcaccaataaaccaccaataatcaattcaataaagattccgacgacaccgcctaaaataacaccatataataatgcttttttaccgctaaaagttgaagccgaaatatttttattggttgctttagtaatgaattttacctgactcgttgatgaaatagttgagatttgctgtttaaatgccgttgcaactgcattagcctgttttacggcaagactttttgagcgatctgacaattgaatactcaaaatcagtgaattgtctttagtttcaacgattgtctttttttgtagacttgcgatactgccattataggcatcgatcttcttaaggttattttgtgcaactttcaagaccttatttgaactaataaaatcttgataagttggaattaaatgtaattccccatcaacctgctgcattaaatagcgacttttttcgtgtttcggtttgacgataacagtcgattttgcagtataaataggagcataaccactctgtgcataatttcggcttaaaaagccgccaactaaagctaatattagcggaatataccaaaactttagtacgattttaattatttttttaattgaaaaattttgtgtcaagattagcatcctctcatcttagcgaatagatcaattcatcactaaactatcctaccatatattacaatacgtttttattttttcattgcacaacaagtattaatttttaattacgtttcaccttgtacaagccggctaaaattttaaacgaccattttttatctaacttggctacacttaactttagttttatctttttgcttacatatttactttgtaaaatttcagccatcgttacagaaaaagttgaaaggccgcgatgtatttctgaatacttttcatcatcattaagtggtgtgtctgctctaaacaaattcataatcaaactactcaaactgcgcagtttaaacaaaacaaaaatctcattcacagctgaagaggcagcaaatcttcgacaaactatttctagtgaattaaattgatcttgcaaattagaataacgatcagcacgatattttttataggccgagcccgcacgtgtcacatcatagtcatagaaactcttatcaattaatgtgattgtttgaatctcagccattgcatctagaacaaataaatagtcttcgcccaatttagtcggcttatataaaatattgtgtgttagtaaatattcacgccgaaatactttgttatagactctagataacaaatctaactccatcaacgtcaataacaattctggtgttaatctattagttgaactagcatggggaattcgtgtcctgattgtttgacgttcgtcaacatcacgatagccaaataccagaagatctgcattttctttctgtgcggccttgttcacttcaaataacaaatcctgttggcaataatcatcagaatcaacaaagtaaacgtattttcccttagcaactgctaaaccaaagttacgtgtatccgaaacgccactattctttttcggaaagaatttaattcgcttatcagaaagataacgactaatataatcttttgaattatcagtcgaaccatcatctataatgatcagttcaaaatttttataactctgatcaagaatactctgaatgcttttcaccaaatatttacctgtattataaaccggcataataattgaaaaaaaaagagtcgatttttgcatcagaaaatcctccttgtctaaatcagtatttatttccaattagcttctactacttcaataacgctttgatcgccttatagtctaaatccaaccgctgattatactcacgattaaattcacgttcaacagacgactcataatcatcacttaggcttactccaatttgttgctctaactcttgttgcgagtaggacttaggtaaattaagttcctcaggatcacggtaaaatccgcgcaatttgcgatactcttctaaatcgtacaaatacaatataattggtttttccagtaatgcagcatcaaacactaaactagaatagtcggtaatcaaaagatccgtagaaataaacaactcatttaaatctggatacttagatgcatcaaatatatgatcactattctcggttcgttcaacaaaataatgtccccgaaaaataaaattatacttctcattcattcgccgaaaaaaatcatcatcaaacggcactttaaaatcgttatgaccagctacttgctgatactccctaaaggtaggcgcatataatatactctttttatttggatcaaggcctaactgttgcacaactctctgtttaattgcttccttttcatgatcagatgttgtcacaagctcatagttgcgcggtaatccagtgattttaatttgttttgtatttggaaaaatatgtttaaaaatatcatgatcatattgaccagaagaaagtaaaagatcaaaactaactttacgataccaattccgtggtagaaattctaagtgagcttcatcaggtccaagatgtttcaaaggaatcccatgccaactatttatataaatgtgctcagcatttttaaaaggaattaaacgttcgatcgaagtattagaaatccaatatcttgattgaagtaatttaatgaaataccgaaaactgtcaatcgataatttttcattctcagggatttctggaaactctcctggcctttgaaacccccatagaaaagtataatccttaaattcaggatctgcttttaacattaaataaattgctttggggctatcactatattgacgccctgaataactagttaataaaatttgcttagagcggacagataccacatgcgataataaagctaaaatacaacgcataatctgaaaatagatatttccaatcaagtcactatgcttaataaaattctttaaacggctcattatttttcctttccagattaacgatcaaactgcaaaatatactgatatctttctttattctaataattcggtttaaccattcgcttcaaaaagttaccacctttaaccaaccaattttgcttttccatataaacaaaattaacttcagttgtccggtactgctcattcactgccaaccatacatccagcagccgctcactgataaaaccatagactcgcgcttcatactggttgtaatcactaatatccaaattttgctcaactttagctaaaatgtcaaatagccactggcaatattcgtcaaatggctgctgcttcataataaacatattgaacatatgagcagatttacgttgcatgacttcgtcaaaagcgtttagatacatcgaataatcctgttcaataattttacgggtcaagtccaatggttccgcatgatgagcatgaacgtagtgtgaataattggattcaatatagtaattgcgctttttaggtaagataatatcatgatctttcaataatgattctgtctgcgcctgatcaagcacactggtcaaatctttttgcttatgcaaactgagatagcgccgataatgcactaaaccaatcgcatcggcatccaaattacgccacgcccaataaatggccgtcaactcattgtaatgagcatttttaaccgaaatattatcgccagtattgtccccttgaaaagtatgattaacatccgggtgtaggtctttaccgacaaaaataggtaagtataaattttgatcttgcggcataacatagtttttatgtgccgccaccaatattttaatattcatatgtatctccatcattttatttcaaaaaaaaagtgctgatcaaattcaccagcacatttcatgttttagattaataggcacctgtatgcttgaatatactagcaatattcataaaaataatcttcaaatcaaaccacaaactcgcatgatcaatataatatagctcaacgtcacaacgttcagggtactcaatgttactgcgaccactggcttgccaccaacccattgcccctggtgtcattgataacaatttatcaacttgatcgccatattctttcaactcaggttcaacgactgggcgtggcccaactagcgccatatcacctttgaagatgttgataaattgtggtagttcatcgatcgatgttttacgaataaagcgaccaaacttggtgattcgtggatcttcttctgcaggtaacttatagctgttagcaatgtatttacgatacaattcaggatttgcttttaattttttgtcggcattgacaaccattgagcggaatttccagattttaaacggcttaccgtttttaccgatccggcgctgtttataaatcatcggtcccttattttcgccaaaacggtagataattgccatgacgagaaagacagttggcacgagtacaactaaagccaatccggaagcgataatatcgcaggtccgcttgattgctaaataagttttcgaacgtgtttgcatattttcaaggtatttaatttggttagccgtgagcagccgtgattgttgccaattagcacccacgctttcctttttctccatcaataattatcctcctaaaaccgactcgttactaaggtaaaggccgtaagcagacgcacagggtgtgttgcttcaaatttacaaagtaggttgttccaacaactcctcgtgtaaacaacaaatgtaagtatactgaattcccagttcaaaaacaagttcacccgtaaatccagcaagatacttgtcctagtatagcagtgtcagcaaacctgggcaatataaatcatagtaggttacagaaaacttagaaaactttagagcgtccttaattttctaattaagctgttcatgttcttgccaaacaacttcggcttcagcacatttaccagcggtattattgatcaaatgttggctgattaacccgtctagttgataatggctgctagcaatatctccagccattagttcatgttcatatcgaatattaacacgaactaaatcgtgattgcttagataagccatccctaaatgatcgaacatccagtcaaaataatgcacattattgacgtgatggttagcatcaatgtcgtaataccggacacgatattcttgttgttcggcattcactgtgtccacgtggtgaactcggggaaagtgcttaatacccttcatttcaggtgcagcatagggttgtactaacgctggaattacggacaccatacttcgagtttcgtagctcatcaagacccatgaactatgaatcgtcactaatcgtttaccggtagcatcctcaacccaataatcgcgatagcaaaaatatttattataacccgttgctgttgtcccaaatatcaccgtctcgtcaacctgtggcatccgctcaatttcaatctgatattgagtcacgacccaaccgacattgtagccatgaacgacttcattggttaagcctaattgatcattctggcgctcggaaactagaattgcgacgttgagtaacatcgccagtgtcatttggtttttggtatcgccttcgtaataagtgacttgatgtggttctgtgtagattgccgccacgttaatttccccctatttcattctagcatagctgctaaccggttaaaaatttaaaactgatggtatgctttgtaaaccgtttgtttggccacatcccgctgtttagcaaccactttgatggcatgcttaggatcactgccttcactgactagttgtgccacgtaatcatgcaaatctaaatcagcatatgcatcatcttcggcttcagctggttgtggattaccagcaactaagataacaaattcgccacgcggctcatgctcggtgaaccaagccagcgcttcagccagggtcccacgcaagaaactttcatatttcttagtcacttcacgggctaaaacaacctggcgctgttccccaaaacttgtggctaagctagtcaaagtttttagtaaacgatgtggtgcctcgtaaaaaatcatcgtttcagtatgatttttcagcggtgctaattcagttaattgctgttgtgatttacgttgcaaaaagccgtaaaagtaaaacggttgtggtgctaaacctgaggcaatcaaggcagtcaaaccagcattagctcccggtagcggtaccactgggatcgcctgttcgatcgcggctgctaccaattctttccctggatcactgattgacggcattccggcgtcactaacttgcgctaaggacagaccactttgcagatgtgccagcaaacgcggaattcgttcttgcgtattatgttcatgaaaactgatctgtttggtggtgatgtcaaaatgattaagtaatcgctgcgtattacgggtatcttctgccgcaatcaaatccacttgctgcaacactttaacgctgcgcatggttatatcgtctaaattcccgatcggcgttggtactaaaaataacgtacctgacgtctgagcagcaaaactgcgttgttcctgcatgcaatcgctcctatcccacaatattaagataattaaagctaaactatttcactaaaaaattagtaaaactattattatataaaaaagctgagtctcaagctcagctaaaaatcaatggcgctcaccatagataacgtccaagcaaaaagcacacggctcgtcatcgatgcgccgtgaaccatacattaggtagcaaacatggaacccttcttcatacaatttttccaagttagcacgcgatttcgacaattgtggcgtttgctcgtgttgctttgttgcttgttggtgctcaacttcctcagactggatttcctgcaaatgttcgcgtaaatgttggttttcgatttccagttctgcattgcgctctaagatttgtgtcatatctgtctgcatttcatcaatgcgggccagcatacgcttcgtatcggcctctagttgtacaaagctatcgtacagctcccgtttctccactttttgttcacctctatctcacttaattaggatagttgcttagcaaaatacactaataaacttttgctgttcgtggcgatggccattcttgtggtaaggttcaaccgcaagaatcatggctctatctcactcaattaggatagttacttagcatatattattaatgctgcttgatttcttctaaatcgtagtctaccggcacttcatggccgtctaaacgtacacgtagtacgtgcgataataagttcatgccaacaactttaccaggtccatcaacggtttgtacgcgttctccataatcaggtagcgccgcttttgcttcttcatacatgtcatcttcaaattgtagacagcacatcaaacgaccgcaaagcccggatattttagttggattcaacgataaattttgatttttggccattttgatcgatactggcacaaattcacctaaaaaggtggaacagcataattgacgaccgcacggcccgataccgcctaacaactttgcctcatcacgaacaccgatttggcgcaattcgattcgtgttttgaatacactggctaaatcacggaccaattcacggaagtccacgcgaccatcagctgtgaagtagaaaatcaacttatgtcgatccaatgtatagcgcgcgatggtcaatttcattcgtaaatggtgttgccgcaccatttgcctagcctgatgcaacgccgcttgtgcatctgcttggttgctagctgcatgagttaaatctgttgccacagcagttcgctcaaccactatttcatctaaagcaacttcttctgacgttagatcctgtgctcggacaacttgtgccagatcctgacaatggttgaacttaaccacgatctgactgccagcttgcacctgcaattgattcactgcccaatgcgactggcctgccttttgaaaccgaatttccataacttccatacacgcacccctacctttctacttcacaattaaggacatttactagccaagtacgctagtaaattttgatgttacggacgatggccattcttgtggtgaaaagcgtgccgcaagaaacatggctctacttcacaattaaggacatttattagccaagtacgctagtaaattttgatgttacggacgatggccattcttgtggtgaaaagcgtgccgcaagaaacatggctctacttcacaattaaggacatttattagccaagtacgctagtaaattttgatgttacggacgatggccattcttgtggtgaaaagcgtgccgcaagaaacatggctctacttcacaattaaggacatttattagccaagtacgctagtaaattttgatgttacggacgatggccattcttgtggtgaaaagcgtgccgcaagaaacatggctctacttcacaattaaggacatttattagccaagtacgctagtaaattttgatgttacggacgatggccattcttgtggcgaaaagcgtgccgcaagaaacatggctctacttcacaattaaggacatttattagccaagtacgctagtaaattttgatgttacggacgatggccattcttgtggcgaaaagcgtgccgcaagaaacatggctctacttcacaattaaggacatttattagccaagtacgctagtaaattttgatgttacggacgatggccattcttgtggcgaaaagcgtgccgcaagaaacatggctctacttcacaattaaggacatttactagccaagtgcgctaataaattttgatgttacggacgatggccattcttgtgacgaaaagcgtgccgcaagaaacatggctctacttcacaattaaggatatttattagccaagtgcgctaataaattttgatgttacggacgatggccattcttgtggcgaaaagcgtgccgcaagaaacatggctctacttcacaattaagctggttaacgaataaactgcataatcaaatattactattttaatagttgcaaggttaaacgctccaatgtattttgaaagctaacattagcagttaagtacttttgtgccgccaacgcagcttccatttgcgttaataattgttgattagtaacattctcagcccattttgataattgcgttcgttgcccaggaaaactcaactcagtatcgcggccaaaatgtaacgccagcacatcctgtaataataataaaatcagggccagcacttcattttgaattgctcgttccttagctacaggtaccaaattggcttgtacatcaacaaatgctaacggattattttcttgcacgtggccaaaccactgccagactttctgccgtagcggctcaaaccaatcgctggctagccattcctgagctgtaggtaagctgttagtcagtcgtgccaataacgccgcatcaaccgtattgatacctgcagccgttagttgcgcaattaattgtggccgtggtaaacgattaaattcaataatctgtaagcgtgaaataatcgttggtaaaatctgatttttagctgttgtcgtcaaaatcaagtaagtttgcggtgcaggttcctcaagaaacttcaataagccattggcagcgctgaccgtcattttatcggcatcttgaatgataaatacgcgttggttagtctccataccgcttttggtcaattcttgtttcaaaaagcgaatttgctcaattttcagactctgcccttctggcgccactttgacaacatcgggatgattgccactaagaattcgctgacactcactacaagtaccgtctggcataccatccaccacatgagtacaaaataaccgcaatgcaacccatgtagccagctcacttttaccagttcctgcgtcaccactaaataagtagccttggcttaactgctggcgcgcaatcacacttttaaatagtgctactaagcgtggctgcaacgtttcaatcgtcaatgtcatcgcttagaaacgatgaaactgttcgactggcaaaacaaaaacagtcgcaccaccgacctggacttcgaccggataagtactttcgccaccaaccgtgttatccaagctaaccggtggtgtcataaattgttcgcgtgtgtgcgacgtctctttgataatcttcaacacttcatccacccgctcatcggcaatcccaatgataaaagttgtattgccggatttcaaaaaaccgccagtcgtcgataatttagtggcttgaatattagcgtcaacgaattccgcgctcaagcgattgctatctttatcttgcacaatggcaaaaatcattttcatatttaaaactcctcctatattaaggtactgtcaaacgtacctcgtttttgttattaatttccgaatattaaaaaacacccgaacgtctttttctggtattcttggtgtgcgaacaacaagaaaatccagaaagaaggattcgagtgcatacaccattaatagcctatttag

SEQ ID NO: 642 - DNA, 11314 bp, Unknown
  Metagenome-assembled genome
tcttcgtggtagttggttttgatgaacggacaggaaatgcccgttttttgttcaataataatatacaaaaaaatctgtcattaataatagattaaatctattaccaacaacagatattgtacagccttttaattgttacaaattgtataattcaattgaaggtattgtattttgcagttattttctataatatgtttcttgacatgaaaaatgttcgaatgtaaaagtgaggaaagtttcgatgagtaaattaataataaatggtgggaaccgtctttctggagaggtgtcaattggcggtgctaagaatagtactgttgccttaattccagcggccattttagcagatacgcctgttaaatttgactcagtcccagacattttagatgttcataatttaatgttaatcttaaaatcaatgaatgtttcatcagtgtttaaaggtgatgttttgacgattgacccaacgaatattgtcgaagcaccattgccaagcaaagcgattaaaagcttgcgagcttcctattactttatgggggcattactcggtcggtttcaacgggcgactgtcagctttcctggtggcgacaatattggtccccggccgatcgatcagcatattaaggcgtttaaagcactgggggcacaagtgagtgaacatgatggtaccgtttcgattaccacggggccaaatgggcttcatggtgctcagatatttttagacatggtgtcggttggcgccactattaacacaattttggcatctgttaaagcaccgggaacaacggtgattggcaacgccgccaaggagccggaaattattgatattgccactttcctcaataatatgggcgctaatattcgaggcgcgggcactgatgttattcgaattgaaggtgtcccaaccctgcaggctaaaaatacacatacgattattccagaccgaattgaagctggtacttatttatcacttgccgccgcagtcggtgacggtattttaatcactaacattattcctgaacatttggaagcgtttgttgccaaattagaggagatgggatgtgatttgacagtttatgaagacagcatctatgttggcccttcgaatcatttaaatcctattcgcatcaaagtgatgccatatcctgggtttgcaaccgatttgcaacaacctgtcacaccattgctgttcaaagctcaggggcgtagtattattattgataccatttatcctcaacgaattaaacatatttctcagttaactaaacttggtggtaagatcaagtcggaagatactgaagaaggcattattgttgttgataattcaccccatctagttggagcaaaagttgatgctggcgaaattcgtgctggtgcatcgttgttaatcgccggactaatggctaagggaactacagaaatctcacatgccgaaaatattttgcgtggctatggcaacattgttgacaagctcacaggcattggtgctaatgttaaattggaaattgaagaaagagtttaattgttattgattgaatatttcttttatggtaaactaacaaggttgactaatcgataatctctggatcatcagattggttcagggcaaaggagcgatatatattatgaaaaagggaattcatccagaataccatcaagttgtgtttcaagattcaagtaccggttttaaatttttgtcaggttctactaagggttctgacgaaacaattaagtgggaagatggcaacacctacccattaattcgtgttgaaatttcatctgattctcatccattctatactggtaagcaaaagtttacacaggccgatggtgccgtggatcgtttcaacaagaaatatggtcttacaaacaactagcatcacttttagcgggacacttggtgcctcgcttttttgttggctttttaactttcttttgggggaatgtatttgttatgcaatgatgtgaactggggatggtggattatttggcgaaaataaagcgttcaaagcaccatagtggtttgaacgcctcctgtcttttttaaactaagtggttaaagagattatacgcgagcttttctcattgctcgggtgttaaaataaaccattgtcaggttaacgacaactaaaagggcggttgaaatgaagacaccagcatagtcgaattcagaagaaaccaccgatccaatcattggaccggcaacgtttcccattgcttggaacgattggttccaactgaatacccgaccggttacgtgtggtggggtgttttttgccaaaattgcttgaacggcaggtagcatcgaagcattggaaattccaattaggaatctcaaagcaattagttgccaaacattggttacaaacgccattgggacataaacggccattgctaaaattaaaccggcaatcagaattttgtctgttcccagtcggtctcccaggcgccccagtaacggtgcggcaaatagggtcgcaattccgggaactgcagcaacaattccactgtaaaaagttgttgcgggactattatgcataatttgtctgacatatagcgccaagatgggaacaattgagttgttagctgcttggatgatcattgttgtaacaaacattccaaagacaagtttagcgtttgacaattcgccaatgacatctttagtgtttaacattttggattttaaaacaggttgaaaatcttcgtgaaccataaatgtcgtgattaggaatacgattagaaaaagaaaacctgtaataaaaaaagtgactcgataagtaaagatggaagcgagtgttccaccaagtaaggggccaagcaaggttcctgacacgttgccagtaactaatgttcccaatgcctggccgctttttctcttaggcacttgagttgcaattaaagcgttagcattgctaatataacctgagaagacaccttgtagtaatcgaagaccaatgagctcccagacatttgtgacgagccccattaagatgaagacgatggccatacctgccgaggcacggaccagcatcaatttacgtccggttcgatctgccaatttcccccatagtggggaggctaaggccgtcacaaaataacttgctgcaaaggcaaggccactgtacaaactcaactcatcatgagtaaagttgcctaatgagtcaacatagagtgacagaaatggcataatttcgctaaagccaacgccggccatgaaagttccaaaccatagcactgctaaattctttcgccatgagtttggattggcactatttgtagccaattgttttcttcctcctaactaattttgtagtatttatgcagatgagggttaaccatgaaaaaaaatgtgttttttaaaataactattaatattgtgtttatcttactcgttttggtagcgcttgtaatgatttttaatcggccaattaaaaatcaaattatcaattcttaccatcctaaagtatccaggaaggtcgttcttcgtgctgagcaaagacaaaggcaagatacgaaacgacatcgtcataatgtcagctacaactttaaaaaagtgaagtcacttgactttgaaacagcggtcaaagcgagaatggctagtaatcaaattgaaatggtcggtcaaatattagttcctaagtctggtattcacttgcccattgggttgggtgtttcaaatacaaccctggcgttagctgccggaacgatgagaccagatcagaaaatgggaacgggaaattatccgctggctggccaccacatggtgaatcattatgttctgttcggtcccttatatttcaagaccaaagttggtgatcggatctttttaactgatatgaaaacgatttatcagtaccaagcctatcagcgtaaatttattgctgctaatcgagtagacgttgttgatcaaacgagaaagccaattgttactttagttacttgtgatgcgacgggtgctggcagactgatgattagagggaaactggtcaacaagtatcccttgaatactgcaacgccaaaattaaagcgagcccttttgaggcccgctaataattaattgaagttagtttccacgtaagccaaccactttggcaaggaacgtgaaagttgtgcgtatgtcctgccaaacttatggtcgtaccaaggatcgggaatgtcttggccagcttcgtctggcaaaatatccaaacaaagatgaatctttgcttgatcggcttttggagccatctgtttaagaaaataaacattttgactatccataccaataattaaatcggcccaagtaaaatcttcgttagttattggacgagaaatcattctggaaatatcgatgccatgttttttcatttctgcttgtgcaccaggatgaggggagtttccctcttcttcattactaattcctgctgaatcaacgtgaatttgattttccaaattatcatttttaaccatctgatcgaacattgcctctgccatgggtgaacgacagatgtttccaagacaaacaaataaaacgttagtcattttcgtaacctcatcattatattgaattaataacaatggtaccaattatttaaccaaagggcaaacttatggttttttaagttaattggggacagatggcatgaacgagagtacaataaaactagaacttgatatgaggaaatgaaactatgaagggcaatttcatttttataaacacaaatccaatctccaatatgattttatcctcgggaattagtgccgctgattatattaacggtttagaggagttgccggataacatcatacttttgaataatgatgaccaaggggcaaatggctataattctcattctaaatttaatttgattacgggttcatctgagattaaacgttatcttttgaaaaatccaaatgaacagaagaagtttattgatttcgatacagaagatagtgtaaataatctttcgccctatgagattgcggaattattgtatctggcacatatgggaacgccattgggacgaccattttcttccaagttattaaatcattatatctatctaactcaaaacgatcatacgacacgcacttattatcgtcgattctctgattttaatcatgtgctggagatcgcactcaaacgaaatttgcgtgatacacacaataccttgcgagtctttttgagaccgttagccgttaaagacgttgacaactcaatcttgattgatttaataacaaaggcaaatgatggcctctttatcctgtttgggtcgttgcacgagcgtaaccgaacttatcatatccctttgcggattttaaaaaatccggatcaagcgtcaattattttaagaactaaaacagttgttgagaacaccgactatgcgggtgatcttacatataatttgcaaaaatctgaatggcatctggattggcagaatcaagcggcgcatgtttagccgtttgttttttgctatactttgaggtagctaataaaaattggagcgcaatactaatgaaaatgacgattggtgagattgcaaaagcaatcaatgccgacacaactgatattttagatgattctttaaacaccgaagttagtggtgtttgttttgacactcgaaagatgttgcctggtcaactgtttatcccacttgccggtgcacatgatggacatgattacattgatcgtgcgatcaccagtggtgcagctgcgacattatgggcaactgaccatgttgatcgattaccattaaagattcccgcactggttgttgataatccgttaaaagcatttcaaaaattaagcaaatattatttggccaaaatcaacccgcgtgttattgcaatcaccggcagtaatggtaagacaactaccaaagatatgattgcttcagttcttgccagcacatttaatgtaacgaagacccatgacaattttaataatgaaattggtgtcccatataccttgttgcaaatggagtcaaatactgaattcctagttgttgaaatgggaatggatcgaccaggccagcttgattttttgtcgaaattagttgaaccggatgtggcggttatcacaatgattggtgaggcccacatagagttttttggaactcgggataaaattgcggatgccaaaatggaaattacccatggattaaaagacgatggttacttcgtttatgatggagatgaaccattactgattgatcgagcaaaacaggtttcggtggctaaatccacattcggtcggaaccataataatgatatttatccgattagcaccagtgatggtcagtaccaaacaacgtttaatgttaacttatggccggatgaagatgtcactattccaatgattggcgactataatgtgaataatgctttggcggcaattgcagttgctcaaatttttagaattcccaagttggcaattattaatcgacttaaaaaatttgatctgaccaagaatcgaacagaatggttgactggaaaaaatggtgaaaagattttaagtgatgtttataattcaaaccccacggccgctaaagaagtattggctgcatttagccggaccaaaacagcaggtcggcgaattgctgtcctaggtgacatgctggaattgggcactaaatctaagcaaatgcatgcctcgctctcagaaaatattgactcaagtgaaatttccgaggtttatctaataggcgaagatatggtagcattgtttgatcggttgaagccgttttttgcgcctgaaaatcttcattattatcacgccagccagctccaggatttgacgacagatttggcaagcgacttaaaagctgatgacgaagtgttactaaaggctagtcatggcattcatttggaaaatgttgttgctgctattaggggttaggagacgatttgtgcgcgattaatcataaactgttttgggtaacagggaacaggtattgttgaacaaataatttagcagtttaacccgcctattcatttctcttgctaaataaggataaacggtgtagactaaaaaagttattttgtaataaatgatttatggtcaagtggctgacgcatcacgaaaaacggatttttttctagttagctgtggaaccttaattgtttcaatttaggaggaaacatatttgaagtttagtgaattaggattatcagaccgcttactaacagctatttccaatagcggttttgaagaagcaacacctatccaggctgagaccattcctatggtccttaaaggtgaagacgttatcggccaagcccaaacgggtactggaaaaacggccgcatttggattaccaatcttgcaaaatattgattttgacaatcccaatgttcaagctctgattatttcgccaactcgtgagcttgcgattcagacacaagaggaagtttatcgtttaggtaaggatgaaaaggcaaaggttcaagtggtttatggtggggcagatattcgccgccagatcaatgccttaaaggggcacccacagattgtggttggaactccgggccgaatccttgatcatattcgacgacatacattaaagcttgaacacattaaaactttagtgttggatgaagctgatgaaatgttaaatatgggatttttagatgatattgaatcaatcatcaaacaaactcctaaggatcgtcaaaccctgttgttctctgcgacaatgccagctcaaattaagcgggttggggttcaatttatgaaagatccccatcaggttaagattaaagcaaaagaattaacaactgacttaattgatcaatattatgttcgagttaaagaatatgaaaaattcgatgtcatgactcgtttctttgatgttcaagatccagaagttacgatcgtcttttgccgaactaagcgtcgggtagacgaagtttctaagggccttgaagcccgtggttacaaagccgctgggttacacggagacttaacgcaagctcgtcgaacgcaaattatgcagcaatttaagcaagctaagattgatattttggttgctactgatgttgctgcccgtggtattgatatttccggggtaactcatgtttataattatgatatccctcaagatcctgatggttatgttcatcgggttggtcgtacaggtcgtgccggtcaacatggtgtttccattacatttgcaacgccaaatgaaatggattatcttcgagaaatcgaaaaattagccaaggtgcgaatgctcccattgaagccgccaacagaacaagaagcgtttgttggtcagcttaactcagctgagagtgacattgctaagttaatcaagcatactaatactggtaaatacgaaaaaatggctgataagctacttgatgagtatgaagccactgatttggttgcggcgttgctgaacgatattacccgtgacaatgtgaaggttaaaattacacctgagcgaccgttatcacgtcaccatggcggtggccggcgaaatggcggtggtggtcatcgtggcggtggccattggaatggttctcggaaccgtcgtaatggtgatcggaactcaagtcacaatcggagtcggcatgatggtggtaaccatgatcggaaacgtaacgatcgatcaaataataaaaagcgtcgttttaccattaaaaattcgtaatttgacgaccatgatgttcggaatttaaacttaataagggatggcttgacataaaacttttgttttgtgttcaagccgtctttttttgtgttattatatactgtaactttttatttgtgaggacacgctaatgattgctggaattggaattgatgttactgatatttgtagaataaaaaaagctgtagaacgtaatcgtcattttattaacagaattctaacttcagaagagattaatcaacttgattcgctttctgaaaaacgtcgcttcgaatatatttccggtaggttttctgcaaaagaagcttattcaaaagcaatgggatccggattaggcccgattgttaagtttcacgatttaacaattatcaataatgaggacggcaagccgattgtttcccatcacccatttgatgggaatgcctttgtctccatatcgcatacggatgagattgttgttactgaagttattttagagaatcgaggataagcagatggtgattggaaaacttcggaatgcacagctagtcattaatcaagaagcactttatgaaaatattcgacatgcaaaagaatatgctgagccaggcacggacgtatttgttgttttaaaagctaatggttatggtcacggggctattcaagtagctcgagttgctgaaaaagcaggtgcaaatggattttgtgtcgcacttcttgatgaggcactcgaattacgtgatgccggatttactcagccaattttagtccttggcattacggaccccactgatactccaatcgcgagagacaaccaaatttcactaacggttggttcgagtgagtggttagagcaagcagatcaaattttgagtgcgtcaaaaacagcattaaaactcaacgttcatttagccttggacaccgggatggggcggattggatttcaaaaacccgatgagttgaaatcagctctcgcttatttgaatcaacaagctgacatctttggttttgaaggaatctttactcattttgcgacagctgatagtaaagatgaatcgtattttaaatatcaatatcagaactttcgtgattttatggcagttattgatcatcggccaaaatatgtgcatgttgctaattccgctactagtttatggcataaaaaatgtgaaggcaatcttattcgtttggggattacgacttatggtttgaacccttctggaaacgaaataactgagttgccatatcagcttaaacccgctatgacatttcaatcaacactcatttatgttaaattggttcaagccggtaaatcaattggctatggtgcgacctatcagacgactgacaatgagtggattgggactgttccggtgggatatgcagacggtgtgccaagaaagatgcaaggcttctcggtgttagttgatggccatttttgcccaattgttggtcgtgtttgcatggatcaatttatgattaaattgcccaaaaaatacgcttacggaacgcaagtgaccattattggtacatcaggtgcggaaaaaatcactactgaagatatggcaaattatcttggaactatcaattatgaagttgtgtgtggttttagttcccgtttaaacagaaaatatgtttaagcctactgctttctgattggtttcatggtatattagatattaaagtaatcttgaatagtataggggaattaacgatggaaaaagcaacttatcaaaagcatttttcagttatcatcaatgatcgaattgccgatcgattggcgcaattttgttcaacagttggaatatccgaaaatgcagcggttgagattgcaatgaattatttctttgatgatccgcaaattgttaacggattaatgaagggctatcgtgaaatggcgaacttaaatcgtgaaattagtcatgacttttcctgttgtgaagaagacgctgatttccatttaactcagtatcgtcaaagattacagaatttccattagctttttagattcaacaatgggaggtgtgagggtgactgacgttatttttaaacgtggagacattttttacgctgatctatcacccgttgtcggttccgaacaaggtgggatgcgaccagtattgattatccaaaacgatattggcaatcactacagcccaaccgttattgttgctgcaattaccgcaagaatttcaaagccaaaaatgccgacacacgttggaatatcggcaggaaatggcattgaaagggattcagttatcctattggagcagattagaacgattgataagcaaaggctaagggataaagtcacccatcttgataattcgacaatgaataaagtcgataaggcaattaaaattagcttgggactcggcaagggttagtgaaagatcagaaatacataagatatcttctgttagcttaaacagtaagaatgatgacgtggtaataccataatagtggcattaattatctgccaattaaattaatgatttggcagcccagttgagctatgtcttgctatgctcaggctgataattagtagtaaaaaagagttccaagagcaataaaaatggttgttcgtcaactgttgttggtgaattcaaatattaaagttctaatcatttcgtgattagggcttttttagtatgaatgcgcaaaacgtagagcacacgggttcggaaacgaaaaaaaccacg

SEQ ID NO: 643 - DNA, 20717 bp, Unknown
  Metagenome-assembled genome
tattgatcgcggtagttgggtttagacctaactggcttaaaacggcttcggtattatctgccaattctttgtcaatctggacttgtacgcgtttcttttccttaactgccatgattttctcgcccccctttattactactcacattatactaatctttgagtaccatctcaattagcctgcttctttaaaagttgtgaatttaagtttgctgtcctttccgcaatggcacttatacaacgttcctaaaatgcccgtacgcgcattttaaaactcgtttaatataattatgctctatctgtttaaaacggcttagatgagcttagatgccgtttaattccaagagcgctcattgtcagtgttctgttcttcggggtgtttggccgcatattctctagccgcttgtttattccaccaaaccccaaataggttttgcatggtaccgtacaagtagttttcaacgttcttaatgtgcttctcattgcttctaagagcgttaaagtagcgtctcaaggctttggtcattaaaggcttcagctcctcatcatcaagtgggattaggaccccaatatcctgatgatccttctcaactcggtacttagcatttaagataatgccgatgaagcgacgcatttgttgtggggtacggcaccagaagctaagtaattgcacggcttcgggttctaagaaaacgggtaagccactgtcttcatcagttaagaagtcattagcatgatttatgagatcctggttttgtttttgaatttctgctggtgagaaatgagctgtggaaaagtccaacttttgagtatctatattgtatctattgttatctatatctttaaagtctttatatagattgctttcgattttcgaaatcccgctcgtagcaagggttttctggttgtctttaacgaagtcatgcggactttcgattttcgaaatcccgctcgtagcaagggttccagcgaagtcatgcggactttcgattttcgaaatcccgctcgtagcaagggatttcggcgctttcggctcatattcaccgcgtaaatagacatcggtggctttgacatcaagtttggaaaggtataaacgattcggttcattctttttagttttcggattaaatcccatttggatttgttttaataaattggctgcttgtaattcttttttgattttaacggctttttcagtagcacaattaaataagtcttgtaattcttgaacggtaaaaataaagtaaacgtggttatcttcatcaacccagttatttctcaacgaatactctagccgatctttgagtaccatataagctaatttagcgtcactgcttaaatgcttgtattgatcgccatacattaataccttagggaactggaaaaatagggctccatatacgttatcggcttcatagtaattgaaatttgtttgatccatcataaaaactccctttcttgaccgacacacgctgtctcaaaagagagttgctaaaacatttgatttgctttaaaatacaaatctgatatgctctaactgaattacaaagcgaacattggtagtgatcggctttgtagtttcaccagcatgtgtctgtttgtgagttgcccaatcggcaacttttttaatttctaacaacaaaaaatggactaaatagcttcggttagctacttagtccattgactttaatttgtttttaactatccttaacttgtcctttgagactggtttgcggtataattaacctacaaattaagaacaacattcaatcgattttcaccggcaagttaaaatcgattgaatctaagtagctttctagcagctacttgctaaacccaaaatccctgattcctcgtgaatcggggatttttctgtttagcttgatctctttattcggttgttaaattagtcttagtctagcatagcgcttaccaagcggcaactttatttggtcttgtatactttatcagcccccatcggtccgttgagtccgttgatcagatacaaggtcttcgtatcaattattgctatcaactatttgtgatttcatcattttccccactcaattattcttggaagtctctataagcattttctattatggtatctaataaggttgatcttgattttgcgttcaactgcttaaccatctcatctaaacgatcaatattcttttgttgaattgagaagcttgtctttacttttcgttcccaattcaatttttcgttaagttcatctttttgcttaacgtctctagcgacttggtaatcgttgttggtacttgaaaacttttcaaatttgttagccataggttaatcattcccttgtttttggatttctgaaaacacatcactcattagtttgataaacggttcttgctcatgtaatttgtcgttctgtgttgcatattctagtatgccttcctttgcaagcatactagcgttgactaattccttttccggtataacaccaataacattgtctatatttttaagtgcagataaaaattcgtgtgaagagttagtattatgtttgattcgattacctaaaaagaatacatcagcagtgatatatgatttaccactaacgggatccacaacttcatcttgcaaagttcctatgctttgtaatacctttgtatgactttcatatccaaagcgacttggttccattggtgaaatgattttatcggcgacagcgacgccatttttagttaaaagattccaagctggtggcaaatcgataattacatagtcatatttttgattcaattcttgagaatttttaacaaaccacataaataataacaattctctatttggttttgaggctaaacgatctgctacttcttccaggttgctagttgatggaattatcgcgatattatcctgaacttgtgtctcaattaacccggagcttggtttttctaggacatctgcaatggtgggctttccactgaaattaaaatgttcattttcaaaagtgcccgtcaaactcttctgtgcgtccaaatcgatcatcaaaactttttgatcttgtgtttgtaaaaatttggcgaactgaaatgccattgtggttttaccaacgccacctttgatagccataaaactgattacttgcataacacactttcttcctaacatataaagataaaggtaatatttaacaaataccttgttctcctaaataatacgactttaagaacacaaaatcaagataaaagtagcactagtggaatacataaaacgcataaaggtatttatttggtggtataaataggtttcaacaattagtcatacctattatctgttaacattaaatttctttcgataccttataaaggttgtccgtttaattcctgtattacgggcaacatcgacatcactcatgcctgcctcgtaaagcttaaaagcatgttgcaagcggggatcgtcttgggtgtattggggtttacgcccatgatatttaccctgctgcttagctaaggcaatcccttgctgctggcgctcaatgattcgcttacgttcactttcggcctggtacttatagagttcaataatcaaattggtcatcagttgccgtaagttgggatccgcaatccctgtcatggacggtaatttcaacacatctagggtggcacccttattttgaatggagttcataatcttagtcaaatcatggttgtttctgcctaagcgatctaattcagtgaccaggacaatatctccctcacgaatataggccagcattttttgcagttctggccgattagtgttagctccacttaatttatccgtaaataatttatcaacgccttttaaggccgctagctgtcgatctaaatgttgctctttggaactcacacgcgcataaccaattttagccattgtcagcacttccttttggacagttctaatgaacatttgtaattcctagtatagcacagaatcaaaaaaggccaatagggtatacccaaatggccaccattttaaaagatggcaaattctataattaatccgaacagaaattaaaaagcccaaagcaatcacttacaatggtagtagctaattccaaccaatatagggagtgattactttgggtacatctactttatcacgttttcaacgtggcgcactagcacaactggtcaatgaggggaataaatcttaccaagtaatggctgacgccttaggcgtcgccaaagctacgattagctatgagttggaccgggttaaaccttatgatccagaattagctcagcaagatgcagatcgcaaaaggcggaattgcggtcgtcgttcgatgctgacggcagcattagcgactttaattaccaatcacttacgattaacctggtcaccagaaaccattgcggccgcttataacttgagcactgcgtcaatttataattggcttaatcgtggctggctccccttcaaattgactgatctacccaatcggaatgtccgccagcaccgagtgagcgaaaatcgtgggaaatttacaagtgggacttccatcgaacaacggccaacaactgttaatcaacggttagcttttggtcattgggaagtagatacggtgctttctagtcgaagtgagtcacgatcatgtctggttacattcgtagaacgtaagacccgacttctatgggccatcaaagcccctaatagaacggctaaggctctaaacaccgcctttggcaagtttatgggggccttcggtccccaagtaaaatccattactgttgatcatggtaaagagtttgccaattatcaggccttagaacaggattatcagatcaaagtttatttttgccatccatattcaccatgggagcgaggttccaatgaatattttaatagacggttacgctggttcttcccgaaaaagaccaattttagccaagtaacgactgatgagatcctagcagcacttgaactaattaatcaacgaccattaaaaatacatcatcaacagactgccattgaaagattccgggcttgttcggattaaacttgtaatttgccatctgttttagttttattgtgtcttggctatattaaattataaagcctaaatgccaagcagttcgcgtataataaactagtgagtaatttaaaggtgggggaaggactgtttttatgttggaactgtcgtttgaaaaagaagttgttaaaaccttaacgaccggaagtaatcaatgggtggaacgaaaagacctatatggtgcgacgccggaacaattatgggctaattttcgtgataaattaaataacaataactatgctaaattgcagggacaccctttaactgataccgaatttaatcaggttaaacgggcgattgaggtccggacaccttacgaagcagctaagttactagccgccgaaaatggcattggcaaagttgaagtcgaacgtgatgatgctaagctgggcacggttacgctcgagttgttttggaaagcggacgttgctggcggtaaatctagttatgaagtggtacggcaagcggtacgaccacggctagctggtactcaagacgtcgaccctgatcgccgttttgacgtaaccttattaattaatgggttacccttaattcaattggaactaaaaaaagccacggtcgaacttaaccaggcttttaatcaaattgaaaaatatgcgcaggaaggtaaatatacggggatttactcgctgttgcaaatgtttgtgattatgacgccagatagtacggcgtattttgcgaatgccgaaccggatcgtttcaacaaagcctttttgtttaattggcggacacgggataatcaccccgtggaaaacggcttagcgttcacgcgccaagtccttaatattcccatggcccacaaaatggtcagtgaatatacggtcatcgaccaagaacgtcagagcttaattctcttacggccttatcagatttatgcgattgaagccgtgatgcaccggattcatgaccatcaagatggctttgtttggcataccacgggttctggtaaaacactcacctcatataaaaccgctaaattagctgcgcaagatcctggtgtcgataaggtcatctttttagttgaccggcgggatttagatgaacagacaactagtaactttagtgcctatgccgccaatgatgatattgccattaacgaagcccaaaacaccggtgatttaatgcgtaaattgcaacaaaatgacggtaaagtcttggtcacctcgattcaaaaacttcatcgggcggtcaaaaaaacgcaagcccagctggcaaccggtaagcaatcccgctttagtaagactttaaagcaacgggtgatcttctttgttgatgaagcccaccggtcgcaatttggtaagatgcaaaaggaaattcgagcagcgtttgtcaatagtaactggtatggttacactggcacccccatttttaatgaaaataagaaacagctcaaaggtgatctagcagttacgacggaggagctatttggtaaagtctgtcacgtttataacttgcgagatgccttagaggaccaagccgtgttaccgtttaatgtggaacacgtgacaacgattggtaaagatacgttaataacccgggccctcgagaaagaaacccagcgcgtcaaagcacgtcgcgataagcaaggccgcctgctgagtacagctgatgaagcaaaaattcaagccaagattcaagcgatgtcagtcaaggacttggaagaaacgtatttatctccggctgactttgagaccgatgaacatattaaccaagttgttcaatatattttacaaaaaggcccgcgtaaaacgagtttgggtcatggcaactacaatgctattttgaccaccagttccattgaaatggcgcaacgctattatcaagcctttaaagccgcgaaaaagactactcacaatcagctagatcctgattggccccggattgcgattacttattcattaagtgaaaacgaagatcagagtgcgcaaaaacatgaccaaatggccaccattttaaaagattataatcagcagtatcacactaattttgatttagccgatctgaatctctataacgaagatgtcgcaaaacgggctgctcggcgtgaggcggtctttgctcatttgaaacccgatcaagaaattaatttagtgattgtggtgcggcgattattaacgggatttgatgcccctcggctaaacacgctctttgttgaccgcaccttagcttatcaagaactcattcaagcctactcacgcaccaaccggctccaaaaccgggaattaaaacaagaaggccaaattgtgacctttcgggtgccagcaatcatggaagcgaatgaacgtgaagcttataagttatatagtggcgaaggctcttttaatgtcatcattcgtcccacttatcagcaggccgtcttaaaatttcaaaaggctgtggtggatttaaaagccattgctcaaacgccgacggcggccgatgacctgaatggaaccactgccaaggtacagtttgtgaaagcctttcgccaagtgaatcagcaattgaattccttatccatgtacaacgatttcacttggaaaaatagtgaaaaggcctttggtattgctcagcccgaagtagaatcctatacgggtaaatatctgcggattaaagcggcggttactaaccaagagcctgagaaagtccccgaagaattagctgccttagacttttccttggccgttggttcagtcgtcttggtggattatgattatttgacgcaattaattcaagattggattgatgaacagcaacggtacgcgacacccgatcaggcccaagcgcatatgacggattacctgcaaaatagtgccaaggtccaggctagtttgaataaattggcggaaacgcaaccgcaacaggcccagttaattcgcgaagccatgccttatattgagcaacaactgcaacagtcgcagcaacagagtggtcaaaatcaagcgccagtggcgttgaatgctcgggagttggtggctgattacgcccagaaacaattggtccaaaaaacgacgacctttgctcacacgtggggcttagatcaagcagccctattgcgagtggcgcgtgaacacaccgtgggaactgatgaatggcatcatgaacaagaattaacgcagtcagcgaatttagcagcggccttacaagctcaaactgccaatggaccgaagattccagctgttttgccactataccggattaaatcccaggccgcttggcggcagtttattgaacacgatttagcaatctatttacaaaaataagtgaggttaaacaatgtcagaaaaaacaacgcaagctagtcagcttgaaagtgccctatggagtgcggccgatgtcttacgcgggaaaatggacgcttctgaatataaaaattatttattagggttaattttttatcggtttctatccgagaaaaccttaacgacctttagtggatgggcgggtgaaaccgaaaatgtcactcagaaatatgctcaatatatggatcctcaatttaagttggaaggcgtctcggtgcagcccagtttagttgagtatttgcaaaacacactcggctacttaattcaaccacaagcgttgtacaccaccctgattggcaagattcaagcccatacttttgcgttagatgatttatcccaagcacttcatgatctggaacagtcgacccaaaatctatcgtcagcacaagacttttcgggcttgtttgccgatgtggatttaagtagtaataaattaggcagttctttacaacaacggaaccaaaccattagtgataccatgttagctttaaatgcgattgatctcgttcatcatcaaggcgacgtcttaggtgacgcctatgaatacttgattgcccaattcgccagcgattctggtaaaaaagcaggtgaattttataccccgcggcaggtgtccgacattattgcccagattgtaacctatcagcgcaatgcaggtgataaccaagtgcggactatctatgatccagcggtaggttctggctcgctgctgttaaatgtcggacagcatgtgcaagatcccagtttagtgagttatcacggtcaagaattaaacaccacaacctataacctagcccgaatgaacttaatgttacatggcgtctcgtatgacgatatgcacttacgcaatggtgacacgttaagtaaagattggccggttgacgaaccttacttatttgatgcagtcgtcatgaacccaccctactcggcacactgggataatagtgacaaacgtttgtctgatccccgcttccgcgactatggcgtcttaccgcctaaatctaaagccgatttcgcctttttgctacacggcttttatcatttgcaggagcacggaactatgggcattgtcctaccccatggcgtgttatttcgaggggctaaggaaggcaaaattcgccaaaagctcctgctggataaccggattgatgccattattggactacccgccaatatttttcattccaccagtattccgacattgatcatggttttaaagaaacacaagaccactgacgacgtcttgtttattgatgcgtcccgggaatttgaaaaggacaagaatcaaaataggctaacggcagcgaatattcaaaaaattgtgacaacttatcaaaaccggcaagatgttgataaatatgcccatgttgcttcgatggcggaaatcaaggagaatgactacaacctaaatattccacgctacgttgatacgtttgaaccggaacccgagatcgatctggaccaagttaaagctgatctgaagcaattggacgaggaaatcagtcagaatgaacaagcctttaatgaattagctagccagttagtagccactcacgttaatgatcagtcaaaatcggaggaccactaatgaatgctaaacaagctaaatatccgcaactaagatttcctggctttacagacgcctgggaacagcggaagttaggcgatattctcaaagaattcactacaaagtctaaaactgaaaacgaacatagaattctatcgagtacaaactcaggaatggagtttcgagatggtcgtgtttcaggcgcctctaatctgggatacaagatcataaaaaacggagatttagttttatctccacaaaatctatggttgggtaatattaatattaataacattggcacaggccttgtatctcctagctacaaaacatttcattttataaatatagatagctcatttataaatccacaattacgtactcaaaaaatgttggaagagtataaaaactcttccactcaaggagcaagtgttgtaaggcggaatttagaactagattccttttatcagattaaaatgtttgtacctacaatttccgaacaaataaaaattggttcattctttgaacaactcgaccacctcatcacccttcatcagcgtaagttagctaagcttaaggaacttaaacagggctatttgcaaaaaatgttcccaaaaaatggtagcaagttcccgcaattaagatttgcagggtttgctggcgcttgggaacagcgtaagcttggtgaaatcgttgaattttattctggattgacatattctccagataacgttcaagaaaaaggtacgtttgtactacgttcttcaaacgtcagaaatggtgaaattgtcgatgcggataacgtctacgtttcacatgatgttgttaattcttcaaatgtgcaaaaaggcgatattatcgttgtcgttcggaatggatctagggatttgattggtaaacatggccaaataaagcaccaaatgggcaataccgtcattggtgcatttatgactgggattcgctctgagacaccagattttaccaatgcgatgttggatacacaacaatttgccattgaaatcaacaaaaaccttggagcaacaatcaatcaaatcacaactggttcattcaaaaagatggcgttcgttgttccaataaatgtagaagagcgaaatgctgttggggctttcttccgaaacatcgatgaccttattactcttcatcagcgtaagcttgaaaaactccaagaacttaaaaaagggtatctacaaaagatgttttgctgattattaatttgatcaaatttaggatcctatgaaaccccatgacttaatttttattgtgcttggtcaatacttaattcacttgtataatggattacgcaggaagttttaagggcggtggctgtcttttcccttgcgaggtgaggcccatgggaacatggaataatcttcaggaaggtttcacagtcaatgagcgtcttccagacactctcgttgatgttgctgtttgcaatgtttattttagcgttgctaacatacatcgacaaaaggaacaaataaaaaagccgccctgcgtaactttggctaggttacagggtgactcaactatcattttttaactaatgccaccgcctttgaagcggcttgcgcgggaagtcttgttagcgcaagacttcctttttctattacattatagcatgtcccttaaaaactggctaacgttttaggctttgatcaggttcagaatctggttgtttgatttctggattctgttcagcaaatgctttcagctgcttttgcgttcgctcactgatttcttggtgcacatcatttaatttattttttagttctgatttttgttgtgggttctttgcttgcttaatttgttgttgcaagccttgataggacttattaagatcctgggctgatagcttttttaaatcatgctcaggctctttttgtgcttcttgtaagcctaattgtttggttaagccatcgctaagctcaatcactttgttgctaacttgctggatttcacttaaagcactatggatcaccgctttatctttggcccaggtagccacataaccaagtgagtagttactggtatcaacaccaatattttgcatggcaacatacgcaaccgcttcggcttgggtttcctgataggctcgtggccgatctttaaaggctgattttaatccatgtaactgactatgtgcatattcatgatataacgtcttcaattttaaagcattatcggattcatcaccaccaataacaatttcattagtgctgggttgaaaataccccttagccccctttagcgtcgacaaaggcacttcactgaccttaaggtcggtttgctggtttaaataatctttgaatgcgttatacaagctcgtcacgttctgatggtcggctaaattttctttgacaaaatccttggcacttaacaccggctcaccgctagtttgtgatacgtcaaagacgggtagataacggtaaccgacaatggcgcgttcatcggtggtatcaagacgctttttctcggctggtgttaacttcttaataatcggggccgcaatccgaatcgcttttgcgccccggttgacggtgcggttaaaagccttctgccattgcttaaagcctgcgacttgagtggcttgcggattttgcgcataaatcaaatcaatgtttctagcgctataatgatgaaatttagccagggtattaagatactgtttaaatcggtcactatcggttaattttaggatttgttgttcggcttgggcgactaattgtgctttccaggctttaacgtctgctttactcggcattgtctacccctcctcattttcaaaaatatcattcaatataggggctacgttgatttgaatcggggtcgtgccataaagggcgatgtagccatcagctaatttttgccaagccacttgataataggctccgttaccagtgatttcttttaaatacttgtaggttcctttagcctgtaaaactggtaattcactcccaataactgctaatttattatccattttatgatctcctttgctttgctaatctcacccgttgttcgggtttacttttagggttgtaaaagtgaacctaaatgacgggttcaccaaccggaacgtagtgcagggcggtaggcaggttctaatcaaaatcaaaacttaatttgtggccgtcaagctttaacttggcgtcaaacaactttccttttttgctcttgaaaccctttaatttgctcgtttcccccttggtaactaacgctttaattgcggtcttcccgagcgtcttgctactccatttcttaggtaaggtaaaatcttcaccttgcttgggcttcacaatgtaaaacttctgtttatttaaaacggtcgcttgcggtgtttctaagaatacttcggcggctttttgcgcttgctgttggtgattgatttgttgcttaatggctgaactgccagtcaattgcgcggggacctcagcaatcaatttttccacgaactttttgatttggttcaaaaagttatccggggtgcgttcttcggtactgatttgttgtaacgcttgctcccattttgctgtcatctctgggctagttagcaagggttcgagttcgaccgctttacataaagtagttcccgcttcactgacgtggagcttgttcttttcagtaaccaaatagccgcgtttttttaacacttccagcacattggcccgggtcgcacttgtcccaatgccttgcacatctttgagaatcgcctgggcttcttcatcatcaagcgttttaccggccgtcttcatggctgtgattaatgtcccttcggtaaacggtactggtggggtcgtttctttttgcggcgtttgcagatttgcttgaacttggtcgccttggtgaacgatcggtagggtggctgcctctttctggtcggctttgtgatcatcaaataaaacttgccaaccttgcttagttgggaccttacccgttgctttaaaattggcgtcgccaacttgggtaataatgatggtttcttcatactcgtaaggatcagcaaacatcgctaacgtcgttcttaaaactaaatcataaacctgttgctgtaatttaggtaagctggctagtttctctttcgtcggcacgactttagtcatgataatggcgtagtgttcttcaaccttctttccattaacatagcgcttattaggggcgatattggtttaaagcgacttgcttagagacaaccccagataatcgtcaggtagccactaaaacaaattcttcattcatgatgtaagccacaatcggtgcgggataattaaggtacttgcttcgtataaaacctgaatggccgctaagggtttgactggcgctgggcgtggataacgtttattcatggcatctaggagactggatagtgaggaatagttagggactagcacgtttttagcctggtttgcatgccttgataattaaaaccagcctgtgaggcctttctgcaacgggtttagcttgcatgaataaaaacgtatcacgccagcgccagcaaaccttagcggccattcaagtttatagaagccaagttctgagttatccccgcaccgattgtgcttatatcactgatgagaaatttgatatttagtggctaatctgacgaagtatctggggttggctctaacagtcgctttacacaatacccccaataagcgctatgtaatggaaaaaggttgaagaacacacgccattatcatgactaaaatcgtgccgacgaaagaaatagctgcattcctaaattacagcaacaagtctatgacttggttttaagaacgacgttagcgatgtttgctgatccgtacgagtacgaggaaacacattattacccaagttggtgacgccaattttaaagcaaccggtaaggtcccaactaagcaaggtggcaagctttatttgatgacaaaaccgaagccagaaagacaaactttaccgctcgttcaccaagggaccaagttcaagcaatctgcaaacgccgcaaaaagaaacaacacctccggtaccctttaccgaaggtacctgattacggccatgaagaacgcggcaaaaaagttgatgatgaagaagcccaggcgattctaaagatgtgcaaggcattgggacaagtgcacccgggccaatgtgctggaagtgttaaagaaacgggctattagttactgaaaagaaaatacgtcagtgaagccgggttactttatgtaaagcggttgaactcgaacccttgctactagtccagaaatgacggctaaatgggagcaagcgttacagcaaatcagtaccgaagaacgcaccccgataatttttgagccaattaagaagtttgtggcgaagttattgctgatgtccccacaattaaccggcaatagccattaagcaacaaataatcaccaacagcaagcacaaaagcgccgagtcttcttagaaacacccaagcaccgttttaaataaacagaagtttactattgtgaaacaagcaagggaagatttaccctccaagaaatggagagagcgaagacgctcgggaagaccgcataaagctggtcaccaaagggaaacgagcaaataaagggtttcaagagcaaaaaggaaagtgtttgacgccaagttaaagcttgacggccaaaattaagttttgattttgattagaacctgcctaccgccctgcactgtttcggttggtgaaccgtcatttaggttacttttaaaccaaaagtaaaccaacaaaagggtgagattagcaaagcaaaggagatcatgaaaatggataaaaataaagtcattgggagtgaattaccagttttgcagctaaaggacctacaagtatctaaaagaaatcactggtaaaggagcttatatcaagtggcttggcaaaattgctgaggacgttgccctttatggcacgacctccattcaaataagatccattgccaacattgaatgatatttttgaagatgaggagggtaactatgccaatataaagcagatgttaaggcttggaaagcacattagtgcccaggctgaacagcaaatctaaaattaactgataggaccaatttaaaagtatatcaataccctggctaaaatttcatcgttatagcgccagaaaaacattgattatatttatgcgcaaaatcctcaagccaccaagtcgccggttttaagcaatggaagcttttaacgcaccgtcaaccggggcaaaagcgattcggattgcggcccgatcattaagaagctaaaccagccagcagaaagcttgataccaccgatgaagccgccattgtggttatcgctatctacccgtctttgattgtggcacaaaactagcgggaccagtgtaagtgctaaagactttgtcaaagaaaatttggcgatcatcagatgtgacaagcttataacaaaagcgtcaaagattatttaaatcagcaaaccgacctataagtcagtgaagtgcttgtcggacgctaaatggggctaagggtatttcaaccagcactaatgaaatcgtcattggtggcgatgagcccgacaatgctttgaaactaaagacgtttataccacgaatatgcgcatagccagctacacggctaaaatcagcctttaaagatcggcacgagcctatcaggaaaccaagccgaagcggttgcgtatggtcgccatgcaaaaatattggggttgataccagcaatactcactcggtacgtggcactgggccaaagataaagccgtgatccataggctttaagtgagatccagcaagtgagcaacaaagtgattgagcttagtgacgggtgttaaccaaacaattaggcttacagaagcacccaaaagagacctgagcatgattaaaaaagctatcagcccaggtcttaataagtcctatcaaggcttgcaatgcaacaattcaaaagcaaaactatccacaacagaaacacaattaaaaaaacagttgtaacaggaacaagaaaatcaggagcgaactcaaaaacacaactgcaagcatttgctgaacagaaaaaatccaatccgaatcaaacaacctgatcctgaaacttgatcaaagtctgaaacgttagccagtttttaaaggtcatgctataatgactagaaaaagggaagccccgctggaacaggacttcccatacaaccgcttcaaaggcgggtgcagaatttaaaaaacattgtcgctcgtcctgtaccacccaaagttacacagggcggcttttttatttgttcctttgtcgatataggagagcgcaagtaaaatgccaaacagcaacatcaacgagagtgtctggaagacgctcattgactgtgaaaccttctgaagattattccatgttccatgggcctcaacctcgcaagggaaaaagacagccacccgcccttaaaacttcctgcgtaactatttcaggtgataaagtattgaccaagccaataaaagctaagttgtgatgatgaaatgattttttttcatatactcctaatttaatcaaggttgtttataacaaaacatttttaacatctcattatctaattgtgcttcggtacaggtttgcaaatctttacaacatgatactcactcaaaaccaggacagattataatgattttggtaccaaatttcagtataggaagcaaaactgccaatgagattagcagtctaacctcagtcaaggtatcggtctgcttggcggcaaagaactgccagcgatgggttcctgccgctagtgccagcaaaacagctagtgcgatggggcacctttggttgggccaccataaccaaaacagtccgaagaagcaatatgatggcaattatatttggtttgagtgaaacgccaggtgagtcaggcaatcagtagaaagtctaagaagtcttgtttttaattttgtagctgaaagttttttgatataaggttcataaaagaatgatagctatccaagcgacattacccgggtaaccaatttgaactaatcgatatgatttagaaggctgtgcgccatgcaacgcgatccacaccaggttgatatctacgagatctttaatgccgttctccatattctccgtactggaggtttcaatagcgcccaaggtacctccaaatggcaaaacggttttaaggctattccggcagctggttagaaactgtttgagatcttcaaaacgcgccgcaatagaacatgacattaaaggctaaggtatcatcatagcgtcgtatgtaatgggatccttagcgttttggtattgtatttactcaagagattttcgacaacttctaagttcttcataggttggtgctgttgttatattagcatgctttaatgagctttatttagatttgtcgaacacagcttcccaatctggtatgcctgtgaacagggggtccacagcgtgacgcaaattggcggtgatatgataagtctaagtcgtctagacattaatagtcattttattaaaattgcggttgcaaaaaatatcatttcgttttcaatctcacttccatagttcccaataacggtggcacacaagtagcaactgctttctttgtcagcagttaattaatgtgagttttactgccatttggaaaatatggttatgtcgaacactgtacttgtacggattaaagtgagaaaaaccagcgttttctgtctgtctttaaggcaattagcccagttctagcacagaactataaattgaaaacccttatatactgggttcccaacgatccccctaaaccggcacgctgccccccacgacattcatccggtatccgccttgtgtgtgtgtgcagtagtcctaagggtagggttatgtttttccaagtaatctatggtcagtctcaaaccaagtcacggcggcagtatctggaaagtcgtatgcatgaatctaaactgaaattgcaccggccgcaccagtcttgggaccaagctacttctaataattgcgtattgggctgaacccagtaacaaattaaggacagtatcaaaccgacgttcatcagtatatgcccaaatctgtagatttaaattttaccctagtagcaggctaacaaacactcaaaaattagtgcggtcaagtcagtactgttactcgatttgtgttagttctggtgagcccatagatccaaattcatttccacttggaaagaatcttactacgtgtgatatagcgtcacgttaattttcgtcgtaccattgctcggccatctcaacacgatatacccagccccgatgagggcccggtgtttttagcttttgtttagatgctgtatctaacgacaaataatcagacatgtgtggtaaaacgtgactctgtactattgttttcttggggatcattaaatgaaaaaccttgaaaagcgctactttaggaattgtcccgtggcaactgatcattttattatgatttataagtaacagcaccattcgatgcgaacacctgacacgaaatgattttctggtatattgagttaactaaaggtgtttaagtcaaaactcaattccaagcggcctctagcttcttaaagccacggtgagaaagtgaatgccaatctggtacttctcggaatagcagcatatggaaaaccaacaaatggataaattagggtattcgtcggcaaggattattttaacttgtagtgtaggctcacatctctttgctgattgcgcttgaaattacggcgtccggctaccgccaattacaatagttgtttctttttaactgtcctaaatcgatctcctttgatttaagggacaacaatatagaggatgtctatttatatatagacgatgtaacttgatgtgtcaaggaggagaaaaaatgaattataagattatgctatgttatcaaagcaatgggcgacgcaagtcgccttgaaattctcggacactttatcttgcggttaaaatgcgtgcctgccgatattttagacattttgattttaacccaacaacccactttctatcatagtgaaggtatacaaactggcggggatagtagagcacacaaaagatggcaagtggcagcaatattcattgaattcaaaaatttataacaaccgtttcctgaatttacaccaatcaactgttacaaagtgaggaaatctgtgtctgccatccaactgttatgaagataaaggctgcaacaaaatgcaacttaaagaaaacaacggtgttgatgcaatggaagtatttttggctattttctattttttgcttaccttaattttagtcattggacaacatcgtgccatatctatgggtggtctgctgtggtggtgcagttagcactggtttttggcgtagttttttaatgacgtgggaacggtaacggtattgtatggaatgctacacttcattgtatccattgatttgactatcgtgattctcgatcaaattggatctttgaagggccagcttttacatatggcacaattagctgtttaacggcgttatgatgttatcctaagtgctgtttctaggtactgtttgtagcagctttatttgctaatgatgttgtgctgcgcttatcgactcctattgcttttatcgatggttagagctttaagtttgacgataaaaaattttccattcatcattgctatgggttattgctgatgcaacttcattgcctttcgttgcagcaatcttgtgaaatgtctcagacagatttcgttcggttttacatctcagaatatggcatgtacgcatgtcgggattttttcccctgattaatttacttggtatagcattcgattctttatttatattcgaaaagctatctaaagagtttg

SEQ ID NO: 644 - DNA, 9445 bp, Unknown
  Metagenome-assembled genome
gatgccattgttcatcacttaattcatagcgacgtatctccatcgtgatcaatcctttatttttagcatatcaaactggataccatgcagaaaagtttaacgcctgtagtttgaagacactacctagcttcagctcttaaactatcctgcattttatgtgccctaattaagcttcgaaaatgggttgctgcttctgtaaattggtcatcggtcaaaacctcagtattaattggcaatgccacactccccacgcaatttcgaaaagtatgctcattcataatgccggatcgtaaatcgctcgccatattggtgacaattggctcggaaatatcggggtagattcgttgaatagcctgactaaccataattgaaacggcaatggccggtgtcgcatcgtgtgccttggcatatttcataaaacttgcctgatcaataaccagttcatgacgatagcttcgatcatttaaatgatatttcgtctcaatcaattgataaccatgatgatcaatttccggaatgtcagcagaattggcgttcactggtggtaaatattcaaatggttcactaatttcatctggttccatcggatcgtcatctaaattaatacctggaatttctggaaaatcctgattcttaatagaaaaataatcatacagcaacgtgttaacaaacggcatgatgccacggccgtccgccaaagcatgatggtatgaaataaataaacgttgctgatcaaaggtgacatcaaccaaatgagagttggtctccggcccaccgagtcgccgcaattcgtcagttttagtaaccaccattggcagctcgttataggctaaaaaataactgctgttttttagaaccatcttactgattaaatatggataacgcttaagtgcttgatttaaagcttgctgaaggattggctggtcaatggattccgttaatcgaatatcaatcaccatgctgtgagcaccctgcttaccatataaaaaagattgaccagaaattagtttatcaaccttagtaagtgctgcaagataagctcttccattcactgttttaaaaatatcttggtaggttgcgtcaatagttgtcattgtcataatttgcactcctttaaatttgtcagttagctcgttgtttgagattgcactaactttacaaaagaagtgttaagccgttgtttataaaatgtttgagaaatgttaattggtaaacaacatcaataaatccattgtgttagatcgaacgataggcccataatggtatcaattcttatagtaaaggagtttgatttatatatggcgaatattttagttgtcgaggacgatcctcagttcaaccaaatcgtttgcatctatttgaataaccacggtcaatcagctcaaggggtcttaagtgtgcaagacgcttatgacaagatgtataaccaattgttcgatctcattatttcagatatcatgatgccaaacattgatggatttgagtttgccaaaaatgtccgtgaaatcaatccaggaatcccaattctgtttgtcaccgcgcgcgacgacattcaatccaaacgacgtggctatgaatctgggattgacgattacatggtcaaaccaattgacatggaggaactgctaatgcgagtgactgccctgttaaagcgagcaaatattgctaatgatcgccagctaagcattaataatctggtaatgaatgcggattcaatgagtgttgttattggtcaacaagatattccaatgactgttcgtgaatttaatattctattcaaactgctctcttacccaaataaaacgttctcgcgatcacaattattagacgagttttggggaattgacagcacaactagtttacgagctgtggatgtgtatatcacaaagattagaactaagtttgcaacttttgatgcattcaaaattgtaaccgtccacggattaggatataaggtggtcttaaaatgagaaagcagcgaaacatttcaattgctggatatttgggtaccttcgtcatttttgttttcttcgcaacattaccaatattcttatatggaaataattcccgtaatattggcagcagctacctcaaatggtacgttttatactggattgtagtgtcagcattctttatcggaatcattgcttatcaaaaacacatttcatttgatgttccgcttgctcgattaagcaaagctgccaaatcagttaccaagggtgatttttcaatttatttacaaccaattcattcatctaaaaatcccactgagattgataatttgtttgaagatttcaatacaatggtagccgaactaggatccaccgaaaccttaaagaacgactttattgcaaacgtttctcatgaatttaaagctccgctggccgttatcaaaagctacgcaaatgcgcttcaaaacaattcaaacaactcccatgcgcagactgatcaatatatccaaataattattgatgaaactgacaaaatggccaccttaatcactaatgttctaaagttaaacaaaattgaaaatcaagcaattcatccaacaatgtcaacttataacgtcagtcgtcaactcgttgagacaacattgacgtttgaatccatatgggaagccggccagatttcactcaaagttgatattccagataatctgcaggtgacagcagataacgagatgatgaacattgtttggcagaatctgttgagcaatgcttttaaattcactttggcaggtcaaagtgtctcaattaaagctaaaaccgtagctgacgggattgaagtttcgatagccgatactggtgagggaatggatcaagacacaatcaaccgaatcttcgataaattttatcagggtgacacctcacattctcaaagtggaaatggattaggattagcgctcgttaatcgaattgttagattaatgaacggcacgattagtgttgaaagccaagtcggccacggcagcaaatttaccgtttggctgcccgacaataactcggatagttagtttctaataaagataccctccttaataattaacatttttcaaacaacaaatcgaattctttccggtaatatggaactacaagctacgacctattctttataggttgtaaatcctatacagattggcgagactaatgatgagtaaacattttatcggctatgaacaccgtgacatcctaattgataaaaaatatgttgatatttactccgacgcttaccctaattttgggtggcagattgaacgaaaaggtgctggtaaagaacatcatgacaagacactactaaaaatgaaacgtgatcgaaagctgattaatcagactgaattaaaacggcttcagcgtaaatttgagtcaaagatggcaaatattgaaaaacttgaaagattaaaaacactttcacccacaattgttgcaagtatcattggccttatcggaactgcttttgtagccggatcagtttttgccaacgacgtcggatacacaattgggatgattgttttagggacagttgggcttgttggctggattctaccctatccggtttttaaacaccgaatgataaaatcaacccataaataccaaccgttaattgatcatgaatatgatttggtctatgaaatttgtgaaaaagcatataccttaagccgggttatagactaattgaaagaatcattatttcaggttatgacaccactagacaatatttttccacattcgtgctctaatcattctctcataattagcgtataattaatcttataggaattgtgacatttggttgagaaacgtttcggaacagcgtattctagtttcaaaccaaatgatctacatatcgcagaaggaggaatttgtttgaaaaatctattagtcgcagccaataatgctgaaggtggtcaatcagaccagccaaccagtgattcgattgataaatctctattgaaagatgacctttatcaagccgtcaacggccgttgggaaaagactgctaaaattccagctgatcattcatcaaccggtggctttatggatctcaatgacaacattgataaactattaatgggcgatttggacgagatcctaaaaggcaacaaaaacagttacgaggcacctttctccgaatttttaaaattttatgaactggctcaaaacttcaagaaacgggatgctgacggagctgaaccgttaaaaccatacttggaaaagattgaaaacatcaccagttttgatgatttaaacgcccaaatcggcgactgggtcaaagaaggatttaatttgccgtttggatttgacgttggccccgacatgaagaatacccaggtgaacgcgttgtttgccggtgtgccacgcctatttctgccagatcggacctactacgaaaataataatccagcttacaaacaattaatgccaattttaaccaagaccctcagccaactattagtcttggccgattatagcagcaacgaggccgaccaaattgtcgagtcggcaaagaaattcgatgccttaatcgcaccccacgttaagtcatctgaagaaaatgccgattacagtaaaatgtacaacccacagaaattcagtgatttcgctaaatccagcagtcatttggatattactaagttggcgaaggaaatcttcgataaagtaccggaacaggtgatcgtcacggagcctaagtactatgaagcgcttgactcaatcgttaacgaggatactttcagcgacatgaagaactggatcctggttaatacaatttactcatcatccagttacctgtccgaagaattccgccaaaccggttcgacttttggtcgggctttgtccggtaaaaagtcggcaaccccacaaaagaaatcggctttctacttggcgtcaggaatctttggtcaaacaatcggtgactattacgccaaaaagtatttcgggccaaaagccaaggctgacgttgaacacatggttcggaatatgattagcgtttatgaaaaccggttaaaaaataatacttggttaggcaaagcgactcgtgaaaaggcaattttaaagcttgataaattggaacttcaagtcggttaccccgatcacattgacgaaattgaatataaatatcaggtaacgcccgaagatcaaggcggtacgttgtttgaaaacgcgtcaaaatttggccgaattgctttggcagataactttgccaaactcggtaagccggttgaccgaacccgttgggaaatgagtgccagcacggtgaatgcctattatgagccatttaaaaacattattgtctttccagctgccattttgcaggcacccttctacagcctaaaacaaacgtccagtcaaaattatggtgggattggtgccgtgatcgcacacgaaatttcacatgcctttgacaacaacggttccctgtttgatgaactagggaatttaaacaactggtggaccaaagaagaccatgaatactttagtaagttggctgataaaatgattaacgaatttaatgggattccatttgctggcggcaaagttaacggtaagttaaccgtttccgaaaacattgccgatgccggtggtctcagttgtgccaacgaagccgctaaaaacgagggtaactacaacttatatgatttcttcatcaactgggcaaaagtgtggcggatgaaagcaaccaaggaatataagcaattactactaaatattgatgtccacgcgccagctgaattgcgggcaaatgtgcaggtcaaaaatctggacgacttctatgccacgtttgaagttcaacctggtgatggcatgtacttgaagccggaagagcgggttaaaatttggtaagagtgtgacaaaaaacggttagcttccagaatataaggactctaatttcaatattccgggtttgaatattgtgattagagtccttatatggccggaagctgttttttgtcacacgtttcggctatttagccagtccagcaaagaatattctgaatctgaatatttgattaagagccttatatggccgggctctgcttgctgccacacgtttcggctatttagccaggcccagcaaagaatattctgaatctgaatatctgattaggacctttatatggtcggggtctgcttgctgccacacgtttcggctatctaaccaggtctcatcaaagaatattctgatcctgcatatttggctaatcggtttaaatagtcggtatttatccgccggcacatatttttcatccggtgacaatagcaatacaataaccgctacaattcgctaatttaatcactaattgtattaacgtgacacgaaaaaggactgattcattaaaagttacttttcgtgccacgttttttagtattaacaaaagaaattaaaaacctcattttgctcattcatcgctgtttccaacataaccggcgaactgcacaccataaagccatttattccaacccatttgatgttataattgtaagggtttactagactgtgaaagaggtttctgccatgcgccaaataccaatcaaaatgactttcttttttcaactgcatcccatcattgccaccatcttttttggtgaattaattgttctgacaatgctgttcaatcacgttgctgtggcgttgacaggaattgtttctttgatgatcatcaatgttttctatcttggcagacacgctgcttggcaacagctcaaattcaatggcgtcttatttttcatgattgtcttttttaacgtcttacttaatcaaaagttttcaccctttctatggaaagtgtcaaccggctttttcacatttaagttatcctatccggcgctcctctacggcatcacgatgggaatcatgttgaccgagatgttaatgacgttcgccttgttaaacaccattttaaccgccaataaattaatttatgtttttgcgccaataacaccaaagctcgcactactggtcacaatttcgtttaatctagtcagagatttaatcaaacgatttggtcagctgttacttttacaaaagactcgaaatctcgataccaccactggatcattaccaacccggctaaaaaaaatattaagtctgtttcaaattttgcttgaagattccctatcatccgcgatggaaactgccaatctgatggatgcccgtggcttcggggccgccaagcgaactcattaccgttcctatcgttttaacccaaccgactggttctttctaatgggtaccacggctgcttttgcgttattattgtttgtaaggatcaacgcaatgggttggacgaattcggttgccgatttcaacaccatccttttcactggcgacctttacccaatggttctattgggtagctttacgttactgccattaatcgctgagggggtctaccatttatggaccaattaattcaaattcaagatttaacgttcacttatccagcccaacaacagccagttttaaaagatatcaaccttaccgttaatcatggcgactttattgtcattgccggcgataccggaagcggcaaaaccaccctgctcaaccacctaaaaaaagaactcattccagctggggaaacgaccggtgacgtcttaattaacggtaagctcatcaaagccctttcccaactcgacagtgcccaaaccgtgggatacgttgctcaaaatccgcaaacccaaccgatcatgtcgacagttatcgaagaactggctttcccattagaaaacgttggctgtcccagtaatgaaattgaacgccgaatcgctgaactaagtaattacttaggacttgatcaattgctggaccgccaaatcagtgaactctccggtggtcaactgcaactggtcaatttggcatccgtcctcattcttcgacctaaaattatcttattggatgagccaacttctcaattggatccgctcaccactcagcatttctttgaagtactccgccgcgtccatgaggaactgggaattaccatcatcctcagtgaacaccatttaagtatcgcgctttcactagctaaccggatgctcttgattcaacatcaaacaattacgtttgacggtccaccgactgagggaatcaagctaatgggtaacgatgagcggctgggatactttattcctcccgtctcacaagtctttctggctggtaagcgtcatctcgacgacctgccaatttcagtggccgcgggacaacgggcaattcgcaaggatcggattcacttcaagccaacaacagccttaacccaatcaccaattcagcaacctgccaatgtcattttaaaagctaagaatattcagttttcatttgaccgacaaaaaaatattgttgaccacttggatttaaatgtccatcaaggagattggctggcaattatcggtaaaaatggggctggcaaatcgacactgttaaacttattaactggattgcgaacaccgcaacacgggaaggtttattttaatcaaaaggttgtttggaagattcctacgccacaacgaatcaaatccctttcctttctatcgcaaaccccaactcttcaatttcgaagcggaagtgtctatgagcaactaactatccaagccagggaattagctttagatcatccccaagcacggattaacgcgattgttgaccagctgaaactccagccgattctcaaacataatccattcgatatcagtggcggtcaacaacaactccttggcttggcaattgctttattagcaaaaccaacccttcttattttggatgaacccaccaagggattggatccatttactaaaaattttgttggcgatattttaaagcaagtgcaacaagctgggacaaccattgttatggcaagccacgatatgggcttttgcgccacatttgccgatcactgtgcctttatgttcgacggccacatcaatacgtttttaccaacaagagatttctttacccataacttcttctttacaacatcaattaatcgcttggtcagaaatcaagttccagaggcaatgctggcaagggatattgaacttaacaacgcttcgaatggttaggggttaaccaattaatatcaattagctttggaagtgacttgaaagggggtgagtcatgcttgaaaaaacttcttgatctaacctatgttcatcggctgctaatcgctgttctgttaatgatgacctttttagtgctgctacttctattacggggaaaacattatctgctatttagttttatgtgtttactatgtagtatcctgccagcatattggcgctttgaacgtgagccaatcagaaccaaaacattaatgttcattgcaattttaattgcgttggcggttgccggtcgggtgccactcgctgctattccaagcgttcaagctgccagctttatcatcattatcggtggcatcagcttgggacccgaattaggttttatcaccgga

SEQ ID NO: 645 - DNA, 223882 bp, Unknown
  Metagenome-assembled genome
tagtatgcttggtttgggtcatggagaagtcctttcttaattagtttggtcactattaagcataggtctccatggcctacttgtatacttggctcagtgttgcagttcaattttaaatccggcgttaaaaaagattgctgaaaaatggggattgaaaacccatttgtatcgaaatgaagtcttggggattcaacttgatggcaaaagttcaaatcggattgaatcagtttgccatgtcgacgttgtatctgtatcagggaaatggcgtttcgctcccttcagcgcagaagttagcgagggcaatttgtatggcagagggacacaagacatgaagtttcaactatggagtaatttgctatcgttaaaaattatcaaagatcagggtattattccggataggacgcttcgattggtgattggaactgatgaagaaagaacaatgaccgatattaaacgctatatcgatgaagccggactgccggaatttgcgtatactcccgatgggtcatttccactttgccttggggaaaagggcgtttggacagcgaaggtttttcagagaattcaaacgcgggttagtcagattagaacctatcaaagtagtaacgcaatctgcgatcgggttgatgtttggatacccgagaatgataataaacgggcaattgaatttttagcagccaaacaagtcgcttttactttaggtgaagataagcggattatcttcttgggtaagtctgcacacagctcattgcctgaagatggcaaaaatgcgattattccggcattaaagtttattgatgcgttctatcaagaaaattgggcaaaaacatacgttaaagtgtttaccgattattatggcacggaaattggaattggggatgggcaatcccaaatgggtaaaaccaccctttgtttgaatcgaatccggttggacaactctcagttaactttgattttggatgctcggtacaacgacgatactgacgatcgggaacttgaagaattaacggctaagtctttaccagatgcattggtcaccacggtttacgttgatccggttaccaagacggatatgaataatcgctttgttgataagttgttgaaagtttattatcaagcgaatcccgatgattcaagagaaccgtattattcgggtggcgtcagttattcgaaggcctattcaggtcggtgtgtggcttttggtattgaaggaattgattcatcaattccgaaattggctcaccaaactgatgaacatgtgccattatcgataattcctaaaacactatcaatttacacacgggcactttacgagttatcggttatttgaaagaaggtgtgatgattgactcgcaatcttttagaagagaaattgaatcaaaagcaaattctaatttccgacggtggcatgggaacggaattagaaaaactgggcgtcatcagtgattctggcttatggtcatcagatgctttgttgcaccatcccgatgcggtatacgatattcatagggcctatttggaagcaggggctgatatcattacgacggcgacttatcaagctaacccgctattcttaaaaaaacgactgtcgatatcgactgataagccactgatcacaaaagcagttgagatcgctagacgggcaaaaagtgattttggtagggatcatccgaaggcgcaaatacctttgattgcagggagtgtcgggccttatggggcttatttaaatgatggcagcgaatataccgggaactatcacttatcgaaaaatgaattcaaagcctttcatctgccacatttgcaattattaaagcaggcaggtgttgatttctttgcctttgaaaccgttcctaattttaccgaggttcaggctctggttgaactgttaagagataactttaaaggcgttagtgcatgggtatcatttagcgttaatcacgcgtttgatttatgcgatgggactaaccttgagcaagcaattagttatctgaatcaggttcctcaaatttcggcagttggcgttaattgtactgatatcgaaaatatcgcgccgattttggaccggataaaaccgctctgtcagaagccaatcgttgtttatcctaacaatggggatgattatgattcaagtttgggcaaatgggtgtcttcatctaataaacctaaattcactgatatcacctcaaactggatcgataagggtgcccaaattattggtggttgttgcaggaccacgcctgatgatattcatgacatatttaccgtcgttcattctgatcgtgtttttgcataaacaaagagccattaaaataaatcacctaattaggcccgaagcctgacttgttggatttattttgatgactctttttcgtatttataatagtttaacttaaacttgttattacaaatcttaccccgccaacggttcatgaatcatctgaatgtgtggggtcgattcaaaaataaatggttggccatggctgataaagccgaactttgtgtataatttttgaacctgagtctgggcttcaatctcgattggcatcccagcaaaatcgtttttgatggtcttcatgacttggtcaagtaggtctctcccatatccttggccgcgatattccggggctgtgacaactcggccaaatgtcacatggcctgcttctttgaaaattctggcataagcgaccactttaccgtcaaccattttaaaaacatgaatcgctttaggatcgttcagatcgacttcctgatagattcgtttttgggcgaccacaaagattctggttcttagatataggatgccgaatagttcattggttgttaattcattgaatggtttgattatccacataataacggcctactttccagggaataatagttgattgattgtctcgactgcttggtaaaattgagcttgctgttcagttgataagttggcgacgagttgctcaacctggtcgtctgacttacgatccagatcattggccattgcctcaccggaagatgtcaatttgagttgcactgaacgcgaatcggttggggaggggatcttttgtaagaagccctgtttggtaagtcgattgataatccggctggtgtagctcttatcgattttgagtgtggttgcgatctccttaggattgatcaagtgattgagcttaatttctagtaaaatccggccttcctgccagctgatgttggtatcgaagacctttttatttagtaagccaaggagttcggtgtatgagcgattgaactcacggacttttgaaactttatctaaaggtagcaaggcgtgtctccttatggttgggattgggttagattatttttaattatagataaagtagtggcttttgtccactactttattggctgaaataatatattttcgtgaattgagttaggtgaactgtgaagattaaataataatttcttgaggatcacagtatggttttatcaccagatcttttaatcaactttgaaaataatgaagctttatcagacaaaattttgattttagtaaaattagtttttcacatcgttattaggtatataatacaaatattagttaatacatataagacaaattggtttcttaagagtgcaaaattgacgtttcttggaacattttctaatcatgaaaaaagagttggttactgcaggtagccaacattttattaactgaaaatataatgagcgaggttgtgaaatagaagattaatcattataaataactaagcataggatgagactttatctgagaccattttattgctaagagaaagagaagagtggtgtatattttggaagagcaaaagttaactaaatggattttggagcatataccaacaaaaatttttatgaagataattcagttatataaaaaagcgggtccagttccacataagatgaacaatctaacaagacgagtttatatcactagaatgatgaatagtaagaattaccatcaagttcatcgattattagtcaaggttttccaagaggatgaaccgacaataaaagacggacaacaattgtctgacctttccaatgaagatattttcaatcaaatattgtcagatttttctcaggagaaagtagacaaagcaactttattaattgaagaatttgaaaaacgaaaacaggtagagaaaaatactaaaagcaatgatcgaataattaaactaaataagcaaagagaagatcgcgtgtcgaaaaataaaaagcccgttgaagaaagggaaaatacattaattcaaaacgaagctttgaggaagcaaaacgctaaattatcagatcaagtaacatctttaaaaaagcagttggaagttaaaaaaaagcaaaagaagccaaaaaagcaagatcaaaataatgaaaatgaaattgccaaattaaaagaagagttaacaaaagttcgaagtaccaatgaagagaagatgaaaaaaaagcaggaaggaaatgataaatattatgaaaagttaacgaaaaggattaataagctaatcagtgataataagaagtttcaagataaggtggcaaacttagagtcacataacgaccaattagttgatgaaatcacgaaattaaagacatccgttccattaagtcatcctaagaagaaggaaagtgaatcagaagccacttccactgtctcttcgaaagaaaatgttgctaggagtcggcatccatttttacaaattggtgccccagagacaataaatacagcaaagtttaaagctcaatatccgcaagcagacatacttattccagctatattctataagcccgaaatgcaagcaaaaaaatataattcggtaaatgaaattccgttagtgactggacatgaatggcaattttatgattatgtttcgttatacactgaaattctcacagcgggggatcgttatgcgttaaaaaacaatccagatattgaatcggtaattgaaattaaaaataaagaagacttttggaggcaaaaaatataatgcaaaataaacaattgtttatcggaatttgggatcagcgggatgaatatggttctataagggatacagggggtattattagggaaaaaagcggcaagcttttatttaatgtgaagattttaaatgaactaagcaataatcagtatcatgacatggaaattcatgtgtatccccaagaacttgagaaaataggatttgataaaattttgacgactaatgaaatggcagaagaacttccaaagtgggtttttacatttaatttggaaattaaaaaagagcctagagataatgtgtttgcgactaacgttaaacggctacctagaaataatgattttcaagatatggataaatttgaattagtacctgttttccacaagaccgaagacattcttgattttaaagcatttaatcatgctcttttgaatggtagtgcagttgagtttaatgacgctcaattattaaacgatgatgaatcttttgctatttttcaatcggatggtgaagttgataattcagatactgaccgaatatatgagaatttgattattcatgatatccagaatcaatacattacttatgatgttcctagcgagaacactgccatcacagaacgtgattggaataaacgtgattggatcgatgccatttatgaagttgaggacttaaacttagcatttattcccagtcgttacttaatggcaaaaaagttggaaaagatagcccctaaaactgaggaacttgttaatacggtttctgatagtgaaaatgtggttaaatcaaagcctgaaggtgatcgagccttagaatataggctcattgaccgatttatcaaaataacaaaatcacccgattatgatttaacatttaatctcttggatttacttaacttccataattcaattaagagcaatacatttacgattctcgcaggcttgagtggtacggggaagtcaaaaatcgcttctgcatatgcggaagcaattggaatcttgtcaaataatgattctaatagtgatcaatttaatctagtctcagttcgtcccttttggcaagatgatgcagatctattagggtacgttgacacattgagtaataattatcatccaggggattctggattagttgatacattaatagctgcgaataagaatccagataaaatttatatggttttattagacgaaatgaatttagctaaagttgaacattatttttcacagtttctttcggtgttggaaatgaaacaaggcagggaacgaaacatcaaattatatgataagtcacttgaacgtcgactttataattcggataaatatccatcccaaattaatattggctctaatgttaaatttgtggggacaatgaatactgatgaatccaccttccagctatctgataagctactagatcgtgcaagcataatcagtctagaaatcattccatttatggacaaacaacctgccttacaagttgactctagtagcttttctgaaatcactttggatcagtacaataatatgaaggccgatcactctgagcttagcaaagaagaactcactttcttttggaaatttgatcaattgatagaaaaacatttacctaacgttggattggggtggcgtgttttaaacagtattaaagtctttttggctaatgtgccaaattacaaagaatttgatcgaaaggtggctcttgattatcaggtagcacaacgaatcctgccaaaagttaggggaacggaatccatgctcaaggatttgttgactctcaatacttcttctgatgacaaaaagggtcaaattgtacagttattggatacatattcagagatgtctaattttgaattatcgaagcgtatcctgagtaagaaagaattagaactgaaggtgaatggatttgttagataaggttaaccttgtaaataacaggaatgagccttcacaaacttttacgtttagtgaagatgagtttgcattcaatacgctcaacgctaaggagaattgtttatattcaattatatttgaaggagatgctgaggataagctttatattgatgggctagatttgattagtgatagtcgcatcaaacgagatgaaaataataagatgtatgtctcacctagtaaagtagcgttacatctttataacaatgaaaagaataatcagtccaactatttacctggaatttatcggttaaaaatggttcgaacaggaaaggaaccgctttattcatggattaagattgatccaaaatttctaagcaatagcgagttgcatcaactccgtcttgatgttgaaaacactattcgtggattagcaagatcgttcgatgctaacgtaaatggaacgttaaccagctataatgacgatttaactagtgaagattatgagctgcttgcaatatttcaccgagaggaacaaaattttcgacaaactctgtatggaattcgtactttcccaaaatttaacattgcggctcaatatagatggacggtgaaatcaatttctccgcttgacaaccggtctgttcaaaaaatggcaagccatccagcaaaaaataagcaaaattttgccaagacacgcttgatcaattttaacattccacaaaataaattattgaaagagcaacttgtttatgttctgaaaagagtgaattacttaattcaaaagatagagaattcttcaggattacttcatagaaaagtaaattctcaacataatagttttcgagatgatctatccaggctcaagtcctataaggatgaaatcttagatttcttgaattgttcgtggatgcggaacacttctcttaaaaacacacatgaagtcaacttattaggaaatatgaactataaatatatctttatgacaaaatttgttaagaagttaaaattagcagcttcaaagcagacagattttcatcgccagtatgaatattactggcatcgaacagatcttttgtatgaaatatggggatacattcaagtcataaagtccttagaaaacatagggttcaagccaattgacggctggattttcaataaaggccgtgagtgctttgatgagcttaaagatgggacagccgtcacgatggttggtgatcgtgttttaagttcagaagatcaccacttgaaaattagaattatttataatcagagaatttcggctaacaaaaatgttactgtttggacaaatggaagccataactggcctgatattagggttgatttatatgatgcaagtgatgtagatggcagcaaaaccttaattggaatgctggttttagacacaaaatatcgtagattaaaagatgttgaacgtgatgcgtgggaccaacttgcgtcatatttagatcaaataaagacaagtgagaagtatgcttttaccttgaaacgttatgagagggcaaagaatcatagcataattgacttctccaaatcaattgtgtcagctgttggcattctttaccctagaatcgtttctgatcaagatgatgatttagttcaaagattttcaggaaaagatatcataccaataggattgattccgggaaatggtacggtcgatctgaaccatttttttgataaacaaataggcaaacttatcgataaagtagtttatttaactcgttttaataatttgttttagatcatacactttaatgagatcacaaaagtattcgattagaaatctgtttcacgagcaatacaacgtcaaacacatctcttgatcatagttcccaaatcctttaccaaaaattgtacagccaccttgattcttagcatctcgagcgacaccaattctcaatttcatccgactaggtagtggggtgagatcgtcaatcgtggtgccgctaattttttgcccagaaatccaagttccttcgtgcgagacaattagcgtgacttgggtgccatactgattaaactttgctggtgtccataatggtgtgaacttaccacgggtgtctgcaaagtcgccgggactggtccaagtgcccagctctttaccatccaacgtaaatgtgatatctgaaggccaatcttcatttgacatcggaatttcgctacccatttccgctgataatgtcagcatttgcacctgttcaccgggttcgagaaagttaccaacttcgtattcaacataacctttggcaaaccagataattctggcgttttcgggggcgttctgggcatccagtatttgggcgtcgtcgactttaccaattgcaaagccgtttagtcagctacccacaggttggttcaattcggacatccggtatataggccaaggggatgtactttggaagccttaaacgaagatgctggattgcttggaacaacgatggatcgaatatcattcgaccgttaaatgcgaaatctctacatttttccttctttagtgatttacgcagacccgcggctttagtatgatgtgacgtgtcgaggagagtgatcgtttggctgttcccaactttgcgattatttttgtaatatgttggtctggctcgccaacagacgaaggttttaatacttgctggctcgaaaggcttataaacgaggtaaggaatgatattcaattaaaacatagaaataacacctaaacactgttagttgttttagtaaacatgtatcaattaaagtgtaaggatatgcaaacctgattagtttttatgtcctgtcaaaatcaaatgcttcgttattgcgatgggatctatttctaaaaagctacactgatctagattgtgaaaagcgttatgcaccccactatgaataaaaatgacacggcatattaagacctataaataaatgtattctaaggagagtgattagtgatgaaaatcatctacagagttacgatacgctttttcagattggaatatgtcaaacagtttggagctcagtttacctgaacatttaggcgttcaatgtacggtggcatttgatccggacaagccgtttcggatctcaaaaatggctttcgcaacgatgtttaaaaccagccgtaaagatttaaaacttggagggtcaccgatgatctggcggcagcaatttggtttccaaattatgactgaaagatggcattgggacctagaaggtcgcaagaagcgatggacttcgcttggtcgaccgttgaacctaatcaatttgtatcgtgacttgccacctgggcaaggaagttgggttgagtcataatgatccgggttaactgggcaccggctcgattaagagtgcccgccgccgaaattagttgatactgtaaatcatgattttctggacttctgagggattgcgaatataacaatggcatcgaggaccattacaacattaagattggtgttaggtaacgacatggaaggcgattggacgcgggcattatgagcgcttcccaatacgctgtgccaaagccgtgagggctccaaaatgatgactgtgatagtgggggtcgcttccgatattaagtggtggctggggaagtagtggaaagagagtagttatgaacggttatcaaacctatctcaaatttctttctcttttttgaatggagaccattatgaaagcagctctacccatacgttgataacctctcaactcataattacaatctgaattcggccacggcactcaaacctcttggcttttggaacagctggaggaccacattcaaaatacgaagaacgtgctgaacttattcgagtcactgcaccgaagttcaagataaagatattacgatttgtcttgatgatgtggaaaggtttggaacatgcaggatatcacgcggacgctttgtgactttgaatgggatgaccacatttgaattaaatgatgctagaaatggaaagagcaatccagcaattttacaggaaacgcccttccttactgctgccgtggttgtgggtgcttagaaatttaacgatttgactatgtggattggagcggttgaacttgccttgtttagacgcgttacttcacgttatttcgcaataaaacggattgatgaagatggtcatttaatcaagcccaaacatttattacccattccagttattaacgggaagtacgggccgtggtgaagtttgaagccacacatggaaagtgaacgcaagcaaccgaatatggtgacattccggtatgaaccgcttacgggtatgacaaagcaaacaacatacatgtagtgccttaaacagatactaatgcagtaatctacgcagccctcatttgaccggagtaaatcaatcaacttaactgaaaacattcttaccgtgacgattgaagcattaatacgtttgccccctaataagtcatccaataatatccacggaaatgcaggcctgataacttaacttaccacacgacttgaaattgtgaacagtgacctttttgacagttgcaccttcccctgtgggcatccagggtgcagtgtcaccttcactgcgttgaactgagcgccaggattcgaccccccacgcacattgtttgttctcaacgctacgtagtgttgacgtcgcagtgcactcatctcaaaaagcagttatttaacggaaatcttggctttgaaagtctgtggcttggatttttggcgatatggcagagtaatttcaccgtttgctttcgttaggctgttcgtttggctttttttcttacactgacgtgctttggatttcggcagcattatggaactttaatgttatgttaccgttcgtttgacgggatatcgataggtggttgtcggggcggtttttagccgataaaaacgcatgccgttggggtaaccaacccgccctggttcctttggggccttacccctttgcaatttgaaaatttcaagttgtgggctgtggccagcggtgtggtggaagtgcccaactgttatatctcctatcctattaatttgtttggatgattgccttctcgtcaattgcaatgcctatggacgttgaattgcatggtgacgcagggatcaacatcagcgtgagaagaaatttaactgttcgatgtgtcattggcccaagtcggggttctaattgtgactaaaccgcaacgatgcacaatggttgatttctttggttaataacaggttcaagttgggtaatcactatacgatttctgtcagcaatgttcatgtgtattgtttatggtcgtttttaactcaccaaaggaagggttccagtttgcagcgaagaagattcattccaacgtgatctttccccttgcgtttcaagaataagtatggtggatcgcacaaacagttttcttcattctatctagtcttggcgatgcctttaactccggggagtcatttaatatgaaagtatgtacggataacgattacatgggttgggtgggcgtgtgtagcattgtacttaaggcccgtcctatcggcgtgatcttcgttcaccatcggttggttatgatctgggaagagctaaagtatgcttggggctcccatcttcagtatccgtggttatctgttcacatgatctcacatgataattttgcggttgttatgacctcccactattaaaaggggttggcacatagtccacaatatcggtggggtttggggaaattttccaaggtcgattgctagggtgagtgagactcacgttcgagttgaaggctgcttgtcctatggtggtcacgccttggtcaaaacggtggaggtggtcttgaggaaatgctgtaaccgggggttattagcctggttataatggcgctttatcagcccaaccatccagtgccatgaactcaatctaccaactctttatctatattccaattgtcatttacattttacaaattgtgttattgctcatgtacaatcttgataaaaaatatccggcaatcatgcgggaccttgccgctcgtaaagataatgactaattatttttgcaccccaatgtgagtggcaggaaaacgggcacacgattaagatcccatggaattaacagttagttctagttaatttcatgggatcttttaggcttaaaaaccaatgttaatggtgtcagtcaggcataaaaatagtaattgcgctcttagtatttcataatgaaaattagttgaccacgttgaagtttaagcgtgcgaacattattattgttaatagaaggttaactatttagcgagttcttattaaatagaattggaggggtttagttgagaatcaaccatttatttatttctaaaaaatatgcaaaaagttggtgtgctggtgtactaacggcagtcgcgggggtaacgattacgatgggtgctggattaaccgcgttcgctgattcaaattcaaccgttgcgggatcatcaattaagcaaaatcagaccatcaatccgagtccacaagctaatggagatctaggctatcaatgggggaattgctctttgaacctaaacaatgggttgctaaccattaaggcaggtcaattaaccggcatgcaaccggatggccttaaaacactattttccgaggggaagattacggctattcacgttgaaaaaagggttaaattacctgatgactcaacgaacctttttgcggggatagccagcttaacagcgatcacctttgagaagggaattgatacgtcgaatgtgactaatatgaccgcgatgtttatgaatgatacggcactaacttcattggatctgtccagctttaacaccaaaaatgtgactgatatgacttcgatgtttatgggagatgccgcattgaagtcgttaaatgtatccagctttgataccgaaaatgttgtttcgatgaagggaatgtttgccggtgcgactcaattagaatcacttgatttatcaagctttgacactcgaaatgcagttaaaaatattgataataatgaatctggaactacttatatgctgggaatggcgggaggagaaatcgactttcttcttaagaatctttggaaaataacgttagggcctgacacagtaattactgatccatctgaaaatgaaaatttgaaggtcgctggattgccggatgctccgggtaccgccgcaaatccggtgtcatttaccgattcgaactttcccggtgctatctttcaaaataatggttcaaattgggttgaagctggaacgagtgtagacggccataatccaacgggcactgttttaacaagtcgtcaggcacttaaagattatttagctaagcctcgtagtaaaagcgaaaccttggtatggcagcaagttcccgctcccaagcaaaccattacgttggcatacattgatcaatctggtaatcaaattgccaacccgcaaatatttagtggctatccgggaacaagctataacgtttccaactatcaactagtaattaacgggtatgcgtttaatcgagtggtcgggtctttaactgggacatattctaaagtaccgatgacgattacttttgaatatgtgaataatcaaatcggatcaacaatccctgtcacaccattaacaccagcaatgccggttcccgatacttcaacgccaactcccacaacgccaggtcaaccagttgaggtcaaatacgcctttccatttaaagtttatgctaaaacgacggtttataagtatcgaacggtcaactttaaaaagtctcagcgaattcgaaaatacgtcaaacaaccgcgttacaaagtatcggtctttacagttaacaaggcaatcaaaaatgcgcaaggccgttggcgttacaaagttgccggtggctatattacgactaatgagaaaaatatcggcttactgtattggcagtcaggtaagtatcgtaagttgacagtcattaaccctaaaggtgtttatgaatctcaaagtcgactacttgccaaacataatcgagttcaacacttgaaacgaggaacatcagtccgcgttaaagcagttgttcatgatggcatggcaactcggtatgtgttgaataatggacattatattactggtaataagaagtttgtttcgttgaagacctcgtaagctgatttaactttgacgatcatttagcgagcttatatttatcgtatacaaaggctgaatttacttgctttattgtgattcagtcttttttgagcggtgaaagacttgagtaagaaatctatgagcgataaaaaatcgtaaagattatcatattatactgaagcgtggggatgggtattcttcaatagataaattattaacgatcttgaaactgtttgagtaatagacgataaatggaaaaaatataaattcaaaatttcctgttcattttttagactataattgaattatgtttaaattgttatcggaggaggggttaacttgacgaggactgagaagctacttcttggaatattattggaaacatttttaagcctgagctttttcgtaggttcggcagagactgcaatgcccattgcttaacataaaggtagtccatcatttttgcacggaacttgaaagaaaaaatgtagcgaaatacgcagcatataaggattagttggtattatctacgaacatatttcacaattggtgatagaagtactaatgggctgtgtgtgggatatactcgtcagaagaaatacaaagattcaggatgtggctggtgctacttatgatttgcattacgaatatttagggaactgtaattatgaacttcttttctcatgttgggtttgaatatactaatatgaagtaagccacaataagaaaatagcgtatattccaagaggtgaccggcatcatttgttttataaagtgtctaaccgcgttggccgcttttgataggtgtacttataatattttgtcagattagaaagtatttcattgaaaataaaactaggaagggttagttatgaaaatagttagatggataatgattgaaatgatggtattgatggtagggatctcaatagccacaataaaagaagagattcatcctcaatcagtttatgcttcaataaagaaattaggtggccaccggattgataaaccgcgtctacgatttaaatattcgactatcaacgaaaatacacggtttgatccatataaaggcatgatctattactatacaaagcctgacaaagttaaattttctgtgaaagattacgttaacactgaaaagccgggtaggtatgttgttgtttaccacgttaaggataaagcagggtataattttaccattacacattacataagggttaggaagatttttgttaggaatatttataatcctaatgcgatcacttcatcgagcaactcgatttatcatacttccccaatcgggacaagttttaagcttgttcctgaatttaatgtgaagaatgttagttacaaaggaattaagtggtcgtcctctgattcaaatgtagcttcagtatcttctgatgggaaggtggtacctaaaagagatggtgttacccttataattgtcacgtttaataggcagtcatttagtactcctgtgttggtcagtgagggagaacttagcaaattatcgaattctgataatgtatggagtcgtgttaactatgataaagatttgatcattaaatattatgaaacgggaacattaaaacaattacttaaccagatatggattaccaatggatctaaatttgcctatgctaaaaacatatttgcaaattatgcacaacagaataaaacgggattggattataacaatggtgaacatttaattgatgctaaatacaatgactccaatttagatgggataagtaaatcatttttcaaaagtggggatcagattgtcttgcaaacccaagatgagttgggaaagggtcatacttatattggcagttacagaacaaattgattaacactaattttgcctgatgttgtttaagtgaataaaggcctgtataaatctgtaaggataaattacaacttattaatttaattaagtcaaaaaatggaagctcattgattattgggcttccattttttgactgtggtaaacaggaaccggattctttacagctgaataatgacattgcaatctccctttcacccactttcataaatggattgacaaaatattaacaaacaacaataataatattgtactaatattttaatatcttaggaggttatgagaaaaggcgttaaaactgtctttgacacgtatcgactggtccgttgaatttgtttagctggtcaatcttttttgtattaataagttatgggaatactttccggttgcatagagcgctactttaatggttagttcttgtgagaaatacatattagaacatatttgggcgtaaatcatggttgatattggaaagttgttttttacaaagtgggaatttatttaggaaaatgacattggaggggtattcatggatcaagcaactaaattctgcccaaattgtggcagtcagatgccgaggtcgtcaaaattttgtccaaagtgtggttttaaacagccacctttgtcggatgaaaaagttcagccacaggcaaatgatcaaggtcaaatcaatcaaaaagatactactggtgagggattggctagtgatcctgatccaactcaaggaatgtttacaagtcaaactgcgtctgctggcagtaaccagagtcaaattacgccacaagaccagtacagtcgggttaatgccaacgaaaatcagcttgcaccgggttttattaattcgttcaagcttttactgagggatgcatttatgattaatcaccgaatgagtcgggctgatttttggtgggcaatgttgccgactgcgttgatctttacagtacttgaaatcctgatatgtaccattgctgtagataagccgttggcactttattcacttaatgacgatgttcaacggccaatcttatttggcattattcttgttagttcagcaattttttcgcttttatgggttgcatgttttacagctaatatcagacgacttcatgataccaatcggagcggttggaattactgctggtcttttttcccgattgcgggtggggttgttttgctggtattcctatgctcaaaggggacttcaatgaacaggtttccaatgtcgagttcaaatattctttgggtaaaaaagtggtattcttggccgatattagtggttttatttctttggaccggcgtttccctaagcacggcaaatcagcatttaattcgaagcgagtatggtacgtcaaccaattacgcttttgggtttacaggttcccaagctgcgcgtgatatagagcaaaaggttactgatgaggattctgatgactatgatagtcctagtgtccggtgggataatagtcgtggtgagacggcaatccatttaagcgataattcgcgtgtaatgcaaggcctaaatgattctgaagtcgctatttggaagtcattggttagaagtgcgacgaatgaatcagcatggttagcaaagaataaagggaaacgctatagtagaattgttgttcccaatcctgatgactcagaccgaatttttttggatgtctataatggacaagttgaatacaatactagcgatgatatgtaagagatcacagataggaggatgaaaattggttgatcaaaattttaaattttgtattaattgtggttcccaaatttcaatttctgataatttttgtccaaattgtggcagtaagcaacctgctaaacaacttaccaagcagcctcagtcagtacctgaatcaattcctgtagaaagggctagtgggctagattcggattttaattatgctcgaattatggtctatcgtcgtaaacttggatttattggacggcctagcgctattctttatgttcaaaacaaacatttctataatccaatcgaaaggattgctgaaattttggcgggcgtgagctttatcgtttgttttgaacaaaatgggttgctgtttttagcggtttctgttaagggtctgttttctggaaaaaattgttttataaagaatgagtgcattcaagaattctcagtccggaccggccttttagagaatacagtttccattaaaataaatgatacacttattaagttttcgacaccaaagttgttagttggacattcctggcaagcccaaggatttcgacatttgaaacaaaagaacaaaaatagttactaattggggagaaaaatagatttatggaaaataaaaccatctattgtccaaattgcggcagcaaaattgctgccagttcggtgttttgtcctaaatgcggtcaaaaaattaacgtcacggtgtcaaatcagaccgcgccaaatccagctgggagttcccagctggcaaatcatgccaacaatggcaatcaatatacaaaccaacagcaacctcaatattcacaaccgacatcttctcagaactcaaatgcaaccagtgctggaaacgatcggaataccaacttatatttaacgtttggttggatttgcgcggtgatttcgctatttttatttccaattatttttggtgccggtggtgttgtttttggcgttttactgaccaaaaacgagcagtccaggaataaaggtacaattttaattgtgatgtcggttgcaattgggattaccggatttctgcttggtgctgcgctaaatagttagttatcccttgagttttaattggtctgaatatttttacaaattgcatccccaagttggacgttgtatgatgtaagtgagatttaaattgtgcacaatttaaatcaaccaacaatgatacttggagggattcaattgaaactaacaattaaagatactgccaaaacctatttggctaaccgaatcgataccaccaagaacttatttttggcaactgacgatggctctaataaatattccaaagtcggcggtagttgcgcgattggtgataaattccaaattgttgcaaccagcaaacaagataatgattatcgaatcccagtagataataaccaaggccttcatttattcacatctgttggcgagcgaacgtttttgggctcaggtctgacacttgatttttcacacaatgcattggtccttaaagatgacagcggcattctcgatggggccgtctctgtccaagatgctgatcaagtccttaatcagactgatgcagaacaaacggcggaacagaaggcacttagtcaacaaatttgctagaatcaaatcgttcaaaccgagcaagtttctgattcacaaccaaccaggtggtgagttggaaactttttttgtttatcttgttcgaagtcggcgaatgtcccttgtttggtgatacaatgtagccaacaaagattcgtaatggttttattactaatgataccaaaataaatattaatggcgggggatcgacaaactgtcggttctcttttcatttatcaaaggagaattgtgtatgatccatattgtgactgactcaactgcccaactgacaagcgaagaaatcaaagcgcatcaaattactgttgtcccattgacggtgacacttgaagggcagcactaccgggaccggattgatattagtcgagatgaattttcgcgacgtttaaaggaagatcaagagtttcccaagaccagtcagccatcgatgggtcagtttattgaaacttaccggcggcttgcgaaccctggcgatcaaattatctcgattcacattggatcggtcttaagcggcactgttcaaacggctcaaatggcggccaaacaagtatcagcgccgattgaggttgtggacagtgggctgactgatcggggattgggtttcgcggttctaaaagctgccgagttaatcaagactcagtcggacttgcaaacgatcgtcgcggagttaacggcctaccttgctaagattacattaacctgtttcgtaaatagtttggattatttggtaaaaggcggccgggctaatcgggcagttggctttgtttcgacgttgatcaaattaaagctggaattagggatgccggccggtaaactaaaagtcattcacaaagcacgcggcgaaaaagggatgcaaaaaatggttacccaagttgtgaaccaaattattaatgaccatcagattactcgggtggggctttcctatgttgacagtcacgtggatacggatcgaattgcagctgaacttaaacaggcgcggccggatttagaaattatgaacgagttgaccagccctacaattatgactcacgttggtcctaaaggctttgcggtgatctttgtttaaagatttgagctttcaatatcaaatcaaaatttgcagatcggaaactggcaattttagattcaaactcattaaaataggatcagttagcaaaattaggaggaatgagttgtaatggtgtttactaaagacatgcgtgatatgatcgaggatcagctaccttttttggcaacgaccagtaaggctggccttcctcaaatcgggcctgagggaactctccgtgtattaaaagatggtcaattggtttattacgagcatacgtttcggcacgcttaccacaatatgaaggaaacgggcttagcagcggttgcagttgccaaccgaacggtagaaagtggctttcgatttgagggttctgccgaaattcacgaaggtgatcctttggctgaagaggttctggcgccgaccacaattcgtgaacgatttcccagagtggtggttgtcgtcattaacgttgagcgaatctatcgactgaataacgacttagatgccggaactcgattattttagttgattagtgagattctgtggcactgagtaacgctcattttcgttgattagaatgctttttacccatttacttttctggttgttaaaattagcagttcgcaaattggcaatttctcattcatgctggttagaataaaataatcagacttagcaaggaggaatttaaatggcagtgttaactaaagaaatgcaggatatggtaaataatcaattaccgtttttagcgacaactaatgaagcaggtttgcctcaagttggtcccaaaggttcgttgcatgtcttagacgaaactcatttgatttatttcgagcacacgtttcgccatgcttatcacaatttgaagcgaaatggttcggctgccgtggcagttgcggatcggccggcacaaaagggttttcgctttgaaggttcggtgcaaattcacgaagatgatgcgtttgccaagaaaattttagatccaaccaagatttatgaaaaattcccaagagcagccgttgttgtaattgacgttgaacggatttataaattggataataatttggaagccggaacacagattgcctaatggggttttccggttatgaaaaaacagagtgagacaaaaggcgcttaacttccagagtgtaatcggattatccgaatattctgaacttgaatatttggataattcggttacacggccggaagttgccttttgtctcacgtttttgcttggtaataatcgtgattacaaaaatagggctggacaaaatcacttttgtctcagccccattttattttaaaaagcgaaatggactttcgtggttaaatcaattaactcagatcgcaatttaagtctcagagttatttgaatggttaaactttggtatcccaaggcaatttaaagcaatccccttatatggaattagttggtaaaatcaccaccggtgacgccatagctttgaccggtgacataactggccttatcagaggcgaggaatacataaaccggtgctaattcaatgggttgaccagcacgcttgaggggtttggattgcccaaacttgggaatgtttgcttgaggttgtccgccaaccacttgtaatggcgtccaaattggccctggtgcgaccgtattaacccgaatacccttatcggccagctgtctcgatagtgcttgggtcagtgtccgaatcgcacctttggttgtcgcataatccagtaaatacggtgatgggttgtaagcctgaattgaagtcgtggtaataattgaagctcctggtttaaggtatttcatagcggctttgaccgtccaaaaaatggggtaaacattagtttcaaaggtttccttgatttgttttgttgatagcttggtaatgtcaccagccgcctgttgtttaccagcaatcaaggctaaaacatccagaccgccaagttcgtcagcggcctgatcaaccagtttctgattgaaagcttcggatttaaggtcgcctgcaattaggacggctttttgcccagctttttcaatcagggttttaacctcttgggcgtctgattcctcttcaggcaaataattaattgcgacatcagcaccttcacgagcgtaggcgatagcagttgctcgaccaattcctgaatcaccgcccgttattaatgccttgcgaccctttaattgtccggaaccttggtaggaatcttcgccagcgtctggtttgggatctaatttggattccaaacccggttctggctgagattgatttggataatcttggttaaaatatttagttaatggattgattcgtgactcatcactcattcgttaaaacctcctatcatcttttagtagcatcgctgatcattgagttaactgagaaagtgacttttaagaggtgacatatcatcatatcctgttatgatccggaatgttaattcagctgcaacacccccaaatatgatgattgcaaattagtatattgcaaaaaccgatagatagtcaacttttttgattgctaatacggcattatttaaatcgattagtaaatcattgaccgcatataagtttaatgcttgacatataaagattactgtaatagcatgataagcaataaaatgttacgtgactatgaattaatggttcaacaccgcaatgacctttttaaggaaaggaagtatgtttatgctgagtttgttgattacaccaagcagtacttctagtcgcaaagcccgaaaatggctagttgatcatgatattccatttaatgagcgaaacatggcccgacatccgttgaatggtgatgagatcaaggagttactctctttgacggaaaatggttgctgggatttggtttccagacaatctgagacgtttaaaagattgaatgtggggattgagaagttacacttatcacagtttatcgagctattggtagcacatccccaaattttaaagcgaccaattctagttgatcatgagaaacttcagattggctttaacgaagatgagattcgcagctttttgccaagggaattgcgtaaagatgaatttaagactttgttggcaaaaacgtgctgattaattgaacataaaccgagcgcttcaacttacgaataaggaggaatgaccgatgggatttatttgggcattaattgttggtgccataattggtgcgttagctggtgcaattaccaacaatgggcaatcaatgggttggatcgccaatattgtcgcagggttagtcggttccgcaattggtcagggacttttagggtcatggggaccgagtctagctgggatggcgattattccctcgctgattggtgcgattattctagtcttagttgtgtcatggttcgtcaggaaaggaaatcggtgatctcataatggatgcgttaaaaagtgtctttaaatttatggttgccagtacgttgattgttggtggtgtgttgcttggcggcacggtgtttgcggctaaaaagattgattcctttggtgataaactgcagggaaagattcatcgataaatgacatcgaggatgtttaggcgaaatgtcaacccgtagatgctcaagtagaagttgaaatcagaaactaaatatcatgaaattaaaagcgggtccttgttctgctgctaatcattttggttagcaacacgcaaggacccttttcaaatctgagtaaaagttgttagtggatcgggtcataaattgcgaatgcactttataaatcatcatatcggggcaactaaatataacttaattgatataaaaagtctaaataatttgctgatttaagtacctctgttacactgtaagtagattcaatgaagcgctttaattcagaatgtcaagttgaatttaatagtatgtttgttgttatgaaaattggttaaataggggatgacattgtagaaattagtatgattggttagatttagggggaattaaaaatgaacacaaaactttttgggaaaaaatggcgaattgtcaagctgatattggtagcagttacttttctgttgtttacggttgttatggggcggcaggtctcagctgatgatactccggcgatgtatacttataccggtcctaatagcccacaaggcgttttgagtgataagggaattgaatttaatactcagttaattgttaacgggcagtcaggaccgtatcctcggcttatcggtactaatcaatcgagtaatgcgattattgatgcaactcgagtgaattcgattagtcaggaggttactattaaaaatacgactagtgaagccgtaaaaattggaagttatgaagtcttcttaccaagatggatgaatccaaactctccggttgttgcaactgatcagtattcttcaacaacccaaaacggactaaccactcgatggttttcgtatgttgatgatcataattctgatcctactgctttgagagcgtttaatattactggaactttaccagcttatcaagagtacaaattgatcattccaatgaagattcaagatccggactccgttaaggtaaatgatacttttaatattggaaacttcttttatgacccttacaaagaattttatagttattatcgatttggcaaattaatgaccgacaatgatggcaacagcccactggatagtacgggcagataccttgccacaaccaggaatgcaaacggcacgtacaatatgttgccgaatgatattcagcaacatatgccaaagatgaatgctaatcatgaaataaggattaacaactttccaagtggcagtaacgaagttgattttcaaaatgcgactgtaaataataatacgccatactatacaggtgctttgtatttcattcaacttgatgcgattaaggattcggttcgaaacgttggttactcagttgcggttaaacggggcactaacccaagtcagttaatggactactatacctataatacgatcccaggtgcaacgattattgacccagagaccggaaagcccgttagtcctggacaaatagatggggttggcacgctttatatcgagctgcgtaaggtcgttgatgcccatgattcaacaatcagccaaggaagtgcttggaagcctgctgataatgcaacgattcttgatcataacggtaagccggttgatttagcttctaaggatgttacggtaaccggaaaggtgaattcatctatgcctggtcaatatcagattacgtataagtatggtccagacaatgtttcaaagacaattacagtcacggttaaaggtggtagcacttccggtggtggtagtacgagtggtaataacaactcaaccaatggatcaaataacaactcaaatggtaatataaattcaggttcagataataattcaaatcaaacgaccaatcctggcgaaaccactgataccaatggtagtaccagtgcgacaccagaaatcggtaacggtcaggtagccgtcaaaggtgaatcagtttatgctacgaaaaaaattggattatataagaaggctgattttaagcgcaataatcgagttaagtggtactcaaaggctaagcggattaaccgtcctcagttcattgtcaagggataccagcgggacaatgcaggtaaactgagatatcgcgttcaacaatataatccgtatacccgtaaatatgtaaagggaaccaaaggatatatcacagcgagcgctaaatatgtcattcctgtttattaccgctcaactcctaagagcaacaaggtaacggttatcaatcgtaaggggcttaattcttatcggaagacttctttaacacaaaaggtaacccattataaaaagggtgctttattaaaggtcaaaaaagtgatcaaatataaattagcaacccgttatcagttgactaacggccactatatcacagccaacaagaagtttgtgattcagaaataggttgttagaaagtcaagttttgacaggccaattaccattagaagtgattgacttgggaatatggcgatcagtgtaaaagatataccaagtgttttgaggagcaactaccaccttgaaaatgcccggtatattttttgttgggttgctaaatggtttttgaatgaacggctggctagaaaatatggtttcggatgtaattgaatattaaatagaattacaatttttgaaaattaaagcatattaaatatttaattgcataatatgacgtttttgcattagtgttagttactcgtatcttaacgatattggttcgaactttttactttgagagaataattttgtaaaatcctcaaatgacctattgccatttttgaacttttaatctatccttgatttgcagcaaattaacaagacggtaccggatcaggcaatgaccggtataatcaaaggaagggactgtcaagttatgaacttgttgacgattttagttttctgcgtgttaggtattttgattggattagctatcgagggctacacttattgggagctgggtcacagcgccagatcaaggccaggtcgaatcggtagccatattcatccatagtaaataataaaataaaatgatgaatgattgaaagaagcgtcacgattaaccggataaacgttaatcgtgacgcttctttataaatatgagtaatgccgatccgaaacatggtttggtttcttagctggaataagtatccgtttcgtcgtcaaagtcatgctaaggctatcgattaaccctgccacttttttctaaaatagttgaattttccaaaacatcatcgggaatatcaaaaatcgttgcttcaataacatagtgttgaatatgttgatgcgcatatgctaaggcctgattgaaataggcgaaaagctgactaatgttgccagtcagggtggtggcgtagtgaatttcgcttggttctaagcctgccttttcagccaagttgacgatttcttgaatttcattcatgtagtcattgtcaccaaaggcgtagaaggcatatttgcaccggactgggaagtctggtagatcagtaatcgttaatggttttatggcttcattagcaaaatgatcggcatccttatcaccgcgacagcctttagaaaaggtgagttcaaaagccgtctcggtgttttccttatgagccaattggcaaagagtttggacaacattgatcacattttcctgacgaccacgatatgttgtcccaacgctggtggtttttgaccaaactggtaacccagctttattgatggtttgaatagcctgctcaacggtgtgactggcatctgaactcattgagaaaatgtctaaattgcagccggtaatatctacggagccgtcaatgttacaacttgtgtcaattttcattactttattctcctatctgttgaaagtcctgttcggttaaacagtttgtaaacgagtgtgacaaggccaactgaaaagatcaggttggacactaatcgcgtgataaacagtccaagtagtaatcccagttgaaagtgaatgtatccgtgaataaatagtgcagaagtaaaagtcacaattgttgaaagagcggcagctaatgttaaagaggcaaagttgaacttcttatatttgaatgccgcaaaccccagctctgttccaataccttgaaagaagccggcaaataatgcgacaatgccaaatgtaccgccaaacatactctccagcagtgcgccaacaatttcactaattaatgcggcgcccggtaagcgaaccaccataaaagccaacgatccgcccatacaccaaagaccaaatagggcatcgccgacaaatggtgccagccccaaaggtgtgacaagcccgtaaaccaatgtatagagccagtcggaaaaaacgaaaaacccaccgagaaaaatagaaataattgctacttcaatcacgctttgtaaatgccaacggctgttgatagccaaatcaattcctccattccaaaataaaaagtcctcaccaaaaaagatgagggccaaggctgtaatcagtcggttaacgatgattaattatccctgcgtcgatactaatcgaatcaggttcaatgggtataatctcagcacatggcaccccaaaatttttgctgtctaaaatgataaggcgttaatcaatattagtcaaacccatttaatattaatcaaggaattaagactttgagtgggatgaaagcgatgtgatatcatctaacaattttctgaaaaagttttgggaaaatactgatgtcagaagatataacgtgtataataccaattaagggaaaccaaaggatttatttagacaccccacaataaatgttatgcaggaggcttttgatcgatgaagacaattgatgatattcgcaaattagctaaagatgaagaggttgaatacataagaatgaccttttctgacctgaacggtgctttgaaaaatgttgaaattccgatcagtttattagatgaagcacttggaaataagattaaaattgacggatcttcaatcactggatttctaccgattcaaaattcagatatgtacctgcaccctgacttaaatacatggactatttatccctggatcaccacgggtgggaagacggccgcactgatttgtgatgtctacaatcgtgacggtaccccatttgctggtgatcctcgtttcgttttaaagcgactaaatcaatcattgaccgatattgattgtggccatctaaatgttggtgccgaaatggagtacttcctatttaaggctgatgaatctggcaaaccaactgacactttgaatgatcaggcttcttactttgatgtttatccagatgataatggtgaggcttgtcgccgagaaacggttaatacattgaaacaaatgggcttccagattgaagccgatcatcatgaggttgcaccgggtcagtgcgaaattgattttcgatttgacgatgcggtcattacagcagatcgaattcaactgttaaagctagccaccaaggcgattgccgttaagtatggtctgcgggcaacctttatgccgaaacccaaagccgggatgaatggttcggggatgcatttgaatacgtctttgtttaaggatggcaagaacctgtttgatgatcccaagggtagccacggtctttcttcactggctctgaattacttggcaggcattttagctcatgcgcaagcctttaccgcgattaccaatccaaccattaatagtttcaagcgattagtcccgggatttgaagcgccaacctatgttgcttgggccgtagataaccggacagccttggttcgagttcccgatggtcgtggtccggcaacgcgtttcgaattacgaagtggcgatccctctgctaatccatacttggccatttcggctttgctagcttctggattagatgggatccaacgtcaattaacgcccaataagaatgttgaagacagcatttataacatgacgccagaacaacggaccaatgccaaaattgttgaactcccaagttcattgccggctgcactggctaatttgaaaaatgatgatattttagctaaatctttgggaagcgttgtgccaaagtatctggaaattaagcaggatgagttaaccaactatcagatgagtgtcactgattgggaaaagaagacttattttaatgtttaatgctgggattcggcaggcatgaatcctcggtgtttaattaaacgtgagtttgcgatattgttaaaatgcgtaaataaataatgaaagttcgtttaaaataaagtactgttagaattaatcgtaacggtgctttattttttacctccataaagtcataactactctatacaatattaaaaaaagcccattaaatgtcattacaagaattgaaatatgtaaattcataaaagaataattatctagtttggatcataaaggaaaatggattgtgaatttgcagacacgaactaaattgacaattgttggataatggcatgtttctttggtttatttaccaaggccaggcttattcagaagattgaaaggagacgttaaatgcgactatggcatcaaagcctaattagcaagttgccgcggcaacagttactcggtcaacatcgtgaaatcgcggcacttcgcggaaatggttgggggagaccccacgccacggtcaactatgtttttcaatattcaccgtacaagctctaccaattccacgtgcttgtaatgaaagaaatgcaacggcggggttatcatcctgatttagcttggcttgaaccgacttatcgtgggaaaaaatgtccggcttatcaaacgatgaagcaggttccgctaacaacgccaatttatccagagcataatgccgaatacttagccatttgtttgcataacctagcggataagggtgtccttttggattaatttatccgacacgccatccgttttggagataggttggtaaaaaattaaaacggactcattagcaagtgttgcagttgttggtgagcccgtttcttatggttgattaatgatgttcaaaataaatttaagtatgtcgtttcccttggtttgctttacaaattgagtattcagttaattttagcgagctgttttctgaaccctaatatatcttgataagtgattattccatattaaatcgaaatgatagcgcttgcgtacagggatatgttagggtgaagttgtaaatagttaatgcgctgtttttttatgggggaggggcgtactttgaaaatcaaattcaagcgttatttgtatcgaatgatgttaatgctggcgggggcggcaattatgccgttagctggatatgtcattcatcagaatcaagttgttcaaacggttcaggctgcggcaattccagcggatgataccaagttaccgacatttatgccgaacgccaagctacggtacttggtttgggataactacaatgatcaagctggaacccaaccgattgccagtccagctgagatgacaaaaggtgatttggcgaagctacaaaagttgaactattcgccgtcttcaggaagtcctcaggcatacgttgatgcaggaccaattgatggtggaaatggtggcattggtcctaataatccaggtaactattcgctggaagggttgcaatatgccactagtttacaagaaattaacttgtcacccagtttggatttcgcgccaaaatattttcatggtgacattaccgatatttcaccattggcagatttgaagaatttaactgaggttaatttgtatagtaaccgaatttctgatgtcacaccgctgaaaaatttaaagaatatcaaagaattgcgacttcaatacaattgcattgaagatctttcgtcacttagtatcagtaactataaatcattttcttactttaagcagcaagtcgttctgccgacggttcatctaacggggaatacttatacctggcaggcgccgtttaaagaaaaattacctcaaggagtcacctataacaaatataatttatacggtcccaataaagctaacgattattggtggtataaagttgatgctaatgtcaaaccaatgcagcaggtgttttatactggcgataaggtcacttggacgggttcagacaactatgtttttaaaaacttgcttcctcaagtgacaccgggaccaaccaacgatccttcgggcggtagttataaagtcttgggaaacccttataaatattacatgatcggcgagtataaagatacgcaaattaactcaggttatccaattatgacatattacctaccatatgaggataatgtcaaagcaattgaatatcggattattccctatgatcaggcgactaatgaaccaattccaaattatgacccggttaaaaaatctgatctaccgggaaccgccgttgaagttccggaaattgcaggttatacaccgattgccaaaactgtcacggttcctgaaaacggcggtgatgtgaaggcttggtataccaagaacccggttgctcagggtacggtaactgttcattatgaagatgatcagaataatcaattgaaggatgacaccagttcaactggggatgttaacagcccttatacggcgccaactcccgatgcgacaattaccgttaatgggacaacgtacaattatgttggcgtgaaaccgggtgaatcaattcctacgacctatacggatcagccgcaaagtttcacctatgtctattctgaaaaggctgttgatgttgatttgaactataccgttaagacgattgatagcaacggtcaagacttagggaagggctatactgccagcggtaaatccggcagtgtgattaaagcaccagcgattgatggttatacggtcagtccagcccaaaccgtgttggataaagacggtcagattattactttcgtttacaccaaaaacagtaccggcggcggaaccggtggcggtggcatcattacgccgatcattcccgcaacaccagtgactccggctacgccaacaaccccggcaaagccaatcacgccagcgacaccgatttcaccgactgagccgggtgtggtcgcaaagggcgaagttatctacgcggttaacaaagtttatttatacaagaatgccactttcaaaaagagtcagcgagtagccagttatgacaagaaaccgcgaattaaccgaccaatgtttgtcgtgaccgattatgccaagtccaataatggtcgtttgcgttataaagttcgggatgttaaccatgtcacgaaaaataagtatcgaacaggttatctgacgactaattctaaattcgttgtaccggtttattatcaaagtaagccaaaagttgttaccgtcattaatccaaagggcgttaatgcttattacaacaagaatttaacccgtaaagttaagaactataaacagggaaccgttttaaaggttaagggaatcgttcgccataatctaactacccggtttatcttaactaatggccgccatatcaccgctaaccgaaaattagtcattacaggtaagtacaaggcagccaagatggttcaagctaagggtgcgattaatcgatacagcaatgttaatttgactaggaaaaataaacattacaataaacagaccaaaaaagtcttcaaggttaagcgctgggagtattcccaagccaacagtaccaagaagcacggtgtgttgagataccaggttgctggtggttatattactggtaattcgaagtatgtcaaaataatcaaataatagtcaaaaataattctcccaattttgtttgaattgggggaattattttttgcccttttgagtgttacaaggtatatttgctggcaatttgagaggtcaaatggcatttgcttcataaaacatggcaccctattagttgttaactgggtgcatatatgttaacatactttacataaattcgctctgatataaatgataatctatatctttcaaatcaacgtggcagataagtctgcttttgattatgaaggtgaacatctttgaaaggggatgggagctgcataaattttaaatcgatctgaggggaaccgtttagcttaacgagattgacttggggtgattaaagtctgatcggatagctattaacggttatcgtaattgttggttggattcgctgcttttgcctcgaaggaggaagagagatatgacaaaaatttcaacaatttttcccgactatcattttaaaaatgaccgcctgacgttattagcagggccgtgtgcgattgaaacatatgacacctgcgctcaggtagctgaaaccttaaaagaaattactgatgaacttggcattaactatgtcttcaaatcatcttttgataaagccaatcgaagttccggcgattcaagccgtggtgccggcatgactcatggattaccgattttacgtaaaattaaagagacttaccacgtcccaattgttaccgatgtccatgaatcatatcaatgtgaccctgtggctgaagttgcagatgtgctgcaaattccagcattcttaagccggcaaaccgatttgttggttgctgccgctaaaactcggcgggtggtcaacatcaaaaaggcccaattcatggctcctgaggatatgcagggagcagttgataagataacgcccttttcaaacaaaatcctgttaactgaacgtggttcccaatttggttatcatcaattgattgttgacatgaccagcttaattcgtttgagaaaaatgggctatccagtgatttttgacgccactcattcggttcaggttcccggtggtcacggcaatcattctggcggtaaccgtgattttgcttttccattgatgagggccgcattggcaattggggtggacggtatttttgcggaagtccatccagacccaccttcggcaatttcggacgctgacaatcaattgtatttaaataaaattaagccaattctaaccacggccgtcaaactgtttgatgaaaatcgtcaacaacaagaggagttgatggcagatggcttactatgaaattgcaaaggagatttttgaagcagagaagcaggctctaactgaagtatctgagcggttggatgatcattttgatcaactggttgatattatcgacaaaactagtggtcgggtcatctttatcgggattggtaaatcagaaattgttgcgcaaaagattgccgcatcattgtcgtcgattgggcagcctagttttacgttagatgctgccacaacgtttcacggtgatttaggtaaagtttctaaagacgatacggttctgtttgtttccaatagtggtgagacccaagaagtgattcaaacgttatttgcgcttagaacgatttttcccaacggctttacttcaatcgccctgacagggaaccctaattccactttggcgaagaacacggatttattgatcaacctaagtgttgcaaaggaagcggatgttaccgggctggcaccgacatcgtcgacgacggcaacgttggttttaggggatgctttgctggtagcgttggaaaagaaacgatcgtttgataagaaacattttgccctgtaccatcccggcggcagcattggcaaaatgcttctgcaacgggtgaaaaatgtgatgcacacaaaaattccgtatgtccaagaagaaacaccaattaatgatgtgatttatacaattagtaattttggaattggcatcactttggtgagaaactcggcgaccgatgaaatcacggggattgtgactgacggtgatattcgaaaaaagtttttggatgtgccggcggtcaagaagtctgtcgcgaaagattatatgacaagggattttattagtatcaatcaagaaaaaagaaatcaggaagcgtggcgggtgatggccggccataacatctccaatttggttgttagagacgataagaatcaagtagtgggggtagtgacgattcacgatgtattttaatcgtcttttgtctcaaaccgcttctcggtaatggtctaattacacaataggggggctgagacaaaagtgattttgtccagccccattttttgtaatcacaactattaccaagcgaaaacgtgagataaaaggcaacttcctgccgtacaaccgaattatcccaatattcaagccctgaatattgggataatccagttttactctggaagttaaccgccctttgtcgcactctgctttctaatgtgttttaattgatgcgtagtgtgtggttagaatatcgttgcgctgaatgcttatcataaaagaaggttatttgtagtaatttaattacgacttttaatattaaaaaaatgattgtcatttcacaagacgagactatgattagaaatatagtacagtggctaactcgaaacgatatcgtaaactaaacagagaaggtgctaatgatgacaaacaaagtcatgcgtagtaagacctattcaacatgggcgagccaaaaagttggtgacaaagcaaaagaatacttggccaagtatgatatgacattgtctgaatatatgcggttggcattagtgaaagcggcaaatcatgaagtgaaagtagtgaatttcttggagacaccggaagtactcggcgctaaaaaggaagttgaacaaggcggcggaaaaacgtttgattcattggaagatctttggaaggatcttaatgaatgaatttaggtggttgtttggattgtttgatatcatgaacaaaacttattttctaatattactctggatcctaaaaaagaacgcatgtcaaaacgctgctgcccgccctctttaggataataactgttttgaatttgtgattaaaggattatttaggccacaaaaaagtccctgttggcgtcagatggcgtggtagcggggactttcttttagataattctgatctgtgccgccgcgttttaagcggttcggcttacctagcgaatacactaatcattataacatacgtttgacagtcaatatcattttgggtgaagaatattaaaggattattcacttattgagttactgaacgttgtgcttcttcaagtagtcacttaatgggactaatttttcagcataataacgtttcttgaaatcatcaattgtcttttgatcatatttatcagcgtctaatgtcaatttttcaactggaattggtcgctcattggtaatcttgatatcaattaagactggcttgccagctttagttagctcaacggccttatcaaaagcaggtttcatttgatcaactttgtcaacggtgatgccagtcatgccctgaccttcagctactttagcaaaatcagtctgtggcaggctaataccgaaccattcgtggttgtcatcctcttgctcatcttcaataaagccaagggcgtcattagagaagacaacgttgataactggtaagtggtaggcaacttgggtgctgagatcctgcatgaccatggcagctgcaccgtcaccagctaaattaaagacttgacgatttggatagctcagctttgcggcaattgatccgggtaggccgacacccattgtggcaaatagtcctgaggtgatccaaggttgtttgccattcactttgagtaaccgaaccgcgttctgggtgacatcgccaacatcaattgagtaaatggcatcgtcttcagaaattcgattaatttctttaaacgcaggctcaaaccgcaaatcaccatccgttcgattcatcatgtcatcattgtattgatgccaattggcaacattatcaacattggctgcataccaggcagatggttggctgtcttcgcctaattgaatgaaccgttgcaacgatttcttggcgtcggctaaaatggcaacatcggtcttgtgacgtttaccaagcacttgtggattgttgtcaatttggatgaatttaacatcaggtttaaacatgacttcggcaaatggataattggaaccaacaaacaacataaggtcagtctcttgaagcgcttcgttagctggttttgaagcaactcgggcagccgatccaagcaaggcttcaaagtcgtaaggaataatttccttgcctaaagcggtcgtaatgactggaatttggaatttcttagcgaattgcatgacttcatcagcagcgccataggttccttgacctacgtaaaggattggcttcttagcttgtttaatcaaatccaaagcttggttgatttgctcgtcggaaccggcacctaattctggtctagcaaagttcttagctgagctatagtaaccgtcagctgggatctctttgtctgccagatcatttggaatggtaacgaaagctggcccgtgttgcgcaaacgcacgacgaatagcttcatcaaggatatgcggtaaactttcagcggtcataacagttcgagcgtaaacgccagcatctttgaaccatgggttttcatcaaattcttggaagaaatcttggttcatgagtgcttgtgggttttggccaacgatgaatagggctgggactttatccgccattgcatcgtaagcgccttggtacagatgagtagcaccaggaccggctgaaccgaaagcaacaccgatgtgaccggttagcttggtatccgcaacagccgccaaggcaccgacttcttcgtgacgaacatgaatatatttgatgcggtctttttcagcgtccaaagcgtacatcaggttgttgaccgttccacctgggatgccataaatatgatcaacatgccagctttcaagggtccgtaatgctgcaatacctgagttaattgtatttgccataatcaaaatcccccgtttcattttttgatcgacaaccggctaacttgcctggattgtctggaatgcagtcgcgctaaaaggcgttgcattcgacttttcagtattatgataagtttctttgtggggaaaaacaattaaatgcacttatgaattgtaagcggattagttgccggtatttcactgattgacgcattaaaattctcatcgttttgaaatcataacacagggtctgtttgttaatggggtactatatatgctataataatccgtatagccgaaagataatgttaactagaagttgaacctttgccggattgttagaaattgccaatggtggtagttttcgaacgactctctacgaaagggggctttcaatgttacaattacgcgatcagttatttaatatgttggctaatacgccattgccgaaaaattatcggatgtcattaaaggcgttgtatcagcggacagacttattttgggactatcaattttctgagattgcccaggcttttgaacaattagttaagtcccacaatgttaaaggaaaacgagtaaagttgaatagtaagcaagaagattgggaatttttaggtatcctatgatgatttcattttcggcttgtcgaataaagattctgcttcagtttataaaacatcaacaaataaaagcaacttgaaatcgccctttaagcgaatccaagttgcttttatcattttgaacgtatcattattagccctttaaaactgaattccaaaataggcggtctttgatattgatatttaaattaccagaacgatcggattctttttcaaaatgcttagctaaaaaattcttcaatgttttcatgataagcaatacccccttggtaatagtcaaactaacttgaaattcatcaaatggcgttggaataattgattcttatatgatgttgtcccttttcaactccaactacagtataaggcaaaaatcgtatagcgggttaataattgtgcctatgtttacgcttacattgaaatattttttacatcagtgtaacaattgtcatcgttttggcttatttctgtaatatttggtttaaaaaaacaccataaattaaattccaggcagtatttatttgtttagtgggtattcaagatggagaaaagcgccaatccgattagtttattttttcaaactggtgcgctaaagttaacttacattgattaaagtcgttgtccattaggaaagaagctgatttggatggcaaaagattgggtaaatacagaatttgaaggctcgagtttaaccgcttttaatttggagcgggatgcgcgatttaaagaattagaggaacaggtccgcaatttacaaattgagaatgcctacctaaaagaactgcggagactggggaagcgcgggaaatcattaccaatcaagaagtgtcgcggctgatccatcgtctccggttcgcgtttaaattacaagatatcttggatgttttgcatttttccaaggggacctatgaatattgggaaggtcggttaaatcgccaagatcgggatgctgaattagtgacgttaattcgacagattcgcaaggaaaacaatgattatggttatcgccgagtaactggtgctctgcgtgcacagggtgtcattgctaataagaagcgggtccagcgaatcatggcgaaactggggatgcaggttaagacctttgtgccatctcaaactgatacatatcattcttatcggggaaccatcggcaaagtctcaagaaatcggttgcggcggcattttcggactagtgtttgtcatcaaaagattgtcacggatacatcagaattaacgtatcttgtcaggcaggccgatggttgttggcaaaagcatggcttatttttggatgcatttatggatttatataatagtgaaattattgcctaccggatttcggatcatcctaatgaacaagcgattttggatggtctgaatgaagcaattcaaaaaacaaatgactgtccatatcgacggacatttcattctgatcagggcggtgattatcaagaaaagcaatactgccaacttttaaaacaccaccggatttttcaaagcatgtcgcgaaagggcaactgttttgataacgcggtgattgaaaatttctttagcttgttaaaacgggaaatgtattatggtagagattttcgcaactatgggactttaaaagaagccattgaacaatatatcgattattataattgtcgccgaattaaggaaaaattgggatggcggagtccggtggcgtatcgggagagtactcaaagaaggtaagaatatcatatatattttaaaggggattgattactcggcctaatcaagttacggatcagccttttaaatcatgaatagtaagggcttcggctgtcaatcggggttgagatcacgttataatgagggcgtatacaaaaaataattcacaagggggagttatggtgtgaatattaaaataaaacgttatttattgactgttagtttgatgatcagcggagtagcacttgcaccattagttgggaacaacttccaacattatccgtttatccaaatggttcaagctgcgacgacggctgtcacggatagcacaaaactatcggaagtgatgcctaatgaaaagttgaggaatttggtttggtataatgttaactggcaatatgatcaagaaaacaagcctgaagttgctgatactgacgctttaactgtcggtgatttagggcaactaaaaatgttacagtggtggccagaagcatattatcctgatccggattacatggcttgcgaaccgcttaacggaggtaatggtgccttagggactgctaatccaggagggtcttattctctcgaagggttacaatacgctaagaatctgactactctagatattgctcaaaactataattatggtaaaaagtatcggaacaatgatgttactgatgtttcaccattagctaatttaacaaaattgactgatatcgatctacatggtaatcgaattactgatattacacctatcagtaagctaccaaatgttacgagactaaatatttcgtataatcacattagcgatctatcttctttaaatacgtcccaatacacaggtagttttacttatgactaccaagtgattgtcttacctaaagtaaatttagctggtaatagctatacatggaagaatccgtttattggcaaactgccacaaggggtagattacgatcagactaaaatttctatgtaccccagtgaatttactccttctcttgaccttgatggcactagttttcaagcgttcttttataatggtgatgtgcccctttatagttcaggaaattttgtttttaataatttgactaaacaagttattcccggaccaacaacggcaacaattgatggtcaagtacaaagacttgtacaaaacccgtataaatattacatgaacttaaactataaagtagcaaaacagatgacatttgttttctttttaccataccaagacaatgtccaaactatagcctataaaattattccgtacgacagagcaacaggcaagccaattccaaattacacgcctgaagaaaagtcgggaatgccgggagataaagtggatgttccaacaatttctggatatacaccagaaacaaatcaggtcacaattcctgccgctggtggtgatatcatcgcctattataccaaaaaccctgccagtgaaagtaaaattacggttcattatgaagatgaagctggtcattcaattcaggatgccacgacgacatcaggtaaaataggtgatccatacaatgccagccatccggcgacaattactaaagacggcacggtttatgaatatgttggggttaaggataacagagtgttaccaaccaagtatgctgaaacggatcaaacgattacgtacctttataagaaatcatcaagtggtggtaccggtggcggcggaacgccaaccacgcccattcagccttcaacgccaacgactccagcaacaccaatcatccctgcaacgccgattacaccatcaacaccagtcaccccaactaatcccgatgaaccgggtggcggtctgattgcggcaaaaaatgcggccgtttattcagttaaaccaatctatctgtaccaaggtaaaaacttcaagaagtcacaacgaattgcgttctacacgaagaagccatgaatcaatcggccaatgtttgttgtcactggctatgcccgttccaatacggggaagttgcgttatcaggttcgtgacgttaaccatcgcgctaaaacagcgggtaaacggggctatattacggcaagtaccaaatatgttttgccggtttattaccagagtaatcataagacgttaaccgtaattaacccgcgaggtgtcaatgaatatcgccaaaagaacctgaccggtaaagttaagaattatcggcaagggacagtcttgaaagttaaaggattcgtccgtcataacttaacaacccgatatcaattgagcaatggccactacgttaccgggaaccgtaagttagtggtttccggtcagtacaagcaacctaaacaagttattgttaagcatcggattaaccgttatcaaactgccaacttgacgaaacgtaatggatcttataaacgcggtcaacggatgacaattaagcattacacgtttagtcacgcgactaacaaacagaaacgtggcacgatgagatttgctgtcaagggtggctacatcaccgccaatcaaaaatttgtccgagttaatcgataatctaaggctttgaaatcgataattttgccttagcgatagttttttgaaaactgttggatttatcatgatgaactgaaagatgaggagatatcaggcaattgaattttgcctgatatctcctcatcttttttacataattattatcatggtaaaaataaatttttaaaatgattttgtcacattacttcaccaagatttcaccctttattaatatgaatatgcagttccttaaatatttcggaagtcgactgagtgattaacttggcattgagctgcttgaatttattttgagcaaagttggctttctgttgattacttgcagttaagtaattttgcaatgcggtggtgcctgccagttgttcggcaacctgatcactttggtttagagccctttgcatatggccttctacggctttttgaattggtttaatatactgagttgtaaaacttattggatagggttgaaccaaggtgctggttaacttgtaagtccagaatgctgaattcgggtcgtaatggtctgtgccaatctggtagctttgcggtgtcgcgttgatgtttgtgtaaaacgggacataaacactagtatccggagaggccattgccaaccattgaatgccggcaatggttttagaaactgtttttctgatttgaagtatatgcgattcatcattcattggcatgttaattgggcggtatttaccaacccagcggcccttagaatcatattttgtgccactaaaatggctggataaaacatcactgaccttattaattgtcacttttttatcaggtttcatcaggagtggaagatgtcttgattgaatattttgttttctacttggggttaagagtcgttgaccatcccagattcgtggcgtattatctgtcgcgtcctgtttattgttggttccaaatgcccgagcaaaattggcttcacgcattttatacccagataagtgatgtctttttataaaagtgataagcccctttgagatgagacactttttcgaattattcaagactaacttaccaatgctcagttggttggggatgattgcataatagttagccggaatttggatagcggcccattgatgtccagcgccgatttccatataccaaatttcatttttatccgaaaaaacaatcccgtctgattcggcagcaccaaatttgctaatcatcttacctaatctttgaacaccttggcgggcagaatggataaatggtagggtgacatctagcatggcatcctcactaatccccttcttgataaatggatcggcttgggttgcccgcttgtttgagttggtggattccgttgcactcatcgcaacatttgattcattgataccgtcttcaccatatgtgccatgtttcgaggtccagtcaggagttgcagtatatctctgctgctttggggataatgttattgtgaaaccatttccctttgaaagatagtgggttggcccttgactggtctgattatgaaccacaaagtgtttggcccaatttgttgcattgtcttcatttcgagcgataatcgttgaaccgtcttttgtggcatgattgccgatcaccagtgttgtgcaggctgaagcttgagttgctccggcgaaaatcacaataatcgctaaaccagctagaacgactttttgatataacttcatatttattctccttattttccaacgtcgattgaccgagattggtcgtcgatcacaaagttaacgtcaactaatttaaaaattgaaattaatctttccttgattgtccggattgatttgtacaacccaaacactgaaaagctttctttgggaacacaataaatatcaacttgaagatgcatgcctttcttaaatgccaaaatattgttaaatttccagccatcagggatgttgtctgtcacaatctttttgatttggtgttggatggtattagacgaaattgtgccgtctaatatttccctaatggcctgtttcatgtaaccaattggttgattaataaacagaataaccaaggtaacggtaataaagaaatcgccagtgtataagagaaaggagagtggtgagcgcgctgaaataaacattaagccaattgcgacgacaccgattccagcagacagggcaacatcaataaaactattctttgattcgactgataataattcgctggtgccatttgtattggcatttccatggcgatagacttttaagagacaaaagcccaggctgaccattgcaatcgagtaggctaaaacggggacagcactgattctggttccttcacctgtggcaaaataatggtaggccctaagactgacgttccatgttgtaagtcccattaatgtgatcaccagtattgattttaagaagatataaattggctctagattaaacaatcctttgggaaaccctctgattttgttctgactgactttggaaatcgtgatggcaatgatgccggaaataacttcgattaaaacaaatgaggcatctaaaaacagtgcttggaggtgagtcaccgaaaagatggctagcccggtaatactcatcagtaaattaatgattattccgatagttaaagttcgctgctcggtatttttgactttcatgttgggtgtgtctcctttgaaagtaccacttgttatttttgaaaagaattggcatactgatctaataatagacatctgtttattaatgaatatgtgttcattataaagaaattcatttttgtgagaagatcagtttgatacagactgtctggtaatggacataatcaacagaattgaccattaggaggaaattatggggcttgatagacgtcaaagaaaaacccaacaggccattgagcgcgaattcattcgtttgcttcaggccaaaccgttaaataagatatcagttgcagaaatcgtgagtggagctgatatttcgagaagtaccttttatctgcactacactgatatttatgagttgtatgatcaaatcaacaatggttttttagacggattggttagcagttttgaagcttactatcctgctgtcactgagagttattttggacttgcccaacgattaatcgattatattgtaaagaataagaaactatcaaaaatctttattaacgaaaataatgtgtcactgattgataagctctctaagatatttattgacaaagtcttggcatttgaaaaaattgattccaataactatgaggaatattacctggttgtctggtcagttagaggaatgattggtgcgattattaattggattaatgaaggaatggatcccgcagaaggaatattcgttgacgttatgagaaaaattctggatagactttaggagctatccagaattaagcagaatgtggatcgttagtgataagtaaagacaatcaaattgctgatcaaaagtttgtgaaagttaattaacaatttctcattttaaaaaatatcaaatattatccatattttttaaaaatgtataaaatgtaattagcatggtcgaaggataacaataagatttttaaagtgattagttgccggagacttgtgatgactaggcactataaacctgatgacacatgagtttgcctagaattttcacctaaatctattaatactttttgccgttattctgaatttttgcataattttccataagaaatgtgttaaaatactaagcaattagtgtgattgacatgtgaaatgtaaacaggaggattctatgcaaaagtttatacctcgttttcaatgtaaaaatttaattgagcagttatttgatttagccagtgagcatcattttaacgctaatttagttgatgcttattcgcgtaatcaaatgaagttgcaggcgattgatgattttgcaatgattggtgtcggcttccaaatggtgaacctgccgaatagcgtcacggcaatcggcgaaggcgcttttgcacgcaatcagctcaatcggtttgatgcgcctgctcacttacagcggattgacaatcgggcattttggtataatcacattcgctcgattgattttaattcaggcatgcaggttgccgacaacgcctttgatcatcaggaaatcgcttattcggattttgacttatacggtaagctgcacagctttaaaccagatgagttgattagtatctatgtcgaccataagttgttagggccggatgatgttcgggcagaaatcgattcatccatgattgactttgattgcattcaatcgggccgccggggtgtgccatcgttccgggttgtcgatgatgggcgattaattaagccaatccacggcgtcaatatgggtgattctggtttcttgaagattgccggttattttaatctaaaaatattaccattggatctaaccattcaccatgtctatttgagtgtttgatcgaagagcccttggatatggtattaaaaaagaagagagtgggacgaaagttgccttttggcgcacgttttcactcggtaataatcgtgattacacaaacgggactgggacaaaagtaattttgtcccagtcccgtttgtgtttgaattgatgattattctcaaattatttatatctggtcgccaatgacttaaagtgatcataactttcaattaacaattcttttggcgatgcgtcatacataatgcgaattttatcgggatggcttgattggcggtctttataaatttgcgtattgatatggtgtgatgcgtgtttcaaaacaaatgccaaatcagtatcctgcttttctaattcattgaaaattttgtcgccgtctatttcaccggggttcagtacctcaatattgacgccgtaatatctaaacaaactggcaaaggttgcctgtttgaaccaagaaaccaccttaatcgtcttgtcggttagaatgtcaatggcgtcaggatggtcgggtaataaaatgctggccaacccggttttactggttggcgatttctttgaatggtgaattggtgaaaaagtctgatcgttgttggccggaaccgtataatgattgtcaattgtaaacgtatcttggtcaacatcatattgaccccgatacgcgtcatcaaaattgattggataccttgccggaataacgggatcgggaaagacggttccgttgattgagacaaaattagtttggtcgtctgattcttcaagaaaaccgtagaatcgagatcgtgacggcggattggcggggtcaatcacttccaactgggcggttgtgtgaacttcggattcgaatcggtaaaagaatctgtgatacagtccaaatatcggctgatagttggtaatcggttcatggtccatccgcctgtataattcatcaatcagctgcccggttggtgcctggcctaatgaagatgaatttggtcgtggcgatgaattgagcaattgagacttgatttttaattcttcgtgtagtgattggattcgagaccctaatttattgattgtattgcttaatgatttgttttgatcatcggcttgttgattagcgtgttgaagccgtttcaatgcttgtccttgggagcttctaatcaagacgttcagggcatgcttgacactttgtcgctggttcttcgctcgggttagttttgagcgcatttcctttagttgttgggataactcaagtagttgcgaggccttttccgaacgactttgcttttcgctggtgagccggttttctagttgaagaaattgattttgctgagcagcgccttgatcggtgagcagcgtaatttgttttctaagttgggcgattgttttccgattatcgatccgctgcatttgaagatgggtatttttctgactgagggtttccactttttgagtgagctttttcactttggttttgtcttttcgatagcggatgtaaatcttttcgtttttagagggggattttgatgtgggagatggtgttttggattggtcggtgagatgatgtttttgatatttctcaaatagtgcttttttagctgccaatgcagattttttattgtcacgttgtttttcaaattctttttctgagtatgatccttgcatggcagatagcgctttctttcggtaacaatgattggtttctttaaatttagtatacgttcacttattatatacgtaaaaatcggtggatttaattaaagtccgtcaaattagttccactaagtgtatcgagaagccaggatgatacaattaacctggtaaactgtgttaaactattaaccagctgatctgtcgtgccgaatagaaactggagggcgaccatggaacaatttgtacctcgttttcaatataagaatttaagtgatcatcggctgatgttaaccaatgttgatgatttttatggtaactcactggaagttcatacacccaagggactccacctggcggaaattggtgattttgcgctaactggactaggatttcaaaccgttaatttgccagatacggtgacaacagttggggaggcggcatttgccagaaataatttgtctactttccgatcacccgaaagacttactaagattgataatcgggccttttggtataatcatttgcgatcaattgaatttccgcgaaacgttaaaattgctggtaatgcgtttgattatcaagaaatctggtactctgatttcaaaacaccgcatcagctccaatcgtttaaaccaactgaaatggtcacgatttatgtggctggaaaacagttaacaaccgatgatgttcgggctgaactggacccagcgatggttgacttcgagaaaattgaagctggtcagcgaggtgtcccgtcatttgaaattgccgatggtgggcgaatcatcaaaccgattactggtgttgatatcaatgatgatggctttttaaaaattggtggttattttaatttaaaggtgttgccattaaacttaaccatccgacatatttatttaaactttgaggctgagtaatttttaaggctgatgatctccagcaaatgaacttaatgaaaaaatagtgtggcgggagtcgtttaatttgagagttaaatgggtttccaacgacacactatttttgtgaaaaccattgaaagcggttgcaaatcaactaatgccgttttataataatgacattaagttaaacgtgaaagcgttatcgaaatggaggcagttattatggtagaaaaagatagtcaaaaagtcgaaaagatgctggtagtgcttgctgtgggcctgtttttcattgtggggattgctgcaagctttgccctttaagataaagtataatcgttttctatcaaatcatttgattccttcaaattaacactggtaataattgtgatattaaacagcgggattgaaacaaaaataacttttgtttcaatcccgctgttgtgtaactacgattattaccaagtgaaaacgcgggacaaaaggcaacttcctgccgcgtaactgaattatccaaatattcaaacccggaatatttggataatccgattacgctggaagttgccttctgtcccgctctctttaatattatttagcaaagtaatcattaagcgtcggaattgcttctccagttaatgctgagactttaaaaatttgttgaataccggcttcacgtaattgtccaaccgcgtagtcaatttctgcgggagtggcaatatcgatcttgttaataatcccaattgcttggggttgaaacatcgtgacaaagccaggcggaaagattggtcggttatcagtggcactttgaatgactgcaatcatattggcgttcaccgacgtggtaattagcggcgtataaaaatgtcgattctcagtgtactctcccggagtatcaatcatgtcgtcgcagaattcgatggactgagtttcactagactgaatcttttgatgatgtaatcgctgaatgagggttgtcttgccagaattgtgggcaccgacaaacattgcttttcgcataacatcgctcctatttattattcgcacgatcagatacttaacgcctattattttaacatgattgggttagttgatagtgagaaatttcgaagaatcaatcgcggctttgcaaaaaatcagataaaaatgtgcaaatgattagtcgccccatgacagattgtgtcacaatgcaagtaggggactgatgtcgttggacaaaaaataacaaccacggtcatccgacagcgtggttgttatttagtcattatggatttatgggtggcaaaggaattgaaccttgtctccggaatgattattccgttgctctaccaactaagctaacttcccaaaatcatttagtggttataagataacataactaaaatgacgcttcaacgatatatttgttacaaatgttgtaataaatacatttgtgaattaatcattaagagatatcagcggttattgggataagtaattgaaactttttttgaaactgaatttaattagattgcttatctttcagtaaagaaagcggttaatgaatagtgagatgattatggcaaccaagttagaattgaactgatttttattttacttcgtgatattgatatcaaaatgatatataataaagttatattgtggtatgcaactttggaatttgagaggaaatggggttgtcaatgacagttaaaagtcgaaccgtccatttaatgggcactgtgattaaagttcaaattgaacatgatgatcccgaaccaatccttgatgaagtggttcggcgattaaaatcttacgaacaacggtttagtgccaatgaccgtcgttcagaattaatgcaaatttctcaaaaagctggattcgagcctgtcaaagttgatccagaactatatcagctaattaaaattggaaaacagatcagtgttcatcaaaatgataatttgaatattgctatcgggccactggtgagaacttggcgaattgggttcaatgatgcgcgggtcccgactgagtcagaaataaattccgcacttgctaaaaccaacccaaacgatattgaattggatgatacgcaccagacggttttcttgcggcggttaggaatggcgattgatttaggatcgctcgcaaagggctactttgctgatttgattgcggcttatttaaagcagcaggacgttgcctcgggattaattaatttaggtggtaatgttgttgtctttggcccaaattttaaaacaacctctggaaattggcgaattgggattcaggcacctggacagccccgtggcacccatcggttgatcttgaatctgcaggataaatcgattgtgacatccggaatttatgaacgacatttagaacaagctggtcatgactaccatcatattcttgatcgacggaccgggtacccggtgaaaacagatcttgccagtctaaccattatttcggatcgttcgatagatggtgaaatctggaccgggcgactgtttggtctatctcagaatgggatcatcgcgaagctggcagtcatggatgggattgatggtgtcttaattaataaggatggcagtgtcatttctacgctgccaaagcaagcaacagttattttataaactagattagagtcgtgaatcgcggctgaaaatgtgatattaaaatgggggatgacgataaatgaataaatatattggaattgttggaacaaatacacagcgatcgaccaaccgtcaactattacagtttatggaacgccattatcaggaccaggctgaaattgaattagtcgaagttgctgggttaccgatgtttaacaagcccgccgatcgagtaattccagatcgggcagctgagattggtaagaaaattgatgaaagcgatggcgtgattattagtacaccggaatatgatcatgcggttccggctgttttaatgaatgccttagagtggttatcatatgggattcatccgttcttagataaaccggtcatgattatcggggcatcatttgggtcacttgggacatcccgggcgcaggctcatttgcggcagatgcttgatgcacctgaacttggtgctcgaattatgccaagttcagaatatttgcttggccacgttttggaagcctttgataaggatggcaatttgaatgatcagggtcgaattgaccggcttgatgctttgtttgccgactttgaagagtttgtcaaaatttccaaggaactttggcacacgactgaatacgataagcaagaaatctctaagctggataaaactgactttggttcaaattagccaagtcggtttaactgtgagttaaggaaacataaaggagacgcaaaatgatgaaattagttggaattgccggaactgttgaggacaagtcatacaaccggatgctgcttgaatttattgcaaaccatttcagtgggctagtggatattgaaattctaagtattgacgatttaccaatgtttgatcaagataacgatgttacaaacagtggcgcagttcagtatctgaatcggaaaatcagcaacgctgacggtgtgatcatcgctactccggaacataatcatacaattacggctgcgttaaagagtgctctggaatggttatcatttaaggttcatccgttttcagacaaaccagtcatgattgttggtgcgtcctattatgagcagggatcttcacgggcccaattgaatttacgtcagatattggaagctcccggggttaacgcaattgttttcccaggaaatgaatttttactggccaatgtgaaggaagcctttgatgacaatggtaatttgaaagacgaaaagacggttgctttcctgcaatccaatttgcaaaaattcaagaagttcgtcaaagtgattaattcgatgaacaaagcagctggtgggactgatgaagcagctcaggctgaagatttggatgcgactggtaagatttcgaccacggttgaaggcgttgatatgactgccgatgactgggttgaacaagctgctaaaaaagtcaacgctgttgatggtaagacatacgttaagttagatcgcggtcttttgacagttgatcaattaaactatttcttaaattcgatgccaattgagttgacttatgctgatagtaataatcaatttatttattacaacaagatgggtggcaaaatgttggcaccacggacaccgggccaagttggcgatccattgtcaaaagttcatcccaagcgagctattcgtggcgtcaagagcgttattcacgcattacgaacgggtaaaacggatatggttagtatgccggttcctggtaatggtcctgacaaatatatcatgcattattataaggcaatgcatgatgaaaagggcgagtacgtgggaatcaatgagtttgttttggatttgattccaattattaagtggtacttgaagaagaccggtcagaaattgacggcggatccaaacaacaaggtcgatgcggacgcgagtgcttcgaccaaggatgattcatcaacggatgcggatgccagcgcgtcagtggatgatgatgccgctgataccagtgctaatgtcgatacggatgcaagtgcatcagtcgacgagaacgacgaatcaaccacaaccaatgattcaaaaggtaaggatgatggtggttcggatgcaacggcaagcgcgtcggtggaggactgggactagaaacagagtgcaacgccaagcggttagatcccagaatataagataaataatccggatatccctgaacttgggatatccggattatttgttttatatggccgggatctgcttggctttgcacgtttcggccaagtaaaattggagatgaaccaaaagaatagtgaggggttatatggccggaagctgcgacttttcacacgtttcagccaagtaaaattggagactaaccaaaagacaagtcggggtttatatggccgggatctgcttggctttgcacgtttcagccaagtaaaattggtgatgaactgacctactttgtttatatggccgggatccactacgctctcaaaatatcacatcaaagttgtcccattccaatcaaaataggtagtaaaagcatgaaacggcccgccaaccagcggccgcttcatgcttttattatgctatcggatttggtgatatactaaatgtagaattaaaaaaaagggcttttagtaatctgatttcattccgatattgacattggtaaaaccttaacggataataaaataatcactatttggatgaaagggttgtttatttgatgttaaattggattgagcttgcgtatgacattattcacgcaggtgttgtgccgggtccaccacatcattggtaccaaaattcggtctgggtgggaacaaaagaaatgatttcactactaacgttactaggggtactgattgccattgcaacgttttatcgaaattccagagttagaaaatttgatattacgcttcaagcaattgatttttacaatcatgaaatccgggatgcaattaacgatttttcggattcgttcaatgaatctttggttgataataaatttcaagggaaagatattaatacagcgatgataattgttgctaagaatttggatattcgaaaagtaatccatttattagatgagttgggattctattttactaatcgaaatattaactcttttcaggttaaagcggtcatcagttcagaactgatagcctttttgagagataggaaatatcgtaagttgattaatcattttgttagtcagtctaatttaattggtatccaaaatttgtatgagaatatcggattagaaaatggaagtgatcaaaatggctcaaaagatacccacatatgaaaatccaaaggtaattaaagcaaagaaagaggcacagaaagttattcaagagattgatgatggcaagataacgagggaaaaggctgaacttgatgctgtaaatagcgttttagaggaattgggtcaacctaaagtcaccaacttgagtgacaaaaaatcagttggatggcgtaaacgttcaaaaaggattcaaagaaagattgcaattcaggattttttaaatgtaatcacctttggcctttaccaaggtaaaggtccatactgaacttaaaagttcgtgactatttttggaaaagatttgttgataaaataaagaaacgttggtgacagtgaaaatatactgtctccagcgtttcttttgatacaccaaccatgttgatttattagcaacgcaatctgttcagggcgactttcaaatcaacatcattaaaacaatcgttaacatgtcacaaagggataaactggcaagaatattcatttgtaactaactgctgattcttgagatgaagtaatcgtataatgaaactaatcatgcttggattatctggaatttgaagataggccatcattaaattggaggctttttatgaaaatcaatcaatttggttacgtgccaactcaacaccaacaaatcattgatgagttgcgtgatattcggtttttagatttggagaacattaaaataaaatcgccattacacttatttcgaagtttgctgcttaaatccttttctgttcatcagggtgaaacgacccgaagagcgaaaatagccagtatgatggcaaccgaggcggttgatgcggacacgtatactaacggttcggggactttgagtaagtcggccttttataatattggtctgcaactattaggcttcatggttgatctggatttttcactgaccaacccattaaagatgatgaccgaagttggcctgccaatcgccgaggtgactgacccgctgacccgcgatgatgtaatcgatgcctggtaccgattgttgaatacccggaccaaatttggtcaattgttgattgatgaacttgctggggaggggtattatcaccaatttttagctgatgagacctttaaacggccattaatttttaatggcaaagcgcaagttgtttttgacacggatcatctggttcgtgaagttgtttacgttgagtcaccattagatactgatcacgatggtcggcgagatcttttgaaagtgaaactgattcgaccggctgaaactgatcgtggcttgaccgttccagttgtctacactgctaatccatacggcgaggggacgaatgataagtggtctgaaagttggtcacacgataataatcgaccgttaaaacgtaaacaaccaaacaattttacatatagagatgttcaagatacatatgatcattcaaaagtgccggtaccaagaacgatcaaaggtcatacaaaacagaccgaggaaacgtttacgatgacttggacctattctttaaacgattactttttggctcgcgggttcgctgtcgtttattcggcggggattggtaccaaagattcagatggtttccgaacgaccgggacgagggatgaaacgatcagtgccatttccgttattgaatggttgcatggtgatcgggttgcatttaccaatcgggttgatcaaattgcaattccggcctggtgggcaaccggcaacgtcggaatgaccggtcgctcatatcttgggacgttatcgatcgcctcggaattaaccggggttggcggacttaaaacggccgttgttgaagcgggcatttctaattattatgactattatcgggagaatggcttaatggtgtcccctgatggcgacgatgctgacgtcttagcggagtttacgtttagccgccagcaatccgccaccgattatgccaaaatcaaggagccgtggcttgcccacctgaaacaaattaagcgggatcaggatcatgatagtggcagttataatcgcttttgggatgcccgaaatttattgaaagaaaatcacgcgaaggccgatattctattggttcacggattgaatgacgggaatgtcaaaccagctcaagtttggaatctacgcaaggcgttaaaatcgaaatccttaacccaaaagttaattttgcatcaagggcaacatgagtatttaaacaatttccggtcatttgattttaccgatattgtcaatttatggctgaccaataagctgctgaatgtggccaatcaagccaaccaagtgttacccaacgtgattgtgcaggataatgctcacgctgaaacttggcatggctatcaggactggggtggccaggaggctagtatccaaatttatcagttgggtgacgatcagatgatcaatccagggggtcgcacatcgttttcggatcatttagataagtcgcagttcgagacctatacgaaagatattaataagtggcgcgatgatctctattcacgggatggctcgccaatggacggtcactgcatccggatattgacaccaccgctggtaaacgatctggttgtcgacggtcggccgtcactgacgttaactgttaaaagcagtcaagcggttgggatgatcagcgttgcgttgatggattatggtaaagcgaatcgattgaccgctgatccacaagtgctggcatcccagcaaattctaaccggctatcattggcgaaaagatgatttaaaagaatttctgccaaagaaaaagtcgaatgatgttaaacgggtggtccagggacatatcaacatgcaaaaccgggaaaatgcctacaaggttgatgacctagaacccaatactgagtatcagttaaacttggttttgcagccaacattttggcgcttcttaaaggggcatcaaattggaattgtgatttatgccactgatatggcctatactgttcggggaaatcagaaaattgagtatggggtggatttggcgtcctcaactttaaaattgccgaggctaaaataaaattttctttattaaactgattatgattgcaaaataaattatcccacacgtacgctataacgtttgattgacgttatgacgtacgtgtgggataatttatcaaaggaggcgatcacatggcgattttattgaaagatgtcattactaaggaacacggtaagatgagctcgtcaagtttggcgaagaaggctcaattaccccggagtacggttgcagatgcgttaagcagaccaattggccgaacatcgtttgaagtgatcgttaaattactaaatgcaacttcgattccagttgaactggttattagcaagtatttggaaaagaaaatttctccagctgaagaagaggttcgtttcttaaatgaatctgatctggatacattaacaatcatgggagtcactttcagtaaccaaacgaatttttggaaaacacgtgatagtattttaaatagcatttacgaaggtgcccacccaagccaagaggacgttatggacgcatatcgacagctcgaagaacatgttcctactgatcagctaatctcagaattaactgataaatatcgaggccggtgataatggactggattaggcagacacttcaaactaatggcaccttgaaaaacaaatttaatattaaggattcggaagcattgcaagaattggaatttcgattgacgcaatataaatatcgatcgattccgactagtaaaattactgatattaatgatttgaaaagaattcaccgttggctgttttcagatttatatgattgggcgggtgaatatcgtccaggggactttggaaagggtaccactgaattctttccacgaagtcggtttgaatcggccatcaaaaatttgaatcagcaaattcaacatattaaccaaacaagctatcaatctgatttagtatttgcaaccgatttaggaaaattaatgtttgatatcaatgtgttccatccgtttagggagggaaatggccgagcccaacgattattcattcagcaattggctaaacaaaatggaaaagaccttcatattagaaaaagtgatccagcctatcccacatatatgaatgcgaccataaatgatgattatcatttgatggctcaagcaatcttgaaagctatcaaataaatggacaatgacgatcgactgatttatgggagcaatggaatttgagcttggaatcatagtggatgaaaggggaaagacaatggcatcccaagaagaacgcatgttggccggcaaattatacaatgtttacgacaaggacctagccaaaaaatatgaacgaaaggataatctgcttcaccgaattaatttcccacaagcagggatggatccacaagctgagttaaaacagctgatcgggaaaatgggtaaaaattcttatattgaaccgccatttttctgtgacttcggggaaaatattacggttggtgatgatttttattgcaataccaacgccatttttcttgattctggtaaaattaccattggcagtcgggtattaattgggccacgggtgagtttatttgccgcaggccatccaattgacgcgggagtccgaaataagtggctgggatttggcaaaccggttaccattggggatgatgtctggattggtggcagtaccgttgttaatctaggggtgacgatcggcagtaacgtggtgattggctcaggatcagttgtgactcacgacattcctgacaatgtggtagcagtcggcaatccatgccatgttctcaggaaaatcaccgaggatgataagcaggaatggcaggcgcaatatcgggattatcaggcagattaagcttagactgttcgtttaaaataataaaatccccaaacctatgtcattctgatactggcattttagagagcgccgaagaaaaacaaagatttctcaggtgtgatctggaaggaaattgagaaaatttgcaaatgattgttgtctcgtaagtagttgtgtttacaataatggctgtgtatacttaatgtatacgaaagtgagggagaggatgaatatgtcagtaaaaattagaagaatcggaaattccaatgctttgactgttccaagcaatattaagccaatggcacaagagtttgatgtttttcaaggtcgtgatgggatgattgtttatgtgccgaaaaagtatcagaatccctttcatgatgaagcttttattgaatcacatgacctttctcaagatgaggaatttgggggtaaactgattggcaaagaaatccccaaagattagtcgttatgttccgaaccaacaagacattatttggattgactttgatcctgcggtcggacatgaaattcgaaaacgacgacccgctttagttataagtaaccaaggatatagtcggatgactggattagtagtggttgctcccattactcatgcaaaaaataatgtattacgagatagtggcttcttggttccagttacgacacaaaacgtcgatggctttgtgaacccgcttcagttctacacctatgattatcgaaagcgtcatgccgaatttgctgatcttttggatacaccaagttttatcctcgctaaacggacgatcattgatattctgaactaatatcataaaaatgagcgttgaattaacaattaatcgtttccaatttggaagtatatttccagaaaaactaagcgatattttcgaatggataaaataaataacgacagctcagttttcccgtgtaaatcgagaaaactgagctgtcgttatttattttaatttgaaatggattcagaagaaacctgaaaatggggttaatttcctttcaatgattggctaacccgctccgcctccacacacttctgcaaggtttgtcgaatacttttaacaacgtcatagtccttaatgcctaagacatcctttgtgtcattgggatcaagatacagatcttccgtttgcatttccgcgctaactaccatgtgaatgccgtgttcctttccctcggcgtcagcttgttgatcaagttgctcataagtgggtttcatttgttcaaatgagacaaccggtacttgtgttttgccggtttgaccgagtgcctcgacgatcatttgataaaattcttgatatttcatatttttggcgctaattgcgtaagtcccacgatgcttgccataagccattgcaccgaccgctgcctcggccacttgttcaacggttaccatggccgtaccgccgcgcagggcagggaagaccggttgattacgggcttggtcaacaaacattttccataatggcattctaccgggcattgtcccaaaaatataaggtaagcgcaatgatgaaactttcattgaaccctcgccctctgcgaatgcgatttgttcttgcaataatcttgtgttgggataagcttgatctcttaaatgatattggggaagtcgttcagcaaattcggcgaagtatgagccaaagacaacaaagtttttaaccccggcttgttttgccaatcgggcaagtcgttgagtgggtaggacgttagcttcataataaaatttcatggctggtttagcgggtacgatccgttcgtctttgccggccgcataaataaacccatcacaatctgaaagcaacgtgataatgtctggatcactcatttgattgatatcacccagttgaacgtcaacttcgtgaggtaaaagattatccgccggcatcggtggtaatgccaccgtttttacctgatatccttgcgataatagttccttaatcgtgtaatagcccaaaaatcctgtgccacctagaacaaatacttttgtcataataacagcctccttgtttgtatcttcacaaataagtataatagagacgaacttaaaacaatcatcaaaaatcgtttaaatactaactttttcgaagaggtggcatgcatggttaaccattttccatatatcagctcagattatttatccgaggccttcaaaccaacggaactggcaattcgtcagatcacgatggcacaatcagaacgggcacactatcgaaatgaaattgaatttattttgatcattaagggtcaagcaagcattgagattaatcagttacaatttgacctgcaaccgggcaatcttatccaattaatgccatatcacgttcatcgattcattattgaacaaggccaatctctggcgatcattcagattcgcttttcaattggactattattattaacatcaactaatcggcaaacctatttaaaatcgatcaaagagttggataccaacgtgccaatcattaaattacctcaccatgcatttagccaattgcgagtgctttgccaggaagtcatttacgagaaacaggaagcggctgctaccaattttgaagcgttgcacatttctctgatttcatttataaatgtcgtcagttgagaaaacttggtatttcaataccgagatgaatcaacgtctcggacgaccaccgttgtatttgtctaattgtgaatcaatgtattgagcaacgattttttttgaaacattgcccaaggtactcataaagtaacttggagaccacaggtgaccaccccataattgttgcttggtctcagggaaatcactaaaccatcgtttagctgaaccgcccttgaaagacttcacaaccgacgctggcgtcaccttgggtgggaaacttaccagcatgtgaacctgatctggcataacttccaaatgagataactcaatttcgtttttctcggcgatatttgttaatatttctttcatcacatcaactttttctattgaggtgaacaccggttttcggtattttgtcacccaaactaggtgaaagttaaaatcataaacattagttcgttcatatttaatcatatgagtatctcccgtttcttttatactggtgatatgatacaatttaattctatcacatgttaaaaagaaaagagttggaaatatggctttaaaaggtattaagttaagaatctatcccaaccaagaacaacagttgaaaataaaactgaattttggatataaccggtttgtttggaatcagatgttaaacatgatgattaagcgctatgaaaataatcctcaggcaccgtttttaaatgcttttgccttaaataacttgttaccccaacttaaacgggagtacccgtggttaaaagaggctgaaagtaccagtctacaagcaacgtgtaaggatttaataacagcttaccaaaaattctttaaagaacattctggctttcctaaatttaaatctcgtaagtttcccaaacaaagctatacctttagaatgggaattaaattagttaacgatcaccatcttaagctacccaaacttggaacagttcgcttcaaatgcggacaagcagtcaccggtaaaattaaaaatgttacgattagactttcagcaacggagaggttttacgcgattgttctcgttgatacagaggtaaaacaattgtctaagaccaatcgggcagtcggaattgatctgggcgtttctgatttaatgattaccagtgacggtatcaaatacccaaccatccgatttgataaaattctagctcgaaagaaacagtactgggaaaaacggttagctcgaagaagattgcaagctcagaaagaaattgcgtgggacagacacaatcaagttccttatcctcgtgacctttctgacttcaaaaactatttgaaagctaagcacatggttgctaaatacgccgaaaagattgcgaatcaacgcaacaactacctgcacggtctaaccaagatgctagtcagtcaattcgatgtgattaaaattgaagatttgaaaatcaagaatcttttaaagaaccacaaactcgcgcgagcaattgccaaccaatcatggcgggagcttcgttctcagttagaatataaatgtgcttggtatggtaaacagttagtcactgttaatccaagaaagacctcacaaatttgttgtaattgtggctatgatgatggtaaacataccctcgacattcgtgactggacgtgcccaaactgccatcggcatcatgatcgggatattaacgcggcccgaaacattctaaacgcgtaaataaacttttaggcttggaacaagccttggtccatagccgtaacctctatattaagttcttgaactcaatacaagtcagcggtgttcccagaagctcgttacgttagtgacgagtagttcacatatgaaatatcaaaagcagtctcaagtgatgcagttaaatccggcttggcgggtccttcaatatgttcaggtccatcatcaggaaaatttgacgccaattaacgttgcccaacggcttggtgtggcggttgctgaagtgaaagcgttaatccgccaattaaccggtcaatcctttaatcaaattctcaaccaggtgcgaattcggaatgccacggcgctactgcagtttgaagaattatcggcaaatcagattggcaccatttgtggctatcaaacccaggcaaatttctgtaaacagtttaaattaattcatggcatgtcaccggaaatctaccgggaaaccaacttggcagttaaccaagcgtccggttcaatcgatgcctggtcaattattatggtcattttagaaaactgtactcaggcattctctttaaatcagctgacaacaatgacgcatctttcgagtagtaagattgagtcattgcttaaaaacagtgttcagatgacatttaaacaattactaaatcgctttagggttcaaatcggccacaatttgttaatggcgcttgatttatcagtggcggaagtcgcggacaaaacaggtttcacagatagcagtgcgtttattcgaaattatcgaaaggtttatggggatacaccggggaaacaagtggtttaaaaaggggacgagtgaatgcaaaagcaaaatgatcaacaaaggcgattgccacgccgggggaaaccattaattcccaaaatggttgtcctattaatggtcatgtacattgtcgatgttagtcttgggttgccggactctttattgggatcgggctggccgaaaatgcatctggatttaaatgtcccgttgtcctatgcgggatttgttacgatgatcattgcactgaatacgattttttcaagcttaagttctaacatggtgaccaccaaatttggggctggggttgtcactctggtgagtattttactgactacggtgggaatgctgggattttcgatatcaagccagttctggatgctttgcttatgggcgattccatatgggctcggagctggggccattgatgccgcaaccaataattttgtggcgttaaattatgattcacgtcaattgaactggctgaacagtttttatagcgttgggacaattatcagtccctatattatgggctcctgtctaagtaccagtgctgggtggcacttgggttacattattgccggctcaatccaaatgacgattgcattgattgtatttgcaagtttacccttatggaaaaatacccggcaagtcaaaccgattaatcaccaaacaaaacgacggctgactaattggcaaatgatgaaaattccggggatgagaacggcactgatcacgttttttgcctattcaacggttgaacaaacagcggggctatgggcaagtacatatatggtgagagtccacggcatttcgttggcaactgccgcaaaatttgggtcgttattttatattggcattacccttggtcgatttttcgcgggtgtgatttcagatcggattggtgaccagtggctggttcgaaccggctgtattgtgatctttattggaatcgccatgatttcgatgccaatctcaaatgaccatttcgccatcattggcctgattacgattgggttaggctgtgcgccaatttggccggcaatcttacacgcaacgccaatcaattttggtgccgataaatcgcagatcgtgattggcattcaaatggcggctgcctacaccgggacaacaacgatgccaccattatttggctggttggccagccactttgggatgaaactatttccggtcttcttgttgggctttgctgttgcggtgttgattgctagtgaacggctggcacgggtggctagggggacagtgatgtaaccggggtctcatcagttgtaatcgtgaatcgtgagaagggtcatcagtgattatgctgatggcttttttatttacttcttttacataaggtaaacgaatcaaagccttcgctcatgatgtcacaattaatcattggataaaaatttatatttaaattaatactgttaaacatcgattgttgttaaagggacatttgtgattaaaataattagccccaaacccattgcattttgtaaacgatttcatttataatggtcacagttttaaaaacatgttttgcaaaacggatttataaaatgtgattgttaaattagataaatgaacggggtgtagattttgaagcaatatttatcatatgcgtttggaacctttggtcacgatgcattttacaatacattaagtatttattttatgatgtttattaccagtcaattatttacaaattccagtgatgccggcatggtcagcattgtcacgacaattatcgtctgtattcgagttggggaaattatgtttgatccaatgattggggctgctgttgataataccaagacccgttgggggaaatttcgaccttggattatgatcggttctgtcgttgcgtcgattgggcttgtcttcttgttttcagatttctttggattaagttacagcaatccattaatttacttgattctccttggggttacgtttgttgtgattgatgtcttttattcatttagtgatatcgcaatttggtcaatgctaccagccttgagtatcgataataaagttcggacacgctatggtaccgctgcccgaattggatcaacgcttggcgctcaagtggttattatcattatcacaccagccattatgctgttctcacacttgttttccaaagtgccgtttggccagcaaactcacgcgggttggttagggtatgttgtcatcgttgcactattatgttcgggcggtgcgttaattacctgtttaacgattaaagaaaaagatagtttgattcgaagcaatgtgaagcatactaaatttacggatgtctttaaggtgattggtaaaaacaaagtgttgttatggattgccttatcctatttcttattcgcttttagttacgttgtgactaattcactgttgatgtattacttcaggtatcgacttggcaacgctgctgcctatacttgggtcggtgttatcacttgtgtcttgggagtagtttcagttgcgttgttcccagctcttgatgcttggattcaccgaaaagctatctatgtcggtggaattgcgttcatgctaattggctatattatctttttgttcgccggttcaagcttaccattggtattacttgcagttgctttttacttcttcccatacccattgattttcttggccactttgatggttattactgacagtgttgagtatggtcaattagtgagtggcgtgcgaaacgaatcagttacgttgtctgttcgaccattgattgataaattggcgggagcggcttctaacggaattgtcggaattgttgcggttgccgcggggatgactgggaatgccaacccatctgatattactgcccatggtgtttttcagtttaatatgtttatgttctatattccaattgctttactgattattgcggccttgattttctttgctaaagttaacttatcagaagcgcaacatgccgaaatcgttaaaacattaaatgccagattggaaaaagaacagcaggttagttctttaaaagatggggtgcagagtcctgttagtcatcgcgatcttggaacctctccaaccagcaattcacagatttaatttaatttaaattgtaagcgtttaataatgatgtagattctgaaaacaaataaacggcctagatattcttcttttgaatatctgggccgtttatttgttttgaaccttaatgattagatactttccacaaatgattcaatcctcggaattgctgcgccaatcgcaactggtcgagcggtgaccattcccaggctcaagtaagaatgatcctctggaaaggcagtgatgtttcgaatccgttggtcaagattcttgatgactgaactgtctaagtaacgaattaattctccggcgatgactaatcgattgtccaaaaacatatgaagattattgattgcctcagccagaaaattcaagtagacgtgccagcgttcctgcgtttcttcgtcaccagcttttaagctcgccatgaaatcttcaattgattcatcttcatttagcaacgaactcattgaacagtaggtctcgatgcaaccatgacggccacagtaacactttcgatcgctctgcgtatttaaggtaatgtgttccattgtcccgctgcgaccattttcccctgaatagattcgattattaatcacaatggcggtccccagatgctcgccaatggaaaggtaagtggtgtcctggtggctattcgttaggaactgttcagctgccgcaacgcagtcggcatcatggtaaaaagaaaccggatatggcagatacttgcctaatgactcggtggttagaccggtagattccaaaatcttaccccaaaggacagtttgaccatcatgggaaataagtccttgaacacccattccaattcccagaatatgtttatcagctaatttatttttgtcagtaaacgagttgatccaagttgcgagtttcttaaagtaggcgtcatcatttgaatatgaaagtttttcagttgccgtcgccgtttccttgccgtttaagtctaacgctgagatggtgacgtgttctttaaaaatttcaatgccaagtgatacatgagtattggcagaaacggaataggcttttgcacgccggcccacctgtgactcaaatttgccaccaattcgaatgagcttgtttttctttaattcagttaaatttgaactgacggttggtaaactgagatttaattccagtgcgatttcctgttttgaaattttctcacgttggtaaattaaattgaaaatccgtgaataattatcgttactattcctatccataatgccacccataacccctctattaaatgtttgtctagtacaaaaatagcatgtcacaaaagaaaaagcaattttgtaaattagggttaaaaatcattttataaaatagttttataaaactattgacagcgctatcattttgttttagtatttatgttgtattaagataaatcgttttgcaaaactaatttataaaatgtatctaagatttacgatatgcaactatttcaacacactaggaggcaccaacatgggtattttagatagaatgtccctcaaaggaaaaagcatttatgttaccggcggcgcgcaaggattaggcaaagcaatggcaacaggtttggcggaagccggcgccgatgtcgcaattgtcgatatcaacgaagacaaggctaaagcaactgctaaagagattgccgatgcaactggtcaaaaggcaattgccattaaaactgacgtgactgatcctgatcaagttcaacacatggttgacactgttgtttcagagcttggtggtttggacgctgcgtttaacaatgccggcatgtgcttgaacattcctgctgaagacatgtcatatgaagactggttaaaagtagttaacttgaacttgaattcagtatttctttgttcacaagcagctggtcgttacatgatcaaacaaggtaaaggctcaattgtcaacactgcttcaatgtcagctcacattgttaaccgaccacaaccacaatgttcatacaatgcaactaagaatggtgtcattcaactttcaaaatcattagccattgaatgggctaaaaagggtgtccgggttaacacaatcagcccaggttacatgggaactgatttgacacttagctcaccagacttgaagccattaattaagacatggaatgactgggcaccgcttggtcgtttaggccgtcctgatgaattgcaaggaatggcagtctacttggccggtgataccagtagcttctcaacgggtgatgattacttggttgatggtgcgtttacggcgtggtaaaaaccagagtgtgaaaccaagcgcttagctcccagaatataagggtcccgaatcaaatattctgggtttaaatatttgattcgggacccttatatggccgggagctgcttggtttcacacatttccactcggtagcccggaagaatattcccgatcttggaatattcagttgaggcgcctatatggcaggggtctgcttcttatcgcacgtttcaacaaatgagagagcgtgggtcaaatattctgggtttgaatatttgattcgggacccttatatggccgggagctgcttggcttcacacgtttccgctcggtagccaataccttgtatcgagaaatggaactagccgctctcactgtaattttcagctgagcaagtcactaattatgaaccaaacacaaactgaacgtgcgtgaaccattgatcttttaccgaagtcttctcgatggtcgctacacggttttgaactggttattcgaaaggctgtcgttagccttgatgtttgatgaggcttttaggacagccatactctaggaagaagaaggaatatatcatgaaatatcttattggtaccgacattggtacatcggggacaaaaagtattttgatggacacggatggtcatttaattgcccaagatttggaagaatatgatgtgttaacgcctcatccactttgggctgaacaatggccaaacgtttgggtcgatgcggtaaaaacatcaattcgtaaaacagttgaaattgccggcgtcgatccaaagcacattgttggcattgggattagtggtttatatggcggctctggtgtgcctttggatgaaaatatggaaccggttcgaccagatttgatttggatggatcgacgagctcaagaagaaacggaatgggtcaaggaacatgttgacggcaaacgccttaccgaaattaccggtaatgacgtggtcgatccttattatggttatacgaagattctttggattaagaatcacgaacctgaaaactggcgtaaaattcgaatgttcctaccgccaagcaactatgccatttatcaactaaccggcaaggtctcaattgatcattctgctgcgggtaacttaggcggattatacgatgtcaatacaaatacctggtcaaaagaaatgctggatgcaatggagattcctgaatcaatgatgccggaaccattagttgattcaaccaccatcgttggtggcttgaccaatgacgcggcagctgaacttggtttggctgctggaacaccaattatttccggtggggttgatgtgggtgctgccaatgttggtatgggtgttttcaagcctggtaagtacgttgccgcgattggttcatcaatgaatgccgctttggtgagcgaagaacccattaagggacaaggactcatcgtttggccatatccttacaactctgagcatttggtttataatttctctggttctgcaactgccggcgcaatcaccaaatggttccgtgataatattggtgacttggaagttcaaaatcaacacaacggtggagataacgcatacgtggcgttgaataaggaatccaagaatattggtccaggtagtgaaggtttggtggttctgccatatttcatgggtgaacgggcaccaatttggaactcggatgctaaagggttaatctttggtctctcgctggttcacactaaagcacacctatatcacgcttttcaagaggcagtttgttatgctttacgtcatagtatcgaaagcacgggtcgcgatcttggtgagtacattgtgattgccggtggggtaaccaattcacctgattgggttcaaatgtttgctgatgtcactgggtacgcagttcggacaccgattgaagatgctgaggccaaccttggcgatgttatgttagccggtattggtacggggactttgacggtggaagatgtgcaaaagtggcaagtcttagggaacccagttaagcctgatcccgttcgtcacgatatttataacaaatactatcagctttatcgcaagttataccaagaccttgaaggcgatatgcacgaattaagcgaagtagagaaagcttccgaaaaaatgttaggaagtacagttgaagcatagttaagaattggtgacaagggtttaagataatcactagattttatgtcacaaaagggatcacttctaaaaataaataaaataaaattctgttcgaattaaaccgaccaaccattagatttcctagtctagtggttggtcggttatttttgtaagcatattaagttagtgtacttttgggcgcttgaatttatatccagctaacttgctttttgattgtaagtctctccattttttctgttcgacgccgtctcccttttggaaaatagttatctgagctattctttaaggatcgacaatgattattatcgtcagcgaggcgaacgagtttttagcagtatttcggagaacggatattaacgtaaccgggggaatctctatcgatttttaatacctgttgacatttcacttagatgtgcgttattgtaataacattaagaatttatgagaacgaaatgcaacgacgaagaaagtagtcaatttcaattttggtcagcgaacccggtctagtgaaagcgggggcaaaatgcgattggtgaaaatcacttttgagctgtgggctgaatatagtaggcaaccaccggtacgcaaccgttagaaatgcggcaaatcgcaacttgacgtctcactttgatcctagcttagtgagtaacgttctaggacaagttgccgtttgtgtgaggcttttttagcaaacaaaggtggtacagtgcgagagcgccctttcagaattaattttctggaagggcgctctttttgtcgatacagattaatttctcattaaattctcaaaaagctaggaggatgaatcatgaaacataaactattaactttagcaatgacaattttaatggctggatctttggcagcctgtggcaagagtgctgcgcattcaggcaaaactttaaatgtgacgctgccagatgaaccagcaacagttgatcccaatacggcatatgataccaatagtgccagcctgatcactcagacgatggaagggctgtacaagtatgataaaaacaaccggattgttgccggggttgcgacaaaagtcgttaagccgacgaatgatggcaagacttatacttttaaattacgcaaaaatgccaaatggagtaatggtcaacccgttacggcaaatgattttgtgacgtcatttcggcgaactgtaaatcccaagacaaaggcacaatttgccagtgtttatgattgcttcaagaactttgatgccgttcaagctggcaaaatgtcaccagataaattaggtgttaaagctttgaattcacggacattacaaattcaattgacccgggcggtgccgtatttcaatgacttggtaactaacaaatatttaccaattaattcaaaagcagttagtaagtacggtaagcaatttggaaccagttcaactaagtcggtttatgacggcccgtataagctggtcggctggtctggcagcaattcgtcttggcattatgtcaaaaatccttattattggaatgcacacaatgtgaaaattcctaaagtgaacgtgacggttactaaagagcagaatacagccgttaacctgtttaaatccggaaaaattcaagtcacttcggtaaccggccagtatgtgcgtgagaataaaaatgatccggaaatgcatacacatttaaccggacgtgaaaactatctttacttcaataataaaaagccacaaactgactctgaaaatttgcggcaagcaatttcagcggttattaatcgcaaggaactggttaataatgttctccaagacggctcgaagcaaatgctaagcgcggttccggaaggtgatcaaaaggatccggcaaatggtaaagacatggctaaagaagtggggaacttgttaccacaaaatgtcgccaaggctaagcaatattggaatgcttatttgaaagaagtcggtaagaagcaggtaactcttaacctattgactgatgatacggatcaggataagcatacgggtgaatatatccaatcggttgctcaaaagaacttgaagggcttaaaggttacgatgacttcgattccgcatgcgcaacatgtgtcacgggattttgccggtaattttgaaatgaatttaactggctggtcgactaactggttggatgcttcggacttcttaggattgggaacgtcaacgaatcaagttaactttacgcatttgaagaatgccaaatttgacagtctgatgaatcagtcaaatcatctgagtggccaagccagatacaataagttggtccaagcggacaagtacttcactgcatttaaggggtatgtcccgttgtatcaaccggctcaagcgaatttaatcagtaagcatgtgggcgggttaaagtactcgttgttgaatgatgcacaataccaatacgcctattggaaatagcagagtgtgacaaaaagcggttagatcccagaatattaagcttaagtggcttatatggccggaagctgcttgctgtcacaggtttcaaccaagtacccagctcaaaacaaatatttcggttctaaatattgagtctaagtgatttgtatgcccagaatctgctattgatcacaatcaaaaatttaacaaattaaaacatagttgcaaaataactggaggaaacaacatgacaaaaacattattccataatttcacattatttgatggtaaaagcacagagaacgaatcagacgcttggtttgttgtcgaagatggtaaattaattgatcgtggcaccggccatacaccatctggaacagacgaagaagttaatttaaagggacaatttgtaataccaggctttcttaatgttcattcgcatttaacttccaggccggatacatttgatggtggctttggcatgtctgagacagaatcagccgtgttggcacaacagcatttacgacaattacttaaatctggtgtgacttatgtccgtgaatgtggtgatgcctatgatgttgatattaaattaaagaaaatgatgaaaaatggattgctaaagcacgttccagaattgcaaccttctggtagagcaatgtcaatgacggggggccatggcgatgcaccccacgcggcatacttaaccgattcccctgatgaaatgcgcaaagcggttcgaacggctttaaaaaacggcgctcgggtgattaaaatgatggcgactggtggtgttatgacgcccggtgattttatggcggatccacagctatcagttgaagaaatgcgaacgggagttgttgaagcccatcataaaggcattcgtgcatcagctcatgcagaagggaatcctggtatccaaaacgcccttgatgctggcatggattcaattgaacatggattctatgtcactgaaaaagagtgccagcaaatggtcaagaacggtactttcctaacaccaacgttgattgcggaaatgaatatccccaagtatggtcatggcgtgttgccggaatgggagatcaaaaaatgtgaagacgcgttggatgatacataccggaacttcaagcgggcctttaagttgggagttaaatttacttgtggtactgatgctggaacaccattcaacggatttgataagacacctgaggagtttgaatatcttacaaaggtgggaatgacgcccgctgaggcgtatcaatgttcttcactaaattctgcgacattatgtgatgtggctgaagatcatggtaccttggaagtcggcaaatttgctgattttcaagtgcttaaagctgatccattacaagatgtgacggcagttcagcaagttgataaacaagtctatttgaagggaaaacgagaattttaaaaatcgtttgccagatcatattactgagaaaaccgttacgatttaattgattattagaaaaaaacttatcttttcttgaaatattcatttaacgtggtatgatttactataaattgaatcgttccgttatgtaaagaagagaagagtagcagtgatcattccttatagagagccgggttgatggaaaccggcaggagagattacggtgaagatgagctctgaacattgacgcgtgttcacgcacaagttacggcaggatccgttaccatcccagacattaatcagtgtcgttgaggtaattcatgtaaatggattacgaatttgggtggtaacgcgaagctttcgtcccttagctacagtttatttggtagcggggaaggaagcttttttattttccgaatgttcaagttacttcattatcataacgggcattattctagagggggtacggtaatttcatcataactggatcatttgagtgagatcagatattaaatcatgtttgcaattatttctaattatttatttaaaagatgaagggaagttcgtaaaatgaagagaagtacaaaatggatcattggaattgttgttgttttagtcattgtggttgccggatactttagttttggcggaaacaagaaatcaacaagtggtcaaacggtgactgtcggaattatgtcaggaaccagcaaagatgacaagatttggaatgcggttgctaagattgctaaagataaatacaaagtaaatgttaaatataagaagtttactgattacacccagcctaacaaagctgttgccaacggtgatgttgatatcgatgcctttcaacattacgatttcttagctgactggaataagagcaacaaaggaagcattgtgccaattggtaaaacatttatcacgccaatccgggtatattccaagaaggttaagagcttgaatgatcttaagaccggtgcaacaattgccgtaccgaacgatgcgactaatgaatcacgagcattatttgttttgaagaacgctgggttgattacctttaaaccggggacaacacaggcaacgcttagtgccattgccaagaaccctaagaagatcaagattaaggaattggatgccagtcaaactgctcgagcactttcagatgttgacgctgcggtcatcaacacgaactttgcgcaaactgccgggttgaactacaagtcagctatttacgttgaaccaattaacaaggattctgagaagtggatcaacattgttgccgctgaaaagaaagacaagaataagaaagcttataaagactacgttaaagctttccagaccaagaagattaagaacttgatcaataaagaatatggtcaagctgaaattgccgcctgggatcttaaaatcaagtaggccgaaaatgatcaaagataatgaggtgttatgatggctgacagtgtcattgacttagagaatattaatgtcttttttgaacaagaagggcaaacaattaaagcggttaatgatgtgacaatccacgttaacaaaggtgatatctatggggttgtcggttattccggtgctgggaaatcgacattggtccgcgtcattaacctgctgcaaaaaccaacagccggcaaagttgtcgtgaatggagaaacgttatttgaaaaagacgatcaaacaaatgctaaaatcgtcgatacgaagcaactgcgaacaaagcggcgccaaattggcatgatttttcaacatttcaatttattggaagaacggaccgtaattcaaaatattgaatttgcgttaaaacacagtggccaaaaggaaaaagaaattgtggcccgggctcagaaactgcttgatttggttggcttgggagatcgtggtaaagcttttcctgcccaactttctggtggtcaacagcaacgggttgcaattgccagagctttggcaaatgatccagaaatcttgatttctgatgaggccacttctgctttggatcctaaaaacacgattcaaattttggacttactaaagcgagtcaacgaagaattgggcctaaccgtggttctgattacacatgaaatggatgcggttaagcgaattgccaataaagtggccgtgatgagtgacggtaaaattattgaacgtggcagcattgttgatgtctttaccaatccgcaatatccattgactaaggaattaattgggacggccggtgagtcggaaaaggcgcgcaagattttggcaacgcatcctgttcaatcggcagacgatcaatgggagttattgcatttgacctacactggcccatctgttattgacccggttgtgaccgagttatatcaaaaattcgatgttgaagtcagcattattttcggtaacgtggatgagctgcagggtgttccggttgggacattgtttgtcacgatgactggtgctgcggccaaccgccaaaaagcgattcagtatttacatgatcaaaagattggtgtttcaaagattgaaaaggaggcggctaaataatggcatggtttgcaaagtactttcctaacgttgtcacccttggttggggcggcgatgatggctggttgactgcaatcggccagaccatttacatgactttttggtccgctttgtttggtggcattcttggattgatctttggaattggactggtattgttcgataagggtggtatcaaagaaaaccgggtctggtttaatatctttgataaagtggtctcgtttttccgagccattccatttatcatcttattagcctttattgcaccggtgacccaacaaattgttggcactcagattggaactaccgctgcgcttgtaccgttgtcactggggatgtttccgttttatgcccgtcaaattcaagttgccttggaaagtgttgaccacgggaagattgaagctgctcaatcagtcggcgcaaccttttcagatttaatttttgatgtttatttacaagaagcccgttctgaaattgccagggtcacgacagtcaccttaatcagtttaattggattgactgccatggcgggcgcaattggtgccggtggtcttggaaatacggcgattgcatacggctataatcgatttgataatgatgtaacattggtggccacgttcttggtcttaatcttcgtgttagttatccagttggttggtgactttttggcaaaacatttagatcataagagtgtttgacaatcattaattaattgaagctttgtttggtaatcatggttattattgtgtaggaaggtccgttatctagaatgcaaaaagatgaacagttacaaattctcaaagatttaattcaaattcagacgccgaatggcaatgaattggcggtttcggaatacatcggcaaattatttgatcggtaccatgtcccttataaaattgatcgctttgatgataatcgtgccaatctggttgctgaaattggcgaaggaaaaactgaccaagtgttggcctttgaaggtcaccaagatacggttgccgtttctgatcctgataaatgggagcatcagccatttgagccatttatcactgacggtaagctttatggtcgtggttccgctgatatgaagagtggcttggctgccgaagtcatttcattgattgaattggtggcggataaggtaccgattaaagggaaaattcgcttaattgccacggctggtgaggaatacggaactcctggcgccaaccgcttggcagccaacgggattgccaaagatgtttcggcaatggtcgttggtgagcccaccagtggccaagtggtttacgcacattccggtagtttgaattatcaaatcaagagttatggggaagctgttcacagttccattccggaaaaaggaatcaatgcgattgttggcttatcaaaatatattgatgctgaagctggtttatttgatcaggcgcctaaggatcccttcttaggaacagtcaaacacagtgtgacgttgattaagggcggcgagcaggttaacattattcctgactacgcggaattggccggtaatattcgaccaaccttgagcttcgacaatgatcatgtgattcagacaattaaaacggcaattgataaaattaacagcgagaccgattatcatctggaattttctttgattcataatttccgacccgtggaaacggatccgaaaaatcagttcgttcaattggctaaaaatgttgccagtgataagtatcaggaccgttccgttgggctgacaaccatcaatggtgccacggacgccagtgtcttcattaagaataatccaaatatggcggtggtggttcttggacctgatgcttggaaagttgctcatcaaacgaatgagtatacaactttggatagtttttatgagaccatccaagtttaccaagcgattgtcaaacggtattttggctgattactcagcgcgttgtaatgtaatgcaacaattattttaaaatagtaagaactaaaacggcctttaactttgttggagttgaaaacaaagttaaaggctgtttttatatggtttcttttcgccaatatttttatttgtttaaatccactcgccaatcgttatcattatataagcgaggcatttttttaaaaattgagtagataataatcgagtatccaatcggtaaaataaaataaatcagtgctaaaacggtcacgtttaaccaagttgatccgttcatgtatgtaaatgagttaatcgggccaaccggttggccaaatccggcaaaagccggccccgccttaatgccgataaacgaatctgttaatccggttaatgcgcccacaacggcaatcggtaataacattcggggatgtttaacaaagttggcgagcatcattttgaccgaaccccagaacattgcgaaggaaacacctttcccattcatttgatacgtggccacggcaaccatcataaagcaggccgttacaccaactgaggcggccccaccagcaatgccatcgatcccgatagcataagcaaggccaactgttgatagaggtgttgcaataataacggcgaaagacattgcaattaaagtgcataataggattggctggagggtggtaaacaaattcaaaatgttaccaacccccattgagatcatatggacatatttgtaagaccacatgccaaaactgccaacaacggagccacatagaattggttcccaaataatcgagaagctgccgacaacatttctaattaaaaagatcaggacaatcgcaattgcaatgatgataatcgtattgattaagtcgcccatgccaaccaaggtccaagtgccgtttgaatacttcacagcaccacttccagccattgcagctaaagaaacactggccttttcgatcattgtaaaaccaaattgatcagctgctaagatggctgcagcaaccgggacgatgtagattcccatacttgttgcagtgcttacagttgcccaaaaattgttgcttttagctaatccgctaataaagggcgcaataattgcccctggggtaacagcaacgacaattgccattgccacaccagataaaagcatattccaaaattcgccaaatttatattttctcaattcctgcatcgtgtttctcctcgtattatgtccaattagtagtggtaaactggtattttgttcatgcaaatattatcggtcataatgaataattattcaatacttatcgggatagaaaaccaattgttacaacctggattaccaattgaaatcattcatttgccggctcaataatttgtaagctgatttattgtgaaacgcctcaattaaatttataatttgagtattataacttgtttccttggttaatgaatggaaggtggcatgttgaatggcaatttttaacaataataaagtccagggactcctaatagaccggggcctaaaggatttagatgatcagacggttgagcatgttgaagcaattcttagcgaactagatgaaaataaattactcaataagagcaataccggcaattttactgaccgttcgaatcaagagaaggtcggctttttaagggcacttgttgaacagaattggattattatttctcagaatcaacgaatcttggatgaaatgaaaaaacaccactagttagtaaggtggactgtaacaaatatgcttttgtttcggtcctttttttgtggtcgcaatgatgtgtggcaggagatttgggtattgcaatcatacttatgtctacaaaaaggactcatccagtagttattgaaacgatattttgatcgagcaagttggtaaaagtgccaataccagtaagtggcaaattgatcctttcaatattataataacaatcatggatccgcttacggtgtcgaatcaaacatgaaggacgtttatgatgaaaaattatctaccagtaattaatactcatttcacattatttggcggtcatgtggaaactgtcagaccagggtggaagtggaagcctgaagagcatccagcatttgaactgatgtatgttatccgtggtagtcaacgaacgataactgaaaccggggagatgattcttaacacgggtgagtttaccattattcctgttgagacgcgccatactaattatgccgttggaaatgaaaaaatgacctatttttgtatgcattttgacctagatgatccgacacttaaatatttattaattcgaagctatgcggatcgaattattacatcacaagatgcagaatatcaggacttgaaggatcaagttgaagttgtcatgcaactatttaagtcaaagtacgatttagaggatcaattggatattcagatcgatgtgctaaaaattattaaaatacttgttaaggttttgaaacgtgatcaccatctacaggactatcaaaatgatattaatcaatttatgctatgccaaaaaattgcgagtgacttaaagcatcgtttagattatgaaatttatcatgcgagtgacccaaagtcagtatcaatttcaaaggttgtgaagtctcatcacgttagtcaaagttatgttcttaaactttttaatcgatattatggcgaatcaccgcaggaatacttaattgaccttaaattatcatctgcaaagggattgctgctgcaaccacgggttcaaattaatgaagttgccgataaattagcatattccgcaccaagtcacttttcgcgggaattcaagaaacattttaatataacaccgcgacagtatattcagggtgttagcaaataactgtacgaattagggatagttctaaacgaattatcctcttttttattctcaaaaatagaatagaatttataaatgtaagcgttatcttcgtttggcgacaagtctggataattgctttaccatgcaggatcggtttgcctaaacttattttgcaacaaataaaattggttacttctatttattctcgagaaaaaatagtggtgggttcctaaattgatggaggtcattttatgattgatgaagtagaaattaaggctaataagtcgaagatgccgttgaaattaagcttgggtcttctcattggttgtgcaggttggatgggtccttatattgggttggcagtaacgctgttgccagccaaaattggccagttggcgcctagcagcaaggtgtcattagttgctacgttttcggctgtcgcgatggttgttgcaaccattgcaaatattgtgaatggtgcgctatctgatcgaacccgctcgaggtttggaaagcgaacaccatggattgttggtgggtccctaatatccgctggattattttatgccatatctgtggcgccaaacatcccagttctactaacgctttgggcactatatcaggtttccttgaatgcggttgtggcaccattagttgcgatcattgccgataaagttaatcctaaattccggggaactgtttcatcattctatggtgttggtgcggcaatgggaaattatggatcaggagttattgctgcaagatttcttggtggcattcaaattggaatttgggtgtttgcactcattgggattgtctttgcaattatttccgttattttaatcaaagaaccttctaataaggatgagcctcgtgaaacgcttcatggtaaagaattattgcaggcttttatttttccgatccatgatgctcgtgacttttacttagccttggttggtaaattattgatggtaactggtcaatacgtgattgttggctatcagctttatatttttacagattatatgaaattgaatcaatcagagacggccaacagtatttccgcagtttcgatgattttgatggtaacggggattgtctttgcggcatttgcgggtccgttggttgacaaaattggtcggctcaaattgccggttgcattaaccacagtcatgctcggagtgggggcgttcttcccattcttcgaagccaagccttggacaatgattgtatatgctgtaatcgcgggaattggcatgggggcttataactccgtcgatcaggcacttaatgtggcggtgctgcctgatccgaaaacagcagctaaagatttaggcgttattaatttggcgaatacattaggtcaagttgccgggccaattatttctggcattatcatctcgatggtcggctatcacatgattttcccagtcgagactattatttgtgtcattggcggtggtttgatcatgatgattaaacgggtcaaataaagggaaggacaattgatatgaaaataaaaggtgttaatttaggcggttggttagtgcttgaaaagtggatggcacctcaggtctttcgggggactcaagcagatgacgaatattatcttgctcaggatttacccaatgatatttatcaggatcgaattgcaggacaccgatcagaattcatttccgaacgtgactttgttgacattgcggctcgcggatttaatatggttcgaatcccggtcccatactttatttttggtgaccggccaccatttattggctgtattgatgagcttgaccgggcattcacttgggcggagcattacgaccttaaaatattgatcgatttgcacacggttccagatagccaaaatggttttgacaatggtgggattagtggtgtttgtaaatgggcacaggaacctgaagaaattgactttgcattgacggttttagaaaggctaagtcaacgttacgggcaacgatccggattgtttggcattgaggtactgaatgaaccgattggtaaaaaaatgtggaaaactatggatgtgcctaaccgatatccggcacgagatccacaaaaggcagcagggagtcaacccatttctctttcatttttatctggtttttatctgaaggcctatcagaggatttcaataaatttagcagcagataagatcgttgtctttcatgatggttttgaattaaatgcttgggaagactttttcagacagcatcgttttaacaatgtgatgttagacacgcatcaatatctgatgactgcagaagcagatgggattacccaaactgttgattcatatattgcttatattcagaagttgaaatcgcaaattaccgaagttcaaaagtacgtcccggtttttgttggtgaatggacattatttaattcatatgcagttgggacagacacccaaggtggtcgaaatgcgttacaagttgattttaatcattctcacaaactgacggcatctgaattgcgggaagtgtaccaaacattatggcaaactcaaacggaagcttgggatgaaggtgtcgggtatttttactggacctataagttgctcattgacacagttaacgattccggttggtatggctgggatagttgggatgtgagccgggccttcaataaaggctggattacaaaaaataaggagatttgaaatggcatacgaaattagaaatccaattattccgggatttacgccagacccatctattttaagagtgggcgatgactactatattgcaacatccacttttcactggaatcccggcattcaaatttttcattcaaaagatttaggcaattggcatttattgacacatgttttagataaaaatgctggaattgatttgagggggacggataccccagccggaatttgggcaccccacctgtcctttgataaaaagaccggattatattggattgtactgagcaaaatgaataatatgaatggccgaatgtttgatgcagataattatgcgatgtctgccaagacgattatgggaccttggtcaaaaccgatttatctcaattcgattgggtttgatccatcattgtttcacgacgacgatggtaagcattatgttgtgacgcttgaatgggaaactcgtgagggattcgaacatcccggtgcaattgtactggatgaatttgatccacaaaaaggccaactggttggtgaaagcatcagaattagtcgtggcggaaccgatcgtggttgcttagaggcgccccatttgtataaacataaaggctggtattatctgatgacagctgaagggggaaccggctatggacatggggttgttctacagcgttcgaagcatattacgggtccatatgagtctgatcctaaaaatccaattgtaacgtcaaccccatattacttttataggcgcggagaccctgatgcaacccggccggatctgtataatccggatgcacccttacaaaaggccgggcatggttcgttagttgacacgccaaatggtgaatggtatttagctcacctatgcgcccgaccattgccaggcacgcttgattgtaccttgggaagggaaacggccattcagaagatgagttggaccgacgaaggttggttacgaatggcagacggtacaactttggcaaagaaaacaaccccagggattacgggagttcatccagaaagtatcaatgatgttgggatgcgggatgactttgatcaagaaacggttgatcagcatttactcacaccgtattgtgtccaggatgaaagttggatgagtttatctgatcgaaagggatggctacgactccgcggccgccaatctttctactctaaacgagatgtttcaatcttggcggccagagtagatggcttccgagtaacagctgaaacaaagctgtcttttcatccaaagcactattcggattctgcaggattaattctctactatgataatagtaattggatttttgcaaggatgacttatgacgagcttggaaagcatcccgttattgatattgttcaagcagttaaaggtgctaaaaaagagttaatgaaagttaaaattccggtaaatgatgggcaagtatcatttagagcaactgttaattatgatcgtgtgcagttttattatcaagttgatgattcggacagttgggcggctctcggctctcagctagagattaagtatttatcggatgaagagattgacggctttactggtctaatggcgggtatcgggacttgggacgctaaccgacggacatcttacgctgattttgactattttagtttagaccacaatgaataaagattggcaggcaggaagctgggaaattaatcatttcgcccagtttcttttagcataaacccgattgttatcgagcaaaaaatgtgtgatagacggcgatttgtggtcacatgaccaaattgtcctcatatttaggattgaaatatcgagataatttagttgtactggggaaagtatctttttcctaatttttggcaataagcttagtcttttaagaagttttgaaggtgccagttattgaccagatttggatggcgccggacttctccaggtgaatgggccacaattttagaaaagacgcgggtgaaataaggctgatcactaaagtttaaattagtcgcaatttcagtaatggattggtcagttgtggtcagcatttgaatggcgtgctggattctgaccagtgttcggaagtaaataatggaaacgccgacttccctattgaataatgaagcaagatatcttggggataattgaactgatgccgcatagtcactgatcggtttaagactaatcggatcatttagaatcatttcatagatctgtctaacggggtgtgatagattgctgacatataggtgattaacggtttcagctagttcaatgacacaattgaaaacataatgaatgacggcttcggttgaagtcagttgatccaactttctgacatattggtcgttcaaagaatagccctgattagggtcaacgccaccacgaatggctgatcgaataaagacagaaatgccaatgattccccaatttttaatgcttcgcaaatcgccttcatctgataatttgccgattcttcctgagcgaatgagactggttaaatattttggaacttcgtgaactgaaccggtctcaattgctaagctaattgcccgctcaaaatcataactgacatgagtaccgtgttcaaagctttttactgccaagatttcaaaatcattgattgggcatttaagccgactatcgaatatttgttttaaatcaaaattatcagatgtatcagtgagattacctaatagtgttaccaaatattttagacggtcatatgaaatattaattgtcgctcgattttgtgatagggcaattaaataatggccagcaaatgattggtcacttaggttgatcccaaatgggccaacaatccaaaaatctggagtgcccggtacaacaattgaatacattcggggactatgttcaattaacatcactttgatcaccttttttggaacaatttggcaaatatcctgataaagtttgcttgagagatgaccaatttgttgagttggacatcttgttaagtcgttagcgttaaatctagctgctggaaagccggttgcttctaaaaataatgtcattgaatccaatattgtcaccttttttcttagtcgtgcagaaaagtccaaaaatttgttggttagttcaatctttaaactatccgtgcttatataataacattgtagcttaaataaagcgcttacatttaaggcaattgatccgctgcttaatattgcgcgataagttgatgcatttattagtaaattgataagctgataaggtgtctgggaagtgttgaaatgatttaatctaagctaatcatcaaaccgaccagcattcacgttgatagtaattacagctgaagcttgaaatatgattgaatcgcgaaaatgatgtgggcgattcacgtgagtaccagccattttgggaggtggtttgccaggttcctgcaaatttaatgtcatatattgtgaaattagaggagatgttattgtgaaaatttacgttgatggaaatgcaaaatttgatggtaatggcacgaaagatcgaccctataaattaattaatgaagcggcaaaggttgcaatgccgggggatgaagtcctcgtttttccaggtacttatcatgagaacgttaatccggttcatgctgggacaaaagatgcacgaattgtctatcgaagtgttgaaccactaaaagcagttattactggagctgagcaagttcaaacatgggaaaaatatcaaggcaatgtatgggttgccaggattaaaaatggcgtttttggttcatataatccgtatacaacgtatgtcgttggcgattggtattttggcccagttaataagcatacaggtgctgtttacatgaatgatcttcaattctacgaaacagtgtctatcgatgagtgtcttaaaggtgatgtttatccaagatcatgggatcaggcaaactcagtatataaatggtacaccgaacaggacaaggacaacaacgagaccgttatttatgctaacttccaaggcaaagatcctaatgagcaagacgttgatatcaatgttcgccgcgaagtgttctggccacaggaaacgggaattaactatattaccgttagtggctttaatttaaataaagccgcaacgacttgggcaccacctgctgcctatcaggatggccttcttggaccgcattggtcgaaagggtggattatcgaagattgtgatattagccatagtcgttgcgcgggaatctcattaggtaagtataaagatcctgataatgatcattactttacttataaacatgttaaaagtccaactcaaatggaacgtgacgcggtctgtcggggtcagtatcatggctggttaaaagagaaaattggtcatcatattgtccgtcgttgcaacatccacaactgtgaacaggatggcattgttggtcgccaaggctgtgtgtttagtttaattgaagacaatcacatccatcatattaataatatgcaagaattagcgggtgcagaaattgcaggaattaaactgcatgccccaattgatgtgattattcgtcggaaccattttgatcacacgaccatggggctttggtgtgattgggaagcccagggaacgcggattacccaaaatttatttgatcataattatgcgccagagggcacagcaccacggttagatggtgcaatgccgagccaggatatttgggttgaggttagtcatggcccaacaacaattgataataatttattattatctaaatcatcgttgaagattccaaccgagggtcttgctgtcattcacaatttaattttgggatcatttacgtacgtaggaaccggtactgattatcctggaaatggcgcgccacaacctcgattcacgccatatcatatcccccaccgtactgaagtagccggattcatgactattttgcatggagacgatcgcttctataacaacatttttctccagaactggccggctcaagatccagaacctgaggataatgaagaagttgggacagctgtttttgatgactatccgacttatgatgagtggtatcagccgtttaaaccattagagggcaaggctgccaaggaaaatgacatggagaatttgatggccgcgcaatttagtcatttaccggtctggtccagcggtaacgtctaccttaatggtgcgaaagcttggaaaaaagagacccatgacttagttaacgatcgcgatcaaatcgattttaaattggtaaatgaaaatggaaaattgtcaattaaaaccaacttatatgattttattggtgactttagcgacagcattatcaacacggatgttttaggcaaagcctttgagccagagcagcgctttgaaaccccagatggtgatgacattgaattcagtgaagattattttggtaaccatcgcggtgtttcaacaattcccggacctttcgtatctggggaagatgcgatgacgaccttgtggtaaaagttgcttttaaaacatattatttaataatttccactgttcacttttctagtgaataatgatcttaactttataaaagtatattcaaaaaagagcatctcccgatctttccggtgagatgctcctttttgaataagctatcttgttatcttaaatcatcatttgtcatccaattccttataatcaaaataatcaaacgttgctgtttcatcgtaacctgaataatcaactgctgctagtcccacaaatgcgccggtgaagaaaccgccataagtttggagaacgtaatcgtccgagagaacggctgcatccagcgtaaccggaacttcaagccaagtttcaccgtcaaatgagtattcatagctgtaggtttgtttacgaaccttggtcttaaaccaaacatattcaaccccatcaggaattttgattgcatcatcctttagatacgacgtgtagttgccacggttattttcagcgacctcgatgacccggcctttattttcatcaagcgtaatgaagatccatgaccaatgtttatcattgtagaagttcgttaacccggccatctgctgataactgaatgggtcaaatttgacttttgtttcggcatcaaagttaaaggcttgccaacgactggcaatcattgaaacatcgaagttgcttgcgagtgagtaatgacccactaattttagttcgccgttgccaaatgatcccatatggtcggtaaatggcacgcgcagtgtattccaatcgtagtcaagggatgggttatcaaattcatcgtgacgggaatggcttagtggcgcatccgtttcaatcgcatcttttggtgcctcaacggcaacctgtccgccatgaccaccaacgactcttggccaaccctgatcgtcccattcaactttttgaatggatgtttcacgaccaagcgtactccaaccacggggatcgtaagcagattcgtttttatgattccaaggtcgggcacttaatgatgcatagtaccattcgccacctggtgtattgactaaagcaccatgaccctgtttctggatgtagaaatccggggtgtcaaaattagtaataaatggatcgcccggttcagtttcaaacgaattagcatccagtgtcttggaacgtgcgaccacttcttggtgggtaaagacagtaccaccttgagctgcaaacaagtagtaataaccattaatttgataaagatgtgggccttcaaccagcttaacatcagttccctgataaagcgtcttggctgttttaggcattaatttcatggtatcggtatttaattcagtacatgtaatgccgtcaaatgggtgatggtattctcgatgatcccaagtttgctgaaccagatatttacgaccgtcgttatcatggaaaagagaagcgtcaaagccgacgccattcaatttgatggggtcactccatggaccagtgatatccgtggcggttgttaaataattagtcatgtccttaaaggcaccttctgttactttaacatcagtaaagactaaccagaatttgccgtcagcgtatgataaatccggcgcccaaatcccaccggaagcgggattgcccttcatattcagtagggtagtcgttgaaagtggggatggtaatagtttccaatgaaccatgtcttttgattcgtggagtctgacgcctgggaaccattcaaaagttgaattagcgatatagtaagtgtcatcaactctgataatgcttgggtcagcgttaaaaccaggtagtgcgggattttgaattttcatgagattatgttcctcctatatttaaatggatttagaatcaaatcacaatgttacgtgtttataatttgccttcagattttcgttcatcgatttcaaggttaattcgatcaacatctttatcactcaatgggtaacgactcataatccacattgcgacgaatgccaaaacaattgggatccagatcattgaccattgaattcccagtaaggcggatgagctttgtgtggctttggaaccatcaaacttgaagaatgcgttgacgtatccaggaatgatcccaccaagtgctaatccaatcttgaagaataagcccatgattgcgttaataattccggcaacccgttttttagactgatgttcaccataagaaacaacttctggaaccaatgaccacatgtagccagttgctgaggtaattccccattgcattaggaaacggccaacgtaaccgagcaatggtgagtctttaaatgctggcatttgccaaacaaatagcaccagttgaccaatcacgaagagaatcaagaagacatagaagaattgttttttaccaattttctttcgaatgattggccacagaaataccaagaaaattcctggaattgaaccaatcaggttaatggaagccatccattccgggtgaccaacgttatattgcatgtagaacggccaaacggtattgccaaagaacataaacgtgaacccgatcaggaagaacatgccaaggacttgaagcggcttgttacgtttgatttcggcaaataaatctgaatatttaacggaagccgtttcttctttagtgggtaaaacccgttctttaacaccaaagtaggtaaccatcaataaaataaagccgataatcatgtaaatcgacatgactaagaagtaggcaccaccggcatgaggagatgtatagtcacctaaatttagttttagaccaaacaacccaacgtccttcatttgtttatcaggagaagcaagttgaacaaataagggtaggaatgtataaaccattaagttaccaatatttgcttcagtcattcgaaccgttgttaaagtagaaacctcatcgttatcgcgggttaaggaagcgttcaaggccccatatggaatgttcacaaatgagtaaattaacgcagttgccaagtatgaaataaacgcatagatgacatttccccgaacggcttccattgggaagaagagtaaggccgcacagacggttaacggaattccgaagtaaagtaagaatggtcggtattttcctcgttttaaattacttttatcaacgaccgcaccaacccatggatcccaaaaaacattcacccaacgaacaactaagaagattgttgccccaactgctgctgaaatcccaaatacagttgttaaataaaataatagcattgagccaactgtaccaaaaatcaggttttgagccaggtcaccggcgccatagctgattcgttcgccccaagagagttttgcgaactccttttcggcaacgtgtttggtaccggcgtctttcacattatctgccattttctgtaccccttttttattagttttgctaacgctgattcatccccaacgctaaccacaactcgtattgtatccgcttacaatacggccgattaacttcgttgttaactagtttttgtcaaatcgtgatcttgaactgacgaactatccagataattttattggcgaactaactttttagaacaatcttttcccgttcttttgcataaaaaaagagacaaattcaatgccacctgtttcaacagattaaattggatttgtctctttctgacgtatagtttaattgtttattcaaagtagccgctttgagaaactgatcggacggttcgtttgtgactaatttgtttccgataagcacttggcgtggtcccagaccatttcttgaactgcttactaaaattggaaatggtacttgagcctagcatgaaggcaacatcctcaacggaatattcagcgtatccgagtaataattttgcctttctaaactttttttcctcgataaagtggagtggggtaacgccgtacactttacgaaaagtgcgatgcccgtaaccattgctgatcgccatttgtttgcagattgtattaaacgaaaggggtgtattttcaatattttcgacgccctcttcgattaaagtggccatttttcgggcaacctttgcttctcgttcagtgaaatgcggatgtttcgtattatcaaaatctgcaacttgctcagttaagtcatacaaataggtgaggagggcaatttgaatctttaaattagtttgttccgtgctcaaactaacattcttactaaatttaataatatcaagggcaacctgcatcgacaattttgcgatcggttgttctgaaggaatgacagtattggcaagattagtaatgatcgctgactttagcttcaaactttcaaaattaaaatggaaacaaatgtaagtgagctctttatctttattagcattgcgattggtatgcaaagacccgggtgagataataatgacactgccagggccataggtcattggtgccaaccctctaatctctgtggtttgctgtccttttaagatgcacattaattcaaaggcttgatgtttctgctcaaaaaagctccaaccgccgggaacagtgtgcatgtgaccgccaaaaacatatagcccagattcaataaccggaattgaaacaaattttttcatgatatcatgacttcactttcggataaattaggaatgacagtttactcctgtatcatattagattaggattaggtagtcaatgtaaagggttacaaactttgtcaaaatggacattgaatttgtcattttgtgacctgtgatgccgaaaaatgaattgttatttatcaacttactttccgaattataaaaatcattgcttgggggattgattcttaaaacaatagacgtaacgaatcacagtttgaaatcaagatatgattggtcgatttttagattgagataaattgaatggaattgggtaaggttacgggcttttatggtaaaggtaatcatccagatatgaagtggaaataactttcggtcatataggcaacatagtcccacattttagactttaggtatttttgtggattaccgaaccgaaatgtggtttaaaggactgattccaaaacatagggcaagtatcccgatattttaaggttaggaatgtttgccgagccaaaacgtgcgaaagcccgctgcttccggccatataaggaccttaagccaatattccaggttcggagatactggcttaaggtccttatattctggaagctaaacgcgggttttcacactctcacgaattgctcaactccaaaaaactttgaatctgctccggggtcacgcccaccgtcgttgctgcccgcaacggcatgtttagaaacatcttggcggttgccggatcacttgtcattaccttatcgaatatttcgccgattcctgattcatccaaagcagattttaattcagggtgatcaaccaagacattaatataagtgttcatattaacaatcagtggttggacaggggtccaatccagcgaaatatcttgatggagtcggatattctgactactggagccaatcaaaatttcatatgaaccattatcaacctgccaattttcggttgctggattaaaccaactaaatgcccgtgagccaagtgtgaatgacagttgggtttcttcgcccggattaagcccaaccttaccgaaatcaaccaattgtttagctgccatttcaacgtgactggcatgattgccaacatagatctggacggtttcttcgccctgacgctgcccggtgtttctgacctttagggaaactaagacttgtttgtcttcaacgctaaccgttaagtcatggtaatcaaaactagtataactaagcccgaaaccaaacgggaattgaaccggcaattgtttcttatcgtagtagcgatagcccataaagccgccctcacgataattttcaatttggggatcggcattgaaggtgaggtaactcggcgtatcttctaggcgttgtggaaaactttctgctagtttgccggatggcgttactttgccacttaagatatcccaagtcgcttcgccaactgcctcgccagccaagtacgtttccaggattccagcaacttgatggacccatggcattaacagaacagagccgttttgaagaattaccacggtattgggattgacctttgttactgcctcgatcaactggttttgagattgaggcaggttaaggttatctttgtcaaagccttcagattcttgttgttcagggtacccggcaaataacaggactttatcagcctgcttggcaagggttactgcctgttcaattaattgatgatcgacttcatcttggctgagtgaatatcctgctgcatagggtgtttcgggtcgtgcttgatcaatggcttggaaaggagtgacaaggtgatgcgcattgacatgtgagctgccacttccttgatagcgtggctttttggcaagttcaccaattaccgcgattgaatcggcggcgctaattggtaaaatatcatgatcgtttttcataagaaccatgctcttggccgccaactttctcgcaaattggtgttgcgcatccatatcgtatttttgcggctcccctgattgttgttgccaatggtcaatcattgccagaactcggttcacggctcgatcgagagttgcttcggataattgttttttcttaacggcagtgacaatttcttcagttgacagatcacctttgccgggcatttccagatccagtccagctttgattgcggctgtgtgatcggcaacggcgccccagtctgacatcacgagccctttaaatccccattcgtttcgaagaatatcggtgagtaatctgtgattttgtgagtttagtgtcccattaatttgattgtaggaacacataattgttgcgggatgagcgtttttgacaaccttttcaaatgcagataaataaagttctcgtaatgttcgttcgtcgatattggaagacatagtgaaccgttcgttttcccgattgttggcagcaaaatgtttaacactaacgccgacaccctcattttgaacaccattaacgtaggcagtggctagttcgcccgttaaatagggatcttctgagaaatattcgaaatttcgaccagctaacggactgcgttttaaattaatgccgggtccaagtaacacgccgacgcgctctgcttgagcggctttaccgagataatgaccaagttggttcatctcctgccggtcaaatgaacaggcggttaacgctgatgccgggaagcaaacagcttcaatactttcttttaatcccaagccgctcatggaagcatcctgtttccgtaaacctgagggaccgtccgacatcatgagtggtgaaagatttaatcggtcaatcgttgcggtataccaaaagtctttgccagaaacgagagcagctttttcttcgagcgttaattggttaatcagttgtggatcaattgccataatgaacgacacctttcttgtgattagtgatgaaaaattaagcgggttccttccatatctaaaacccgatggatcgccattgaggcgccaccaagtaatgtcgcatatttaacgtcctttgacatgaccagtggtgggactagtggcataaagcctaatttcatttgaacgtttttgagaatttcagggagctcttcaatcaatggtgaattaaaaaagatcatttgtggatcataagcggcaattaagtcggcagtgacgattgcaaggtggtaacagaattgctcaataatttcagttacttgagggtcgtttaaattaaaatcacgaagtaattcattcaactgataatgtttcttattctttaatttagcgattttagtcagaatcttggtttgtgaccactctgaatcaaagttaggtaactgagcaagccgtcgttttttctgaccattgtcttgaatcataatccggccaatttcaccggcttggccgtaatttccagtgtataggtgggtattaatgataattccggcaccaattccttcatggatactgattgaaacaatattttccaattcttgcttactaaagtcctgttcaaaaattgcggagaggttagcttcattttcaactattacgggaacgtcgtattttttcttgaaatgaccaataagatcatattcttcaaagtcaataaacggtgaagtaacgacttcaccgttatagaccacaccaaagattgcgattgagatggcccgcaagccattaaccgtatcaaaatttggtagttgactaatttgatcttccatcattgcaacaatgtttgtgattgattgattatcaatgtttcgggtgttgtattccaacgttcggccgtcgagtttggcggctaacatttccagttcatgaccggaaatactaaagttgaccacgtagccataagccgcgttatactcaaccaactcaggcttacgaccactcgtaccggttgatttatcttcccctagacttttgacgagttttcgatcaatgaatgtgccaacgatgtctgagaccgtcattttatttaggcctaataatttagaaatatcatttcttgaaatcgggccgttattgataattgcctggaggacagaccgttcattgaaatcccgcatcacgtctttattaataatcactttttctctctcacttttcattgaaattagtcatctgcattctcttttgcgtgtttagcagccagatcactttgcattttcttttcgataccatcaacatgatagaacaataaggcgatggcggaaagaccaaatccaagtaacggcacccaaatatagtttaattcaataccgtgcagtgcagcggctgactggttttggttggcaacataatgagtgattgaaagaatccatccggtaatgacaccaccgattcccattcccaacttagcactgaagcttgagaacgaagtcacgatgccttcagctcgaacaccatttttccattcaccataatcaacagcatcggctagcatgacggcgatcaagccagatacataaccagttccaaggtaaccaacaattgttgcaaaaataatcattgggacacttaagtgggttgcaccaacgcttaacaataattggccggcgattgccatgaccatgcccaaaagcattgtatttcgtttaccaattagtttggaagttaatggggttaacacaacggcaatcaatgagacaaattgtaggcttagaacaaatgaagctaaaccagcgttatgcatattgtatttaaagaagtaaacggtgacttgagaacgtgtttgcatccccaaccaatagataaagttaatgaagataataattgcccaaggccagttccgtcgaagcgcttttagcgactctttgattggaattgattgacgggaactcttagtctgaacacgttcctttgtatttttaaagacaattccgaaaataatcacaacgacgattccgacaattaatgcccagataaaccagccgtgggcactagtcgttgagccgccaccgaagaacgcgaccatgcctaatgtaattccggtaataatggctgcaccggcagttcccataaactgacgaatggttgaaagtgtcactcgttcttgagggttgcttgttaatgatggcaaaatcgaagtaattggaatattaacagctgaatacaagacatcaaccccaatataggtgacgtaagcccaaactaactttccggtcaggcttagattgggagtggtaaagaccaaaacacagaagactgcaaatggaatcgagaaccataaccaataaggccggctctttccccacttcgtgtgggtatgatcgatcataattccccagaagggaccatcaaaagcgtcaacaattcgggcaactaagaataaggttccaacggcagccgcactgataccaaatgtatcggtataaaaaatcatcaagtaagttccgaccatttgaaatgacaggttgcacgcgaagtcacttaaactataggcaaaccgttcgttccaagggaccatattctttaagattgtggccggcttggcaattgcttttttctctgaaacaggttcatgcatagtgaacacctcttaaatagtttttgacgttaataaattcaatttacaaacaaattgtattgtaaccggtttcaaatgtcaacaaaaaattaacggttacttttatattatgaatgcattctatataagccagctaaatagagaaggctaagttgatcactaattcattgaaaacgttgacaatcttttgaatcatagttacactatcggtgacaattaataaattcaactttcaaaaacaaagtagaggtgtttcttaatgaaatttacagatggatactggttaacccggccacaatatgaaattgaatcaccaatggaagtgtttgattaccgaaaaacggttgattcactgacattgtatgcaccctttaagaaaatcaaggatcgtaatgatgaactaaacttgggaatgtcgaccattaagctgacgtcaccggttgaaggcatcatcggtgttaaaatgactcactttgaccaaccgacacacggaccgtcatttcaattaactgatgagcatcccaagattgaaatcgaagcggatgatcaccaactctcctttaaatcaggtgaattaactgctcaaatgccttataaatctgactttgagattgatttccaacataatggtaaaacgattacaaaatcaatggaaaaggctcaaggcagcattaccgataaagttgctcacaaacactacatgcgtgagcaactgtcaatgggaatcgacgagttgatctatggtcttggcgaacgatttacgtcatttgttaaaaatggtcaatccgttgatatttggaaccaagatggtggaacgggcagtgaacaagcctataagaatattccgttttatctaagtagtgaaggttacggtgtgtttgtcgatcagccggaaaaagtgtcatttgaaattgcttcggaaaatgttgatcgaactcagttcagcgttgaaggcgagtcacttcagtattatgttattgatgggccaacacctaaggatgtccttaataaatacacccggttgaccggtcaagtttcattgccgccagcttggtcattcggcctgtggttgtcaacatcctttacgacggattaccgtgaggaaacagtcatgaagtttattgatggcatgcgtgatcgtcatattccacttgatgtctttcattttgattgtttttggcaaaagggatttgagtggtgtaatttcctatgggattcagaacagttccctgatccagaggggttgattaaaaaaatccatgaccgcggcattaaagtttgcgtttggctgaatccatacattgcccagaagtcacctttatttgaagaagggcgagacaaaggctattttattaagcgtgaagatgggaatgtttggcaatgggatctctggcaggctggtaatggtttcgttgattttacaaatccagatgctgttaagtggtaccaaggtaagttaaagacgttactggatatgggtgttgattgttttaaaacagattttggtgagcggattccggttgaggatgccgtcttctttgatggatctgatcctaaacgtgagcataattactatacctatcaatataacgacgctgtttatgatcttttgaagcaggaaaaaggagaagatcaggcagttgtctttgccagatcagccacagtcggttcccagaagttccccgtccattggggtggtgataacttatctcgctataaatcaatggcggattcattgcggggtggcctgtcgttcctactttccggctttggtttttggagccatgatattagtggctttgaagagcatgcaaccccggatctctataaacgttggacgcaatttggtttactatcttctcattccagatatcatggtagtgttcaatataaggtgccatggttgtttgacgaagaagcggttgccaacaccaagaagtttgtggacctgaaattatcgctcatgccatacctttttaatgaagctgtcaatacccatgagactggcacaccgttaatgcgaccaactttcttggaatacacccatgatcgcaacacttatttcttggaacatgaatatatgtttggcagtcgattattggttgccccaatttttaacgcggaaggaaacgttaaatactacttaccagctgggaagtggacgaatattttgactgagaaagtctacgatgtttctaaaggcggtcaatggttatctgaacagtatgacaacttaacgttgccgctgctggctcgtgaaaacagcattattttgcgaaaaccaggtgctgaacatgctgaatacgactacacagatcgcccggatattcatttatatgaaattgagggtggcgcagcaatttcaacccgagtcgttgatgaaaaaggaaacgcggcgggtgccgtgaaagtggtccgcaatggtaaccagttgacggttacggccaccggcttgaaagggacgcccaagattctggttcatgagaatggcgaggttaagacttttgagttgcaaggggattctgtgaaaattgaactttaatcgttgaaaaatgaaaaggatgaacgcattaacatataagcgttcatccttttttatgttatttgtattcattaagtaacttagccaggaaataagtcccttgcttgtaatcactcaaacgaatattttcgttaggtgagtggggatgactgccagcgtaatgaatcccaaccattacgattggtacatgaacgctgtcttgaaactgcttcattggtccgccaccaggcatatttggaattaggcgaactttttctgaagtataaacatcattagcaactttgacattgagttgaataaacggatcttcaagatcactacgagcggcgtcttcacccagcaggtagtcaactttcacatcatcaaagccgtttttaacaagttgatcactaattaacttggcaattttctttggctgttgattaggagccaatcggcaatccaacttagcagtggcttctttaggaataatggttttgacgccttcgcctgtatagccagcgtttaaaccattaattgtcatcgtcgtaccattaaccaattcttcacgcggatcgtcataaataaatggtctggttaacccataattttctttgactttctcagcatcgaaatccatgttttgggttgctctttcttcagcgggagttaatttttggatatcgtcatagaagccatcaacagcaattctgttatccggggttcttagtgaagccagagcctgaactaatcgccaagctgcattatcggcatagcttgctaatgaagagtgaagatcggcagccgcagttttaacatgtaagttaaagctaacaacgcccttagcgccacagacaatttcgaaattatcattttcatccttaccgccgccttcccaaacacaaacatctgctttgagttggtcggcgtgagctttgacgtagttatcgacatctggactgccgatttcctcttcaccttcgacaaagaatttcaagttgaccgggataccaccgtgttcattgaagtatttaacgattgtgagtcgggacatcagttcacctttgtcatcgcaaacaccgcgggcaaacattttatcatcaatgatcgttggttcaaatggtttcgtacgccattcatctaatggttctggtggttgaacgtcataatggttatagaaaagaacggttttatctgattttcctttaaattcagcataaataaccggattgccaccttgatcagtccatttttcaactttggccgcgcctaaatcagtaaattgtttaattaaccattcgttagtttcgttgattcccttgttttgagctgaaatactagggatctttaagtatccagtaacattatctaaattatcgagagcatattgttcaacttctgtttgattcattatgatcaccgcctatttaatttggttaccgtgttggtaaaccgacttgtcttgttgagtaatcgcgtcaatgttttgagtcgggtcgtcattaagaactaaaaagtcagcgtatttaccagtttcaagtattccatattcatcggaaatcccaatcaggtcggccgcttctttagttgcagcaaacaaagcttgagtgggtgttgcaccaatttcattaactagtaattgcatttcttcccaagtaccagtcttaaagctattgaatggggtaccggcgtcggttccaacgatgaccttaacgccttttttaaatgccattgaaacatttttgaaaaagtcggctttaacttgatcgttcttccgaatcatataatcagggagtttatcgcgaccatatttactgatacttgcagctgcgtttagggttggaaccagacgaacatgatgatcaatcataaattgggcttgcttttcatcaacgtaaatgccgtgttcaatcgaatcaaccccagcatccagtgcgttttgaatgcctcggtttccctgagcatgggcggccacggttttccctttatgatgagcttctgccacagccactttcatttcagcgagggttaaagccgtatcatcaatgttgtcgccagctgacataacaccaccggtcgccatgactttgatattatcggcgccgattttgagagctgttcgaactgatttccgcatttcgtcaggtgaatcagttaaatatgaccagtcaatttcgccgtttgagccttctttgaaatcaccgtgaccaccagtcattgacattggtcggccggacgcaataattccgggtcctttaatagaatgggtcttggcaaaatcacgtaatttaatgtctgtattaaacgcacagccacaatcacgaatgtaagtaacgccagaatcaattaggtcgctaagattttgcaatgcggttgcagtaacctcggtttctgaaagatattccagcttattagtaattggattcatcatcatgtgcgtatgtgcattgattagacctggtgtaacatatttcccctttaaatcgactaatttatcaacatcatcacggaccggatcaccagtggcaaggtgagtgattttaccgttttcgactttaaaccaagtgtgctgtttaacaccgttgtctttaccgttgaaaagagttgcgttgtagaagattgttgacattattatttaactccttttatggaaaaggaactggacaaaatcaaacttcttccagttccttttttctttacaaacatttttttgaaatcatagcgttggtgaagtgatattaatagacacgtttgccatttttataaacagccttatcagcttgttgaaccgccttgatatccgttaatgggtcattatccagaaccaggaagtcggcatatttattgggttcaagtgtcccgtattctttatcaatcttcattagtttggcggagttttgacttgatgtctgtaatgcctcaaattcactggcaccttgttcaaccattaattgcagttcgacaggggtcattgaaaaatcattatagggtgtcccggcatcggttcctaatgtgattggaacaccgcgtttccatgcatgcatgatatttttatataaatcttggagggcatcggcagctttcttaatttcccaatccggtaattttcctttagtatattcagggattgcccaatcagcaacaaaggttggtgtgatataggttccttgtttaagcattaagtcgatttcttcgtcattcacgtaaaagccgtgttcaattgaatcaacaccagccttaattgcgttcatgataccaggattaccttctgcatgggcagcaataatgcgacccttatgatgggcttcatcagcagcagttttcatctcttcaacactaagttggggatcatccatgaaatcgccaggggtcataacaccaccagttgccatcactttaattgccatggcgcccttctttaagccggttcgaacagcttttctcatttcatccggtgaatcaactaaatggccgaagttaggaaagtcaccgtggccaccagtcattgaataaggtcgaccagaaggcaaaatatcagggactttctttaactcgccttgtttatgtaactcgttcaaataaatatcgatgtcatatgagctaccgcattcacgaatataggtaacacctgattttaacagttcatgtaaatgttgaacggcatggacggttgcgtcaacgatattgacgttcatgccaccatcaccctttaacggattcatacaaatgtgtgtgtgacaattgactaagcccggcatgacatattttccattaagatcaacatttttgtcagtggttggagcgcttccatttccaacctcgtcaagttttcctgttgcgtcgtctactgtaaaccaagctgattgtgtggcagtttgatttttaccatcaaataaagtgaaatttgtatatgtcgttttactcacttaaatacacgctcccttgttaaattaatattagactagttctcatataacagttagtcaactgttgattaatagccattaattatagtttacctaattatcaatgagatatctaccataaaataagaattgactaacagataaatgagtattaagatttggtttattatgaatatttaatcaaaaaattctataggagtggtatacatatgaattttatcattgcatttttagttgttatggtattcatgtttgttggtgaatgggtatctagcgcgtcacatgcttttattccttctgtttttgtttctgccgttttattcgttattgggttttggacaattttgcctaaagatgttgtgactcaagcatcttatggtaatgaatttgttagtatctgtgtggcaatgttattagttcatttgggaactttaatgagtttaaaggaactcctagaacaatggaaagcagtttgtattgccttattgggagtttgtggaacgatgattctttgtctttctattggaacctggatttttgattggcataccgtcattgctgccgttccaccattaactggtggccttgtttcagcactgttgatgactaatgggttaaaggcacaaggagtaactgctttgatcgcattacctgtctccatgtttgttattcactcggttgttggttatcctttgacatcattaatgcttcgacaggaaggggaccggttaattaagcagtttaaaggcaatggaagtaaattgacagaagaggaagccaactcttcaaccggttctcaagcgttcaagtcacaaaatgtttttaatatgaaaccagaatatgagacccctgcatttacgctggcacgggttgccgctgttgcattgttaagtacatggtgtgcgggtttaatcaacaatgcaattaatccaaatgtggtttgtttaatctttggtgttattgcgcatcaattcggtttccttgaagacaatgctttgaaccgggcgggtgttttcaattggttgatgtatggacttttagcatatgtgtttgctcaattgagtgtcacaacgccagcaatcatggggaatattattttacaaattattgtcttaattttcttaggtttgttaggaatgttcttagctgccagagttttggcaaaaccatttgggatgtcttggcagatggcgtatgcttgttcgttaacctcgttgtttggtttcccagccgattatattttaacttcagaagttgctcatacggttgcaggtactaaagacgaagagcaatacttacttcaccacatgatgcctaaaatgttggttggtgggtttgccacggtttctgttgcatcggttattattgcttcagtattcttgaaattaatttaactattttacaaataaagattaaaaaagacattttgcttacacggcgaaatgtcttttttctataacggaaaactataaagtaaacattatttttctgccaatcgatctaatagttgataggcttttgaaagaggaacagtgttttcaacatactgcgtaataaagttatccacataaggataatcacttagctggatttctttaaccgctgcagccttatcaatctttgttctcttgaaccgaaattgctgatcatctatccaaagccactgagcaccttccagatctgaaaagggcattccaacactgccggcattgataattttctgatgaccgattgttatttcgaattataaatgggtatggccacaaatgataaacggcgattgtacgcctagaaatagcttcttaattattgcaatattggaatgaggcgtaaaaatcgttgtattgttcttggcaactgcgtgacaaaagaagtcatccccgaccgtcacattgagccataatcccttcaattttaaaacttgttgtttacttaattgattggcaacccatttgatttgatcctgggcgtgctttgataaagacagttgtttgccattataagcatcaacaacatcttgatcgttattacctgaaattcccactgtattaaacttttttgataactggtcgattaattgcaaaaccgctaatggcattggtccgctgacaatatcaccacccaaaataaccaaatccggttgcagatgatccagttgatccgaaaccgcctttaaagcaggataattcccatgaatatcataaagcgcagctgttttcattatgtctctcagctccttttgatcaataactggtgctcgcctttttagggtctgacagcggtgcttttctaagttatcgattatgatgttcatttcttcagctctcgaaagcactattaatatgggttattatcaattttttgacaactgatgtcaaatctgatggtacgcactaaacgattggacacattaaaactggctcttgattatgttaacgttaattgtgagccggttttaattgattctagttggtgcacacttgttgagttccttttttctatgaagaataagccacaagctggtcctgacaaggagaaccatcaagttaaggtactttcgtgaatagatacgttaaatatttgtataaatttgagacattcgcgttagccgtctcaaacgagcttaaaaataaggcattggttttgacttcagccggactggtactaaaatgccagtctttatgactaatcactgaagttttaatacttcgttctgcctcattgttactgatcgcaacttaagggagcagttaagtagacttttagcgcagttcgttgattaactaagtaagtaatcgctttacccaactttgatttttcaatcgcttgggttagtttttctgttgataaaggcacaatctcttttgtctcacgtttttgcttggtaataatcgtgattacaaaaatagggctggacaaaatcttttttgtctcagccccatgtaatcgctgcttacactatagatttactgatttataaccgttcggaggctgacgagcaaaatgacgttagtacccactgaataattttaagtataacaaggtacttgatatgatatttgttattgtgctgtgtaaccaccatcaacgaggaattcggaacccgtactaaatgatgattcgtctgaagcaaggaacagagccatatttgcgacttcaatcggttgggctaaacgtcccattggatgtaatgaaaccaaatgatcctttactttaggatcggtcttttcaagattctcaaccaatggtgtatcaacataccctgggtgaactgaattaatccgaatatcataatgttttcgagcacagtccagtgcggcggattttgttagaagacggacaccaccctttgatgcattataagcaaataaatcaggatcaccaactaaaccttcaacagagcaaaggttaataatagaattcttttcatgattatttttcattgctttaatgccatatttcacaccccacattgttccagtaaggttgatcccaattgtcgcgtcccagttcttttcatccattttttcaatatcagcatataaaccaatgccggcattattaacaataatgtttatttttccaaacttatctaatgtggcattaattacgcggttccagtcatcttttttagaaacatcttgttgcataaaaacaagtcgattaggaattaactctttttctaattcatcaccagcttctttttcaatagcggtaaatacaactttagcgccttcttcagcaaaacgctcaacaatggctttaccaataccttttgatccaccagtaactaacgcaactttaccttgtaaacgtcccattttgaagcctccatttcaaagttttgtacaaaagtattatatatcacaaatcaattttctgtaaagcgctttcattaccatgaaatgatcatatttattaaattagttacaaaatgtttttaattgatacctttttatcttgattgttaaatattgccattctaaaagaggccatcttttctgagcttttagacttatatatgttatagctaatagcattaaaaaatggtttaaagttgttgggattttgttacgaatctgactataaatgccatggactgtcattaaagcatttgatttttgggataaaattcagagatgttttttatcattcaattttatgattagaaagacaccactttctttttactattttttaacttgtctgtagctcattgttaagattacaaattaatataaacccattgaattacggatttatctttaacgtaagtttcacttggtaaggtcgagggttggataccatcaattaaatatatccaaccatttgtattatttaaggaggatagcccatttatcgatgatacatatgggaatccgttaatcgtttgttcctttaacataacgttcatcttctgaaaataatgatgggaaactgcgtaaacagaaatattgtcattccagtctaattccctgggtatcgtatacactttttttacgccgttgtatctttttctaaactgtaaaggcgtaagatttgctgtttctttaaaaactttattaaagtaatttgctcttgaaaaacccactttttttgatattttgtcaatcgattcatctgttaggataagttgtttttgtgcaagagctatttttctagtacgtatgtaattagagaagttgattttaaagtattctttgaatagtcgactcaggtaggccggcgacaagtaagaatttttagcaacgttgactagggtaagtttttgatcgatattttgttcaatatatgataaagccatatcaacgttattagtttcttcgttactatcagaatcagttggtttattaaattcatcattttcgagctcagttttgccggaaaaatgtgaatttacgatatcaagtagctgttcttcttcctctaactggtcttttgttaagggagagagaatggcaactttttgataatatgctttaaatattttggatgtaatggcttctaaagcttcttggtataaaaatgcggcattaacaggtagggtatttttattacatataaacataccgtttaatttatcattaataattaatgggaaaaacagtgaagatccttttttgtaaaagaagtctgtaacttttttcggatcataaaaaaggccattcccggtgactaggtgaagggtagtatcgataaaggaaatatgtgtttttgtgagttgattaaatagggacagaatttttttgactctggcgtagtgagtttcttgtgaagaaaagttcattaaaaagtctccttttatcacatacaagctgtatttatggctacatcatagtttaaaattatacaaaaatcaattattcgtaataaaaagatataatatcttgccaattaacatattttaagaatgaaaaggcccaagaaaattaaaataacttgttatataataaacatgcagtaaggggtaagcgctttcagtaacgattctttacgaatttaggaggctttcattatggaacaagaggcattgggaatgattgaaacaaaagggttagtcccttcaattgaagcatcagatgcaatggtaaaagctgcaaatgttaccttaattggtcaagaagaaattggtgcaggacttgtaacggcaatggttcgtggcgatgttggcgccgtaaaggcagctgtcgatgcaggagttcaagcagcgacaggcctcggtgaggttatttcaagttatgttattcctcgtccgcatacagatgttgaaacaattttgccacataaaaaataattgttgaaaagtccctattttacttgagtgaaaacaaatcaaaacctttctgttaatgaaagtaacaattagggattctctatgtccgggtatcaggaggtggttttatgattgattttttaaattctaatagcgtttccccggagtttgttggtgctgacgaagttggggatacaatcggtttgtgtatacctagtgttgattcacaattgcttgaaaaattacatgttaagaaaaaatatacagtgttggggattcttggcgatcgtaccggtggcggtccacaactattttcgatggacgaaggaattaaagctactaatactgagtgtatcgatgttgaatggaccaatgataccaaaggtggtggcggtcagggttgcatgattgtaattggtggctacgacccttcagatgttcgtcaagcaatcgaagttacttttaaaaacctacgtcgattcttcggagacgtatataataatcaagctggtcacatagaactacaatacacggctcgtgctgctggatgcttgagtgaagggttaggcgccgaagaaggcaaagcgtttggcattcttaacgggtgccctgctccaattggagtcgttatggctgatacagcattaaaaactgccggcgttaaaccgatttcattatccacaccaagtcataacggaagcccctctaatgaaacggttctaacaattagtggtgactcaggtgcagttcgccaggcaattattgccggtcgcgaacgcggaatagatctgttaggacaaatgggagataagcctgtaaatgactatccatcctatattcattaagattcttattttaaagggggaataattaatgaagcgccaaaaacgatttgaaaagcttgaaaaacgtccgattaacaaagacgttattatgaaagaatggccagaagaaggattcatcgcaatgaagagtcccaatgatcctaagcctagcgtaagggttgaaaatgggatcattactgaaatggacggtaaaaaacgtgaagattttgatctgattgatatgtatattgcaagttatggtattaatattaagaatgctgaaaaggtaatggccatggattcagcaaagatcgctacgatgcttatcgatcctaatatttctcgccaagaagttttaaagtatacaactgccatgacgcctgccaagggtcaagaagtaattaaccaacttgactttggtgagatgattatgggtgccaaaaagatgcgtgaacgacgtaaaccggcaaaccaatgtcacgttacgaattatattgataatcccgttgagttagctgccgatgctgctgaagccgctttaagaggctttgctgaggaggaaacaacgactgctgtaagtcgttacgcaccttttaatgctttatcagtattagttggttcccaaaccggacggcctggtgtccttcatcagtgttcagttgatgagtctacagaattgcaactgggtatgcgtggcttaacatcttatgctgaaacgatctctgtatatggaactgatcgttcgtttactgatggtgatgacacgccttggtctaagggatttcttgcatcatgctatgcttcacgtgggattaagatgcggttcacatcaggatccggctcagaagttctcatgggttatcctgagggaaaatcaatgctttatcttgaagctcgttgtattttgttagcaaaagcttccggcgttcaaggattgcagaatggttcgttaagttgtatttctattccaacggctgttccaaatggattacgtgaagtcttgggcgaaaatttgttgtgcatgatgtacgatcttgaaagcgcaactggtagcgaccaatcattctcacactcttcaatgcgccgcacttggcggtttatgggacagtttattggtggtaccgattatatttgttcaggatatggcgctgaaccaaatgcagataatacttttgccggttcaaatgaagatgtttatgattatgacgatatttacttcttggaacgtgattatggtcagtcatttggtattcactcgattaaggaagaagacgccattagcatccgaaataaggctgccaaagctttacaagcagtatttgaaggattaggacttcctgaaattactgatgaagaagtcgaagctgcatcttatgcggatgtgcacgaggatatgcctaaacgcgataaggtagcagatatgaaagctgctcaaggtatgatggatagaggtattacagctgttgatgtcattaaggcacttattgatggtggctttaaagatgttgcagagtcaatccttaatttgcaaaaacagaaggttgttggcgattaccttcaaacatcatcaatttttgataaagattggaatgttgaatcagctgtcaatgatggtaatgattatcaaggaccaggtacaggctatcgtctatatgaagatgaggatgagtggaaaaagataacggatattccacaagctattgatccaaaacacttcgatatgtaaactgaggaggcattttcatggttgaaattgatgaaaacttaatacgacaaattgtaaaagaagttatagctcaaactcaaactgatacgcctgttcattttcagaacgataacttgcagacaaataataatatgaataattctgaagatgcgtctgcagtaccagaaaataaacttccttggtttcaacccattgggccagctaagccaggttattccagggatgaagtcgtgatagctgttgcacccgcatttgccacagtcttaaccaagactgaatcaggcgtttcgcataaagaggctttacgtcagatgattgccgggattgaagaagaagggcttaacgcgcgagtcattaaagtttatgatacgtctgacgtttcattcttatctgttcaaggcgatcatttgtctggttctggtgtttcaattgggattcagtcaaaaggtacggtaattattcatcaaaaggatcaggaagccttaaacaatttggagctatttccagaggcaccagttatagatgctgaaatgttccgtgcaattggtaaaaatgcagctcgatatgcaaaagaagattcgcctgaacctgtttcgcagccaaacgatcaaatggcacgacctaactttcaagctatttctgctattttacatattcgagaaacacatcaggttgtccctggcaaaccagctgaagaaattaaggtaacggtttaaggagagataacaatgaatgatattaataactcgaatgtaaatagcgataaaaaatacggtgtggatgattatcctctttataagaagcaccgtgatattattaagaccccttctggtaaagcacttgacgatataactctcgatgatgttgccaatgagaagattgatcgtaaagatttgcgtattacaccagaagcactaaaaatgcagggtgacgtagcgggagctgcgggtaaagagactttacaaagaaattttgatcgtgctgcagaattaactaatattcctgatgaccggttattggaaatgtataatgcattacgtccatatcgatctactaagcaagatctgcttggaattgcagatgaattaagatcaaagtatcacgcaacaatttgtgccagttggtttgaagatgctgcaaagtactacgaaagccgtaagaagctaaaaggagataacaaataggggttctccaaaatttctttgacacggaaataatttttcatgatagttgtcgataactgtatgaaagaaagtgaaaaaattatggatcaagcaagaattgaagaaatggttcgcagtgttctggcagaggaaactaataataaggttgataaaaacaacgataatatttctcccctgttaaaggatttgcgcgattctgtacaagaaaagattaaagatcattcctctgatgacaatgtgtcttcacttttagagagcgtaaaaaaagatgtagaaaatagaatcgtataggttagtgaggatttatttgattgctggattgcgtcattagtaattagtcgatcttcattcacctaaataaaaaaggttggccgtcttaaatttgagacggccaacctttttgcctaaacgataaagttcagcgatactttagcatttgtatttcaatgtttatcccaccaacttcgagtttctttaatccgttcaattcttaaattgggcaatccttcacgggaaacgccgtgccaagactgaggatagcgggccatttgagcatccacgccattttcaactagtgcactgaagaattcttctccctgaccgataggggttcgcgtatcccactcaccctgcatgattagggttggtgtttttactttgttagcgtaagccattggtgaaagcttccagagttttttaacgtcgtaacgatctgttaataattcttggggcgtaaacatgaagccaatgtcactggtaccggagaaactaatccaatcggttacggggcgctgcgcaacggctgcggcaaatcgattagtgtgaccaactacccaggttgtcataaagccaccgtaggaaccaccagcacagtattgtcggtcctcatcaaattcgggatgattttttaaaacattgtccattccttccatcaaatcagtaaaatctttttcaccatatttgccgacattttcctgacagaatttttgaccataagttttactaccgcgaggattaagcagaactaatccatagccgtttgcggcgtgaacttgcatttcaaagaagaagttttctgcgtaggcaaagtgcgggccaccgtgaacataaagaacaagggggttcttttctttgggcgtagctggttccatcaaccagccttcaatcggtaagccatcactagcatggtatgtaaaacgttgtggtttcacgtagttgtgagacttgtcgaacgacttattaggattataaagatcagtttgtttacccgtaaaacttaatgttgctagcgccactggacgagtggtagttgagtaagtaatcagtaattgatctttatccactacgacccaatcggttattcgttcgggctcatcgaaaaaggcggttggcttgccatttgtatagaaaaacattttagaacgtccatgatgagaggtcctaaaagcaaatttttcgttatcaacccaaaatgcatcatcaccattcaaattctgagtgaaatcagtgaataaataatcgtggacttcctcagccagttctccagtatagtcggaaaactttttacttaataaatcatatccgtaaacgtaaaactgtgtatttgcttgatactcatctgattgaccaaccagtaataacttggaatggtctggtgaaaatttagcctcggagaatacccaggttggtcgactatcagtacaattcgttaattgaccggtgtttacatccaggacgtaaacaccatggctaaagtcaagatcattttcaggattattgtccattgttaaagcgactaaagtgccatcagtgtccgtatcggaaagagtaaaatcggttttggatgaataaaccaattgcgttttttgggtatcagcatcatatgaaaacaattgatagacgccatctgttggataaaatccaaatccgtccgctttgtgattaacacggtaaacatggcgaatcgttggaaacttttcataaggtttcttcgggacctctgttgtctggcgggtcttgtaaaatactttatttgtttccttagcggtaacgagttgttccactgaatgggggagagctgagactgggattgcagtgcccccagtataggtaacttgataaagttgaaattgtgagttggcatctcgctttgagatgaaaaacagataatctttggcaggggttggcgcttttgaagcgtaattatcattatcaaagcgaccgacatacttaccgtctttggtaaagccaaggatatttgatcggtagccgttgctttctttgtctaagtatgtttggcttgcaaaataatattggttagatacagccggctgacttaatgtttttaatttgtaaaaatctgcttcagttagtttttctgtcataaatgcgttctctccttatttccagtatgcgtatcggtattgtgagtcagttaaaaaggaatattttaagccgcccaccttggaagaaaccaagtggacatccgtgtgttgtagtgttgggacaattggttgctgattcatggcaacgttgcctgcctgaaccattagtttccaacgttgttccccttgatacttggcagtattattgacttttgccatcaatttttcatatcgtggatttgaccaatgggtaaagttgacgctgttagcctttgtcatcagatttaaataatccgatggatctggaaagtcggtactccatcctaatgcagttacttgatactttttaccaaacatccgacttagctgctgctgttggggaacggaggttagggtgacagttacccctttcagcgttgattcaacagcgctttgaatgtactcgccaagcttcttttgatcactgctatcctcagttaaaagattaagtgaaactttcttagtgccaagttgtttttgagctgcttgccaatattgttgcgctttttgtttattgtaagtggtgttggtatttagttcagagttaaaattcttaccattattcgggtcggtattttctccgtctggaacaaacgacttggctggagttgagccatcttccatcacatttttagcaagttgctgtcgattgagagaatcgctgaccgccaggcgaagatttttattgctggttgttttattttcagaattgaagtttaaaaaactaagtgtcccttttttagtgtaaacaatttcctttggataacgttttgcatcttgtttaacaaagcctccggaaatcaatgtttcctgaagttttccgcctgcaaataaattttgagctgttgttgggtctttaacgacttgaactttgacgtctggaattttgacatcttttgcatcccagtattctttgtttttcttgtaaacccaacttccttttgacggatcccaattttgaagtgtaaatggaccgttggaaacggttttggtcgaactggtaccatattttgatccccattttttaactgcagccgtattaatagggtaatattctcctgcagctttgaagttaaagtctgggtctggcgctgataatttaatttgtaattgatgtttacctagagccttcacgcccaacgcactcggtttcttagttcctttttgaacggctgtgtaatttttaaaggagataaagcggttggcatattgtgattttgttttagggtcaacttgccgatcaaaagaagtgacaaaatcctgtgctgtaacgggcttaccattttgccatttagcatttttccttaaattaaaagtataggttgttccgtgatcagtcggtttaactaacttagttgcgacaccgggaacaaccttcccagtattggttgtgtgataaaggccttccaatgtttgggtgagcatacttccagagtaaacatcggtgtatgtattaggatctgcggttgacggctccattgcaatactaacgttaagtgttttctgttttgactcggaactttgggaaccctttgacgaacaggcgcctaataatagtgctgttgttactaatagaccatatgtaaatgattttttcatttgcgaatccctccaaatatgtttgaaatgcaagggtaaaataaaaagcggccaagttttaaatcaacttagccgcttagtaaatgagatgtcaggtaagactaaaaagccttaggatgacacgaatcaaacggctgtctgatcataatcactaagacactaataattgaaataataatgattttgatagtcatttgattcgcctcccatttacaattgcattccgattaaattattaatatgtttctcataatattcttttgacattttaaagtcaacactcgtctatgattattttaaatctatgccactataagttaggagataaaaaatagcttcatattattagaaatgtgtctactattttagttgatttaaaacgtcaatttttttcaaataatcatttttctatcaaaagatgaagctaagcgccggttagacgaataacttaaaatagtggttactaccctcgctaactattttggatgttagctgggattaattatttattaatgatgaatagttatcatgttcatttacaattgaatttatcattaaaaagtttataattaaattctaatctaatgggatggagagtgagaatatgataccaacaattggaatggtcgcggatgtgacaatgcgaaaaaattcatttgctgattacattactgatgatgtttcggaggcaattaagaaagctggcggattgccaattatttttccaacctcggattctaaatatgcagaagattttttaaacaaatgtgatggaatggcattcctgggaggacctgatgttgatccaactttatatgatgaagaaccaattcccgaactggggtatacatatcgacagaaggatgaattagaacttgaactggtgcgccaagcatatgcagcaggcaaagcgatctttggaatttgccgcggcattcaagtgatcaatgtcgggctcggaggaaccgtctatcaagattttccaagtcaaagcgaccggaaagttttgaaacattttcaagcagcaccgctttcggtaacgagccaccatgtcaatgtcatggcaggtagtcatttagagaaaataatgggcgattaccccatggtcaactcacatcatcacgaagccgttaaggatcttggcaatgatttaaaagtgaccgcaagagctaccgatgactgtgttgaagcaattgagagtatgaattcggatcagttgcttgccgttcagtggcacccggaatgtttatacacgaagtatcctgaacacgatgcgttgtttactgactttgttaaccgagtaaaaaaacggatgtgacaccacgatgttgcataaaagtttcaacattaaaaaataatttgaataactatacattaagtgatagtatctaattaaattttaatgtggggtgttgatatgaatcatttaaagaacaaggtaaccatgattattggggctgcagtaattttaactttgactggttgtggaaaatcaggtagttctgggccaagcaagcttgcagacaaacaagtgattaatttgacacaaaatgcagaagtgacttctgtagatgtttccaaaatttttgataaaaactcatttaatcaaatggacgccgtgggtgagggcctctttcggtacgatgcaaatggaaagattcatccagcattggcaacaaaactgactgagtcaaaaaatggtaaaacgtattggattgcgttgcgtaagaatggtcgttggagcaacggtgataaggtgactgcccaaaacttcgtatactcatggcagcgagcagttaatcctaaaacagcaagtgaatatacatacttgtttaacggcgttaagaatgccaatgcgattgtggccggcaagaaatctgtatccagtttaggcgtcaaggcgactgatagttatcacttaaagatcgacttggaacatccaattccatactttaagttgattttggccagagaaaccctttatccacttgatcagaggattgtggacaaatatggaagtcagtatggaacgacttccgctaaggctgtctataatggtccgtttgtgatgcagggatggacggggtctaatcttagttggaaactagttaagaattcacattactgggataaaaagcatgtttatctgaagcaaatcaactatcaagtatctaaagaaccctcaaccgcttataacatgtatcaaagtggtaaattggatatgatttcgctagtcggccaacaagctaaacagctaaagaataataaaaatactgtcaaacgtgatttagcggcgctaatgtatcttcagtataattccaaaattaaggcgttgaaaaataaggacttacgattggctatttcactgtcactaaatcgaaatcagttgactcgaaatattttgagcgatggttctgtaccttccaaggggttggtaccaagtaaatttgttaaggatcctaattctggtaaggattttgcaaccgcagcttatgtaaaaaatacggttgattataatccaacacttgctcaaagttactggaaaaaggcgcagcaagagattggcagaaaaaatatgactttcaatctgctatgtgcggatgatgatacgactaattatgcggtccaatttatttcaagtcaggtcgaaaagaatcttaaaggattaaagctaaacattcaaaagattccgttcaaaacaatgctgacgcgaacatcagaagggcaatttcaaatgaattacattggctggtcagctgattttgccgatccaatcacatttttaactttgtttacttccaataattctgaaaacaatggcaagtggtctaattcaacgtacgaccagctcattaaaagatctaacacgacagatgcgttgaagcctaagcagcggtatcaagatctgattcaggcggataaaattctgtctgagaatcaaggtgtgacaccaatttatcaaaataacaccactgatttggttaatccaaagttaaagggcgttgtttacgataagatcaacggtcattatgacttcaagtcggccagactagttaagtagttgattaaataatgaaaaaggaagtggttcgttgtggataaaacccaacgattgcaattaattgaggcgctctcaaatgcgaacggtgcgcccgggtatgaagatgaagttaccaatttggcattgaaatggggcggtcattttgccaatgccaagcgtgatccaatgggaaacgtttatttgtctcatcgtggcaacaacgacaaaaagccaacattgatggtggatgcccatttggacgcggttggatttgttgtccaagcagtcgatgataatgggatgatcaaatttgtccctaatggtggttgggtaccaagtaatgttgctgcccaaaaaatgcgggttcgggataaggacggtgattatattccggcgttagtcgtttctaaacctcctcactttatgacggccgcggagaagaagcagccgattagtattgatcacatgcgactggatgtgggttcaacgtccagagaagaaacgctcaatgactttggtattcagaccggagcgccaattgttccggatacgacttggagctataaccccaaacatgactttatgatgggcaaagcgtttgataatcgaatgggaacggcagcggccattaccagtttagctgaactagccgatacagaattgcccgttaatttggttgtcgcattggcaactcaagaagaaattggttgtcgtggcgcgcgggtgacttcaagaaacgttcatcccgatatcggaatttgtttagagggttgtccagctgatgataccttcacaccggcttggctgagtcaaaccaaatttagaggtgggccaatgctacgtgatcaagataccagctttattgcgagtcatgatttccaggcatttgttgctcaaacagctgacgaattgaagatgccatataccagagcggttcgaacgggtggtggcgttgatgcgtcagaaatgctattggaaacaggcgccccaaccgtttgtattgggatcccggttcgttatgagcataccaattatgcgctgtgtgcttatccggattttgagaagacggttcaattagtgacgaacctgatccctaaattaaccgttgatcagttgaaaaagtggtatgtggcagtatcaaaataaatggtgttggaatagcggttagttcttggaatttacttaaaaggaaggccgttctaatctttaatttgatagcctgtaaaaaagcgatatggtcataagccaaattgaagtctgataagcctgattaaaaaagatcccgtagaaccagtatttgtaggttattcattatctacaaatactggtttcacgggatctttttgatggttgattattttggtagagatcttgggataaacgaggggtgtacctaaacagtttgtccggcttcacttaattttaaaatcggatcaaataattccagtttaatacaatcaacgtttcccatatcggtgattgctaaatccggaattgcagtgattggcaaaaatgacagatagaatagaggatcaggtaacttactgccgagttcacgggttgcttgtttcaggtcacgttctctttgtgctaatttatcaggtgcaaggtcagttgcaattccgccaattggtaattcaagaagatcaatgactttaccatcgacaacaacaatctgaccaccaccatgttcgatcagctgattggctgcgatcgccatatcattagtattagtgcccaaaacaaccaggttattgtcatccggagaagctgatgttgcgacagccccttgtttgagggaccatcccgagacaaatcctaatgattgattaccatttttgccgtagcgttcaatcacggatacgagggcaacatctttgttgggatcgggttgcacaatgccgtccttaacatctaagataacgtcccgtcgttttcgaacaaatgggccgacacttttaattgtttcaacattggcttgcccattttttaaatcaacatggtagtcaaaatcttgtggttgtaacctctgatgttttagtcggccctgtagtttggaactacgttttggagcggctaaattaaccaccatttgattatcttgggcaacaagctgccctttactgatcactgagtgaatattaaaagtgcctggctggtcaactaataaaatatcagcatcttttcctggtgcaatcatcccaacgtgatcatcaattcgataggcttcggcgctattaatagttgccatttgaattgctgtcatgggtgcgataccagcattaattgccaagcgaaccatatgatcaacgtgaccatggtccaaaatatcggttgcgttgacatcatctgtacagaaactggtatttcgggcaattcctggggcaacttccgtaattgcccgaatgttttctttcaaaaactttgtaacggttgattcacggatgatgacatgcaaccctttacgagccttttcgacgaattcttcgtggctatagctttcatgatccaatcgaacgccgctcattaagaactggttaagtgctttgccacgggccattggtgaacaaccaaaaatcggttgatgatatttctgagctaatgtgagcgtttttaaagtatcctcatcacgagtctgaacggcttcacgaacagtttcccaaaccccaaaacaattttcctgttgtaagagtctggcttggtcgtccgagtcaatgtcataagcaatggttgatttaggaaatgtataaggtgttttgtatggcgcaccccaaaatacttttagtggcagctgattgatttctgcaaagatttcttccaggccgtctaaaccaattgatgaaatatattcatcaagaccggagatgatactggtcgttccgtgggggagaactgcttgagaaaaactagtcatactcatttttgagcattcaacatgaatgtgaccatcaattaagccaggaaccaaatactgattagttgcatcaatgtgtttggcgttcggaccaatgtagtcggtgatatcttggtcgactgcaacaattcgtccctgatagattgcaacgttggtttgataatattcacctgtcataacgttaactaaagtgccgtgttcaatgacggtatcagcaggaatctcggctgcaccagcttgaatatagttacctaattcgtttgtagatagcaaaatttttcctccattacttttacagaatgtttaaaacatacagcaacagcacaaatacaaagaacagcgcgatcataattgggttgatttccttgcgtcggccagcagcgatcattgtgatcggatagatgagaaagccaaatgcaattccgtatgaaatattgtaggtgagtggcatcccgacaactgtcaaaaagacaggtagggcaatttcaaagtggctccagtcaacctgttttaacgattgggccattaacacgccgacaataattaatgctggggcagttacctgcgaggtgaccactgttaatagtggtgagaagaataagctaagtgtgaagaagccggccgtgaccaaggcggtcaatccagtccggccgccaagggcaattccggctgaagattcaacgtaggcggcagttggggtggttcccatgactgaacccgcgagcatggaaaaggagtcagccattagtgcccggccgattcggggcatcttgttattcttaatgaaaccagcttgttgggctaggccaattaacgtaccggccgtgtcaaagaaggccactagtaagaagattaaaataacagcccatagctttggtgaattaagctgaggtaaatgggtaatgccgacagcaaaggttgggccaagacttggcactgacgaaattaaatgggttggtaaatgaatgagacctgtaaataagcctaacagcgtcgttgcgatcatcccaataaagattgaacccggaatttttttagccattagaattgcgatgacaaagaggccaaagatacttagccaagtcgtcggaacagtcagtgaaccgatttggaccagtgatgatttactaccaacgattaagccgctttcctgtaggccgacaaaggcaataaaaatgccaattcccgctgccattgcgagctttagatcattaggaatggcattaattacaatctctcggattttaaaaattgaaataatggtaaaaataactgatgcaatcacaattcctgccattgctgtttgccaagagatgcccattcctaatacaaccgaatatgtaaagaaggcattgtctccaagccccggtgcaattgcaatggggtagttggctaaaaaggccattaataggcagccgataatagcggataatgcggtagccgtaaaaacagcgcccttatccattccagcggcccctaagatacttggattaacaaataaaatataagccattgaaacaaaggtggttgttccagccactgtttcggttcgggcattggtatttagttcacttaaatggaatcgtcgatctagccatccgtgacgttcctttgtagcagtttccatactttaatccaccatcctaatataaagttcgtgtttatctagaattatggcatagataattgataaaagcaacgcctaatcgttaagcaatgaaatgatatatttaaggaaataactatttacgaggttgaaattacgtgttattctaacaatataataaaattaaaagcgaacgttcgtattttaggaggaagatcactttgacagatgtaacccgagaatttcttcaacaattaccaaaagccgaactacatattcatcttgaaggaactttggaaccagatcttaaattaaagctggcccaaaaaaatcatattaatattggtcagaatacaattgaggaagttaagaaaagttatcagtttgatgatttggcttcgttcttggcagtttattatccagcattggctgtgttacaaactgaacaggatttttatgatttggcctatgcctacctattaaaagcaaaagataatcatgttcgtcacgttgaattattctttgatccacaggcgcataccagtcgtgggatcagctttgaaacggttattaatggattttatcgggcaactcaggatgccaagagtttcggtgttgatgcgcaattaattatgtgctttttgcgggacttttctaaagaatctgcccggcaaacgttgttggaagccaagaaacatcgtgataagattcttggaatcgggttggattctgacgagcaccataatccaccaatgaaatttgcgactcattttgaaaacgccgtgtctcagggatatcatattacgatgcattgtgatattgaccaggttgactcaattgatcatattaagcaggccttggaagtcattggggttgagcgactggatcacggaactaatattgttgaaaatcccgatctggttgactttgttaatcaaaaacagatcggtatgaccacttgtccgaagtcgaacagtttcgtcagtgctgatatgaagggtaaagaaattaccgatttgttggccaaaggaattgaagttagtgtcaattctgatgatccggcatactttggtggctatatttccgaaaattattgggcccttgctgaagcatatgatttatcagtcgaccaagttgttcaaattgccaaaaattcatttaacagctcgtggatcagtgaccaacaaaaacggaattatgttcaagaaattgatgattttgttgccaactatgattttgagaaggcaacagacttagttaaatagtcatttgatttataaaaggagcttctagtagacgtttttgtctactagaagctcctttgttagatgttggatcctaatcactgcttgggatgagttacggttaatgcgccatcgagcctcgttttttcgttcgaaaattatgtttcaagcgcggccacacgtacttatctgctgtttgaataattaatccattgcagataattgaaaagaaggtgccaatattaaccgcaaataagttttgggtgactgcgaatgaaatcatcatcgccacaattggtgggataaaatcaattaactgggcagccactgcacttttacgaaggtaaaagaatcgcaaaatgttggttgtatcgtcattgggatgcattaaaatgttagctcgctgatataacgaaatggctgtgcagaagaagataattcctaaacaggacaaaatggcgcgaataataattggcagattaccgataccggctgaatcaaataaatttacgaagagattgacgaagtaactaaagaaacaaacataaccgatttcgccaacaaatcgcggccaatcccaacgtttaatcaaaatttgattagtgaccgtattcaaaaagccgatgatgaataaaatggcaccaacgttgatgttaaaccaacggctataattgacggctgatgcggtccaaacggcacttcccatgttggctgaaattgttagcgcgttaccgaacgcatttagaattaagccggatattaatccaatcaggcgttctttaaatgtatttttgatgaccaagtccctctctctccaaactaatcgtgttaaagataccggttggttcgtggctcgtaggtcaaagtcacggccttttcaggtagaacaactttaattttttgatagacacttttgaaaccttggtgcagaagtttaatgctgacccgattgcgattaactgagatggcgtagcgattgaattcacctttttggtagttgaagtccacaccattatcctggtaatgatcatagtgcccctgatcaccccaaacatggaaggtcatttcgtcatcgggttcttctgaaatgtggtcgacttgttggccccatggtaggattgcgtttttctggacgaacaaaggcaacttatctagtggtgcgttgacaacgatatctttgccgccgttatattcacggtgattccagaagtcaatccattgaccagcaggtaaatagaccagtcgcttggtttgtgacttttcaacaattggcgccactaacagactattgccaaccataaattcgttatcaatatctgtcacgcgtggatcatcatcgtaattgagaaccagtgggcgcataatcggcaagccggttttggcctcttgggcaaacagatcgtacatataaggaattaagcgataacgtagttgtagataacgtcgataaatggagagggtgggttcgccaaaactccaaggttcttggtgacgggtacccatggcactatgattccgtaataacggactaaagatcgctgcttcaatccagcgagttaataattcaggcgttgtgtcggaaccgaagccaccgatatcggttccggcaaaggcaaacccactcaaaccaagattgcatagttgggggatcatcatttgaatgtgagcccaaagactgcggttatcgcctgtccagactgttgaatatttctgagtgccggcgtaggcagctcttgtaatgatatatggtcgtttgcctttatgggttttaagtccttcataagtcgcttttgccatattatgaccataaacattatgcattttctgatgggttgatttaagcttttgatcactaaagacaatattgtcagggatgtcaccatcaaatgaagctggttcattcatatcgttccaaatgccggcaaccccaatatcggttaaaaatttggtgttttgagcccaccagttgcgaacctcaggacgaccaaagtcagggaaagcggagtcacctggccaaactttgttgatatagacttgaccatcgggtgtctttacaaaatagccttttttaacaccttctgaataaactaaatagtcagggtcctttttaaccccggggtcaataatggtcacaatttttattccacgttgtttcagattttgaagaaaggccttgggatcattttggtaagcctcattattccaagtaaagacccggtagccacgcatgtaatcaatatcaaaatgaatggcgtcgcaggggagtttggatttctttagatgatcggcaatggtttcaacttcctgttggctgatgctgtatccccagcgtgattgctgataacccagcgtccatttttgtggtaacggcacccgaccagtcaaataggtgtaattagtgacgacgtccttgagtgtttgacccccaaggatgtagtaatccaagttgccggcaacggcagagtaaaaataatagttggaattttccttgcccatgtcaaagtgactgcgataaggattatcaaagaatagcccatacggatagccattttttaaaccgtacatgaccggaatggatttatatagtttagtgaaattttccatttgaggtgcgggattatcggtgttccaattgtcatactcatagccgcgtttatccaagtagccggttttatcacccaagccgtagagatgttcgtcagccgctaatgctttaacgacttcgtagtaactgttgtcatccccgttaacggattgtgaaacggtgtggccctccgcttcaaccaattgtttatgagcttcatcgattccccggtctagcggtgatcggctgccccgatagtcggtgattagcggatgacctgcctgatcgtaaacatcgatatgctgatcggcgtcaatttttagaagcaatgaatcagtttttaattcatagtgattatcattcttgtttaaggtgaaagttgttgattgttgtttattgccctcgacggcgtaagactgacctttatcaccacggaattcaaaaacgcggataatttcgggggttagaactgaaatttgaagatgacgatttggataattaaatgtcactgtttgattggtttgcgtgactgacggtaatgtttccatatcaagacttccctttaagtttaattcaatattgattttcaaacgtaggtacacatctatcgtaacagtttcagagcggtaattgattaatgaactttcaagttgtcaataaaaattgttgggtgaatatttaatgtatctggtcacagagatgctgaatggattggataagtaaaaatatgcctcgcttatgtcataatgggttcgaggtgataaacatgttaaaaacgcccaaaaataaaaacgcctccaagtccaagttgaccgaaaatgatatgatgattcaagtcgaatcttgagtgatcatgggcaaatcaagagtgagagattaagctttgaacttgaacggcaagttcgtcattcaaatattccagtgattaaagatcctcagaaggtcgatcgacatcttctggaaaatggcgatgataattgtcttatgccgaatagtatttctgaattaaataataaatccgactgaagtttgtgttaaggaggcttccaaacgctagttaattatgaagatatggctgtttttcatcccggttattaggttaaggactttttatctgaaacagtaatgagtcaacatgaattggctaaacgattaaacacaactaagaagacgattagtgaactggtcaacgggaagattgatctcaatgataatctgattaatgggttgtctttagtatcggagacttcgaaattactttggagaaatctgaataacaggtatcaacaagataagcaaaaaatagatgagcaaagtaaatctaatgaaacactttaaaaattagaaggtgaaattggtgattgaagttttttgatcatcgttaaaagtacagtgttggatttagcacttaaactagttcgacaaaaccattttttgtgatctgatcgtataatcattagcaatcattgcaattaattaaaaccagttcacatttttttgaaatcttcaatttgttgttatacaattgttacattagattggaaggggtgatcaagatgttgattgattttacagtaaaaaactttttgtcaataaaagatgaaatggttctttccgccgagacaggagagcgattaagtagattaaaggagactaatacagtcaaaaacaatttttcgagtcttttaaaaagtttgatcattgttgggccaaatgggtctggaaagtctaatttaattcaggcattaaatttaatgaaaacgatggttcttaacgatcctgaatccgtgacaaatcggcttcggtatcaaccgttcgctctaaaccaattttctgaaaattacccgacgcaattcgaaacaacttttagctattctgaatacacttatcgatattcgtttgagtataatgcagatgaaattacttctgaaaatttggcgattttaacaaagccttcttcaaaaattaatgaaacaatttatttttcaagagatcatcaaaatttcttggttattccagataacttgaagtcattagtgactaagacgcgaccaaattcactatttttgtttaacgctcagcaagcaaatgatgagcatgcaattaatgtcactaaatggtttcaaaatgatttaatgtttgtggataatctgcaaatgactgatcaatttgcaaatttaatcagaaacgacaaaataaaaaatgagtttttacgattccttcattttgcggactttaatattatcaacgttaaagctcgtgagattcccttgccagactttccggaacaatttaaaaaagcgttagcgatgcttgaccagactgttaatcttccgactagcgccaaagagttgtttacagttcatcatcaatataatgattctggcgatgttgttgctgaccaagagattccgttatctatggaatcgaaggggacccaaaaaatatttttaattgccttatcgattatcagtgcccaactcgatggtgatcgaaagactctattatttgacgagtttgatgattcgctgcattttgagctctctaaagctttgctgcaaatctttaattcaaagcaaaataaaaatcaatttattttaaccacgcatgagctccaattactggatactgatttacggactgatcaaatttatttgatggaaaaagattttcaaggtcgtagtgatttgaaatcggtttttgacttcaaagatagtcgtaaaaatgctcgggctgatgttaagttcatgaaaaaatacatcgaagggagatttggagcatttccgcaagttcaagttggcgaaatgttgaatgcgttagacgcatcccagaatgataattaatggcaagaagatcaaagggcattccattaaagccgattattgtgatttattgtgaaggtgaatccgagaaagcgtattttgaaatgctaaagcgaaagtatcatgctacgactgttcatactgaaaaaatagctgttgagtcaatcggaatcaaaggaatgccgttactgcaaaaggccgtcagaaagattcagaaactccaaaaaaagaaaaaaattgatcaatcatacgttgtgtttgaccgtgatgaccttagcaggagtgaactgcaacaatgcgaaaagtttgctaacgagaaccgcattcaaattcttttctcaagcatcaacattgagatatggattttaatgcattttcaaactgttaacagagcctatcaggcaagtgagttaaatcagattttatcagggaaagacttttttgatactgattatcgacggtttaagggagcttcctacgatcatttcttatttgatcgggtgaagacggctatgatcaatgcaaatcgacttgaaaaaggacaaagtaagccgtggtatgactgtaatccgtatacaaatatcaacgattttataacaaaaatatttaatgtgaccgagttctgatgatgggttgaatgaaccaaattaatcatttttgcgggatccttctggttgaatgtgtttcagatggtcgttttgattcatttaattgctgctaaatttcaccttgaaatattaggtgaaacttagcagtttttttgaatcgtgaatgtttaaaaataaagaaaattttcttagcccatttatcatacatgccctaacagattaaacgatttactttctgttaaattaggcttgtggtttgcatttctcaatggtaaactttctgtgtaagcgctttactatattgataatggggggcaatttatgttcaaggggcggtttttcaagggagcagttttgctgggattgtttttagcatcgtttttggcatttaagcaggaagtgcttgcaaagtcaaattcaaatcaagaaatacccgttcaactattaggtgtcaatgatctccatggtggtttgcagacgaacggtaaatttgtgatggatcaggtaactgtgaataatgctggtggtctcgccagacttggtggttacctggatcaagaggaacaaaattttaaaatccttcatcccggtggcgtgacgctaagggttcaaagcggtgatatggttggtgcgagtcctgccaattccgcattactggatgatggcccaacgcttgcagcattacacgcgatgcgggttaaggtgggggttcttggtaatcatgagtttgaccatggcattgatcaatatttgcgtgaagttgatggcgtgactccgtcaactgattatttaaataatcctttacagattcaagctattcagcaatatccatttgttaatacgggaatgaagatgctaattgcaaatgttctggataaacgaactcatcaaattcctgtgggctatcgtccttataccattcaaaaagtcacggatcccaaaaccaatcaatctgttcgagtgggatatattggtattttaaatacgaatctacctggaattgctaaaaaatatcaatttttagacgaggctcaaacgatcgccaagtatgacaatttgttacgggggaaaggagttaaagccatcgttgttttgggacatacaggtgcagtcactcaagatggccaaacaaccggggatgctgttaacgatttaaaaaagttaaaacagattgatccaaataatagtgtcgatattttctttgccggtcatagtcatcagtatgcggatggttgggtagacgggattcctgttttacaggcaggatttcaaggtaagggattttctgaagtaacgggcagccttaactttcaaacgcaagattttgatcatcggacgttgaatgcaaccgtgaagccagtttactcagctgcaaatgatccggcatcgtttaaaaagagtctggccttttatgaaatcactaatattatcaacgatgctaatcaaagagtggcaccaattattaatacaaaagttggttcaattgctggtggtcaaacaatcagtaatgaactttcgaataataaggaatcacaagcagcctatgttgttgtcgatgcgcagagaaagattgccaaccaacagggtcattcaaccgatattgccattacgagcaacgactcaatcagaagtgatatgacagctcagggggatggcagtgtcacactggggacgttatataatatgcagccgtatggcaacagtcagccaattgtagaattgaccggccaagatatcattgagttgttaaatgaacagtatacaaagtcgcaattatatttcttgcaactttctgggctgacctatcattttaaagcagcaagtgaaggcgggcaattggcaaccgtttcaaatgttcaggttgatggtaagccaattgatcagaatgtgaaatatcacgttctgacaaatgattatttatcaactggtggcgatggctaccttgcatttacaaaaggaaagattgttgataacgctggccaggatattgacttattaactgcatatttgcaagcaaatagtccaatccaagtaccacaattagaccgaaaaattcaggattaataaggggaagataaagatgaagttttcaacaaaattaatgacagtattatgcgcaatgggattagtgggtgcaatcagtgtggtgacaccgatgcctaactcagaggctgcgtcagtaaaaaaggcgacaaagaaggtcactaaaacagttaagaagaccgcaccagtaaccatttatttaactcgtcacggggaaacaaccggaaatgtcatggggcgcgtccaaggatggagtgactttccgttaactgaaaacggcattaaagttgctgatcagctaggttatggattaaagggcattaaatttaagtatgcgtatgccggcaatttaacccgtcaagaagttactgctaaacatgcactgaagtattcaggaaattcaaaagtcaaagtaaatatttcccaattcttgcgtgaaggtggttacggaagctttgagggtgatagtattgccgccgataacaataaaattgcggcggtttatggttaccaaagtggtgatgacttcatgaagagtaccggcaaagattattggaacatgttgcagaacgcttattatcgacttgatcgacaaaattcacaacaaacaaaattagttgccggcgaccgtgcagaaagtgcgacgatggttcaggatcggatgactaaagagctaaatacaattgccaaaagaacgacaaacaatggtggaggtaacgtattggttgtgagttcaggtatgtcaatcaatgaatacttgtcgaccatggcagctaattatacaggtgctgcaattcccaacgccgccgttactaagctggtctatcaaaatgggaagctatcggtaactggtcccattgcctccttggattatgttaataaaggtgcatctttaatgaaataaaataggaagttgattgttatgtttagaaatgatcatcaatagatactaaaacagcaggagttgggaaggcatttaatccccaacttctgctgcttttgttagatcattattcttttttggtggttcttttaatcaaccgaccaatattttcggctgtttgagcaacatcatgagttgcagaatgcaatgcttcgtccaatgttttgacgccggcaacactggtgaagatggcgtcaattgttttctttgaatacaattcttcgatgcggtcaccaatactgccagcgattgcaatcaccggcgcgtctggggcaacttcttttgtcgccaaggcaacgccatatggggtcttgccaaatttggtttggaaatcaatgccaccctcaccggtaaagacaaaatcagctcccttggcttttcgttttaaatcgctatattcaacgacaatgtcgacaccctttttcatggttgaattagtaaaggccaataaaccggcaccgagcccgccggcagctccggcgccaggataactcgctaatgctttaccggtttgcttttggatcacgtcagcataatgacgtaaattttggtccagtgtttgcaccatttctggtgttgcacccttttggggaccaaaaacagctgacgccccattttttccgaccagtggattggtgacgtctgaggcaattaggatggttaaatggttaattcgtgaatcaacctcacttgtgtcaatttcagcgagtcgatctaaggcaccaccgccaaatttaatttcctgatggttctggttgcgcagtcgaacaccaattgcttgtgccattccagcaccaccatcgttagttgcactgccaccgatccccaaaatgagtttggaaatgccatggtccagtgctttcaggattaattcacccgttccataggtggtcgtaatgagcgggtttcgggttttctgattaataaattgaatgccactggcttgggccatttcaattacaccggttttaccatcacctaaaaggccaaactgagcctgaacaggggtaccaagtgggccggtaaccgtttctgtgattagtttgccagctgttgcatcgacaagtgattgaaccgtcccttcgccgccatcagccattggaatcaatgaataatcagcctgtggatatacacggctgagaccggctttgattgcttcggcaacttcttttgcggttaagccgcctttgaaagaatcaggcgcaatgacaaatttcatgatttaaagtctccttagacatccttgtagtgatagctttatttacaatggggtaatcattatcgtgtggggataaacaacagtgaataatcatctttctactaaatttcatttttacatattattaattatgacacgtaaatggccacgtttatatagtgaagctgccaaaaaatctgatttttcctcattactaaagatgaagaaggtgactacggcgcaatattatcatttaaaagtttgccttttcgatgaagtgagctaatctatttatgattattaaatccttttgtgaaaaaacaatgtaattgctggaagaaaaatttcaacaatgagtgacgacttttctgtagaagagacgttaaaaacggcttaaattgttagatgttgcttaaagttaattattttgtcaccagtgaatcgcttgatttaggctggtttcacccgttaatgataaaaatgatgccatttttatcaaaaaccataaattcttatttatttttcgttgccccacgaccaaataaagcatagaatggtattgagcaggatttcacaaatacgttgacataagggggtaatttgaatgtcaattgtgctatcaacgcttaaagaggctgatcacgaaaaccgggttgcacttagcccagcagttgtcagtcgaatggttaaagatggttatcaagtattggtggagaagtctagtggggaagctgcctacttttctgatcaagcatatactgatgctggtgccaaagttgttgacagaaatacggccattagcgacgcaaatgtaatcgctgtcatcgaccgaccggatgatgcgacgcttgctaagctgaagtctggtcaagttttgattggattgctgagttcacttatcgatccggataagatggaacagttagcaaaacaaaaggtaacggctttatcatttgagttgttgccacgaacaatttcacgagctcaaagcatggatgttttgagttcacaagcatctgttgccggatacaaagcagctttggttgccgctgatgatttcacacggtatatgccgatgatgatcaccgctgccggaactgccaaacctgcaaaggtattagtattaggtactggtgttgctgggcttcaagcaattggaacggcaaaacgtctcggtgctgaagtttccggctacgatgtccgaccagcttcaaaaggcgaagttgaatcattaggtgccaagttcctaaccagctcagttagtgctgctggtgccggtggttatgcgcgtcaattgtcagctgaagagcagcaaaagcaacaagaggaacttgcgggattcattaagcaaaacgatatcattattacaactgcccaagttcctgggagaaagccaccattgttggttcctgaaacatctgttaaggaagcttccgctgggacaatcttcgttgatttggccgcaagtgatcttggcggtaacgtcgccggatccaagccaagtgaaattatcaccactgataacggtgcccgaattatcggtgcccaggatatggcaagtcaattaccaaccgcttcatcggaaatgtatgccaaaaatgtccaaacagtcattaagtcaatcgttaaagacgatgcgttaaacattgatactgacgatgatgtccttagtgaattagttgcgacccatgatggtgaaatcatttctgatcgactgcgcaaagcgctcaatctgccagtgaaacctaaggcagatgaatcgactgatactaaggaagactcttcggatgatactaaagatcaatcggacaaaaaggagggtgcttaaaatgaatgaggaattatacgctaacttagcaattttcgtgttaagtctgttagttggttttgaagttatgagtaaaattccagcaaccttgcaaacaccaatgatgtctggtgccaatgccattcatggggttgttgtcgttggtgcatttgtcattgccgctgaagctgataatatgtacttctatattttagcgttcttggctgctttctttgcggcagtcaatgttgctggtggttatacggtcaccgaccggatgttggggatgtttgatcgtccgactggcggatccaagaaagatgataaaagtggaggcgagaaataatgagtttacttgaaacttgcgcttcattaatttatttaatttctgctgtctgctacgtcattggtgttcacatgatgcgttcaccaaagaccgctaaaaatggtaacttgttatctggtttaggtatgattatggccgttgtcatgattttgattgaaatcattgctgacggtaaaatcagtttcccaggctggatcgcgttagcagccggattgattttaggaattggttatggggttattaaagcccgtaaagtaccaatgactgatgtcccacaattggtttcactatttaacgccgttggtggtggtgctgctgctacgattggtatctttgattacacccggttggctgccggttccggattggctttagccttttcaattccagtcttcctagatgttgtcattggtgggacgactttctcagggtcactcattgcgactggtaaattgtcaggacacgttcccggcaaaccaatcattttccctggtagtaaattattgaatggtttggctgtgattgccattattgttgctgctgtgatgatgattggttttccaactaatatctggtacattgttttaggattagttgctagtttgatctttggtttattgatgacattgccaattggtggtgctgatatgccggttgtcgtttcacttttgaacgcgtttactggtttggcagtttccttcgccggctttgttattaataaccaaatcttgattatcgccggtgctttagttggtgctgctgggacaattttgaccctgcaaatggccgaagcaatgaaccgttcagttgccaatattattgctggtggttttggtggtggcgacgaggcttcttctggtgccgctactgatgtcccagctaatattaccgaaacaagcgctgacgatgtgggtctgcaattagcatatgcccataatgtcatgattgttccaggttatggattagctgctgctcaggcgcaacacgaagttgccgagttggctaagttgttgacagaccacgacatcaatgttgactatgccattcacccggttgccggccggatgcctggtcatatgaacgttttgttagccgatgttaatgtgccttacgatcagatgaaacaattggatgaagctaattcaatgtttgagaataccgatgtttcattggttatcggtgctaatgatgttaccaacccacttgctcgtgagtctggtaatgcgatttccggaatgccgattttggatgttgacaaatcgaaatccatcgttgtgatcaaacgttcaatgagtactggttatgctggtgttcaaaacccattgtttagtgatgataagacaaatatgttcttctcagatgctaaaaagggattgcaggatattatcgcatcaactaagacttatttgagttagttgatcgaagtttactttagaatgaagaagagctaattatgtgcctgtatgggatggataattagctctttttattttgacttgacaggaagcgctttcattgatatctttaagatgtttaaaataattaaaaggttttaatgagaggtgtatccagtatcatttataattgatgagagaagttagcactaattattggtcattatcgggtcatctctgaaaagtctgacactgttttaaatcatttaagttttgtatgaataagtgtgattgcaatcagataaagctgttagtcgcttattgtcatacatgttacaaaaggggaagattctatgaggacacatcatcatttattatcgaagattttggtatctggattagtcgttccagcacttggtttaattggcgtaggggctaatcaacctaacactgttcaagctgctggcgttaatgttgttacgaaaacggacaattatcgatcgcccactcagcagccggaatacaaggtggtaccgaaaaagtatcgatctgccattccagttcagtttttaggaatcaatgatttacacggtggcttgtcgacgaccggtgatgttcaaattggcagcaaaacatataaggatgccggaacagttgccaggatggcaagttatttaaacattgcccagaatcattttaagaaagtcaataaatccaacaatacatttcgagttgaagctggtgatatggttggtgccgcaccagccaattcgagccttttggcacatgaatccaccatgcatgttttacgcgcgatgaactttaagattggaactctgggaaatcatgagtttgatcgtgggttggctgaattcaatcggattttaacgggtgccaaacccgcagcgactgctgacaagttggttaaaaattatccgcaccaagcttcaaaaattgatttgattgatgctaacgtgattcgaaaaacaactaataaaccgccgtatggttatcaaccctatacgatccgaacagtcaaagctcacgggcaaaaagctaaagttggctttatcggaattgacacaactgatttaccgcatttgacactgtataacaattacaaggcctttaagctgctggatgaggccaaaacaattgtcaaatatgataaagttttaaacaaaaaaggggttaaggctgttgtcgtgcttgcccatacgggagttgcttccgaaaatggtaagacaactggggatgttgttgatattttgaagaaagttaaccagattgatccgaaaaacaacgttggtttgtacgttgccggtcattctcatcagtatgccaacgcggtgattggtaagacccgagttgttcaggccgtttatacaggcaaagcctatgacgatacgcaaggctacattaatcctaaaaccggcaagtttgttgggctgacatctcatgtttacccggtcctatcgaaaaaagctgataaaaaagtaaagtcgaatgccaaggtagcagcgatcgtcaaagatgctgataaacgcgtcgcaccaaaagttaatgaagtcattggaaaagctgggactagtaagccaattacaggtcggctacacaataccagtacaatggaaaatgctgctggtgaattagttgtcgatggtcaattatatgaagccaaaaaggcagggacaaatcctgactttgcgatgaccaatactggtggtatccgggcagatcttgacgtgaagtcaaatggtgatatcacgtggggagctgcaacggctgtccaaccatttggaaatatcctccaagtggtaacgatgactggtaagcaaattgaagctgctttgaatcaacaatatgatgaaaatcaacattattatcttcaaatttctggattgaaatatacttataccgataccggaaataaagatcagccttacaaggttgttaaaatgaccaaggaaaatggtgaaccaattagttcaacgggaacctatcgagttgtaatcaacgacttcctgcatggtggcggtgataatttctttgcctttaagaatacaccgattgtgggctcaattggttctgatacagatgtctttgttaactacattaaggatatgaaggctgcaaatacgttaattacagcaccaaaattggatcgaaaagtttaccaaaaggctggatcggctaagcaggcgattatcgttgctttacccattcaaagtgtctttacggtgaatgaatagcaactgatttatcaaagaaataaagataaaggtaattgggtttcaaatgaaaatattgtcaaaaaaagttagggcagtccttctgccttaactttttttgtgtcggaaacccaggtttctacttgcctaaaacggatgtgtaatcataatgccaagtttcttgcgtttttcttcatacatagttcataagtcgttgctaatatatcacccatagataaaacttataaatgcaaactacaacggaggtcctcatcatgaagagtattaaacataaaattttattgactaccggcttattagttggaatgaccgcaactggtattaaagtaaatgccaatgatgatttaacgcctgtcaatcaatcttcggaaagttcaacaacgacaaccgctaattcaactgccacgacagaaactgcttcaacaacagccgctccggcagcttctgataagcaggtcagttggcagacaccacaatccgcggatacttcggcagataacagtcagacaagcactggttatggaaatcaaaattcaactgcgggtacgacacaagcaacgggttcgacggggcaggagacaacagttgatccagctcaatcagcgggtgttcagaattctcaaccggcgcaaacatctggcacgcaaacgtcatcaactcaggacacacaaactcagccgaccacgtctcaggcccaaactgcgtcatcaactggcgttagtaatgggagtcagacgacggcatcgactaataaccagcaagctgcatctcaacaggtacaggcaccaaccagcgctgcctcaacccaggaaacaaatcagactagttcggtaaacaattcggttaccagtaaccagtcaacaagccaaaatactactggggccgccggtaacacttcaaatggtggccagacagcaactgttcaaaatcaatcagcaagtccacagaaagccacgtctcaatcagaaaagaggtcagataccaaatcgaccagccaatcaaaagatgattccaagcgttcggctgccgctaaaacaactcataaggctaaaagcaaggctactgataatcaacgggctacgcaaaaaacgtatatttattatgatgaagttaatcctaataacccgaatgaatacggaaagattatttattcggaggtaagcgatgagaaaactaaatattatgaatataatccaaatactaacaagttcagtttaataacagatgccacaatgattggagaaattaatgaggcgtttgatagtgaaaaagtgacaaaacactatcttgaaaataccgcggaccttcaagaggccttgaaagatccaaagattgaaaatattggtgaatatcggattgttagaattaataagaatcctggatctgatatcccttcattggaggagacaatccgtacttttcagaaattaggtgagggtgataaggatcattatgtggttgaaattgggggcgactattttgaatatcgtgatggaaagtttgatatgaagacatcggtaaatgatgatgttgaagaggcaaagagcgtgattgaacgacagtacgcaaatcagacaacattagatgtgataaaaaaggaacttcaaggtactccggatttatcattttatgaaaactatcgtgttactgttgttccagaattacctccaaactttgatggcatttactccacaactgatgatggatatgagaataaatattcagagcctggtagtgtggaaggtgcaacgattgtcctggtctattctgatggtggtgattactatcgatttgatcctgaggaaaataagtttgtttcgttagatccagaggaatatgatcatttggcagctgcaaaagcggcagcgtcaggtgcaggtgtagtcgtcacacaattattaccaaatgaattgggaacgcaggaccttcaagctgcagttgaggcgggacaaaattacgttacaattgatggacaaacgtatatgatttatcatgttgccgataaaagtgggattccagagaatacgccatattatctaatgatgattccaaaagccttgcctgcaacagacttaaaacctaatgatgtcttaacagatcttaagacggttaatcctggtgtgaaggtaactcttgtagattattggttaacgagacctggtgggaatgaggcgcctagaaatgcgatcagctcaggaattaacaatggaaaagttttgaaatttggcgccggaaccggttccaccccccataatgatttttcatcaacaattacaaaaggaattgtacaggagagattagttgacggatacccggttcttaatataaagggagaagagaagcagtcgttaaactatttatttgacggcagtcattcatccagcaaagctcatacgacagatgcagagttagcaatgtttattagtgatggcaacggtggctactatttcaacagtcaagataatcatgcgcttttaaatgagaagggcgagatgattatttacaatcttccgaacaagccagatcgtggtgttaaaagtcaattctttccattaaatgctaagaacatgttttttaacgaggatggttctccaaaagagtataatcaaaacaccacaactggatttgataacggtggcttaaatcactactttggagcgaaaattgatctcgcctatattcatcctgaagatggtaagatttctgatgaatctggcggtaagaaggatatggtatttaactttagtggtgatgatgatttttggttattcattgatggaaaacttgttcttgatattggtggaattcatggtgccagatcaggatcaattaattttcatactggagagaccagctatataaatggcatcgagggtaccgacccacaagagggtaaaaatctatcagagcttcttggaacgggttggaatgataagaacgaagaacataccatgaatatcttttatcttgaacgtggaaggaatgaatcgaacttcaagatgaattttaaccttaaaatcccgtcttataattatgccaagcgtgaagcatatgcgtatgaacaggaaaaggtaaacgaaagatacgtatacgcagaccatgaggcctattcaacaaccgacaccccacaatggacatatggggttaatgagaaatatggtgttcggcttacaccggttggacctgggcctaatccagatcctgaccctaagcctgatcccgatccaactccggatccagacccggttattccgacacctaatccagatccaacacctgaaccagatccagttattccaaccccggatccgattccgacccctggtccagaaacagatccggaactagatccaatcctaccgggaaaaccggataaagaaacggcctctaaaccggataagggttcatcgagatcccaaattgataagaagcgttcaggcaagtcaacctcttcagcagttggcaaagtcggtgttatgggattgcctagtcgattcgatcagtcaggaactttaataggttcttcagcaggttcttcaagaaaagcagctgatggcaccttgtatctcgcaaaggacgcatctcgaccaacttctgattcacaatttaaatatgatttaactaatgacggcaagaaagctcgggttggcgaggatgcaactagtattcaaacagcatcggtattaccacaaaccggcgatagccacaattcaatcttgagtatcatcggaatggcattgttaacaatgttgggagcaggattgtggaaacggacacgaaaaaagagttaatgattattgaaagaccgttaaggaaacaaactaaataaaaataatgacatgggcaagaagttggaacgtatgtgcgtatctacttcttgtcttttgttatgtcattgctgaatgtgataattaatcagtaaaaaacgattgccgggggctcaatatgtgcggtaatattaatgaaagggggaaatttatttaaggagaatatgaatgcaattgttattaacggcaagaagttatctgagaatttcccaaaagggcgccttagctgatcggagggcacccggtcatggctaacaaattaatcaaatcaaacttaattggtcgtcgtgatttacatggaaacggaggtgggcctttggatcctgaaaaatacgcaactaaacaggagcttcatgattcagaaaccaggctttctaatcaaatcgcgttacttgaagctcatttagatacgaagtttgaaaagacaaacgccgatttgaatcaaaaaatggacaatatggacgctaaatttaatcacagatttgatcttatggatgccaaatttgatcaaaggatgaatcaaatggacgcaaaatttgataaaaagatgggacaaatgaacgcgaagtttgatcaaaagatgggtcaaatggatacgaagtttgataaaagaatggatcaaacaactgctgactttaatcgacaatttagccttatgaatcaaaaatttgatcaaaaaatggcttacatggatgctgaatttaataaaaagtttgatcaaaatgatattcggttcgaaaaagtaaatacgcactttgcaaatattgaaactgaaattcagatggcccgaaattcaatgattaagtggtatttgggctcatcaattgcgttggtcggactagtcattgcagcaattcattatctaatgtgatcatgaaatcaggtgtggtttgactcaaatgccgaggaaaaaatatcttgtcttgggtcactgaatccagcaatgcagacaagagcgctccgggtcatataggccccttaactgatcgcttcaaaatcaggaattgtgttgtggcaactcagtcaaaacgtgcaaaggagcagcaggccccggccatataagccttctaaccggatattccaaattcaggaatatttctgtggattggcttccaaattcaaaacgtgcaaaagagcagcaggccccggccatataagccctctaactggatattccaaattcaggaatatttctgtggattggcttccgaatttaaaacgtgcaaaggagccgcaactcccggccatataagccacttgatcccatattcccaaacctggaatatgggatcaagtggcttatattctgggagttaaccgcgtctctttgcactcttcacaataatttcaatcaacttaattgaacccgtcgcgatattatgggaaaatgattgtcggacttaatcctaagcaattattagcataatcaaaagggttagcatcacctgattattcaagcaaatgatgtgattaagaaattatttagaagggtgatttttaaatgttcaataagcagggaaaatttggccgctcgtttaaacgagtgacggcactattactcgtaacagccgcgacattagctttggctgcctgtggtaaatcatcaaattccggaaagacacagcaagtgctgaaattaagtacaccatctgaattggcaacactggacaattctaaagcttcggaatctgttagcttaacgcaactctatcatactggtgaggggctctatcggttgggaaaaaactcgaagattgagaatgcgctggcaaccagtaccaaggtttctaaagatggtctgcaatatacgtttaaattacgaactaacgataaatggagcaatggcaaactggttactgctaaggactttgtctattcctggcgacgaacggcggacccaaagacagcttccgaatattcatatttatttgaaggcatcaagaattttgacgcaattcaaaaaaaacagctttcaccagataaattaggagtaaaagcaattggcaacaacaagctggttgtgacacttagcaagccggttccatattttaaactcttggttgctttcccagtctttttcccagaacaagcatcagttgttaataagtatggtagtgactatggcacttccagcagcaaaacaagttataacgggccgtttaaacttgttggttggaacgggactaacgaaacgtggaaattggttaagaatccgaactattgggataagaaaaatgttcatctcaaacaaattgatctgaatgtcgttaaaagcccagcaaccggtttgaacttgtatcagcaaggtaaactggatgccgttacgttgagtggcactcaggttgccaactaccgcaaaaataaagatttcaagaattttgtcggtgggtcaatgatttacctgcaacttaatcaaagacgggttaaggcattacgaaatctaaaggtccgccaagccttatcgcaaattgtcgataagcaggcgttggcaaccaaagtcttaagggatggctcgactaaaccgttgggatttgtctcacaaaatctattccgaaatccgaagactaaggctgactttgcaaaagacgcttatgttaaatccggggttgcttatgatccaacaaatgctaaaaaactctggcagcaggggatgaaagccgttggtcagaacaaattgcatttaacaattctgagtgatgatactgatcagacaagatcggccgcggaatacttacaaagtcagtttgaaaagttacccggcttaagcatcagtattcaaacggtaccgaaactaacccggatgtcacgatctgagaagggaaactttgatgttgttatctcaacgtggggagctgattttgccgatccaattaacttcctgagtttaatgacaaaaggcaattcgtccaataacggtggttttgtgaatacaaagtacgatcagttaattgcaaaatctggttcaacggatgccaacgacccacaaaaacgatacaacgatatggtaagtgctgaaaaagtattaatgcaacagcagggccttatcccgctgtatcaaccggcaacagctcaattgtggaaatcagatgtcaaagaatatgtttggaacccagctggaatgagccaggggtggaaggatgtttcgattaagtgagtgcgagtgcaaagagacgcggttagctcccggccatataagccactaaagcccagattcccggttttggaatctgggctttagtggcttatatggccgggagctgcgtctgctttgcacgttatgaccaagttgccacaaccattcctgattttggaatatccagttaaggggtttatatggccggggcctgctattcctttgcacgttatggccaagttgtcacaacattcccggtttttgaatctgggctttagcggtttatatggcgggggtctgctattcctttgcattttatggataagcagccaacaacattccttaaaaatttgtgcttggaaagttttacctggtagtccagataatatcagcatgttgtagataaccaattaagatttggaactcatccgaatcaatttatattttcgacatcacaccttgacatcgatcaattagaggtataaattagataacattaaacattgatgagtaaatgacaaaacactttgaaaggaaaagtagatttgcctattttttaaagagagctttcggctggtgtgagaaggtagaaatagtgaatcgaaaatcatccttgagtggcagggacgacccatttagtccctgatggcagccagccattatgatggacgtgtatcgaaagggaatgtgaatcattctttctttccgtacattgaggtttagtcgattttgattagacaattaataggtggtaccgcggagacgccctatgtaagtgacagaacttgcatagggcgtcttttttgcttatcaatttattaacattaaaaaaggagtggttttatgcagcagggaagtaaaattttaacattgaataatggttttcatttgtttaccagaacagttggggaaggtgacgttaaactgctttgtgttcatggcggtcctggaagtaatcacgaagaatttgaaaactttggcgaagaattggctaagtatcacgttcaagtctcgatgtatgatcaactgggctcattttattccgatcaacctgattttactgatccggcaaatcaaaaatatttaacgttggactattacttgagtgaattagaggaagtccggcaaaaacttggattagagaacttttacttgttgggacattcttggggtggcctacttgctcaagaatatgcgttgaaatatggtcagcatctaaaaggcgtgattatcatgagcatgattgataatatcgctgaatatactgttcatattaatcaattacgtgaccaaacattttccccatttgaggtggcttatatgaagacggtcgaacatgatgagcgctttgatgaccctaagtatcaggaattggttgcaaaattatataagctttatgttaatcgtcatcctgaaagaatgccacgtcacttagtcgagacaatggctacgccggtttacaatcatttccaaggaaataacgagttcgtgatggttgggacgttaaatggctgggaccgtcgagccgatattcataatattacgaatccaacgttattgacgtttggtgatcacgacacaatgccactggcgactgctaaacggatgaatgaggagatcccgtcgtcgcgattggtattaacgccggatggcggtcattgtcatagtgttgataacccgaaagcattttttaaaacattaggcggatttattgaagacgttgaaacgggaaacttcaagtgaggggcaaatgagactaagttattttaaataaaatcgttggaggcttgttagtatgaaaaaacaattggtaacagcagcagtttgtttgtccgcgttgcttttggcagcgtgtggtagtaaaagtagttctaaatcagttggttccacaaaatcaatttcattgatgcaaaacgcggaactattatcgttggatacatccaatcacgccgacctgacgcaatggaacgtcttggaaaatagtatggagggcttgtaccgggcgaatcgtcacaacaatccatccccagcaatggcaacttcagtagttaaacctaccgatcatggtaaaacatatacgttccacctacgcaaaaacgccaagtggagtaacggtgatgcccttgttgcccaagactttgtcggcgcttggcggcggtcagtatcaccaaccgcaagatcaggatacaattacatattctccggcattaaaaatgcggatgccattacagccggaaaaaaatcaccaaaaacgttgggggttaaggcagtcaacaaacatacgcttcaggttcaactcgaccatccaatgccgtattttaataaaatgatggtgctgccagcattcttccctcagaatcaaaaggcagttcaaaagtttggtaaagcctatggaaccaagtctcaagatatggactataacggcgctttccaagtgactggttggaatgggacaaacgataattggacgttaaagcggaatcactattattacgatccctcggcaattaagcttcagcaaatcaagatgagtgttgtgaaggatccaaatactgctcacaacttgtttactcaagggaagttggacgatgccaccatatctggtgtgactgctaagggactgcaaaagaataaagatctggtccatgttcgaaaggccgggacgtattatgtccgtctaaatttgaaaaatggtcggccgttaaataatcaaaagatgcgtcaagcgttaagtttagtcgttgatcgccagaaactaaccaaagatgttttgtcagatggttccaagccagcttatacctacacatcaaaagatttgaccaaagatccgacaactggtaaagactttgcgaccgagacaacccctaagctgaaatataatgttgctaaggccaaacaactttggcagcaaggaatgaaggaagctcatttaagcggcaccgtaaaattgcagcttaacggtgatgatcaaacagtgactaagaatgtcgcccaattactgcagtccgaagtacagcaatccttaccaaaggtgaaagtagcaattaattcacttcctgccaaagggtttcaggatcgtgaagcagccggtaagttcgatatggagcagacgttgtggttggctgactttgctgatccaatcagctttatggggattctcgaaagtaccaatccccaagactatggcaaatataaagatgcccagtttgacaacttgttcaaacaagctggcggtgccaatgcaaataatccgaaaaagtactgggcagatttacgagcagcccaagagcgcttaaatcagaccatgcctgtattgccactctatcaaatggttgaaagtcatttggtcaatccgcatttgaaaggtgttttacatcatccagttggcgaagatgattatacacgggcttatttaacaaagtagtgtgataacttttattaaattttgcgaaaaaaagaaccttgttaatcaatactttagcgagcaattgattaacaaggttcttttattgtggtttaaaacaaaggtgattatttttgatcagccgacgtcagttgaagattttgccagaactgaggggtcatatagttattataggcggcttgcttaaagttcttcacccgatgattaaccggggtgtagtttaagataaagctttgaggcgtataagcagcttcgtcattcatatagcgttgccatttcttgaactgctgaactcggtacttctgattccaagctttgttattatttaagctatttagcaattgggtatttttcttggaaacaaagtgacccatattataggaagcatctttactataaaattgagttggggttggttcactcgtcaatgaccagccaccactgaagacgtcaatcttgttctgctttggttgtgataagacagaatagaaactattcatttccattggtcgaccattggtaaacttgacgtttagtcccaattttcgccactgctgaacctgatattgatcaattgattcagcggctgtggatgcctgcatgacgccatacgaaatggtgagttttttgccattaggttgcacgtaccattttccttttttcttatacccggcgctctgtaacagctgcttagcttttttcatgttataaggaaagccgggattcttcgtgtcggcgtaggctttgaaaattggtggaattagcgtgttagcccgccactggacaccattgagcatcttttgattgactttatcaagatccaacgcgtacatcatggccttccgtaagtttttgttgcccatcttactgtgtttgtacatgacattttgattggtcttggtgtcaaagtaaccgagattaaagccaaagtacccgtagcttagacttggtgcaccaaccagtgaatagccactaacctttttaacagatttgtattgactggcaggcaggccgcctaaggcaaagtcatattttttggccttaaaggctgccgcagcattggtagttgaaacgacttgaatattaacgtgttttacttttggttgcttgccccaataatattgattagggatccagttggtcgattcaccatctacttgatgataaagtttgtagggaccgacaaagacgggatgtttacgaactgcaggcgaagaagataatttagaaattttaacgtttttgatgtgtgcatatggaacgacggtgccccaaataaacgtatttcctgagtactgcatggcaggtgataaccgtttaaaatgcagcaccacttgtttaccattttgcccattaggataggtaatcccagaaattgttttcgctttacccgtgtgataagctgctaatcctttaagattagtagaatcagaagaatattgttgggcagaggtgtttttattggcaataatttcataagcatattccacgtctttggcagtgacctgatcgccatttgaccaacgggcgttctttcgaattgtgatcgtggccgttttggctgatcgatccaattttaaattggccaggccaccattgacgatcttaaagttcttattactcttaaacagcgcatcaccaccacctggtgaataaacgtcggaatcctcaacgttatcttgtaaaaccgctaacgtaattccctcaaatggtgcgtcagtcacctcggcggcatccacagtactgtcgttaccggacttggttgctttcccggtggcactgtaggttgtcggcattgaaattgactttggtgcagcggtatttttgctgctggagcaggctgccagagttagagcagaaatcccgatggcacataacgctgaccacttcttcacttttaacataaatgatccctccaagtaaatctgatccccaactaagattagtttaggatgagattatgattagcaaatctcccataaattgtttctagtttagtcttagacgggataatttgcaatgattgaatggatatttatgcattaatgggtaaataaaaaaggaagcaaggtgaaaaatggtttccctgacttcccttaatcaattgcaactagctcaaaattcatttttatcgccgctgtcattagtgttcgatatctttgagtttggcatccgtttgttgcttaaattcttgttcaagtggggattgatcctccttggtatcgtaaacgggccaagctcccagcagttggattgtatccaacttgattttatcctttacgacaatgtcggtttgaatcatatgttcaagcttccttacaagaacgcctaattgttttaacccttcaaactcatcgagtgtatccattaacaggtcatcaaattttgaaccatattgtttggcaaattgatctttcactttattaagctttcgtcggtaatcacgaatcagctgaaattcaccgtccatattttctgagtaatatggacttttgacgagaaatcgaatctgaaagaaaggtagcttatcgactatcccggcaggaagtccatgatttgtgacatctggatcgtctgagttgtaaatattgaagcgatccaagattagtttaactggcattttatcacctcattaattaattttaaatatctaaccagtaaatgcccatctatggttattttaactgacatgttatgcgattacaaaggttggtccaaagattttgaaaagttgaaatggaagataaatttttgaattcgatttaaaaggatctaaaaaggttgaatatccatcttagatttgttgttgggtattcaagggatttagtggtagtctaattctaaaataaactttgaagggatgatttaaatgctcgattatcagcagcaattaacttggtcaaatgggtttggccagcagcaatcgccaattaacattgaaacgccccaggcagcccaacaggatcaaccattatcgtttacaactgacagtgattatcagctcaccaaggagttggatgatcaaacaacgatcaaattactgggaacaggacaagcaactatttttaagcggtcgtttgactttcagcaggttcattttcatgcaggggcggaacatttagtggatggtaatcagaagccctttgagattcatttagtgcatcaaaatgcgattggtcagttggttgtggtcgctttattggtctcattgggtgatcaggatgctgcctttcaacagattatcgaccggtttcagcagggagcgtcaataccggtaaaaatcgaaattgatcagtggctgcccaaattagcggaaggctatcattaccttggttcactaacaacgccaccattgaccgaaggggttgaatggttggtgattactaatcccaatgtcacaattagtcaggatcagttaaagcagtttcaacaattgtttaagccaaataatcgagtgactcagccggtaaatgggcggttagttgaaaaatatttgttgtaagctgtttttcctcttgacacgaatagaatttggccgtaagattttgacaattaaaaagttattagatgttgatgagaagagaactgacgatgggctacccaaagagaacgctgcttgctgagatggcgtggtagacagttggtgagaatgagctcggagtcgtgtcgtcgctggataatcagttgatggccggtttggaaaccgatattttcccgaatacatgtgatatgtatttgaggtagctgattttcgctataaaaatgggtggtaccacggcaaagctcgtccctggacaaagttaatttgttcagggatttttttgtggattcggaggcgatcaatttgagtacagtccaaatgaaaaatctgttacatcactatggattaagtgaccggtattttaagttgtcagaaacgggtgcaacggttgaagaggcagcagaaacaattcatgtgtcaccagacgcgattgcaaaatcactggttttaactgttaaccaacaaccgattgtcgttgtgttgagtgggacggcaagattaggcaatcatcaatttaaagaggaatttgaagtccgaccgagattacttgcgccggataaggtgaaggaagtaacgggctttccggttggtggtgtgaatccaatcggactggataatgcgttaccggtatatttagataattcattgcgggatatcccgtggctctacccggcggcaggagatccgtttcacgccctaaagctaagtttggatgagctgattgagctgagtaggccggtgaggtgggtaaaagtaagcagagtggtctagcaagcgtttagattccggccatataagctcttaaatcccctattcctgatttgggaataggggatttaagggcttatatggccggaatctgcttgctagaccacgttttggccaggtagcctaaaagacaatcccaaattggggctgtctgggttatttgcttacatggccgggagctgcttgctagaccacattttaacttggtagccaacattcctgattttgaaatatggggttatatagccgcaatttatttttctcaacctgcaaactaaagataacttgtagttaaaattaaaaaataatgcccgacatcaatgaattcaactctagtcgtcaaaaattttccgataataatccttcatatcctgatcggcaagtacctgtttactggctttgtcataggataatccctcgcgagcattctgccatggcatttcagatttactgagtgattctaattggtgatctcgtttgtcgccgtaagttgcccagacttgttccagcaggccttcaatttgtggtttgaaggttggccggtcaccttgtggattaattggattccagccgacatttttatatttgtgataaagcttgggtgatgcgggaccatctttccaagcctcaaatttagtatcgttaaaaatgggtttgtctaaaacaaccaagctccaagcgtaagcgtaataacacattctttgaagttttttggcggtcatgggttccttggcgagaaaccaatttgcaacgtctaaaatactgataaatgacataagccacatcctgacatattaaaaattagtgttacgttatcttgtatgaccattgtacttcaagttgaaacgctatgggatgataaaaacgcaaaacaaacgaccctcaaagttagattgttggctaacttcgggagtcgtttatctttgtggcgattaattaatcacccgactagttccggttcggtaattcaacttcacgccgggttgatcatttcgaatgtagacattgaaatggatccggttgctgccgattgatttgccttgcatgcggacaccactggctaataagttatgggctttgaaaaccggtttgacctgataacgcagatagtgttttcgactgctgcgtaaataataggcaatagtgttttcgtagcgctccatgccaggtgtattcagcgaacgggtcccagtaattaagtttcgtaaattattgttttggccggtcaactgatacccaattagatgacagcggttaaacaaccaagtgccatgggccttcttattatgccagccggttgggtcaacataaagcggttcccgttgcctggttggcattaaccgtttattgagtaacgcattagctgtggttgcccggtttagaaagtcgagctgaccatatctttgccaagcaccgtgttttcgagtcaatgttgctttggaaaatttaggccggttgtggttgacgataattacctgcttaccaacattgtatcgttgattatgaatgcggctggttttcctacgaacggtattggcacgttttcgggttgtttttcgaacggttcggcggttagctgatctgtaatcggttttggctaacgttaacccacgccgtttagcagttgataatttaacgcgatagacctttttggcgttatttaaaccacgattatgccgatgataaaaataatgtttgccggtcttcgttacataaacgtaggtcgccgcgctcggcgtttcaattggtgctgagtagctgattccgccaatcattaaaatggttagcagaaatgtataaataaatttcttgatgttatttcaccctcaaaataatgatgactgcaaaattaaaagaaagatgatgtcagtcttatttttcccaatggcataagcggtaatgatgcgctctagcccagtggacagttacatggcggagacggccagcatttgatagtcctcggcaatttctactatagtggtaacgcttgccgtggttgggtgcaatccagacatacccggttcgggcagatgcggattgtggtggcaatgttgcgtatgcgccgcccatagtaaaggtagcgacaaggaccaacgatgctttctttaacttgttcatgatgaaattccccctaaaataagtgtttgaatctcccttggctggttacaaatgaaaattggcgattcgatagtgttgtgataatgatcacaattaaattttagcacttattttcgttaaaaaacatagtgaaatacgtattatgacactgattaatgccactcattagttaattaaataggcctttttaattaacttttgtaatggaagcgttataattatggtgttccgtgagtatgaatatattaggggaggggtttatatgaagtttgatcttaagaagtcattgtttctttcaatggctgctttaggatttgtcgctgttgctggtacatatactgcaacaaatgccagcgcaaagacttacgcaaaagtaacatcaaaccgtaagatgtcgacagatccgacaactagaaatattacctttaatggtagtaatgcgctttataccaaagccggcacacttcgaggagctagaatagttgctcgtaagggaactttgagtgctttagctaattcgaaatcatcatctgacaatttccgtgtctatcggatagcgacgacaaacagaaaatctgtttactacaagattgtttcgtttgaccgtcaatatcgcggctggatttacggtggtaaaactcaaggcgcatttaatggtggtattcagcagttcaccacgttccagagtggtaatttaactgatgcccaaaagaactcaacttataagtttgcgaataccggggttgccaatgatggcaagacggtaacatacgttcaaccagcttggacgcaatataaagttggtcgggcaatcattgattcatcaccttatgccaacgcaacctttaagattgatcaagttggtacccgaactcgtgagggtgatcaatgggttcacattgtcgcaactgataatagcaactcgcaagcaaatggctggattctcttcagtggattaacacaagctcaaacaccaattgctgattatgcaatccgaattaatttagtcgatccaagcaataataacgcggttgttaagtcatttgattggcagaagtccggtgctactaagggaacgccacttggcaaccaaaacaataacaattggtcaattaattcaaatgatcaacgttcaattcaatcatcaattcgaaacgcgctaaatggaaccggctttaacttggatacattaaccagcagccagttaactgctttagcccaaactaagttcggggattcaattaatttgaatgttaataaggcaaccaatattgctgacaacgctgttcgaatcaatattatggatggtaatggcaacgttgtgaaatcacttgattggaaccgaaatggtgcaaccaaaggaaacaatgtcggttctcaaattaatggtaactggacattgaacaataatgatcagcaatccattcaaaatcaaattaacagcactttgagtaattcaggctattacttgaacttgtcgaatgatcaagccgcccaaattgctcaggcaacctttggcggatccgtatacttgtatgctaacagtaatgtgattgccagccaggcccttcgaatcaatttgtatagtcaaagcggtcgttatattggctacactgactttacccgttccggagcaactaatggtaccaacgttggtaactacagcaatggaacatggaacatttcggatgccgatgccaataccattttgaatcaaattaacagtgttttgagcgcaaatggttatcaaactgttggtaatacgttgacagctgctcaacgggctcaaattgcgcaaggtgtctttgggagtagtattagtttgactggttataatagccagacacagagtaattacacaactgttaactgaaacttgaaagtatgaagacagactgatcccttggtatcacagggcatattttaattaatttaaccatttagcttgctgttaacagcgaaactaaccgtttcggcaaaaatgtgaagaactgattcatcatctgaatatttggcgctagtcttggcagaaacttcatgataataatcgtttttacacgaatttagaagaccattaccattgttgagacaaactcaaatctggcatggcttagttcattataaagaataaaaatttccccaatggtgcgctcatcatgattttgccgtttcctgccaagctaattaggttcataagtcataatgacaatttgactaaatggccacaaagaccgttcataatttttgaacttggtgatttgtcggagcccgcaagtattgacttggccccccatcacattaaagaattatcaagttgccatcttcgggcgttagtttgaactgatctcttgtggcggaaggcctaacggagtcgttgcagtactaggagtcatcgtgacgggcacgattagccacaaataccaagcgaagctggaattttggttccgacgtggactcgaccaagcagctgtaccacttgattagagctgcttgggttgatattttgaaggactgccaggacgctttggcataaatgctctaactgaattggccgtccgcgaatatgaagtaaatttgctggaccgtgtaaagcatgcccacgccgttaaatcccaactggttaattcatagaaacattttggtgagctataccagctattcaataacaccatagtcagcctagaacgccatttgcgagggttgcttacaagttgcattgaaccgagggtcattttgtgcctgtgccttggcgcgagtctccggcagaattgttcgttgatctgttgttttagatgattttccaagggacgtttgtggcttcttggaaggacattaatgcaaagttgatcggtacgaagtaattttggccgttcactcaacccaaagtttaaagcccggtatccctttaatatatacactgtttgtcatggtcaaagactcgcgctagtaattcggtttgggttggcgtactcacgaaagcatggtatcacacaatgatcactgctacccgccgccggcggtcaataaacggttcggaaatgcttgattaaaatgactcccaactgaccttgacaatcaagcgttccaattgatccggccatcgttcaaattatttctgacggtgcgactggtaaagttaggtgtttcatgggctcgataaagcgacgtcccaggaactttgtcgtgagcaccattcaatgaccttcatcaagctgatttctgaatgccggcgataattcaccaacttggtgagtttagatagaccaatgagggagtaaattgatgacacatattgtgaagctcgttttctgtatttttttcttataatatgtcatgacgtaagtctcctttgtatcttggttttggtcgactaaagtatacaacgcaggagagcttgcgtttatttttttgccaaaaaagccaataaccacacgcctttggcgtgattattagctttcaagtttcagaaactgtataaaacggcacttccatttgctgttattgcagcacttgccagtttcttatttgaacgaaaacgggactaccttaaatgatcatcattgattggtgatcatcgcatccaggaataaaaaagcgagacgataacaggtgaggaaatcccccatctatcaccgtctcgccttttccatttttccttcgccccacagaatatcacaaataaatggtctgattagatcgtttaaacatttaccttgctaaccgtatgcggtgccaaatgtttcacttctgtcggtagaccaacctctcgatcttcactgattcccaatgtactcagttcagctcgactgcccgcttggttcaagttaactttaacatctcctaataacgcaccccttgtggctgccatgactgaccaattattggatgctttggctgataattcttgattggcaaccattgtcatatcaacctgctggcgacttctgacaatcgtcgtcgcatttaactgactactcgtgccgaccgtaccatcaataatgacactgacacagttcgccattccactcacttcaatatcttgatttaaactgagcctactattgcttcccatcaccgtcaccactgttaaagcttccgggtggctgctatccgcatcaatagttaagttcaacttgtgatgcaaccggacattatcaggaacaagcactgcaatgcaattaattgcctgttgatagtgagccaataaagccgaacgccaattactttgttccatttgagaggccaacaacttgagaattgtcttatctgacaaatgaccggagaatgactgaatccggccaccaacagacgctaattcctgcatggcggctggattaacattccaattccaggaagtctcaccaagctgatgccaatcaaatagggatgtggcaactttaacaccgacatattttggtaaccttgctattcgctcctttgataatgatgttgctgaagccatttcgcccaccgctttctacttatttattcgatttcactaccctttagtttatctcataaaagaataaaagaaagccttgaaatacaatatatatgtgttatgtaaatttatggcacaatatattgtgggtgcaacagaaagtcgctttttccaaatcatgaattatcagttcgattctattcaaataaacgaagaaaattctgcacatatcaaaacaggcttctcggcttttatcttcaaatataaaagtggttatttctttattcagagtaatgaatggcataaaataacgacaagaagggagtgacttatgatgatttcaactaaacgctcgaaccaatcgctgaacattctttatggcattgctgctgtttttgctattattctcggaatccgactgatcttgtttaccttcatttccatctttggtttcttattaatgtccattccagccattcactcgttcatgatgcaacaactaaccgacgctggtatgacagacgcttccctgtgggagattatcttcttttggttaatattactgatcaccctggcagcccggtttggagttgcccttgggttgtttcgattgacggatgattttcgtaaacagcccactctggatgccgtcaatatgaataacttcaaattaatcctgatcgctgacggtggttatatcgtggccgcttatatcggatcatttgcgagtcagattttcaatcttaccggaattagtttatttggtgggggaacactgaccaatattttgatttggctggttttgtataccgtttatctcattttgaagaaaagatctaattcggttggcgacaattcataatccacttcaaatttaataatcgtttctgaatataaaagcagagtggaccagcaagcggttagactttagccatataagccccctaacttgttcccgattttggaatgttaagttagggggcttatatggccggaagttgcctcttatctcgcattttcgctcggtaatatttgtgattacaaaaaggaaagggggactggacaaaatcatttttgtccagttcccctttccttttttgttctgggtaatatcgtatttaactaaacactgcgacgcttaaagacaacgtaactaattgccaagaagatcgccgtgtaagccaaacttccccatgccaattcgggtgtcgacagcatcgtcacctttgaaatcgagggcgtgttcatttgacctggcaaattcatcatattcaatggattccattttagccaattccatttttgaatggctaacgtcatgagaccagcaaccacgccaagagcgaaataaccaataatcccgaccgaaatcgcagctgccgaactcttgaaaatattagcaagtagcaaaaccaagcttagaatcagccacaagccaacaaaatcaccaattaggccataagaaaacgctgtaaagacagtatgttcagccccgtatttctgatttaaatcaaacgtattattaaacaaaacaaatttcaaaatcagtgaataaacaaacactaagacaaaaaagtaaatcgaataaatcagcatcgtcaaccatttgctaactaaaatttggccacgataatattttcgataaagcacttctttaatcgtcccatactgaaattccatggcaataattgagctacatgcggcaatcataaacaaaacagcccaagaatcacctgtaaatgaccctaagaataatgtccgtggatcataaaactttggataagatttagcaattacaccaaaagcggtcataatgaccaacagaataattgtaattgccggcgtacttcgtttatgcagtaatttaaagctctcttctttaattaaagttatcatttcagcctacgactcctttactttatcgttttgcaacagtttcaataatgaagtttccaagtcactgtgaacatgctgaacatcatcgatatcaatgtcactagctgataatagtttgataatatcaggcatcttcgtatcttctttttccaccactgcaacttgatcagattgactaagttcgtaaccattttgcgttaaaatatctttagcctttgaatcgttggatgtctttaaaatcaataacttggcgctgccgttttccaaagctgccatactttcttgataaacaatctggcccttatcaatcacgactaaatcatcaaccaacttttccagttcactcaaaatatgacttgaaattaagaatgtcgttccttgtttggccaaatcaagaataattgtccgcaagtccttgttggcttgtggatctaatccgttcattggttcatcaaggataactaagtccggccgattaaccaatgccaacgcaatccccagcttttgtttcattcccagcgaataggtctttgcctttcgattaatgtaaccgcccattttcatcttatcaacaatatccatgatctgagctttaggcgtcccgtcttttgaaaacaacttcaagtgttgatagccggttaaaaacggataaatccctggatattcaattaatgccccgactttatccattgctttgtggctagttggtgaaacagcttcaccatcaatgctgatatgaccacttgaataattgaataagcccaaaatagctttcatgattgttgatttaccggcaccgttaggacctactaatccaacaatgtgtccgcgttgaactgtaaatgaaacatcttgtaatacttttttagagccaaaactcttattaagatgctcaacttgcaaaattgtatctgtatctgccatgttttcctccttatggacgatggtaaggttacaatacttatatacgcaaaaagtcatcacttgccattattttatttagctaagttaaccataactaatatgtacaagttgcactgataataacatactaaaccgcttccagacaatagcgacatggcatttcttactggaattgcgctttgagacatcgtttatcctgacctcaaaaatcagaaactttctatattattcataacatttatgcgaactcagagttaagatttgcttaatttcgtcaatagggttattatctcccacggacaatgttagacctacgaattcaaagtgaggtaatgcaatatatgacgaaagcattaattgtcgtcacaaatcatcccaaatttggtgaaatggaccgagccaccggcttatggtttcacgaggcagcccacttcgataatgtgatgaaagaaaatgaaatcgatgttgactatgtcagcccaaatggcggttacgtccccatagatcctttaagtttagcaccagatgatatggattctattgattggaacttctatctggacgataagaccagaaacgtccacttggcaaattcgctgaagccagctgatgtcaatccggacgactatcaagtcatctactacgcaggtggtcacggtgcaatgtatgattttcctgaaaataaggacttggcaaagattgcgtcatcaatctacgaaaggggcggcgttttatctgcaaattgtgtgggcgtttcaggattgctggcaatgcgaacaactgacggcaaacgattcgtccatggcaaaaaactaaccagctttacaaatgacgaagaggcactaaacggcttaactaatgatgtcgcgtttctaccagaggatgagttaaaaaaatcgggagcggatttttcaaagagtgatccgttccaacccaatgtggtaacggacggcaaactaattacgggccaaaacccaaattcggcaacgggtgtgggcgaagcggtgattaaggcgttgctgaagtaggatagtgcaaaaagccgcgggtagcttccagaatataagctcctcaaactaatattcccgtttttgggggatattagtttgaggagcttatatggccggaagttgcggctcttttgcacgtttagtctcggtaacccaaaacattaaccacagaggacatctgggactatgtagcttatatggccgagggttgtggctcttttgctcattttggctgggtagcccaaaacattaaccatattgggatatctggccggaagttgcggctcttttacacgtttaatctctgtaacccaaaacattaaccacagaggatatctgggactaagtaccttatatggccaaacgttactgacactttttgtacatttaccctcaacacggatttccgatcatcaaggaaaacgtccaggatttgctataataaccacaggaggcctatcatgcaaatctggagtgatttcacgctttatttattaattttagtgattcttctcggcggtatcacatggttacttttatcaaagtgggttcacgtaaccgagagtcagccattgaaaatcggtttggaagttttactaacgcttatcggattggcttcgaatggattgggcgttatttttctaatttctccctttcataactttggctatgcactaattattggcgtaattgggattcttgtaggcgtcctatttctgtttgaggttttcatgtttttccaaaaaagaagctaataaaaaatgattgtcggcttacggataggcaaaaaggtcttgtgcccatttagcccgataataaacaaaagtggctggatcattattgatcgcagccactttctttataacttaaattagattaattaaaacattctttccaagtgaaggagacataaatgagtattgactaattaacaattcgtctaaccgttccgtttgtttcttttcgccagctgggtgcattaagcgaggtaatgccgacaccaccggtatctgattgaccatgatcatgcaagaataaatgatcgcctaaataaatagcaacgtgtgagttcacctgaccctttgcatttgtgaagaagaacaaatcgccgcgtttcatatgattaaaaccaaccggcttgcccattgtaaccagcgtaaaagtcgttacgctatccagatttccaagtgtgatgccagccttgccgtaacaatatctcacaaatgatgagcagtcaaagcgacgatgacggatatcggctgaatttcgaccgccgccatagtcgtatttagaatgaccaacaagttttagaccggcgttaatggctgtttcaattgatttgttatgtcctttgagtgcatttaaaccgcgaaatcgagtttgctgtgcgctaatccaataggtgtgaccatcttgcttgaacttgatataaccagcgcgctgattatgattcaaatcatctcttatctgacccgtaatgtggttctggagatgtttggtgccgactgttcccaagtattgagaccccttagttccggcagggtcagtgtatagtttggcttttgaggtcgaaatagttagtttatatgggaatcgatatgattggtaaatgtgatttggtgccacagtttgtttaacctcggtgacagaagttggtacctcgttgggactccaagtcgctttgacaaaaaccaatccaatcccgataagtgcagcgattcccagacctccaaaaataagtttacgatgtttcatcaagatatcccccgaatagtttttactggcttagttgtaacatgttgaacgggattgagagattacttcggatggatcttatttatttcttagaaaatagtaataggtatatataaagtcgtcctctggtttggatcaatttatgatggcttttatagaattatttaattttcggatttatagttgaactacaatgcaaaaacggtgtcaccgacaaataatttgtcagcgacatcgtttttaattagtagcttacctatgaacggctaagtttatttatttctagttccttgttcctcaatttcctcaagtgaacgaccctttgtttcgggaacggccttaagaatgaaccaaacacctaaaagacagataacgccaaagattgcaaatacagcatcctgtggcatatgtgcggtcataattgggaacaacagcccaacagcaaatgatccgatccagttagctgatgaagcggcaccggatgcacggcctcgaatagctaacgggaagacctcacctaccagtacccaagtcaatggtgcccaagtaaatgaataggcagcaacgtagatactaaggaaaatcacaatcatcattgggctggcatttggtatcaacatgttaataactgttggtaacaagaatgataatcccattaccgtaccacccataattaacaacgtccgacgattaaacttctcggcaatcgcaatgtaaaccagtgacccaatgactaagattgccccttgaataattggccacattaaagcagaacttgcagctttaccagttgccttttcaacaatcaatggaatgtagtagaagattgcgttggcaccttggaattgttggaaagcagcaaccccaattccggcaatggccaagtaacgatatttaccactaaaaactgtggcccatgatgttgctttggaaacatttttttcttcgttagcagttttcttgatttggtctaattcagtattaatttcattatcgttttgacgaatatagcttaaaacttttcgagcatcatcttcacgacctgatttaacaaggaaccgtggtgattcgggtagtttataaaccccaaagaataagataatggcagggacagcggcaagacccaacattaatcgccatgcccagttttccggtaaatctttaagtaagaaatcaatgatataagatagaagcatcccactcacaatcatcgtctgattcaatccggatagactgccacgcgctttagcgggcgccatctcagacatataggccggcactaacgcagaagcagccccaacagccagtccaagaaagacacgaacagcaattaagtaatattcaccttggttatttggagaaattcctgaaagtaaggagccaagggcaaaaataatggcagaaattaaaatcattttacgacgaccaagtttatccgataactggccggcaatcgctccaccaaaaatcgcacctaacataactgatgacgtaatccagccaacaatccccgcttggttttgaaggccccaatcaatttgcaaaaacggtagcgcacctgtcatcacaccaatatcataaccaaacaagattcctccgaatgaaccgaagaagtaaataaacttgcttgaaatcttcttttctgtaacagcagctttatccattctctctctccttataaaactcagtgtcatacgactgaagttattggcttcccattccatagggttgaaaggggttacataacaaatcgtataaatctacaaaactacaaattctgaacagtcagttaagaactctttaatagcagcgcttacaggactttttaaataaaataggttggaaaataacgaaccttgtaacgcttacagaaagttatattaacgtattcatccgtataaatcaactgtaaagatttgttatccgacaaataaattttattatcgaatataaagcctaatataccgcggattgatcgaccaacattattttactaatattagaataaattttagtattgtttagtgtttattaattaatatcattctttattgacttcacctccaaatctattttccaataagattatctattatcagtaatgataaagatagcaaataggtttggaaaaatcatgaaaattctgtgaaaaaatttaacggatgaacaagaatagctaactacaaaacagatcaccacctatccgctaaggttggcagctttgcaacacaaaacagagtgggccggtaagcggttagaccccagaatataagcctcctaacttgacattccaaaatcgggaatatcaagttaggaggcttatatggccggggtctgcttgctggccatgttttaactaagtaacaagttcagcgagatattctgatcttgaatatttggataattcggttacacggccggaagttgccttttgttcgtttttacctggtaataatcgtgattacacaaatagggactgggacaaaattacttttgtcccagtcccctttagtttaaaactgcttagctattgttactcagctttatgaatgcttccaagaatatcatctttcgaaaaatcatgggccatataggctttgttattgactggtaaatgttgttcaagcgtatcaaatagctggtaggtgacttcacccttgactaaatgaaagcccaagacatgaccaccgaaagaatggtcgtctgataagaagtgttcatgaaaaccggcaacagccgcaccatcgaacagttgtggcgagtagtagcctaatagtgtgccgtcaatttgatcgcgagtaaaaatgctttgattctccgcagttttagccaatgtatcgtaaggcggcgtcgacttttcgactgcccgtgttttgatattagcgaacgtccccttcacttcaacagaaaagaaggtattggccgctcgacttaacgagagcatttgcttatccaattcatcctgatcaacattttctaattcggcaagtggcgcatatcttgcaaaatgactattagcaaatggcagcgtaaacgactttgggacaacattcaccttgccgctatgatcgacttgatacggcttaccatccaaaataataagctcaccgtcgaggccatcaccggttccaattcccgtatcaccgtgcttcagtaaatcggccatcgtaatcgtcccggttaacaagcctggtactagtaaggccagcgtgccatgttgatataaagttgtgtgttttgccatcgtaagacttccttatagtttagtttaaaatatctttcaataaagctgactttaacttaatgttatcactataatcgactggaatgtcaacaattaccggaccctttgtcttaaatgcttgatccaaggttgtaccaagatcatccggactggttacccgcaagccacgagcaccaaaactttcggcgtatttaacgtagtcaaccggaccaaattgaacaccggctggtttcccgtacttggcaatttcttgaaatttaaccatgtcgtagtaaccgtcgttccagatcagctgcacaatatttagattaagacgcactgcggtttccaattcctgacccgaaaacaggaaacccccatcaccggaaacggaaacgacaggcttgccgggccgaaccaatgctgctgcaatcgcccatggtaaagaaacacctaaggtttgcattccgttgctgaatagcaaatgacgtggttcataaatccggaaatgccttgccatccaaatataatgactaccaacatcaaccgtaacagtcgtatcatcgtcaacccgttcctgaagtgcccggacgattgccaatggatgaactgttcccggtttgacatcggttggtactttgttttcggagtcaaattcctgtcgtaaattatccaacgttttggaagtatctgctgataatttgaattcgccaggtaagcgatcagccaaagcatccaggctacccgcaatatctgcaaccacaatcacatccggttgataatctttactaatttcgggtgcaacatcgtcaatattaaccactttaccagttcgatcaacattccaattacgggcttcatactcaaccggatcgtaaccaatcgaaacaactaaatcgcttcgtttgagaagtgtatcaccaatttggtttctaaagaggcccacccggccaaagaaatcatcttcaagctcatgagagataatccccgcaccctgataagtttcaacaaccggtaacggaaacttcttaagtaaactgcgaattgcagccgtgttttccggcgttgaagcccgcatgccggccaagataaccggtaacttcgcgtgtttcaacaactcgataatttgatcaagagttgcatctgcagcccgaccattttcatgtttcgtcaacggctttacctcaggtcgatttaccttatcgctcaatacatcagctggtaatgagataaaggcagcccctgctttgggtgaaatggctgattgataagcgttggcaaatgcttctgataaattatttgcatcctgaacttcaacactgctcttagttgcgttagccattagttccttactaggaatactttgatgagttaatcgtgcaagatcgtcacgaggtacttgaccccccaaagcgactacgggatcagcctcagtggtagccgtaattaaacccgttacaaggttggaaacacctggtcccgatgtggtggcaaccactcccggtttaccagtcaatcgcccaattcccgccgcaataaaggcggcattttgttcatgacgcgccacaattagcttgggtgttctgggatcatcactatatgttaaatcctcaaataattggtcaaccttagcacccggaataccaaaaacatatttaacaccctggttaatcatcgtttgaattaaagcttgggatccacgtttttcattactcatatcaagcacctcatcttttctatgttgacaattcaacttaatctttaccaaaataatagacacgttatgttgaattgtcaacaaaaaaacagtagactttatcaagtaagtaataaataattttcaacaaatgcagcggtggtatcgcaatgaaagcgctaaccattctgatatattattctagaattgtttaaattaactgaagtttcgacagattctcactttgaaagaaatttacacagcttacaaagtgtcaataatgatcgattttattcccttatttttaaacactaatttgaaaggatttttacattgaaagatatcggttacctggcacaagatatttcgattttacatcgtcaatactacaaagatactgggaaacaattcaaaaaacatcatctaaatccaactgctgcctgtattttgttaactgtccgcgatcatccagacattaaccaaaatcaggttgctaaatcgctggttattgataagggtctggcaacccgcgaaataaaaaagatggagcaattagactaccttaccaagacttccggcaccggtaaggcaattaatttaaatttaaccggtaccggtaagaaaattgttcccattatcaatgatattcgtaaagaatggtggcaatcccgtttttccgaaactggtatttcaccagacagtcctttagttgcagccatcgaaaaagtagtcaaagtcattactagtgacgacaaggagtgattttgtgaactatccgacccttttattcgatgttgacgataccctgcttaactttcaggcatcagaacatcaggccattcaaaaactgtttaaccaaatcaatcgaccactaacttccaaagcctatcaaaactatcatcaaatgaatgaagggctttggcgccgtttagagcgtggcgagatttcacgagagacattactgaatacccgattccaaatattcttcagccaatacggtttggatgttgatggcgtggcctatgagaaacaatatcgccaatttttatcggcaggtcatgatccaatcccaaacgctgtccaattgctaaacgatttgagtcatcaccatcaactctatattgtaaccaacggaatcgcagcgactcaaaaacgccgacttcgtgaatctggaatggcaaaatatatcacaaaaatgtttgtctcagaaacagttggccaccctaaacccgaacctcaattctttgactacgtagctgaaagtattgatcattttgataagcagcaatcattagttgtcggtgattcattaacctcagacattcttggtgccgccaattatggccttgattcagtgtggttcaatccagctcatcagcaaaattcgacttcaacaaaacctacttatgaaattgctgaattaatggaattagaaaatatcgtctaatcattattattatttccatgaaagtaaaaagtcttcttatcccagtatcaggatagggagacttcttttaatctttattattaattaccataaccctgtcgttggccccaccatatacagaccaaacgccataaccactaagcaaagacttgtcaccaagtacttataaaatccatgcatttgatacttcttcggcagcgccttcgcttccagcatcagcagcaatcccaacacaatcggcaacaataacgcattcattacttcaacagccactgccattgcaactaattgaacatttgccaatacaaggacagcaccaacaatatgtgctaaacagtaaatgatgtaaaagcccatgtttttcctatcgaacggttcatttaaactatgtttccagtttaaaacttcggtaattccccatgttccggctaatgcaaccactaatgctgccactaacgaaccacctaacaggctgacaccaactaataatttagaattgaaaacacccataaatgggctcaaagcagatgccaaatcaccgaccgtgttaagcggtgcgtgattgccgtggctgccaactgtcgctgcaaaaacgaccacaaagaggatcataatgccttgggtcataaacgtaccaactaacgtatcatgtttctcttttttaattgaatcagtcgttaactgtttatcaactacggcactctgttggtaaaaaatcatccacggcataacgaccgctccaacatttgccgcaaccaaatatatgtatgaagaatgttgccacggaaccgtgaatagaccttggatcatgtcagaggtgttgggatggattaagaaaactgctccaataaaagccagttcagccaagccaataataacgccggcccgttctgtccgccgataactgccgctaaaagcaatcccaatcagtaaaaccgttgcaattggaatcgtaatccatttagaaatgccaaacaattcaccaacgccggcgaccccgacaaactcagtcaataacgcgccaattgatgaaacggctaacgttccggccgataaccaagcccaacctttaccaaaattctcccggataagctcaccatgacctttaccagtcacaattcccaggcgaacagtcatttcttgagccatatataaaatagggatcagcagaacttggggtaataccattgcgtaaccccactgagcaccagactgtgccgctgtaattaaacaacccgcatcagtatcagccagcatcacaattaacccaggtccccagatttttaaccaatggcccactttttcagcaatgtttgaattagtagctgccggatccatcaaaagctctttttctttcatacgccaagctccaatctcgcttctcgggacattttatcaatcgaccatgctggttcccacaccaaattaattttaactttgtcaacctgatcaaatcccattaattcttcattgatcgcttcatatagataatcggtcagtgggcatcccgcgattgttaatgtcatcgtcactgtacataatccttgatcgtctagttcaacgttataaatcaatcccaaattaacaatatcgaccgccaattctggatcgaccacattttccaatgccatcatggcttgttctttgaaggcgcgttgttcagccattttgatcatttcctttctcttagcgtgactgatagttatacaatttatgaaacagtttctgctcaatcaaaaactgtgaaggacggcagatcccggccatataaacaccctaggcccaatattttaacccggaatttttttttatccctgctacctagctgaaacgtgtgaaagaaggcagatcccggccatataaggcagttaagcctactattcagaaccggaatttatcactgctatctagccgaaacgtgtgccaacaagcagatcccggccatataagcaccctaaacccaatattcaaacccggaatattgggtttagggtgcttatattctgggatctaaccgcttgttggcgcactctgtctactatccaatgctcccctccatctcaaagctaatcaaccggttcaattccaccgcatactccattggcaactcctttgtaaaaggttccacaaagctcataataatcatttccgttgccttggcctccgggattcccctgctcattagataatagagttgctcctcagaaatttttgaaacctttgcctcatgctccatcgaaacgttattattcaaaatttcattatacggaattgtatcgctggacgattggtcatccataataatcgtgtcacattccacatgcgcaaatgaaccatccgaatgacgaccgaatttaatcttgccacggtaatccaccgccccaccgtccttggcaattgattttgaaataacagacgaagacgtatttggcgcgttatgaatcatttgagcacccgtatccgaatcaatattctttccggccaccgcgatcgacagcatcgttccccgggcgccctcaccgttcaaataaacagaggggtatttcatcgtaattttagaccccaaattaccatcgacccactccataatggcgccttccaaagcctgagcccgtttggtttccaagctgtaaacattgttggaccaattttgaatggtggtataccgacaatacgcgtgaggcaatacatttacctcaacgaccgccgcgtgcaaactatcactcttgtaagttggcgcggtacatccctcaacgtactccacatgagccccttcatcgacaataattaaagtacgttcaaattggccagacttttcagcatttagccggaaataggcctgaattggcgtggtaaccgtgaccccctttggaacataaataaaagtcccaccagaccaaaccgctgaatttagcgcggcatatttattattagtcggcttaactaatttaccaaaccactttttaaataatttaggatacttctgcagcgccgtatccgtatccgtaaagataattcccagcttttcgaactggtccatcatattgtgataaaccacttccgattcatactgggcagaagaaccggctaaatactttctttcggcttctgggacccctaatcgatcaaaagtggtcttaattttctctggaacatcatcccagtcccgatactttttatcggttgccttttggtaataggtcatattatccagatccaatttggttaggtcagggccaaaatccggttcggtcatctttaaataagtccgataagctgctagtcggtaatccagcatccatttaggttcatgcttttcggcagaaatttcacgaacaatcgcctctgttaagcctttaccggtcgaataaaccggcttgacatcatcatgaaaaccatattcataatcagtatccttaacaatttctgaaacatcagtcatgattgccaactcctttctgggcaagtagattatccaacgcgtgccaagccagtgccgcacatttgattcgggtcgggaattcggcaacggaaccaaccaagacggcatccccaagctgctcttcgaattgctcactaattggttgtcccgtaattaaatgcgagaatgccagaattaattgtcgggcctgatcaaccggctggtgaattaaaactgtcgtcatcaaactcgccgaagcttgtgaaatcgtgcagccggttccggaaaatgccacgtcggcaatttggttatctcggatcaacacacttacgttgatcacatcaccacaagtcggattccttaatgtcagtgttccggacgcgttggttaaatcgccgtggtgccggggattctgggcatggtccaaaataacctcccgatataactgatttaatttagctaatcccatcggcgaaaaactcctttactgcttgaataccactaaccaatcgatcggcatcttcaaacgtattgtaaaaataaaagcttgctcgggcagtcgcgttaacatttagataggccattaacggctgtgcacaatgatggccggcccgaaccgcgatgccttccatgtccaacccggttgccaaatcatgtggatgcagcccatccagattaaacgcaatcacgccggtatgctgattgggatcgtgagggccataaaccgtcaagccttcaattttcaacagtcttggcaacgttgctgccactaattcatgttcataagcttggatgttagccatccccaattgatttaagtaatcaatcgcactacccagagcaatcgcaccgctaatattgggtgtcccagcctcaaacttccaaggtaattgcttccatgaggcagtttgatggtgaacaaaatcaatcatctcaccgccaaattgagccggtgccatggcatttaataactcttccttgccatatagaacgccaatcccggttggtgccagtagtttatgcccggaaaaagcataaaaatccacatcaagatcttggacatcgactttcatatgtggtgcagcctgagcgccgtcagcaatcatataggcaccgtgctgatgggccaatcgggctaactgcttaatgggatttaccaccccaaccacatttgcggcatgggcaattgacacaatttttgtcttatcagtaatttgcttgcgggcactatccatatccagctgaccgtccggcgttaaatcaatatatttcaagacagcgtgttgcttctgcgccacctgctgccaaggaacaatattactgtgatgttccaactgagaaatcacaatttcatcgccttcccggacaacctgattaccaaaactggcggcaatccaatttaaactttcagtcgttgatctcgtgtagataattgattttcgactagctgcgttaataaactcagccaccttatcgcgcgccgcctcgtagctttctgttgcgcgttctgccaacgtgtgcacaccacgatgaacatttgcattatcagtttcgtaatagtgcatgatcgcatttagaacttgcattggtttttgggttgtcgcggcgttatccagataaaccagcggttcatcatttacctgttggtctaaaatcgggaaatcatcccttgaattattcagtcccctgtccatttgcaagcttcctttcaatcatatcaactaactgatttcgaacctcagcgactggaatatcacgcaaaacaacgccgagaaagcctcgagcaaccaaccgctgcgccatttcctttgttaacccgcgactcatcaaataatataactggtcttggttaattcgaccaacactggcagcatggccggcaatcacgtcattttcgtcaatcagcaaaattgggttggcatcaccccgggctttgggggatagcatcaatacccgattctcctgttgtgccttcgcgccatgggcacccttgataatcttgccaatcccgttaaaaaccaatgctgattttccaagcaaaatcccacgttgcaggatattaccctcggaatgacgaccataattggtcacctgcgtgtcaatgccctgagtttgttgatccgttgaaatggccacagtctgcatttccgtatgggaaccgttaccaactaaattagaatcaaaatcggcaatcgtattaccatcgttcatcacgccgactgcccagtcaatgcgggcatcattcgctaaataaccacgccgattaatgtaagcgtgcgtttgttttgcgaacgaatccaacgctgaaaatttgacgtaactgccggcctcggcaacgatctctaccatagtatgagctggattggcaacctcaccaactgtctgggatcgctgaagaactttaaaccggctgtttgctccagcaacaattaacgtgtgattcacaaaattcgttgactgtcggctatcttgaacttgcagtaaattgattggttcagtaacttctacatttgccggaacgtaaagaaatgcaccgccattaaccaacgcggcgttaatggccgttagtcgattctcgtcaaactgaatggcttgcttgaaaaagtaattggctaccaggtcactatgctgacggatcgctgtccgcaaatcgcacaagatcacgcccttcgccatcaaatcctcatctagagcaatctttgcaaccacttggccaacactggcaaattgataacttgccagctgggactgcacactttcgggaactgtgacgttaaccactgattctgaagcaaaatccaacagtggccagtgatgataattaatcttggcaaaaattggcatcggaagcgttgcaattttctgccaggcttgttgacgaagatcgcttagccatcttggttcattagccagtttagcgttttccaatagggctggattcatcgtcaacgtcattgatttaaccatcttatcgacctccgttcccggtagtcacatcctcatcaaccaaatcaacatccaacccaagttcatcacgcagaccggcgtaccccttggcttcgagttccgttgccagcgtggcatccccagtcttaacaattcggccacccatcatgacatgaacctgatcggggtgaatgtagttaagcagccgctgatagtgggtaatcatcagaacgccaaaatccgggctctgcatttgattaacgcctttggccaccacttgtaacgcatcaatatccaaaccagaatcgatttcatccaaaatagcaaatttcggcttaatcatcatcaattgaagaatttcatttcgctttttttcaccgccagagaatccttcatttaagtagcgttcggccatgtcatccgacatattaaggacttcaaggttcttatccagctcttttaagaatgcccgaactgaaattggatcatccgccggtcgggttgcgtttaccgctgcccgcataaattccatgttggtaatgcctttgatttctgctggatactgcatggctaaaaacaacccggcccgagcccgagcgtcaacagtttttccaagcaggctgacaccgtccagcgtgatattgccttgggtgacctgataatggggatttcccataatggtttccgacaaggttgatttaccggttccattggggcccatgattgcgtgagtttccccggtattcatggttaaatttacccctttaagaatttccttgctcgttttggcctcttcatcagttacgctgacgtgtaggtccgttacttttaaagttgccataatgttcgttcctttcaaatggtgggtgtcatcaatcagtgatcactgaaaggcatcatgaacgctacccaatcacaaagaaataaatgatcgggatcaatctgattaccttgcagaccactctaaaaaattatttttactttaccccgattaacatcatgatgcaatggtcggctctaataatataagaatatttcttaaaaataagcacgatctcggttaaattcccgtgttcaaccaatttcagaaaaactgctgtaaactgccttggtagaacgttaactgggaaatagaccaaaaccgtttcttaattttccagtcggatatttattcatatttttttcaattattacaattagtaaaaatatttcccaacaccttctcttatccagaaaatgcactcaattttgattagcttctcctgcttttccctgaaaaaaatacaaaaaaacattgctttgtcacaaaatgagaatatcatgataaatatatttgccttttttaatctaaacttttgaaagtaggtgacctcatgagtcatttagcgcactcagaaaaattaatgtatgatcctaaatttgaacacgacgcttgtggaatgggctttatcactcaggttgacggccaaccaagccacgaacttgttgaaaaggccctgacgatgttacaacgaatgaaccatcgtggtggaactggtgctgagccggataccggtgatggtgcaggaattttaatggcaatgccggatgccttctttcgcaatgaactggctaaaaatgacatttcattacctaaagccggtgattacgcggtagctcaattattcctgccacatgaaccggataaaaaggcagcgatgttaaaagccgtcacagaacaaattgaagcagctggatttaccgtccttttttgccgatcggttccctttgtttacgaaagttgtggcccagccgctcaaaaatcaatgccgggctttgtccaagtcattttacagcggtctgttgacatgcaatccggtcaggattttgaagatcggttgtatgaactccgccgttctttagaaaaaacgttcgatcgacaagccatgtatatttgctcattatccagccgaacgctgatttacaagggtatgctacacgcttatcaggttgcccacttctatccggacttacatgatcccgaaatgaagagcgccatttgtttaatccattcccgattttcaaccaacacatttccaagctgggatcgggctcaaccgttcagatttctcgctcataacggcgaaattaatacgttaaagggtgctgaaaattggatgaccagtcatcaaatcgaaatttatgatgaagacgactccgactcggccaagctggaaaactgcatggaatatctgtaccgtcatggccgcagcatcccacaatcactaatgatgatgattcccgaggcatccggtaagggcaccgatatgcctgacaaccagcgggcctttgatgaatacaatacgtcatttatggcaccatgggacggcccggcagcactctgtttcaccgacgggatccaagttggcgcttttctggatcgaaacggcttgcggccttcccgttacacgttaaccaaaaataatcaattggtcgtcgcttcagaatcgggcgtggtcgacatcgctccccaagatattgttgataagggcattttggccccggcggaaatgctgctggttgataccagtaacggtcatatttataagtcagctgacttaaaacatcaatatgccaaagcccatccgtatcaacaatggctcgctgctaatcggctcactttagatcatttgccagatgtcaagccggaagaaaaagttgccggtgatcaattggaaaagctttggcggcgaaatggttatactcacgaagtcattgaaacagccttaatcccgatggctgaaaatggtggtgaaccagtcgtggcaatgggatttgattccccactagccgtcttaagtcataaatcagaatccctttttacttactttaaacagtcctttgctcaagttaccaacccgccaattgatcctttacgtgaaaagatcgtcattagcacgaccctattcctcggtcgggatgctgatgtcaccaaagatgttgctaaaaactgtcaaaaactaaagatcagcagtcccattcttgatgatcagcagtatgcaaaaataacaagtttggacttacccgctctcaaggttgtcaaactttcattagcctatgaattgacagaaacgccggatcgactcgctcacgttctcgaacggttatttaaacaagccgaaaatgcgatcgacgatggcgcaacaattttaattctatccgatcggccagtaaccaaaaatcagatgacaattcccgttcttttggcagttgccggccttaataactacttggttcgccaagaaaagggaaccgacgcctcaattgtggttgatactgccgaagcgtgtgaaattcaccattttgcctgcctggttggttatggcgcagctgccattcatccctatggtgcttttgcgacccttacagaacgcggctatggcaaacaacttgacagctattgcaaagcttccaccaaaggcattatcaaaattatgagccggatggggatttcgacagtcgccggttataagggtgcccaactgtttgaagccgttggtttggctgataacgtcattaaccagtatttcactggcacaccaagccgaatcgagggaattaacctcaatcaaattgaagccgaatacgaacaaaaatatcagtcggcctatggtaatcatgccattgatgaccttcaatccggtggtagtttccaatacaaagttgacggtgaacatcacctatataatccaaaatcaatttatcaattccaaaaggctgtccgtgttggcagctaccatgactatcaaaaatacgccgcccaaatgaatcaggaggcatctgaaaatccggttacccttcgctcaatgtgggacatcaaggcgacgggcaaacaaccggttcctttgagtgaagtcgagccggtcagtaccatcgtcaagcggtttaaagccggcgcgatgagctttggtgctctttcgcaagaagcccacgaaacgattgcgatcgcgatgaacaaacttggcgcccgcagcaacactggtgagggtggcgaggaccggcgacggtttaaagtcggggccgacggtttggatcgtaatagcaaaatcaaacaggtctcgacagcccgctttggcgtcaacacggaatacttgatgagcgccgaagaaattcaaattaaaatggcccaaggtgccaagcctggtgaaggcggtcagctgccagccgggaaggcttatccgtgggttgccagtatccgaggttcaattgccggggttcaattaatttcaccaccgcctcatcatgatatttactcaattgaggatttagcccaacttatttatgatctcaagcaggtcaatccgtatgccaaaattaacgtcaaactagtatcatcgacaggtgtgggaaccgtcgccgcaggtgtggttaaggctggggcaaatacggttgtcatcgccggctacgatggcggaaccggtgcggcaccccgaaattcaacccgagattgtggcctaccttgggaaatgggcttggcagatgcgcaccaaacattggccctcaatcacttacgacaacgaacaactttggaagttgacggcaaactgctaaccggccgggatattgcggtagccatcatgctcggtgctgaagaatttagttttggcaccctaacgatggtctcaattggctgcatcatgatgcggaaatgtaacctaaacacttgcccagttggcatcaccagccaaaatccggcattacggaaactatatgcgggcaagcccgactatatcatcaatatgatgcatttcttagctcaggatttgcgtgaacaaatggccgctttgggttaccggacaatcgacgaaatggttggtcatggtgagcacctccaaccacgatatgtaccggcaggtaaggctaaagccctgaactacgaccgaattatcaataaaaccattccaattgagcgaaaagtcaccaatccatttaagccaaaatacaactggccggaccttgaccagttcgccaaaacaagcttgcaaaacggtaattcaacaactgtcagcctgccgatcaataacaccatgcgggcagtcggtaccagaatgggcggttggattggggctcactttggcaactacggccttaaacccggtgcgatgaaatttcactatcgtgggacagccggccaaagctttggcgcctttattactcaaggaatggaaatccaattagtcggtgaagcaaacgattacgttggtaaaggattatcaggtggtcgattaatcgtcacatcgcctcgccaggccagagtcttatatacgcactcaccaattatcggtaacgttgcctgttttggtgccaccggtggtgaagcctacttcaatggtcgcgcaggtgaacgtttctgtgtccgtaactcaggtgccaaggtcgttgttgaaggtattggtaacaatggctgcgaatacatgaccggcggtgtcgcggttattctaggccggacaggtcgcaacttcgcagccggcatgtctggtggggttgcctacgtttatgactggacccatgacttcaggcaaaaatgtaatgaagaactggtcgacctctacaaactgggagaaactggcgatgatagcatcctaaaggatctgcttaaaaaacattacgactacacccattcggaaactgccaaagaaatcctggataactgggacagtgaaaaacaaaagtttgttaaagtctatccacgcgatttccataagatgcgagatctgatcgctaaatacacgcaaccgggaatcgataaagaggctgttattgaaaaagcattttataccgcaacaaaggagtgagaaaaatggcagacccaaaaggttttttaaaatatccacgtaaagacaatccaatgcggccaattatgcagcggattaaagatttcaacgtgatggaattggatttaggcgacactgatcgccgtcagcaagcggcccgctgtatgaattgcgggattcccttctgtcatcacggcattttttatagcggcggccgggcagtcagtggctgccccaatgacaacttgattcccgagtggaatgatctggtctatcagcaacgggatcaacaggcctttgaacgacttaccaaaaccaattatttaccggaaatgacgggtcgtgtatgcccagctccctgtgaagtttcctgtgttcaagcgttaaatggccccgggatcacaattcgtaacaatgaaaagttcattatcgagcaggcgttcaaaaacggttgggtcgttgactcaggcaaaccactccatcgaaccggtaaaaagattgctgttatcggcagtggtccggccggcatttcagctgcttggcgacttaatcagcttggccactccgttaccattttcgagcgggacgaccgattcggcggattactcatgtacggcattcccaacatgaaactgcctaaggaaattgttgaacgccggatcaatacccttcgaaaagtcggcattgaattagttgccaacaccgaggtgggcaccgatatttcagctgcagatctgaaagaacaatttgatcgaattgttatctgcacgggagcccgtcaagcccgtgacatcgacgtttctggccgccaattagatggtatttatcaagccgttgattatttaagactggcaacccaatcagttattaatgacggcgttcatgcaacaactaaactaaagggcaaacacgttttggttctcggtggtggtgatacgggaaatgactgcatcggcactgtgattcgtcagggatgtgccgggattacccagttggaaatcaatcccgccctacctcatgaacgacgcccagagaatcagtggccggaatggccaatggttcaaaagaatggttacggtcaaaaagaagcccgcactttatttggtgacgtcaccacgtatgatgccaccgcaacggccttctttggcaaaaacggtcacgttcaggaagccgaaatgagtacagttgaccactacaagccaattgccggcactcaaaaacaaattaaggctgatctggttcttttagccatgggatttaccggtgctgagcagtggttatttgacgaatttggtgtaattaaaaaggctcacagttacgcaaccaatgacggtcaaattttcctggcgggcgattgtcgccgtggccaaagtttagtgatttgggggattcatgaaggtaggatgtgtgctgaaaaagttgacgcttctctgaaaatattagcaaatactgaaacaatttgaaaaaagttttgaaagctaaaaacgcaatggggttagctacttacggcgattcgaatgattattcatgttacctttaatgacaagtaacgttgtattttactaaatattaaattataatatgaatctaattagatatgttcacatcataatgtccgtttcgatcgccacagggaggtagctaacatgcaatcgttaagtcaaaaacgaattacgagcaatattattaaaggatctttaggtaacatgattgaatggtttgattggtatatttatgcatcatttgcaatctattttgcaaattctttctttccagatggtgatcagacggttgaattattgagtaccgccgccgttttcgcagtcggtttcttgatgcgaccatttggtagtttcattatgggtaagtatgctgaccagcatgggcgccgctccgccttaacgttatcagtcagtatcatggccggtggttctttactaattgctttgattccgacttatggaatggtgggcatcttttcaccaattttattaattctgattcgtttggtccagggtctttcactgggcggcgaatatgggatttctgcaacttatttgtctgaaatggcaacggccaaccgacgtggctactacgcttcctttcaatatgtcacgttgattagtggccagcttctggcattggtcgttcaaatcgtcttgcaacttgttttcaccgacgcacaacttcgcgcgtttggttggcgaattccgtttgccatcggtgcggtcggtgcgctgatcgtcttgtacctgcgactttcaatggatgaaacaaatcaatttaaaagcacagcgaaaaagacttctgctcgtggcacactgcgtgaattggcaaagtaccctaatcaagtattaacggttatgggactaacctttggtggtaccattgccttctatacgtatacaacctatatgcagaaatacatgattaattcattaggattagcacccaagctggttaccatgattaatttcttggcactgctgatctttatgtcagttcaaccattatttggccatatttccgataaaatcggtcgtaaaccattgctctactggttcggaattggcggtacgctattgacggttccaattttcatgggcttacaattcttcgacagcccgattgcagcgttcctgcttatgttgggtggcctcttaatcgttagtggctacacatcaatcaatgcaatcgttaaggccgaattatttccaactgagatccgagctttgggagtaggctttccttacggcttaaccgtggcaatcttcggcggcaccgttgagtacgtggccctttggttaaagcacatcggtcacgaggattggttcttctattacgtttcagcagctgcctttgtcagcttcctggtttatgtccgaatgttggagacatctaaacattcagcgttgaatgataccactaccgaagagactaaagctactggtgaaactgaaccagaggaacacgtgatgtagctaaaagtatccactaaaaataaacgtggtaaacatcctgactagatttattggatgtttaccacgtttatttttaagtgtctaaaattcagccattaatttatgaagaacgatgtgaaagatattaattgaacatctttgcattcatcaaaattttgttggcttatcaagccaatacttaattgtataacaataggtccaccgatcttttccaaccttgtagtagtaagtaaaagttggtgttttatgaccatgtcttaggactattttcctgaaattatacttaacattgagggttttatcacgattcttatacctgatgatcattgttcgactttttggggtatagatatattccaaatgcttggtttctttaaaatactcttttctaattcccgcttcataatttccccaaccattagaactaaacttcagtaccttttgcttatttgcataacccaaaacaccttcattaaagtgtcgccaacttgcttccacgttagtattaacttgggtgaaaaacaacattccaaaaactactgctattaccagcgaaagatatatattaaaccacttttttataaccgttgctgacatcccccgtgaaatctttgtttacacccttggagttatacttatattatagttatcctcactaatttgggaaggaagaaatcaaatggataataagaaattggctaaactaataagcaatctttcttggtgcggtgtaatcttagttataatacttgcttggtttactgttaggaaaaatcaaattttatactggggaataatttcctttgcgttatttatttcgattttcttttcaccgggatacgctctaaacaagttagtaataaatcgtgtaaaacatcgaaagtaaaaataactatcaacgtaaatgatgccgcggcctttaactgatgcatttatttcatctccaacagatttgaaattacagttccatcagatcaacacaatttacttaaaaataggtagatgaatacacaaaggataagaatgtcgacaactatcgcaattgaatattttccttttgctacacgcactaaatcaaagcacatgtatattatgattatacaaaaaagaatacatagaactgtggaacaaacaaatataagccaaaaaggacaaaggcaattcttcctttccaagcttcaatccacttttgcattttttaataatttgaatcacccaccatggttttttcttttttattttcaagactttatattttttacaaaagacccagttttatttctttcccttttaagatgcgaataattttccttcttataaatccagtatttaggccagtactgactgaaatattcgtttgatcgatgtcatgattctatctttatcataaaagcaaaccacttcacttgctatccaccagggagaaccgatacactagtaatgtaagcgaattcatttataacagtataggaggctatttaaatggcagaacaatacgattttccaaagactcgtgctcagttgaatcagttggtcgcagatttaagccaattacaagttaatattcagcaaacccactggtatatgcgtggtgagaatttctttagactacatcccttaatggacgattataatgatcagctggctgaccaacttgatcaagttgccgagcggctcattgccatcaacggttcccctttttcaaccactcatgagttcattgataacaccggcctgcccgatgataaggtcacttgggatcaattaaccatgcgtgattttatgcaacggttgtccgatcaattcaaatatttgcgcgatcaatatcaaaagggtatcgaaatcactgacgctgagaaagactttccaactcaggatatgttaaacggcttcaaggacgaaactgataagaatatttggatgatcaatgcttacctgggaaaagggccgtacgatgaataactaaatttatggatatgaagccaccgaaggaacttaacgtggcttcatttttatttatcgtatttaaccatggaaaaccaaccagatacaggcttaataagggcaggttactttaaaatatccggttgcgcggttgcaaaatacagaaaagtagcgtgatgaatccgttacatattaacgtaaaagctaccatctactgaaagatattgatctttggtagaaatatcataaaccgttgcattaatatagcgactttcatctttatcgtgatagggacggcaggtcagtgccaccatcggatgaccatcaaccaaagctctgagtcgaactgccccctgaggcgataatgatagtgataggaccgccaagatcaaaatcccaacaagaattcctaacgaccataaccacttcctcaatttaccttttctagagttcacggctgcttcacttcccttcccgttacttattctatatctgttatgccatactatttaacgattcgcaatctcattaaccataactgtaaggtaattcttaaccactaaattattttttcttaattgacatctctgctaaaatgaccttagttacacttattaaaaataaggaggaatttctcaatggcagaatcagttaaaattggcaaaagtgatgtcacaaccaccccacttggtctgggaactaacaaagttggtggtcacaatttgtttgatggcttaaaagatgagaacggtaaacaagttgttaaagcagccttagatagcggcatctcgttacttgacactgcgtatatgtacggacttggtcgttccgaggaaattattggcgaagtaactcaaaactatgatcgttcaaaatttgtgattgcttcaaaggctgcccaggatcccaataatcacttacagcccaataacgatccggcatttttgaaaaaatcggttgacgatgcgttaaatcgtctgcaaactgactacatcgatattttctacattcattttccagatgataaaacacctaaagccgaagctgtcgccgctttagccgaggagaagaaggctggcaagattaaggcgattggtgtttccaacttttccttggaccaaatcagagaagctaacgctgatggtcaagtcgatattgttgaagacaattacagcctaactcatcgacatgctgaaaaagcattattcccatacttaaagcaaaaccagatttcatttgtcccatactttccacttgcttcaggcttgttgaccggtaaatatacccaaggcgaccaagggaagttcagccaattttccaccgatcaatataccaagatcatgaaggccctcgatcaagtgaagcaaattgccgacaaacactcagccacagttgctcaaacaattcttacctggtacatcgccgacccagacattagtgttgtcattcccggcgctcgaattgctgatcaagttaaaagtaacgtcaaggccttagatgttcaattaagcaaagctgaatttgaacaaatcgacagcttattttcagaattctaatattgaatcagaaactaaacattcgcccatcagttgcagattggttgcgactaatgggcgtttttttacgggaaaatgagcctcattgaattaggataaatattggttatatcaggtgcctgctttctagattcgtgccgacttcctcaaggttactaagttcaaataagtgtatcgccgtagtttctgaccatatgaatcccttaattacttgttcataccagcaatcatcaatattacctagtttaaacgtgcgaaaagccgcagcttccggggatataaaattacctggttgcccattctttacagaagtcaccaattttaccgagcctaaacgtgcgaaagaaccgcagtttccggccatataaggaccttaaaccaatatcccaagttcggggatattggtttaaggtccttatattctggaagctaagcgcggcttttcgcactctttactccaaaatgattttctttttcccattttggtagtaaactagcttattgtttaacaaattttcttcattatagggtttctaaaaatgaaggaaaatcgaaaggagctttctgcattgctaaaaattgctaagggccgaatatcctatctcgcagtcctcggggctgtcttttttatggccattcaagtgactgccaatttaaccttgcccagtttaacttccaacatcgttaataacggggttgccaccggtgacattggctacatttggaaaatcgggattcaaatggttggcttttctctgatcagcattgccgcggcgatctgcaacgtttttctcgctgcccgaacctctcagatgcttgggaaaaatttgcgaaccgacatttaccacaaggtcatcaatttctcaaatgatgaatatgatcagatcgaaacgtcttctttgatcactcgaactaccaatgacgtggtccaaattcaaaacgttgggatcatcatgttacgaatgatgttaatggcaccgatcatgctgattggtgcgagctttctggcctacaacaaggatcatcaattaacaactgtcttcctggttgtcctaccaattatggcactctttatcggttttctactttactttgccgttcccatgtttcgggcaatgcagacaaagactgatagaatcaaccggatttttcgtgagggtttaactggtgttcgagtcatccgagccttccgacaagatcagtttgaacaggatcgatttgaagatgccaaccaggactataccaaaaatgccattaacgtcaacgttttaatggcgcttgcctttccggtcatgaccatgattatgagcgggaccaatatcgccattatctggttcggggcaaaattaattggcacccaatcaatgcaggttggtaacttaattgcctttatgacttacgccatgcagattctaatgagctttatgatgatgtcaatggtctttgttttcattcccagagctcaagcatccgctaaacgaattcaagaagtcttaaacttacattccgcacttaaagtggctgatacccctaaaaaaatcaatcctgatgcctcaacccacaccctttcttttgatcatgtcacgtatcgatatcgaaaagctgaaatgcccgcgctaaacgatattgattttcaagcaaaaagtggccagacagttgccattatcggtggaacggggtccggaaaaacatcattaatcaaccttattccccgtttttacgacgttgaagatggtgctatcaaattggataacatcaacgttgctgatatgtcattagatcaacttcgaaaagccgtttctctggttccccaaaaagcaactctattcaccggaacactacgtgacaacatgagatacggaaaagatgacgccaccgatgatgagatctggcacgctttagagttagcccgcgccaaggactttgttgccgaaaatccagaagggttggatttacacgttgaacaaggcggcggcaacttctcaggcggccagcggcaacgactggcgattgccagagcattggtcaaacaagcgatcgtttatatttttgatgattctttctcagcccttgattttaaaactgatgctgaactacggggcgaattgcgaaacgatccccatattcaaaaaagcatcaccattattgttgcccagcgaattgcaaccgttgctgatgccgacctcatccttgtcctggataatgggaaattagttggtaaaggtactcatgacgaattacgaaagactaacaaagtttatcaagaaatcatcaaatctcaaatcaggaaggaggctgacaaataatggcagaagataaatctgaaaaccagtcaacaacttcagctggcccaggtggtcgtcggggaggtcctggtggttatcaaggcgtcgttgaaaagccaaagaatttctggggcacgactgcccgtctcatgcactatatgtcagaccgaattgttggcttaatcttagtcctgatttttgcgattaccagtgtgatcttccaaattcgaacccctaaaatacttgggcaggcaacgaccgaaatttataagggagttatgaagggaactgccgaacaaaaggctggtttcaacattggtaatttacccattaatttcgacaaaattgtccacattatcatcgtggttgccatcatgtacttagctgccgctatcttcagttatctgcagcaattcatcatgaccctgatctctcagcgaaccgtttatcgtttgcgccgtcaaatgaaacagaaaatgcgggttgtgccaattagatactacgacactcatagtaacggtgacattatgagccgagcagttaatgatatggataatatagccagcacgcttcagcaaagtctgacccaagcggtaaccagttttgtgacttttattggaaccctttggatgatgttttcgattagttggaaattaaccttaattgcctttgtgactatcccgctgagcttaattgttgtgggaattgttgctcccaaatcacaaaggttctttgcggcccagcaaaaaagtcttggcctgttaaacaatcaagtggaagaaaactatgccggccagcaagtgctcaagagcttccgtaaagaagccgatacgatcgagaagtttgaagatcaaaacgataaatattatcaagccgcttggaaggcccagttcatttcgggcattatcatgccgctgatgatcttcatgaataacattggttatgtgtttgtagccgtaattggtggtattcaggtggctaacggaacggtaacactgggaaatgttcaagcttttctgcaatacaccaatcaattttcacaaccgatttctcaactggcaaacctcatgaacacgattcaatcaacaattgcctctgctgaacgggtctttgaagtgattgacgaagaagaaatgaagaacaccaaggccaatcgtgaagtcaaagaaaccgatgacgttatttcattggaacacgttcaatttggctatgaggatcaagatttattaatgaccgattataacttaacggttaaacctggtcagcaggttgccattgttggcccaaccggagcgggtaaaacaaccatcattaatttattggaacgtttctacgatgtaaaaggtggtgccattcgcttaaagggtgttgataccagagacattgaccgtgaagatctccgatcacattttgccatggttttacaagatacttggctgttcaccgggacgatttacgataatattaagtatggccgtgaaaaggccacccacgatgatattatcgaagccgcaaaggccgcccacgtggacgaatttgtcagaaaattgcccaacggttacgacaccgttttaaacgaggccgcctccaacatttctcaaggtcaacgtcagttagtcacaattgccagagcctttgtggctgatccggaaattttgattcttgatgaagccaccagctcagttgatactcgaaccgaagttcaaattcagcacgctatgagcgaactactgaagaatcggaccagttttgttgtggcgcaccgattatcaaccattcaaaacgctgacaacatcattgtgatgaataacggttcggtggttgaaactggtacccataatgaactactggctaaaaatggattctacgctgatctttacaacagtcaattctcagacaatgtctcgtttagttaggaggacaccgtgaaaaaattaattagaattgcttcgatcgttgccctacttcttttgggcttggctggttgtggtcgaccgactttatcggtaaaaaaccaccagctcaagcctgatggtctggcggccgtcatcaagggacaaagcagccacaaacaaattaggtatcggattaacaacggctcggcaaaaaccgaatcaaccaacaacggtagcttcgcgctgacgattccagcaaccacccaatcacaacgggtcgtcttatcagctggtggtgtcaaacaaacggttaaagttggcaaagtaaattccctaacaacttatcaaaaactgcaacgcgcctataatcaagcaacgattgcgaccgccctttcaaaagctgatcaaaaaagagctgctgccttgcaaactcaaggcaccaagctaaaacgcgagcaagttgcgattcagcaggcagttgccgtagctagaaaaaagttggccaagggtgatacttctgcggccgcaactttgcaagctcaagctaaaaaggctgctgccttaaaacagcaggccgctgcgatgaaacaaactcagcagatggttgaagcagcgatgaaggatgctaaatccaaagttgccaatcaattattacccacaaagtctaaagacggtattcataatttagtgaccactaaagacgtcaccatccgaatgaatcaagatcgtcaacaggtaaccggaatcgcaatgctggtaccggttgccgcgatgaaagacaaagtccgggctaagaactttggcctctcgttctctattttagccaacagcgttggtgctgacgcaaaacagattatgaaagatttccaaaagcaggccaaatcaaagaaaaccactaaaacaaccaccaaggcactccattcaaatggtgttgactttagaattggttattcaacaaccacgttatatatttatatcaccaagtaagtgacccatcctgatttaactaaaaacctcctttggctcatgattttgatactctttcaaaatccgtgagtcaaaggaggctttttactaagaactcataactatttttgggaaaatcacttactctgctaaaataaagttatcctaatagtattgacaaaacactaaccgccaaaggagtctctttatgatattagagcgaaataattttttaaacgtcaaacaaattgagcagcaattaaaacaatcacagcagaaaagtagaattgatgattttaaagcgctagtcaaaattttccaattgtgccattccggggccaacgagattggaaccaagctggaaaatctggatgatgagtattcaatgaattatgatcataatccaattcaccacatggaagaacgaatgaaatcaattggtagtctaatcggtaaattagatcgcaaagggcttgatctgaccattgaaaatgtccggaatcatatttatgacattgccggaatccgggtcattaccaactacatcgatgatatttatcgaattgaggaagccctaattgatcaatccgatgttactctaattaggcgaaaagactatattaagaatcccaaacccagtggttatcgtagcctacacattgttgtttcgataccggtttttcagtcaactggtgttgaagacgtccccgtggaagttcagattcggacaatcgggatggatatgtgggccagcttggagcacaagctgcgctataaaaccaatgtcgatcctaaaaaagttaaagagcacactggtaatctccagaaatacgccaccgaattgtatgatattgagagtcgcatgcaagagattttcaaagacctgcaataaacaaaaatcagcaccggttaatgggaggggacccgtcaaccggtgctgttgtttgttttgtatacttatgtcaatagttggacatttgtctaatatctacacttataataacttagtggcagccaagattcaagtgataaccacttcggtttgtccataactagacaaattaataatttcgaaaaaataggtcttcaaacgtccaccgcattccaactcagactgttctcacacccttcttctgggcaccagcccctttggtccgtgcaacgccacactggcagccaacgcccgccatccgtttgaataaacctgaggttgcttattctcggcaagccgtttcgcctgttcttcacaatagctggtcaccattgctgacatcaatttggcatcgagatgtttatttccagttgttaatggtaggtcaaatgcacggtactgatcgtttaaaacttggtttggcaaatcaggcataatcaccattggcgtgcaaataccaattaaagccgcatcgtttcggccaagtgcttcttccatcgttgacacccgacgaaatccaccacttaacataattggaacattaaccaattgattcagcatgtgggcataacctgaaaaacccaattccgaattttcataattatctcctgctatctcaatcaaatcaattcccagagctgccatctttttcgccacctgaattgaatcggcttccgaaaaaccatctaagtctaaatcagtgacactcatttttaaagaaattgcaaattgtggcccgcagctttcacgaataccctgataaatttcaaccaaaaagcgcatccggttttccaatgagccaccatattcatccgttcgacgattgtccttacgtgagagaaactgattaaccaagtagccaaacgcaccgtgaatttgaacgcccgtaaatccggcggactgcgcaatctcggccgtccgcacaaattttgcaactaattctttaacttcagccgttcgcaattcccgcggctgattaaacgcatggtgattctgaccactaatcggaatggcactcggtgcaaccggctgttctgaaaaaattcgtggtgattgttttccaggatgatttaattgcagccaaagctgggtattattttgagtgcccgcctccgcccacttttttaaaattggcaagctgcggtcgtcttcaatcacaacatttcctggctcggccatcgcatgatgatcaaccatcacattgccggtcacaacgataccagcaccaccgttcgcccattttcgatataagttaacgtgaagcgcgttgggctgatgatcgttgtccgcaaaagtttcgctcatcgccgacttaaagaagcggtttttaaccgtcatcccacagggcaacgttaacgattttccaacttgtaaataactcatctaaaaggcacctccattttaaatgatgaccaaattaacgttaagtttgattcaattttagctggaagagtcactttcaacaactccccttttgatgtttcacgtgaaacaaagcttggaaaagtagcacaatccaccctgttgcggtaaattagacgtagatgagttttcgggagggatttaatgactgacaccacaagaaagcaaacacccattgctaaagtttatgaagctctgagtgcaatcgcagataatcggatcacaatgcgggacacagacgcgttggtaacctcatcaaactactcaaaacgctataccgtcaggatttcagacgatttgtattcatccaatgacaacgcgacttattggcagcactatgccggctacccaattgtcgcggtcctcattaagcagggtaaacttgtccttccaaatcattcaaaggaattattagccgcatttaaggatattaattggaaaaagttgaatttagcgtataaaaacaactacgaccaagcggtaagtgattttttgaatcgtagtgcccaacctgatcaaatcaaacagttggtccaagtcatctttgatcaactcaaccagctcccctttagtgttaaagggaatcgcgcgaaattaataaaactagtaaaagaggattcgagtaaatgaaattaattgcatggaatgttaacggcttacgagctgcgattagacacgactttatgacgacgttcaaaaatttaaatgcagatatcttttgtattggcgagaccaagcttcaacccggacaaattaaagtcgatcttcccggctaccaccagtattggaattacgctgacaaaaaggggtactccggaaccgctattttcacgaaacaagaaccccttcatgttaccaacgggcttggcgtcgatgaacttgatcatgaaggccgaaccattacattggaatacgataactactacgtcattgtcagctatacgccaaattcgcagccaaagttaaagcgactagcctttaaacgcgcgtataaccgagcctttttaaattatatcaaccagcttaaagcaaacaaaccggttatcttttgtggtgacttgaatgttgctcaccaacccattgatttaaaaaatgacgcaaccaaccaccataaccctggcttctcagatgaagaacgtgaagacttcacggaattattaaataacggcttcattgacactttcagatttctacatcccgacgaagtcaaatattcatggtggagttatcgctcccatgcaagagaacacaacgcgggctggcggattgactattttgtcgtttcaaatgatttgaaggatcaaattaaatcagctgatatcttaaccgatatttatgggtcggatcattgtccggtggtgttggaattaaagtaaagtgggacgaaaggcggttaacttccagagtgtagtcgggttagcttaatattccgggtttgaatactgagctaacccgactatacggccggaagttgcctttcttcccacgtctccactcggtaattattgtgattagactagaagaattcggtccaaatgatattttgttcaagccaattaaaatattcatattccgggagctgcttgctaaaccacgtttcagattagtagcaaccaagacacacaccggtcaaacaatttgtatctatcacaaaaagagtgaatcgaagccacttaagccaaaagacacttcgtttcacccttttcaatgatttcaactttaacgactcaacctttaaaaaacgctattttgttaacaggtcatccaatttatcaaagaacttatcagccttgactttagttaccaaattaatcgggcggccatcagccgtttcaaaggttcgaccggcaccttcgccggaaacaatcacgtcaccgcgaatatcttttgtttcaacaatttccggatactggctggcaaccgttgtcaaaacatcccacaaataatacgtggagtttgcttcatatgatgataccaatgcatacccttgaccaatcaaatccatcatcggataacgtcgcaagtcggcccagtgctgttgaacatcggcattcaatggaacttgattggtactttccaaaccaaccatttgaatatcaattttggcatcaaaaacggttttaactgcttcggcatcccaataagcattccattcagcagtcccatcatgttttggctcaatgacgtttccagtcgttcgcatggtcccacccatccaatataatcgttcaatatgatcaacgatgcttggatcaacttccagcgcgcgagctagatccgtcaatggcccggtcattaccaatactgttttttcaggttcctgttttaatttttcaatcatatcaaggtgagccggtttatcagcttgaggcgctaattcaggctcgccttcatttaaaatcggaaaggcatcgaatgaaaatgaacttaagcgccattctttaggaaattggtgaacggcacgtgagtttgaagcagccacccgaaccttcgaatcatgcccaaatttcgcaataattttctgggaagccggtactgatccttcaataaaaccatctgcatcgatgacacccacaccagtcaaatgaaagtcaggcatttgtaacagaagtaacagtgatactaaatcatcaacattgccatcatgatcaaaataaacgttttgcaagctaaacacccctaattagtttaacttgatgatacctgaataagggcgcggcgtccattagattaagaatcaggtcgcacagtaaagattgatgtggtatcctcttgacaaagaaatgactattgaaacttatttaatacgtcaaatcccctcacatctttgatttaacggagaacgtctatgaaaaacaatcaaacaaattcgattattaacctcgttgcaaaaacttctaccaatgatctacgtcagtttattatccaccgatgccagttagataccgatttttataaagacttcacagctcaatttggtgaactgaatacggactatgagcttgctaaaacaaaagaagaaatcggatcaatactgaataatactgaatcaaataattttattcccgataaagaatgtcaagtaatttgcgacaagctgtggccgattatagacaaatatcgacatcgtttgaaacaaggttaccatcagcatgcattaaatgggtttcttcttatttatcaggcaggtggtagcatgttaacaacagcatttgatgattcaaactccctagactatcttttttcaatgttagacaacgcacttgtcgaatttagtgatacagttttaaatgagtccgaagacaaaaagatcgattatactcgtcaaatcatcaaaacgtttaacgaccaagaatttaatgactggtatgagtattgttttaatgctctggccagtatgctaccaataattacagataaatcattcgatgttattcaaaagactaccaaatactcatcggttcataattcagaccccaacagttactatgtcagcaaaagttgcattttaaacacgaaaattctcctccaacttaatcacttgcaacaagcaaaagcatacatggaaaaacacattcaaattaatgacattcgcaaaatgcgtattgatttggcaattgaagaaaaagatttcgaattagccgcacaatactgccttgacgctgatgactctaaaagaaacgatccttggaaaaactacctcgtcaaaatatataaaatgaccaaccaacgacaaaagctccaagacatgtttgaaaaaaggcttttggataaccacgatctatctgcatatcaatcgctaaaaaagctcatcacagaggatggctcttggaaaaagaaatatccgaaattactaaagaaatgcgaaaatcgactcacaccatgggaatattcatccatcttggataatgaacatgagattgataaattaatggcattaatcagaatcaagccacgtatcttagatgttgcctttgcccggtcactttacccgagatatcctggtgaaattagcagcttatattatcgtgttgttgtccttagtgaacctgaaattaatcgaaacggttatcatcgacttgctaataagattcgtgaatatgctgattttggcagccttgacctagcgaagacttggattaataaccttattatgatgtatcccagaagacgagccatggttgaagagttatcgattgttttgaatgaaattttgcgttaactttaattcaaactgtagcatctgcatgccattatcccgacacaactaaatctgtttactatgtgacattgaacttagagaaaatttaaaaagaggtattcacaatggataaagaacagcaaacagcattaacacaattcgtttctcggttgtccaaaaaacagttacaagactttgcagtcgctgccgctcagatcacaccttccttatactatgagttgaccgcgcaatcaggaaaactagactttgaagcagaatttaacgatatcaaacagacaattaagacaacaatcaaaaaacatgttaatgatgaaggcctttggagcaacagtactgttattgttgttaacgagttgctgcttgctgacctgcaacgctttacacgacgcggccaacaaggttactatgcttacgcttttcacggaatccttttcgttttgctgaatgcgggaaaaattcaatcaactatccttccatttgatgacacctttaaaaccacgattaatacggcacttaagaaattaaccgctttggttcaacaaattaaagatcaggttaacgcctccaccaaacaaggcatggttcaagaagcactaaagatattcaatcgtaaaatttgggatggaaaagaaaagacccgttacaaaattatcagcagtatcatcccgttaattccagaatcgatgttaacaatcgtcacccaaacaatgacaaattcaatcgctagaatcagtgataatggttatgacggttatatcggaaacgatcttcctgatgcccaagcaatggaaataattgttaaagcccgactaaagtaccattttggaaaggctgatcaagcaagagcacttcttgacaaaaatttggatgatccaaacgtccgtttagaacgcgttaagttcgctctgaatgataaagattatcaactcgcggcaaagctatgccaagagggtgactggcgtaacatgtcatggaaagatatttggcaaaagcaactcattcaaatttattcaacaactcatcaagatcaagatctggagaagattcttagaagacggctattaaccaataacacggatgcttatcaaccattaaaacagctttacattagacaaaacaaatggcaaaggatccgctccgatctactgaaagattgccaacaacaactaacaaccgaaaataacgcattcgttcttaacatcgaacacgaatacgctaaactattagccgtcattgccgataccagttatttaatttatcaatatacacctgtgctctaccagcaatttcctgaagaaatcagccaatcttattacgactatttaattattaacgatcattatgccaacaaagcggcctataaacgggttggagacaaacttatctattttgccaaagttgccaatccccatcaagccttaacttggattagctggctgcaaaagaagtatccataccgatcagctatgcaagagcagctcatgagcacccgggataacattcaagaaataatcgaagaagctaaacaaaccccaagttaacttccgacaagtatcccaattaatcaatcaaccttaaaagagatgatcgtaatgcatccaaccctcactaaattaattcaatacgccaaagatcacgatttcatcgaagccgttggtacggaaggctcaattaataacgccaagattcacagtgacccttggcaggatattgatgtcacttacttttccacggatctacaacggtttcgttttcaggactggtggccaaagtttgggacgcccacgatttggcagcactttgccaacaaccatttattcggcaaggcaaccaagccatggaacacttacctggtccgatttgaccatcaccagcgcattgacttaaagatcgctcctctttccgacttgccaacctatttaagagccgactcgctcaacaccatcgtttggcggcggggtcagcaggtaacaccgaggcaaaccagtgccaaaacccactttatcggtattccaacccaatcggattttgaaaattcccttaatgaattttattggacagccggaaatgtcgtcaagggtctggcccgccataacctcatttatgccaatgaaaccaataatcaaacggttcgaccccaattgctgagaatgttggcttggcgcgtttcaatcaaaagaaaaggccagtttgacgcgggcgctaattataaattcttagcgaactgcttatcaaaccagcaacaaattgacctttttaaaacttatcgccaagacaccttggcccaaaccaaagcgagtctcttggatgagatccagttaatgagggtaacccttagttccttatcaaccctaaaaacattacaaattccagcctatgtttcacaagctgaatctcagcttctctcgtggttgcaggaattaccggattaacgccgccgatgtttcacgactgtaaagaaatgaagaataaatcccaacagcacataaaaaataacgacaaatgaaagatagcttaaccaaaagtgttccgttggcagcatttttaagccaacttgaatgcccattgttaataatgccataaatgcaatcataaagaataattcgatatatcgtttcaatgtactgtcatctcgcttcttcactgaattcagacgctgtccccatttgaggcaggtctgttttttattttccggtaatgccttcatcccgtaagtattggttaaaaccagttcatgtagtttaatcaatcctgccgcggacatcactttatcgatcgttcgaaatgactgatcggtgactccggttacccagttttcgaacgcgccggtataacaatccgtgatactgacgtaatgcttatcagcaaaccgatcagggtgagtgccgcccagatgatcaattcggaccaaccgctcacgcatacagtcaaaaaagtccttcattttaccggccaaaccaccccaataagtgggtgccgcgattacccaaacatcactatcaagcattttttgttctaattcatccaataccggatcatgttgatccccttgatccggcttaaatgaataatcttctaaatagatcgtttcagtttcattgggtgctttgacacccgctaaaaccgtttcaagcattttctcagtaatcccgtctcgacgatgggcaccaagaattcccaaaactttcaaaagccaatcccccctgattgaaaattgatttcatttaaactaaaaagtcttcaaatactaaacataaattgcagattcaataccgtaatcacagctgttaacgcgtacccaagaactgtgataaacagattattcgtgtgccgacccatcaagtcacgattactggtcaaagcaaccattggaaacaaggtaaacggcagtgcaattgacaacgcgatctgagcaaaaacaatcatttgttcaaatgattgatcactaaaaccaaccaaataaccaattatcaaaatcggaatcaacgttacaaatcgggtcaacagccgacgttcccacaatggtaatcgaatattcaaatacccttccatgacaatttggccggccaaggtgctcgtgattgatgaaatcattcccgtaattaatagggcaaacgcaaacagcgtactcattagcgggcttgccagattaccaacaatcgccgtatttttcaaaccattatacacatcctgaaaagctgacaggttactacttttctgaaaaaataaggttccgcccaataccaacagcaacgcgttaatcagaaatgccgcaattaaatggacgttggaatcccatttcgcgaaacgcagcgcttcatcgacctgcttggggttatgataatcgtatcggcggctctgggccaaggaagaatgtaaatatacgttatgcggcatgatcgtcgcgccgacaattccgaggctcataatcagcatctcgtgatttttgataatcccgggagtgggaaccaatcccttaaaaatggctggtacactggggccggctcgaaaaacttcaatgccaaatataatgccaacggtcaatatcgagaacaacacaataaattcaattcgccgaattccaaaccgtaaaaacagcaggactaacaagacatcaaaaatcgtaaccagaattccgtaaaccaatggtatcccaaacaacaatttgagcgcaatggccgtgccaaccacgccagtcatatcagtggccatcattgcaatctcgttaatgatccaaagcgcgtatcgactgcctctgggaatcttttgcgcgatcgcctgtgccaaatccaatctggcaacaacccctaatttaatcgccagcgtttgcatgaacatcgcaaccaagattgacatcagcaaaaccgataataacgcataacggtatttacttccgccagaaagtgatgtcaaccagttaccaggatccatatacccgacagccaccaaggcaccgggaccactataagctagaaacttttggaaaaacgaggtttcataaacgctgggaacagccacactttggttaatttcatcgagactctttttagtatttggtgtcatgatccgtcttcccccgatcgggattgatttgttccatgctaagatcggcaacaaattgacaaaagtcatcgtttgcattcatcggtggaaccgcatcaaaaacttgaccaccggttgcccggaactgctgataattctgaacgttattctcttcaatcgtttccaaacaatcttccacaaacgacggtgtaacaatcagaacgtttcgtttccccatttcggctaattccattaaagtattttttaaatagggttttagccatggcattgggccaaatttagattgaaaaacggttcgaaccttttcatgcggcaacttcaaatattgagtagctccggcagtagttgccagacactccttccgataaggatcgccctttttaaccattgaagttggaatcccatgataactgaataaaactgcatcatatttcttttgaggataacagcgatcaaccccgctggccagtaatttcaaataacggggctcttgatagaaactcttaatcatttttgtttttacgccggaagcacgcacttgctggaaaattgaatcatgagtactctgggtatattgcggaaacagtggtaacacaacgatttcatcatcgtgggcagccatcttatgtaaggtttcagaaatatccggctgtccgtatgtcattgccatttgaacgtcccagtcaggcaagattttctgaaccttgtcccgtaaaatctgcgtataaacaattaatggcgagccggcttttgtccacatatgttgataaaaggtcgcggaacgccaagtccgggcaggtaaaatgatcccccgtaaaagcggctgccaaaaccatttgggtaactcgacaacgttttgatcacttaagaattccttcaagtaggcgcggacatctttgttggtcggtgaaaccggtgaccccaaattaaccagtaataacccattatgtgccatgaaacgcatctccccctaattcgaataacgttataagttttattttagggggttgtgggggtaattacaagagagtggtctaatgagcgcttagcttccagaatataaggcacttaacccaatattccaagagcaggaatattgggttaagtgccttatatggccggaagctgctcattagaccacgttttagactaagtaccaaatccatctactctgggggacttactaatttcacgatttcaacatagttaacccctcaacttcttgattcacttatatggccggaagctgctctttagaccacgttttagcccgatgacaatttttttgtaggacactcacgccaacgacatgcccataacctcacatcgtcgacgtattcaaaccagtcagcatcatcaatatgtatccaatacccaccatgattccaacaaggtaatgttgatcgatcatcgttgcatcaactttcaaagcgttgatcagaattaaaatcggcccaccaaacaaacatagcgtccaagggatgtccaaccatgacggcatggcagtctgatagacaaccagcgtcattaacataaccgtcatcatgatcattagaaccaggcttgcccacattgttttatcctgatgcagtagacccctcgtaagaaacctggttgccagccagccaaaaaggatactaactattaataattcaccaaaatcactcactaacattgtcccaatcaatgatctggataatggcactgcatttgtcgcatggggcgcaatccgcaatacttcccgactattaatgtaaagcgccagtgccatcccaacaataaatgttgaccagtaacataattgaactttttgccgtctactcataaactacctctaatccgtaagctgataggtctcttcaaattcactttgactaaatatttcaattcgattttcaaaccccttgataattacttcgccaggctcaaccgcagtggccccccgactagtcacaatctgtatcttattcttctttttggtaacatggctgtcaaacggtttcacaaacgcttgaacggcctcatgattatcaccatcataaattagatagtgttcattaattttgcgacgaacaatgccgcttttcggcagttcatttttcatattagtcaactccttagtgctatcattaacttaactattatcctataggcttttcaaaatcaaaacaacttaaaattaagtcataacgatgaatttaccgccatggttggttacaatagagaacgaggaaggatgtgataccttgaataactccaaggagtacctagatttcttcaatcatgagtataaagaccccagcacgcacagcgcatatagtaccaatagtaattttcgttttgaaagccgttctgatgcgcttgaagttaaaaatatgctgcaaacccgcagtcctcatgctaaacaatacgaattaagcgtggaatatattaatccaaaccaatcaatgcaggttggctggtacatcactgtccgaaaagtcgttgcaaaaccatcggatgaccaaaccaataattctaaaaaataattttgcgaacatatcatttgaaaatcaagaaacatcgcgttacggtaaaggaacacgttatgttatctaacaccaaatggaggttatcaattaaatggcaaatggaacagttccagatttaattttaaatgatggctataaactaccggcaatcggcttgggaacttatcaaatccgtggcggcgacggtctccaacagatcctcgccgcaattaaagacggttaccgcgccttagataccgccactaactacgataacgaaggattggttggcgaagcaattcgtcaatccggaattcctcgttcgcggtttatcgtgacaactaaactacctggcaaatatcataaatatgatgatgcaaccatggctatccaagaatcactatatcggatgggcttagattactttgacctctacctcattcactggcccctacctaaacgcaatcactatgttgaggcatttcaagccatgattgatgcgaaaaaacgggggttcattcgatcaattggtgtttctaattttgaaccggaacacttggatcgactgattgaagagactggcgtgacaccagccgtcaaccaacttgaaatccacccttattgggttcaagagcgcatgttggctgaagataagaaacgtgggattgtcactgaagcttggagtccattaggtcgtggaagtgccgctttgaaggagccgatcattaaagacctcgccaaaaagtacaataaaaatgtcggccaaattattctaagatggcacactcaacgtggcattgtcccaattccaaagtcacgcaacttaaatcatcaacgagccaatctcgacatctttgatttcgaactaacacctgatgaaatcaaatcgattaattcgttaagtaagccggatggcagaattgatggtcaggatcctaatgaatatgaagaatttgaataacgagatcagtcacaattttttgttgattgaaagtttcttcgatataaactgaaagatctaaataagcaccactttttaattggtaacctcatcgttatcaactagaaagtggtgccttttatatttcatgatgtcggctttcaattcttgaccattttagcaatcatcttacgagcgtttctgtttattatgtaaaatcgattgaataatcgtaaccacaattagcatatagcccagtaatatccagaaattaagggaagcagaaatgtcgatcaggacgttggcaagcaccaaaaccaactggcaggatattgccaagatataaaacagcttttgcgataatcgccagttcgcttcagaggacctactcagcttagttcgatagccaataaagttagatcgctttttatcaggatccattacatagaataaacaaactacaactaatacaattagaatcccaacacttgatgctaatccattcatgatgatcactcgctttcattggtaatctgaaacaattaaatcccggatttttatttgaaaccccagtgaattgggatcttactaagagtgtaggtctagtatttagagaattcaataattttgaaataatgtcctacagttaaccgacagactggttgcaataattagacacaagccaaaatctataaatcatcgcttcctcgtttttccagtagttaactgggctatttgaattccggaaatgaccacttcaatgattattaatttgttttttaatttagtatactgaagatagccctcaaggaggaaaacatgaaaaaatatttaaccattgttctatccatatgtagcctaattattggtttagtcagcttggctaatgatcaagtccatgctaaaagtgataccaattatcaaataattgccagtaaaaatgttaacacctatcaaactctcaattcattcaataataacggcatccttcatgttaaaaatcagtataagaacaagaatgtgcccgtttggaacaagaaacacaccaaggttctttacaatttgaaagactttcctaatccctatctttcagccttaactaagcaaacttatcttcataatggtcataaaagtctgtactatgcagcattcatcgtgacccccaaaggcaattcctcaagatatggtcgcgtctggcatggttatttaaccaaaggatataatcgtaattatcaaaaactgaactatttaagtactgttggcttcactaataatcaagactaccttaattacattaagaaatcaccatcgcaagttgttgcgcgtgcagttttaaaactctttccaaacagtaaactttcactgaggttatcaaacctcggccagtttaattcagatgtggattcaactaacaatcccttcgaagaattcttcacggaccgaatcaatttacaaaaagcggctgcttatttgggcccgaccaagacgaaattgacaaatcagcaaagaattgccaaaattaaacaaacattggcttctgaaggttacacaaccagcaaacgaaatgcaatgcgtaactatgtcattggtatctatgcccctaatccgaatatggcatgggaagaatttgtctggagtattaatttagctaaaccgctataaatcagctattgcatgatcacatattgtataactggttattttgcaaaactttttgatattagatgatgacgtcttcaaaggagaacccgtaatgaataaaaaaatcgttcaatttttatctatcggcttattaacgttggggattagcttaagtgcctacccggtgacttctcatgcttggacagctgttaacaaggacacttggacttctggaaaagccgatgccgcaatttattacactgacacaaataagaatgcgtatatttggaactcgcggtttaccaagaaattgcataatttgaaaaactaccagtacacaacttggtatatcacccgttcatttgtccgtaagaatagcgtctattacgcaatcagtaattatggtggcaaggttaaaggctacgtttggcacgggtacgtaaccccagccgttgttaaaaatatcaacagttttaatcgtgatagtgattatctcaattatctgaacactgacaagtcccaaaaattatctcgagcattgctacgattaattccgaatgctaacataagccttaatttatctaaacaagctgctatgaataagatcactaattaccaatctgtgatcgatttggggaaagtaagtggtactgtgacggagggattaataacccataaaacaattgttcatgatttcctaatggggcctgcttctactaatgcccaaaaagcaaaaactgttggaaaaatgcttgctgccaaaggatacacaagtcggaaattagcttcattaatgaatcagggctatcaagttggtatttatgtcaatgatggtgcggcgacttcggttggtaaatccgggtaccctagtacgattagttttaagtcatcaattcaaaataacatggcatttgtgattgcaaaacaaaaataatttaacatgaaaaccgaacaatcctagttctcgtccgattcatctaacaggtaagcaaaagcaaccgcaaatccacatttaaaacatattaaccgctataatccagagaaatggagaaaaaataatgaaaaaacttttttggctaataattggcatcattattggaaccggcatttacagtggttccccagcggttgcaagttcttcatataagttagtcagtatcaaatatgatagccaaaaaacactgaaagaaacgccaacgcataacggcccgttatactacgcaagaaatccaaaacattcagctgccatttggaattcaaaccacagtaaagtaagacataatctaaaaaattatccgaatacgacttggctcagaaatgcagttgcaatctttgaacatcatggtaaaaaatccgtttattatcatgtgaatcaagttgttgccggcaataagccagtaaaagcgatcggttacgtttggcatggttacttgagacagggacacaatccaaattttcaaaacatcagtacgatcgatattttgaacttttataataatcacgagtatcagcgatatgttaaattatccccttcgcaagtgctaacccgcaaagtaatggtcttatttccaaatagtaccgtttcacttgatttagccaaggctggcttgggattgaattcagctacgtatcatataaatgatgaattgccccccttcttggcgtccaacgaacggacgcttatcctgattaattgtcaaaaaacaccatctttctaaatttgcgcatatggtgacactttggatatgatacaatggttggtatgaaagatacaaatagactaacgtatggcagaacatcggtgtacaatctaaattaccatctcatatggggaaccaagtaccgcaatcaggttttaatcgggcacgttgaggaggttttcaaacgcttggttaacgaaatcgccgatcaatacggttttgaaatcgcctatctggaaatcggtcaggatgatcaggttcacctactcgtcagtgcaccacctaaattatcagtcacaaacattgtccgctggttaaagggcatgactgcttttcagctattccgtcagtgccctgagttacggactcatgattggcaaccaaaggatcggcacttgtggtcacctggttactatgttgaaagcatcggggctgtcaatgaacgggcagtggctaaatatattgacaatcaacgcaagcacgaaaaataacaagaggaggtctcggatggccacggtggttaaaggggttaagctgcgcttatacccaaaccaaaaacaaaccggtcagttgtggcaactatttggcaacgatcggtttgtttggaatcaaatgttagcgatggctcagaaacgctatgagaataacccgaaaagtcagtttgctaacgaatacgatatgaattacctgcttaaaccgcttaagcaagagtacccattcctaaaagcgagtgatt

SEQ ID NO: 646 - DNA, 82482 bp, Unknown
  Metagenome-assembled genome
agaccaacgagcgaaagcgctcgttggtcaataaaatactttacctaactaaattatactaattttttcggtatttgactaccgttaggttagtatgtccttttttaggttactttcttataaaaaagttaactaaaattccagctgccattacatttacgaataactgaaaaaagtaatcagacaatcacttctaaattttaaccattctcttgatttagttagccattttatcaacaattgttctttttaaatagataattagcacgaaaacacgaacattaattaaaattaattcgaaatatatattgaatattccgaattagctagttataatggttgttattcggttaacgaattatcattgaatattttcaactaatgttcgtatttgttaaaaataaccaatggtgttctgatttcgattcattaattcgcagagaggaagaatttttataatgaagcgcaatgacaatggattactttacggaccagaggacaaagtttcttactttcagtcaggattacttggactccaacacattctggcaatggatgtctacgtaccaccattgattattgctggtttactatcaatgacattaggacaaaaaaccggttttctacaggcagcttttctggcctgtgggatcggcactatcctacaaactaaattctttatgaaattaccagtctcccaaggtccctcattcgttccaattggcgcagtagccggggtttattttgcaaacggtgctgctcacggtgggttggcaacggtgctgggatcattggtaatcggcgcgatattattaatcttgttaggactttccggtatttatcaaaaagtcattaatacattggtgcccgctttggtcggtggcacgattattacctgtgttggcctatcactgttaccatctgcattgaatgataatatttttaaagccaccggcaatgttgaccaaaacattgaaattgcggcaattaccgggttttcgatgttagctgccattaccattggtattcgaattccacaacttcaacggttattcagagtaagttcaattgtgattgccttaatcatcggaacggttgttgcgtctgcaatgggccgatttgactggtccgtcgttaataacgcaccgtggctaagtttaccgaaatttaccgccgttcactatggactccatttctcactcccggcaattttgacatttgttgtgatttacatggtcttaactaccgaaaccactggaacctggttcgccatgagtgccgttgtcggtgaaaagatttcaaaaaagcaatggaatcggggcatcattggtgagggattaagctgcttgtttgctgcattactggggacaacaccaatgactggttattcaaccaacgccggtgttgtttccattactggtgttgccagtcggcgagtcttcgtttctgctggtatctggttcatggttctcggcttctttggcaaattatccgcttttctttcggcagttccagcaccagtcattggtggaatcttctccatcatctgcgtcatcattatgctgaacggtctaaatgtcattcgtgatcttgacaccaacgaaagttcaatttatattcttggaattccaattgttttaacaatggctgttatcttattaccaagtgccgttctaaagagcaccccgcaaatggttcaatatctattgggatcaccaattacaatcgctgctattagtgccgtggttctaaacctggcaatgggcgatcataaggctgaggttagcgaagataatcaatctaatgagaatcccaaaaacacgaccagccacattgaagcccagaagctggctgaatcaaaatcttaacaatcagttgcccggaattaaccgggctttttttgtggcctcaacagattgacttgaatggatacatatcattacatttggattaaagaaagaccaatcgccaggcatcttaaaaatgctttacattcaccaaaaaggccccgcactatcagcacaatctgttgacgtgtgagaccaattattttactggacattattttgaaatgcccaacttttctttaagcgcttcagttaatgtggaagaaaaattaattttgtttttaacaccaatatcatttaagtacttgggaatcgtcaaggtctttttaacacttcggttctcttcacgttcacgcgcgatagtggtattgacttcgatggggattaacagctgcgtttgcttatgttgaatatcttgaggatctgatgatgtgggcaacgtgtcaccaaaatcttcagcggttaatagatacccttcgagagcatctttagccatgtggagtgcatcggaaacagtatcaccaaaggtagccgcacttggtgccagatcgggaaatgtgacttcaactttaccggcagcatcaaaggtgaataaagcataatataaatacttcataaccaattcctccattctttgagtgcacaaccaaactgggacgatgatcattaatatcagtctcttttggtacaaacacgactgttaccgagcgaaaacgcggaacaaaaggcaactttcggccgtgtaattggattatccaaacattcaagcccggaatattcgaataatccaattacactctgaaagttaaccgccttttatcccgctctggccaccagatactatttaaggttccctttggaatatccttgcggggatgtggcacagtgaccgttcccggcttatgatcgtttcgaaaatggaaatgatcaccggtggttcgaacatgtcaccagccatccttatgtaatatcctaatgacctcgcgagagtccatactttgtacctcctgttggtacaataatatattaacacgtactattatacgtgttaattcaattaaatggcgctttacatgaatttccttctggaacattctcgcttgaccgttgaaaacatggaaagatcgaactaaacccacagacgattactatttatggaatgtctgccacaaaagtagcctacccaataaaattagaatctatcatatataaaaaaatacttcctctttaatcctatgatactcttcaacactatcccggaaaaggatgatctttaagcaatttggtataaaagccaatttcattaaatgcctcatccaagcgctgcttaaaatgatcactattagtcgcatcagcaatcaacgtgccgtcagctttaaaattatcagttgcgttccacaataaaaccggcgttggcaaaaccatcatctttaacatttgcaatatttcaacaaaggattcagcagccaacatcccaccatcactgtagtaagaataggtaacaatttggaccggcttgcgatcaacttccgggccaacgtaatccaacgcattcttcaaaacacctgggatggcatggtcatactctggcgtcataatgatatagccatcgcaggctgccaaggccttaagccatttatcttcgttgggttttaaattcttaatgcgatacgagagtggcgtctcatcatgttgatatgggtcaagcgggtaatccgcgacccgaatccagttgtatttgacactatcagagttttgatatgttttctgtaaatagttaaaaatcgaatcaccaagtgagcctgtccgaacagagcctaaaacaattccaatcgttaccataagtaaatatctcctcgctatataatatcgttatatatcttcatatataattgtacatcaaataaagaaaaaaatacctattaatttcattttttgatcgatttcgacaaaaatgagattaaatgccgattgtcttttatcccatccgcacctctcaccataagatccaccctggcttgacacccgttttgaagtgataatctttgacgcaaaaaagatccagccaagaaactaaataaaatcagtttcttaaccggatctggttaaaatacatgtcaacaaataataacgagcatctggattaatcattaggtgctttcaacggttcaatctcagaatagtcgaacgacttacctaacttccagaatcaactatcccgtcttagttcaactaaacttaatatttaactattcacttttttcataatttggtcatagacctcatcactaataatgtgattagtccacatccaaataatatgccccagcgcctcggatatatgctcttcagcgggttgctcctttggactaggcacaacgcccattgccggcatcactgtatggtgaaatagtccgtaaacaccaaggccaaacagggtcccttgcccagcgcgaataaacggcacgtaacgaccagcgacactatacaatactgcaaatgacgttgaaaagccaaaatggatcacgtagcttacccaaggcaacttttgctcagaatacgtataagtcgcgtgtgtaagggacgaaggaacaccaaatttttctaacagtttctgcggtggatttgttttatcacggtcaggagttctaggtggtaacacattttcccagcctaacttaacaagtcctgaaatgacacctgcaacgccaccagctatcaatgccgcttttaaatttacggatttactcaatgacaatcagccctttcctacgaccaaattcgctacttactcttaattcattctaaagcagcgaataatttgttacaagcaatgatcatttatttttcagctcacgcttctggtctgccagctcaattcatcgcaatcagtaacaatcggcagactactcactactccgccattaagcaaaaaagtggtgaatttgaacttccaaatcagcaaaacacttttttagaaaagtatctaatgcagcatctcctgtatcaggcgtcatttcaatcggcgttaacgattctgattttgcagaatcaactgcgttggcgatcttctcagtcgttgcggctgaatcgtccaattcgccaggataaataacaccaacaccttgaacgattgatttttgatgacgaggatcaataaagtaatcatatttgtccgatccatacgtataatcacttttaatcgaatccagatatcctgtcaattgttcccaagcaccacttgcccgccgagacttcatgaatactgacgcactccgatatttagtatccaacacaatggttgaaagtaatgtgtcctgctggtcaaatatatcaatccgaaaatccggtcgattatgtggtgagctaatccaaatcggatgatcgcgatcggtatcacttggtcgctgcggaattggttcatcgtaaacaacccttaggttaaaaacaggttgactgccattaactcgagttagcttaaccgctgtaccgggttcaagcatatcgtactgttcacgatcactatcgaatatccaaccactaattggtcgaaagcctaaacgctccaatgactctaatattttaataaagccccagaattcatagagtttctctgttcgtaaccaataagaatgatattgttgatgaaaagctgtttgttccttggaaacccgctctaagtgagccgctgcttctctaaaaaacaaataatttggattcatcaacgacccacttaacgccacctctagatgccggtcgggaatcgcctgcatccacggctgactcaatgtccgcagtaaattgttttgatacgtattcaaaacatccaaatctgcttggaagtcatcctgccgttgtcgaacgtaatctgcagctcgcggccgtgacatgatttcttcaatttgcctgatcagctgatgaaccttccgatatagataagtgagctgagactttagaataatgttatctcgcgacaagtagctgacccgtcttaccttaccgtatatctgattaccacgttccggatgagcggccattttctgaacaccacgaccatccaacgcgaccgccatctgattggtccattgatattgatcttgtagaaccgttcgcggattagcaccaacctcgtaaattgaccttaaaaagccggcttgttgccgatgcaaaaactttagggtaagcacatcttccggttttaaaacatcactatgattggtaaccggaccgttcgtattttcatcaaatgcccgggccagaccaacaattttactttcaacttcatagcgcatcttatcgagtaattttccggttaaaaacttaggccgaacttccaaccatgaatatttaacttcaccagaagctaaaaccaactttagccgccagcttcccggcaaataatgtcggtctggtccatattcttgttcttcataaagatccaggccacgatgattatgaccattggggaaaatgaaccggccatcctcatcttccttaatccgtgaatttgaaagcagatcaagtccatccaaatatagcttatcgccgcgagatccaagaaagcggatcgcatatcgaccattctcctgaatttccagtggcttggcactattttcgtcatcactaaaaatgaattgctgctcctcattggggtagccacgaccgcctaaatacttaataaataccttatcgtgcaaatccattcacctgtaattcttttgcttttcgcttcaaaacattccgtgaaagcggaaaggcagacagcttacttgattgatttaagatatccaccagttctccggctaactcaccctggcggtcaaagtggatgagttcttccagcatttcacgagtcccccgaatctttggtaggattcgttgagccacttggtaatcaaatgcgacttcagctgtataatcggctgttgtcggtgcattggcaagaaaatcttcaatgctgtcaagtgttcgccaactaataccaacatccggcaaactattgttaatcgacgtattcaaacgccagaagaaatcgagttcggtactcgtcaggctgcgtgagctgtcagccatatccttgtatgcatgatccgagatctccggaaaatcctcttttttcaaacttggtcgctgcgccattgcttttcgatctttaaatggcaccatccgcaaactgattgtgtttgaacgatcaattaacttgtcagacatttggaatgtcgattcgtcgacattcattgtccccacaaatcgaacgttttcgggaaccaaaatatgacttggatacttatccgaattatacaagcgtggctcaatatttttactgtaaagcgtaattaaacgatcttctggtcgacgctccaaaacagatagaaattgtgagaagtaatgctcaactcttgccaggttcatttcatcaaacaccacaagatacaatttatcaggattatgattagcgtcgataagtgtttcaagaagaccggaatccgccggccgataattattattcaatgtatcagcataacctaacagatccgcatcatcgttccaggatggccgaattgaaatcatgttaaattgattggattgaccgttgtgtcgacgaagaatcccaaacgcttcagcatatgcagtgacaatcttagacttcccggtcccgcttaaaccggtcaaaatcgtcaataaattggtcttaacggaattatgaaaattaattaagtcattgtcataaagggtcaaaccatattccttagaattaactgtttctcggaatcgtcgaatcaagtctaattcctggttttgctttggtgcttccgaaacgacgttacgagtggcttgccgagtagtcatctttttagcaacagccacattttccttggcagcctgttcatgtttggcaactgcttttggtgctttgttaaccactttttgtgatttggtagctgcttttttgacttccttcacaatcggcttgggcgcagtctttttagccacaccacccaagtttccagtttgttttgcatattcattaagcagcttggatttcagataacgttcaggtacaaacatcaagctttgggcttcatcaccgctatattgcccctcactccacttggcagaatcaatattgcgtacatgaatttgacgctggttggctgattcctgaaaaataatgtgatcatcatcagcatccttcacagaaaccccatcatacaaggtaccgaattcaccttgaccatgctgttgttttgactgaaaaacggcaaacgtcccaaatccctctgatgtcgcactgattaggctcggaaccggaaagacaacgctaccaccatcaaccaacgcatcttcgaatttctgttggtcgagattatctgtctcgtggaaaaccgggatcgtaacaaattggtcgtcgatttcaaaatcattatttcggggtagtcgttggatattttgtgcaaaaaaattatcctggccatttttcagtgatttgccagcttcaacatcgaagataaaaatcagtttacttaaaaactctgctaatttacgtttgcgattttcggaacttcgccgccgatcatcccggtaacccaggtttttaacttcctgaggataaacgttaattcgtttatcatcaaatttgcctgaatcgtttaatacccgaagaataaacattaaaccaccataagtgtcaataataatgccaccggtctcagaaggatcgccagactggtcatggttatcccaaataccgatataccgctttcccggcttagtttgtgtttgatttacatccattgtttcttaaatgctccttcattctttatttcggttactttattagtcccgactaaatttctgattgcgtagatatccccacccggaacttgcaacgtataaatgaaaacctgatcatacgaagatattggctgggtaattaatttatcaatatcttgaacgtgtttatatacagaaatggaatgcttattcgaattaaaaaaattctctggagcaataatttcaatatttttatatgccttttttaagcggatgatatcagtatgaatcggcaggccaatcaataatgttcgcatattatgtgctgtagctgacttgtcctgctttttagggtcatcggctgaatttgttaatttagaaagttgactactcaattgttgaagatttcgattctgtttgctgattgtcttggagtaattccgatttgtattcccaagattctcatatttaccctgaatcttcttaatatatttacttttttcgtcaagcacgttttttaacttagctttttgactcgttaattcagcctgcagattctgattttcatcaaccagtttcttgtattcttttcgcaattggccgagttgcgattcagccttttgagcagattgtgataaccgagtgatccgttcagcatcttgtctactttgcgttaataaacgttgattttcttgaagcaattgcgaatcagaagttacccgatcctttttaacagtcgatgttgatttaggtaccacatcttttatcacaaatttcttcgaagcagttcgaacctctttatgctgttgtttatccggcttaataagtgaagctgcttgctgtaaatcactagttccaaaatagaaaccaactagtcgataaacatctttttttgtcctgccgttaactgacttggactgaatctccgcaacttgtttttttctcattgtcgaaaaactttgtttgaccatctgaagagtcgaagaaagtaattccggcgaaagaagttgcgcgacaatcagttttcggtactgcggattcatgcgacgggccgctgggtcacctaatttaccatcgggctttataagcttgcttgcaacagtttttaaccgagcggacggcatccgagaaagtagccattctgcgacttctcgatcttccaagaaaacacctcctttctataactattaaatacgtaaaaacaagcgagtttaatcgacaaatatcaaaacacatgtcatgatatttgtcgacagcttgtttccaaacaattttaccataatttcaacaaatcatttaattttgatccgaaattcaaaaagcgtgtcttaaattgcttaatatgcattgggaaatggtaacagttttagtttcaaccttgccatgggtgcaataaagttcggctgacttctaatcatcattacagacgcaatcccggccatataagccactgaagcccagattcccaaagtctggaatctgagctcgttgcgcatgcgactagactaaaacgtgcaaaagccaagcagcttccggccatataaggcacttagatgcgtgtcgtcttaactgctaattattgattttacttttgctaaaacgtgcaaagtagacgcagcttccggccatataagccacttagatgcatgtcgtcttaactgctaatcaccgattttatttttgctaaaacgtgcaaaagccaagcagcttccggccatataaggcacttagcgtgtcgtcttaactgctaatcattgattttacttttgctaaaacgtgcaaaagagccgcagcttccggccatataagcccttcaaaccaatattctaagatcaggaatattggtttgaagggcttatattctggaagctaaccgcggctttttgcactctactccttttccccactccccggggtttcctcacccttttttatggtatacgattttgcaccgacaccagcgagttggccgcccttggcaatcaaataggccggtcggattggtttgttttcaaaaaagtcttcaagaatttcacgcgtaccggccgcataccttgcctgagccgacaatgacgttcctgacatatgtgggatcatcgcctggtttggcattgttcgccacggatgatctgcaggtgcaggttgtggataccagacatcacctgaataccctgctaaatgacctgactttaacgcccgaacaattgcatctcgatccactaattctccacgactgtcattaacgatataggcacctcgcttcatggttgcaatcaaatcatcatcaaacatatgataagtttgcgcatgcaatggtgcacacagaacggccacgtcaacaaccttggcaagatcctttacctctggcacaaaggtggcaccaagttgtttttcaacatcttccggcagctgatggcgctgcgtgtaaattagcttaacaccaaatggtttcaatcgttcaaggaccgcacggccaattcgaccagcagcaacgactccgaccgtcatgccttcaagatcgtaggaccgtgatgcggcatctgcgatattccaaccaccctcagtcacaatttcatgagccgggatgaaatttctaacaagtgccagaacctgcatcacatctgattcagcaacactgatactattgctataggtaacttcggcaaccgtaatattgtgttcatttgctgcattcaaatcaacgtgatctgatccgattccagctgtgattgctaatttcaaattcttagcttttgcaattaaatcagccgttaaatatgctggccaaaatggttgcgaaatgacaacgtcagccgttggtaattctttttcgaatacggaattcggcccttccttatctgaggtaacaaccaactggtgaccatgggactcaagatatttgcgtaatcccagttcaccggaaacactacctaatagctcgccaggggtaaaatcaattccttcaggatctggcacggttgatccatcggggtaatgggtgatctttggaattgaatcacgagcatactttggtggataaccattaacgggatctggatacaagactgctaatacttttgccataaaggtcattcctttctatacgacaaacccgccccaagtaccatcagtttaccacgcaagaaaccgtttacaataaataagtacttttttatttttcaactaaatatcaacaataaagtaaaaatcattgctatttaggatgagggttggtatagtatagataatgtatttatgagttcgaaacaaggttcaccgttctattaagaatgattccttttatttccggcttttgatgcaaaatttatcgcgctatgcgcacatggaggtttcattcttatggaacaaggtacagttaaatggtttaatggtgacaaaggttacggcttcattactttagagaacggctcagatgtcttcgttcatttctcagctatcaacgctgacggttacaagacccttgaagaaggccaaaaagttactcttgatgttgaagacagcgaccgtggcccacaagctgctaacgtttctgtagttaacaactaatcattaatttgataataaaagtcctcgattgagggctttttattttgtccaaataattagcttatcagctggtaatttgacgatgctaaccgctctaaatgaagtagacactttaaagcaataatatttatcaataaaaaaggttcaaacaaatgtccgagtttgtttgaacctttttttgaaggattttattccagtcttacttaccacacaataaatcataatgtatttaccatattctatttcaacctgctaatctacccaattagctgaatcactatttgttcctaacagcaacccattcacattaggatttcgccggaagaccccctttcggtttgaaagacatcccccaattgcaataaattatagcactataagaattattttcaaggttactttttaaatttgaaaaagttttttaaaaatacaaattatgagttagaacagatttaaaagggctagcaataaagtaccattctttaaacaaccgtattgtatccggctatcctttgccatccataaatgccggatacaaagtcatcccgccatcgataaataacgtggtccctgtgacatagcttgattcgctggaagctaaccaagctgctccggcagcgacctcttccggctttccaattcggttcatcggcaccattgagactgtctggtcatactgttgcttatcagcaaatttcttggcattaatcggcgtattaattgcgccgggaccaatcgcgtttacccgaatcccttctttggcgtactccatcgcaatggtttccgtaaatagtttaacgccaccctttgcagatgcgtaactggcaaaggttggccatggaattttttcatgaacggacgacatattaataatattcccaggcttgcgatgactcttaaaataattaatcgcaatcttggaaccaagaaagacacccgtttggtttacagaaatcactttattccaatctgcaagtgaaacttcatgggttggttttttgatctccattccagcattattgacccaaacatccaaatcaccaaaattgtccaaggcagcctttaatattgcggcattcccttcctcggtagcaacatcggctttaacgacaaccgcctttccaccactgaccttaacgtcaacagcagctttttgggcagactcctgatcaccattgtaattaatcacaactgacatctgttcttgcccaaatcgcttaacaatggcattaccaattccttttgatccaccggttacaacggcaactttgttttttaaatcttgatacatcttaaattccccctagaatgaaacaacattaaaagattgttgtcacaacggctccggcaacaattagtactaatccaagcattgtataggttaactctcggcgactcttgtgctctctcaaccaaataatccccagaagggttgaaaggacaactgatacctgagagacaacgaaggctgaatttaccccgttagcgccaacggacaatatatatgtaatcgccgcaaacgagaagatgagtccgccaataatattaatccaactaattggttccttaaatgtttttaattgatggctaaaaattaaatataggcaaacggcaattaccatgccaacggattcaggaaggaaaatcgccaacccggaggtactaagtcctttaggaattgaattgtaaacccaataaccagccgacgttaaaatcagcatgatcattgtgcgaacacggactttattatcgacttgagcatttacttcatcactaaccgacgttaaccaaattccaataatgagcaacaacacaccaattgcgccaaaaatcttttccgtacttgatgcccactcaccaaagataaacaccccaattagtgaagtcccgacaagctgcagaccggttgagacaggcattgtctgtgaaacaccaacatttttatatccggtgtattgccccgtttggccaacaatccagaaagcaccggcaagggcagctaagacaaaactttgccaagtaatttgtggccgaattgcaataaagaccccaatgctggcaattaaagtgccaaccgccgtcccgaaaatttggttggctggtttcccaccaattttagcaacgacaggtggcataatcccccaaccaagtgctggtaacaacattaaaagcgcattcaaaattctccaactccaatctctctttagttcagtcaagaactctataatataatgctaaaaatcaaatgtaaacgaattcttgtaaaaaatttacttcttttccgatgttttaaacaattttgtacattattttcgtatattctttattgtatcacaacacaaaaaaacaattttttagcaaaatagctaaaaaattgttatctatctccctcggactaacttctttgctccatgaagtgagatcaaggaaaaaattgatttatcttttaattaaccagttgccaaactgaaaaacagctgaattatcttacctcaaattttctggcttcttgggcgaagtaaaatttcattaatcgcgaccttgtcaggctgatcaatggcataggcaaccgccctggcaacatcttcagcatccaagccgttttctttctcgtccttttcaatctgagctctggttttctcatcagaaatcgtactgaataattcagtattaacggcacctggtgagatcatcgtggttttaatgttattggcaacctgctcttgacgcaagccatccataatcgcttggaccgcatacttagtacctgcataaaccgctgttccgggatgaacaacgtgaccggccactgaatcggtcgtaataatgtgaccgtgcttctgcctgatcataatgggcaacacggcagcaatcccgtacaaaacacccttaatgttggtatcaatcatgcgatcccattcatcgacttttaagtcagcgagctctgaaattggcattaagccggcattattgtacaaaacatctactcggccataatgggttgcggcatagccgaccaaacttttgacacttgcccggtcagtgacatcggtcttttggtaaataatttggccctttggaaactcatctgcgatttctttcaaatcgtcttctcgacgggcaccaataaccaatcgtgcaccggatttggctaataattcagttgttgccttaccaattccactggatgcgccagtaattacaatcactttatctttaatcgtcaaagaaactcactccttcttataacaacaaaccttagttcaattataacgatcttcaaacacaatggggtcaataaactaacgggatccgttattattttttcagatcttatttttttcatttaaatgagccggtttatttggcaccagaaaactagtgtcaaattgcgatcggtttttcaaatagcgcttaccaaattcgtcaatcaagccatgaaattcttgggcatcttggtacgtaaagttttggggcaacctaatttgtttcttcagcgtatcgtatttttcgacattttgataaccaagaaagctaaataattttcgtgcgtacttatcagcaataaatatcggctgatcaaatacgtaaaccaataatgagtcagctgtttcttcaccaattcctggaagcttcagcaatcgttgccttagcgatcgaccgtaatcaattaccatttgttcaaaatggcaatgatgctcgttaaaccaacttaatacgcttagtaggctcttggttttattcacgtaaaagccgctcgggcgaaccaagtcttgaacctctgtaacggataacgctaagattcgcttaacatctaagtcggttgttcgtcgcagattttctaaagctaaatcagcgttattccaattcgtgttctggactaaaatcgccccaatgacaatttcaattttcgtatcagccggccaccaatgctgtggccccatatgttgatacatcgtgcaatacaggggaattggatcaatcatcactcgatcacctttcaaataaaaatgtttaattcgacttatattataacaattgaaattgcaaaaaagagactggataaaaccttttccccagtctcttacggttcgtcattaaaattatttgttaaaattcatttcaggttacccgcgaagtttacgtgattggtaagccaaaaacgcccaagcgaccaatccaaagaagattggtccaataattgtccaaaatgcagtgacataatcgtgagccaagattggttgaattgccgtaaatccaatgccgacaatcaagacgaccaagacaacgcccacaattgtatcagtcaaccatcgtttggtatagatttcaaagggacgatccaaccccttctttcgcttaaagaacggaaatgctgcaattaagaaaatgtagggaaacgacgtagaaatatttcccatgttcgtcaaaataacataaaattgttgcgcgtcagaaccgccaaacgtgacgaagaagatcaatacaacaaccaagatagcctgggtccacattgcaaatgccggcatcccttttgcgttaagtttcgtcatccttgctggccaaaactttgggtttgatcccataataaatgacttcaaaggtgagtaaattaaaacaaagaacgatcccatataagccataaacatgcttaatccggcaaaccgggcaaaacttgtgccaagaattgtggccgcatttgcagataatcccaaactgtggcctaaaacaacccccaaattgttcatcaagacgtaggtaatatttccaaggttaacggccttgccgcctagaacctgatgccaatttgtactaattccccaaaggaaaatggagattgagtaagcaaacgtaatggcaaccgttgaaatgattaatcccttaggaaaggtcttctcgggtttatccatgttatccgtcaccgcacccattgattctgtcccggcatatgcgaaaacggcatagacaataaatgacatcaaggcaatcggcgactgaaaactgggattaggagattgtacaaagctttgaataccattggcgggttcagccaaatgaccgccatttaagaacaaaataacaatactggcaatcgcaaatattcctgttaacaacgaaacaaaaattccgccaatcgaagatacttttgaaattgaatcaattccccgaaccgcaaaccaggtcacaaccaaaatccagagaattgccatgacaccgatcatttgatttgagttgagccccaacagcccccaactctgcgtttgatcgtggccaaagatcaaggttgaaaaaggaatccaaacttttgaagcagtcgacatcatccaagtaatccaagaggaataccagataaacgttccaatgaaggcccatttttcaccaatggaaccggctaaccatgaataaataccaccatgggcgtccttaaaagtagcaccatattcagcaaacatcagcgtacttggcagtagaaatagaactgctcccatgatataccaaataatacttgcatagcccatctgatcaaacgcgacggtggtgttggcaaatccgtaaatggtcgaaaagatcatcaagataagactgattaaggtaatttttttctgcttcatgatattttcctcacattaatataagcgtcaactaatttggaactttagaatagctcatttttattttattgcaactaatatgtatcattttttcatttaatacggcaacgatgaataataatactgctgttagcttaaaatgccgttattaattggtgagggttgagttagaaaataaagagtgggatcagaagcggttagataccagaatataagcaacacaaccccatattcctgaatttggaatatggggttgtgttgcttatatggccgggatctgcttctgatcccacgtttcagcataataaataatctaatctacaagctaatatccttgttttgggatattggttggcagggcttatatggccggaagctgcttgttagaccacgttttggcacaataaaaagttcagcaactaaccatctccctcaaacttctccccaactaccaaaatcaccacgactcattttcatacaacaatccacaaagatgctaaccaatatcatccaatccataaaaaagaggcccggagcgaccatcacgatcactcaggctcctaatttcttcgcttaatattcaaatttttaacaacgatgctaccaacaaatgccggcatttcatcatttactggaaattgttatacagtttttcaaaatcaaccgttcccaaaccggtagcttggttgtaaatcttaccaggttggcctgtgtagtacaaattggaattatcagttgcgctgtcaagcgtcgtaaacggcgttttatccttatcttgagccaatttgtatatttgtggattccaaaagcccatacgaccacctttaccactattaataacggcagttgctccgctgaactgtggtgcaacggcgcttgtcccaccaatgtttgaaacccagccggtcttcttcatataaatttgataaccagtcattggatccgcatttgcagaaacatcagggaagttacgcccataatcagtaccactaagcagaaccggattcatccggggctgaagggcattggaaataaactcacgagcattgaacgtattaacacctgaaacaccttgttggtactgtggtgtgccataaacgtggctaataccgccaccaccaccatttaataactgagaataaagggttagattggataagaaaacgtttcgatgtttggcgaaggctttaaacatatagtcgccaccccatgcccgttctttatcaaccgagaatttcaaaccatgaccataatttttatggaacggcagggtcgtcccaccagtcgtggttacccatggattgtcagcgggaaaggttccgtaaatactataatttggcagttgaatggcatttaaaattttaccaccaattccaatgttataagcaccggtatcaccagaagcaacaaatgttgaaatcccctgcatagcaccttgagccatcacaatattcataacttggccgtaaaccggattaataaggccttgattttttaagtaacgcataatgtactcacttaagccatagctcaaagataatgaactcactcgattttcatcaaatgccgttgtgaatgcatcaaccatgccaacatcgctaaactttgattggtaaacccgaatattggcttgaggtgcaatcgcacccgactgctgaacatccagtgtcgtctctaaaccataagacttttcagcagctgccccaaatggagacggcgcactaagcttcttaacactaatccggttgggtttagtcgcaatatgttcacctttccaataatgttgggcatcacgtttactgaagccgccaaaagtaacgacccctaacgtttggccttgtccgtaatagcctttatcgtacagggactgtaaatgatatcgattaacaaacttctgaggtgcaaattgtttctcaggcttggttggtttcttcttggtcactttagtctgaaccttggtcttcttgttggtcttatttttagatgatttggctgatgcggcttgagcccccgtttgagtcaggccaccgcccattttactattaaaactagtgattcccagaactgtcaaaacattgtcagctaatttagccggcattttgggcttcttagatgaaaactgaacgggattgtcacgatacttagccgtttgtaagttcgtattaaaagctttattaacattcttagctttccctgaaaccttaatcattaagccattactatagttgtgagtctttaaatggtactttttaaaatatggtcgatactgaccaaccacttctgcattttgaccaaatttagcacggaaacttgcaggattataaaaatgtttaaagtcctgattcccaggtgtattaaccgcataaatctgatcggccatttgattctgatcccgtggcttcaggacaacctcgagttgcacctgcttgtttggtgaaagcttttgcttaccacttaactgttttaggagcttattgatcccataaggatcctttccagccgctttcttttttgatgccgcctgggctgccggcgaaaccaacagcaacgctgcaaagctgacagcgccaacgaaccatttcttcttcctcaaattcctcaacttcttcctcatattattagattcaaatttccccaaatcattgctcaaattcacacctttagaatacgctcaaacagtaatctagtgcaattgaaaacgcttttgatcttatccttaattcaccttttggttatgtatggattctaatcctgaaagtgaataacggatcaatggaatttccctctcccaaacttctcaaagatgatcatcatcccttagatcgtaaacacgactaccttattgtgagattacgctattcttgaaattgtgtcaatatcattacaaaaacatgacatttgcaatgtgacaatttctccaccaatttaattgatcgcataagcaaaacactaacacacactcttattttcgactagcaatgaatacgttacatcaggttacctttcccgtcgttaaagcatttctgatgaattagttttcgcttaagtttgttttgggtttccgatttaagtcatcctttaaaatcactagctaactgctaagagacaaaaaaagaacccagtctttttatcaagaccagattcctgcttagttttaaataattaacagattgttagatactaatttttcccattgagaataagacaattcctaatattgcactactaatcactgccaccgttaacaatgattccagcttgttgaaccatttactgccagcagcatctttacgagcgtgcataaatagaaagaatcctggaatgtaggcaattgaacacagcaacaaatactgcaagccggccatataaatgccgatgctttcaaaggcaaatgccagaatgccaatcaacagctggacccaatttccttttacatggatgtgttgaaaagaatatttaatctggtacgcggccacaaataaataacagacaacaattgcagccgtacaaagtgaataggcaaaattatatgcccggtcagtgaagatcagggtacatagaaacccctggattaacaagccacttacaattaatgagaatgtcggcgcaccatgtttatttttccgaccgaaaatagcgggcaataaattccgttttgccattaaactaaccgtttcggccggtaacattgtccacgacagccatgagccaagtgttgagataaccaatcccaagctaatcaaggccccaccccaggttccaaccatatctttaaaaatataaaccattgccggctgattaattgtcgtcaattcggaccgggacatataaccgtatggcaaaagagaggctaatacataaattgtcagcagacaagccagacctaaaatcgttgctttgccggcatcagattttttcttagcccgcgatgacatcatcgtggccccttcaataccaacaaagacccacatcatcaccatcatacaattcttgatctgtgagccaacggttgcgccaccattgaaattccctgtcatgttattccaaaaatcagcagtaaatagatggcctttaaacaagataattgcaaagacaataaatgtgaatagtggaattaatttacaaacggtaattaccgcattcaaaattgcggcactttcaacgccgcgattcactatggctgttaagctccatgcaatcacgctggcaaccataattgatgggacgttattgccggctttaaaaattggaataaagtagccaacggcactcatcatcacggtcgcgaaagccacgttgcccatccatgacgataaccaataaccccaaccgctgataaacccggcatattgaccaaatccggcttcggcataagcaaagataccctcaagatcaggtcgtttcaaaacaagattatttagagataacgccagcatcaaaattcccaatccaacgatgccccaagcaatcaatgccggacccggtgaggctgcttttgccaaatcagaagttagggcaaagacgccggcgccaattgaggttgtcactgccatcgcagttagcgaagttagtccaattcccttcgggttcgttatttgattcgtttgagttgtcatggtgaacacttcccttcatcataaaatcattaatataagccaattggcattgatgtctgtcaatgcttcattatagttagaatatcatgtcagatttttctcacaaaatttaaaacctatgatttgaataccaaaatcgactgtaacatctttacatataaatgttaaaattttgcgaaaattattcacattttcggtgaaatcagtgctaatttgcataaaaatagaatatttaagaccgacaatccagaatatgctactatttctgactttagaagagattgattccagacattaacgttaattggaatctccagatttttatataccagccgtcacaccattacgaacattaaataagcgttttcaaccccactattatcagaacgtgctattctacattcaaaataactaatcaaggaggccaatgatgactgaacaaaaaaatggtgttcaaatttaccatgaactgtttggcaccgaaacacatgatccaagagtgatgtttgaaatgctcaccgtaaacgtcttccaaccgggcctgaactggcgggttgcagccagtaaactcccagtttttgacaaggtttttaaacattttgatgtcacggaaattgcaaaatttgatgaacaagatctcgaagaattagaggcaaatcctcagatgattcgtaatccgcgtaaaattcgggccgttgttcaaaatgcccaggccactttaaacctgcagcctgaatttaaaagtctggctgattatctgtggtcgtttaagccaactcattctgacgcggatattattaagggaccacttccccacgattcccacacattaggcacgttggttgccaaagacatgaagaagcgtggatttacgtttgtcgggcccaccacgatcgaattactgctggtcagtacaggtatcttgaaacatgagcccgaataaatgaacgatgaaaggaagtctttaaaatggttgaaaaagtgacattaattgtcggtcctggacacgctggcctcggagaagctcttgcaagacgatttggttctcaaggtaacacgatcgcgttgctgggtagaaaccaagccgaccttgatagtttagtacaagtgttagccgacgatcatatttcggcattcgcggtgactgccgacttggctgatccggcaactgttagtgcggcattaaggcaaatcacggataaaggtgagcttcaaaccgttatttatacagcaactcagcgaaccaaaaacaaaccggctgaattaaccgccgacatcttgaatcaaagccttcccagtaatttaatcggtgccattaccgtcactaatttggcacttccctatgtcaagaaaaccggtaacggggtctttctatatactggtagtatcgtggcagccaaaccaggcccaagtgacgttgaacagtcaatcggcaaggctggcttacacagctatgttttggcactgaataaagaattaagcaaatcaggtgtttttgccggaatggtcaccatcaacacgtatattcggaaaggaaaatcaggtcacatggatccaaatgtaatcgcaggtgcttttgagaacttggcaaatgaccgccaaccggcagaagtccagtatcattaggaatccgacagcattcgttattgaaaattcaaacagcagtcaaaagcaattttgtttttgactgctgttttcttgtaaatactgacatgtaagcgtttatctcctttaatgttaacttgaaaaaagattgtaaatgggctatctttttgggtatatgctttttataaagttctaattacatagtaagaaaaataaaatacggggtttatcatggataaaagtaaagtaaaagtctcatcaaaaatcaaactatctcaaagccaccacatgacaattccgtggaataacttcattgaaaatgataatgttctggctaaggatgccagtctaaaggaacgggcctcagttgttggccgggttggaattcagatgttagcctgcgggacaggagcttggcgggttcgtgacgcgatgaacactgtctcacgagttttcggactaacctgttcggctgatatcgggttgacaaccatcgaatacacttgcttcgaagccgacctcagttattctcaggtactttcattgccaagtacgggggttaatactgataaattaaatctactggaaaatttcgcaatgaattttaaaaaagaatgcgctggtttaacaatcaaacaaattcatgcgagaatcgatgaaatccagcataaaccaggaagctattcaccggttagtgctggactagcggctgccttagcctgcagtgccttcatttttctacttggtggtggtctccccgaaatgttctgctcatttgtcggtgccggtcttggtaattggactcgccgaaaaatgattgataaacggatgaccaccattgccaacgtggccgtgggtgttgcagtggcctgcttggtttatctctgcatgtttaaagtatttgaatacgcctttcaaattccagctcaccacgaagcaggttatattggggcaatgctattcgtaatcccagggtttccatttattaccagtatgttggatatctccaagttggatatgcgctcaggactggaacgacttgcctatgccattatgatcaccgtcgttgcaactttaattggttggctggtcgcattaaccgtgaatttaaagcctgaagattttatcccacttgggattagtccccttgtcttgatgcttctgcggctacctgccagcttttgtggggtcttcggcttctcaattatgtttaacagctcgactcggatggcaactgccgctggactaattggtgccattgccaacaccctaagattggaactggtggacctaacttcaatgccaccagccgctgcggctttctgcggcgcactggttgccggtttacttgcatccctaatcaaccgctacaatggatatccgcgaatttcactcaccgtgccatccattgtaattatggttcccggcctttatatttatcgcgccgtctatagtatcgggattaactcaatcgcagttggcgcgctgtggctcacaaaggcggtattgatcatcatgttcctaccgtttgggttattcgttgctcgagtcttgttggataaggaatggcggcattttgattaattattcaaccagttgaaattgagacaaaagatgttttttccaacagttaaataataaaagccaatattccaagattcggaatattggcttttattatttaaaatctgagagctgggtatttaccaccctactccagacttttagtccaattttttcttatttaaaacgttcaatttatcatcaaaatcataaacaactggttcaccggttgccatttcaagattcatgatgtcctcatcagaaatgttttcgatgtacttggaaagggcacgtaatgaattaccatgggcggcaatgaccacattcttgccatcaagcaataatggggcaatcttgtcttcccagtatggcattactcgttcaagagtaaccttgagattttcaccaccaggaacaatatgtggatcaaggttggcataacgacggtcgtgaacagctgaaccttcgtcatcagcactcaaaagtggtggcaaaacatcgtatgaacgacgccaaatgtgaacttgatcttcaccatacttttcagctgccttagccttgttatggccttgcaatgcaccataatgacgctcgtttaaacgccatgatttttcttctgggatccaaagctgatctgagtattccaatacgtaatgtaatgtcttgattgcacgggtcaaaacagaagtgaaagcatagtcgaactgaatgccggcttgtttgattaatttaccagcattgatagcctgcttaacgccttcttcgcttaaatcaacatcaacccaaccagtaaattggttagataaattccattcactttgaccatgacgaattaaaacaagttttgccaatataattacctctttctaaattctcttagtcatatactcattagattttacaccaaatccaccggaatttcagccctaatcagaaaaaagcagtttggacattctcggttacccaatcaagacaaaaacgaacgtcaagatatcctaatacctgcgtttaaagtatacttgaattggatactttctatagggaggataaaagggaattgacaaaattaacgactattttgcttggcgtttctgccagcctgtgtttgttgggcagcacctcgcaaacgactgacgcggcggccaccaagcttagcaagggttacataagtgtttcaccacatcattattacctaactaaagcaaaaattcttactactcaagggacatcaactaaacggttcaaggtaaccattcccaaagggacgattcttcagcccggttatacaaccaccacgaaacgtggtcattcatatctccaagtttccgttgatgagctaaactacagcatccgaaaaccgtttttggctcacaaatcaactgtcagctacacggcttggattgcagcaaaatcgaccttttttaaacgggtcaaacggccaacttatttaaaatattatccaggtaaccacattttcccaaccggtgcatcacgaatcgcccgtaatgatggtaatctttggcagggcactcaattaccagccgattatttaagtgcgaccgccaatcgaattcgagtgacaaccaacggctatcttgaacattttagcaagtcacccttctattacagtatcagtgggaaaccagatagtacaacaaaagtccagaaggcactctactttaacaaaggacatctcaatttgtactttaagacaaagcctaaaaaaattgcaaccaccaaattccataaaaaaggcaactatcgctatcgactgattattaatcggctgtatcaaaatgcggtcactaacatttcaaacggaaaaaatcctgccgatccattaaacgttgattacgtcatggtttctggaaagtatacagttgccaacaaggactactacatgacaactgaatcaattaatttagataattaaggggaattatgtcatgaaaatcattcatttgttagtcggtgccatgctgggcgctgtgattatcttcaacatccccacccacgttgcggctgccgatacctacctaaaagttaccaaaaacagcttcttaaaaacaacccgtcagatcaaaacctataacagcaagaaaaccatttcaatgacgatccctaaaaatactgttgttcaagtagcaggagtcactactcgtaacaagaagtgttacattgatttaaatgcgaatcagctaaactataagattcgtcagccgctaattgcgaataacagcacaaccaaatggacccattggatttctaccaacaccaagaattttaaacgggttcataaacccacatacctcaacttttacgcgattaacaaatcctatcccaagggggcttatcgctcatatgtcgctgatggcaatctatggcaaacgactgtctggccggtcgatccaagtacgcaatctgcagccttggttcaaattactgccaatggctatctggagtattctcaaagtgttaatatgaccagcctgctggcacccaagccaaccgattctcttcaaattcaaaaagcaacgtactcggtaaataacgggaaattggatttatactttaaaaccaagccaaaatttgcagaaactacccgaactaataagaagggaaacaatcgatatcgactcgtcatcaaacggctgtttgcatacactgcaaccccaattactgcaaccaatgatccaacaaatatcagcaaaattgaaattgggagtcgctatcagattggcaaaactaattatttgatgcatctgggaactgctgagattaagagcaggtattaaaaaagttagctaccatcagccattaagaccacgataaataaggactgggacaaaaataattttgtcccagtccttatttgtgtaatcaagattattaccgagtggaaatgtgagataaaaggcaacttcctgccgaacaaccaatcttatcggctattttttcggatccggttcttttggtacaggaacggtttcatcatggcgtttaactcctaggatatccaggaaaaatgtaaaaattgggacgccacagatcagcccccagataccgaagaaatgttcaccaattaataaaacaacgaacgtatagaagattggtaaattcgttcgtgaagccataaagttaggatttaaaacatacgcctcaaaagcatggacaacgatgattgtaattaacagataaaagacatcctgaataccaccaaccgagtacccaaccagcgataacgggacaaaagaaataataactccggcaaccggaatcaaactcaggataaagaccattagtgccaacactgctaattgtggtaaatgcataaatgccatcacaatggtagttagaatcgtattgcaaattgcaatgaagaactgggcttcaatcaccacgccaaaagttgaaacaaatttcttgccaaagaaatataagtcttgaaagaaccaaccaaaatcgctttgcaggaacgttctcgaaaaggtatccattgtttttttctcaattgaaaagaagaagctcaaaatcattgacagaaacaatgttacacccatcgtcccaattccagtgatgtacttccaaatcagagaaacaccatttttcatttgtcccatgatattactctgtttaatgagttcatttacccaatctaaagtattatcatctggtaagttctttggatttgaataaaaatcaatgatatctttggttgagccaatggtttgctccgcgatccgcggaatatagattgtaatcgcataatacagcgccaagatcaccactaaatacaggacggtaacgatgacttgtgacggaattttgacatgccgtctgaccaaattagtgagtttaaccaccaataaacaaaagataaaagttaacaaaatcgtactcatcatacttctgacaatgtaaagcaccaaaattgcgagcatcaatacagcaaatcttctaagtggcacattattaacaaatcttgaccaaaccgacaaacaaccaactccttctcgaatcaattttagttttccctctgggtgatcctaattctactctagtgaaccggtttcaaacaaggaaatgttagttgatttatcaaagggggagagtgtgaagaaaggcagttatgctctggaagttgccttttgtctcacatttttgcttggtaatagtcgtgattacaaaaaatgggggctggacaaaatcacttttgtctcagccccccactccccttttgaatgaagcctagttaaacacaaacctgatgtgataccaatcaatttgtcttagtatttttctttaacatactgctggatcgtttggtgattagcatgggcgcccttaataacgtttcggacatcttgatcactcatcgcatttgaatcaacaccggctgcgctaatctcttgacgggctttggtaatttggttattcgtaatcggcttaccatttacctctttatccttcttagtaaccgtgtattcattagatcctttgtaatcattggctgccttcttttctgaagaagtcagactagcactgctactggaagaaacattgggattgttagtcgtattctgattagaattggactgttcaaaatcattacttgaactagccgtactactcccggaatcaaacgttgaaccactgattgcattgttgttttgcttttgcagcttcttggcttttgtcaaaatgctagtgtagtaggtttgcttgatcgatttgtcagcgaagagtttgtccaaagtactattagattgtacgtactttccctcaccactctcgttcaaggcctgatcataaagcttattataggtcttcatattgccctgaatggttttaattgtatcgattcgcgtctgagcccgatcctttagttgctcgttacccttctttgtattggcaacggattgataattgtccttcgcagttccaaactgctgattgtcaaacgattcattggcagcgatgaatgattgggtctgattaagcagccgactcgcttttgtatcgcttggcttacgtttcaaggcgttggtaaatgatgtttcagccgacgggtaattctcatttgaaatttgaaggctggcgcgttgcattgcctgcgcgtataatttttcattttgactatgacgagcatatgcataaccaccaaccgaacctgcaataatgatggtaatgacaacccatatccatttcttcaaaatttgccctcctacattataattacgtttaagattatcatcgttcacaatcccaaacagttgtaaaataagtctcaacgtaattataacatttttgcagccctgacattcaagtgtttagtcgcctagattaaaaggtataataaatatgaatggcgaaatatccagagtgagacaaaagcggttaacttccagaggtttactctgcaggttgaattgtgagatgatccagttggacggcaggaagttgtcttttctctcatattttcgctcaataatagttgcgattgtccaaaaaagctggttaaaataacgcttatttcagcttcttgatgattcagccaaaatatgacaccagttgaaaggggaaaatttaatgcttgaaaaacacttctatcgatcatttttgaaagacgcttttacaattccggttcaggttacatattgggacggcaaaacagaaatctatggaaatggcacaccaaaagtcggtatcacatttcatgaagcaatcccgatccgccaaatcattaaaaatgcgtcaaccgctcttggcgagggctatatggatggcaaaattgatattcatggtagtattgaagacttaattacgtccgcttacgagaatcccaacagcttcttccacaacaaaaaattcattcattatctaccaaaagtctcacacgatgaaaaagaaagtgccaaagatgttcaagaacactacgacattggtaatgacttttaccggctctggttggataaaacaatgacttattcctgcgcctactttaaaactcctaatgatgatttagaaactgcccagaaaaataaagtcgatcatattctggcaaaactaaatttgaagccacaccgttcccttctcgatattggttgtggttggggaacattaatgctgcgggcagcggaaaaatatagcgttcacgttgttgggattacattgagcaaggaacagtatgattacgtcaaccagaaaattaacttgctgggtctcaaagatgtcgccgaggtcaaactcatggattatcgtgagttgggtgatgtccaatttgactacattacttcagttggtatgtttgaacacgtcggcaaagaaaaccttggtgagtactttaattgtgtcgcaaattatttagctcccaacggcaccgcacttattcacggaattacccgtcaacagggcggtgctctcaacggctggatcaacaaatggattttcccgggtggctacatccccggcctaactgaaaatcttgatcacatcgttgaaaatggcatgcaaatttatgacttggaatcattgcgccgtcactatcagaaaacgactgagacttgggatgataattttaatcatgcccgcggccaagttgaagatatgtttgataagcggttcgctcgaatgtgggacttgtatctccaagcatgtgccgcttcatttcgttccggtaatattgacgttatgcaatatctcatttcaaagggaccatcaggccacaatttgccaatgacaagggaatatatgtatcaataacgtacttttgccaaccaagcagttaatttaaaggctggaaatcaattcaaaaaatcaggttctgcttagttatgccattcagtaatcacaatcaaatttttgcgatatcagcctgccctctaacaacaagacaatttcagaatactctggtatagtagcgttaattgttcaggatgaaaggagcctctgtaatggcaaatgaatcagaagagtttattaagcagcatatgtttggtcagcccgaacttaaaccagacgaaaaacgagcatttttgggtaattttcgtgaacgcgttgccttggcgttaaccattcaacaattgcgtcaacccgaaaccgttaagatggttcaaaatattgttgaccactatcccgaataccgaatgtatatcaacggcaaaatgccagactcgcttattaccaaatttatgaaacttgcggtccaatcaaattatcaattcaccattctcgttcaaaatggtgttcgagttgaacaagaggttcattcaggtgattttggattggttatcgcttcaccagataaaaaaatcaaacggcgaattttgttgtaactttattgatattgagaagccgatgaaaacgggactgggacaaaaataattttgtcccagtcccgttttgtgtaatcacgattattaccgtagaaaacgtgcgccaaaaggcaacttcctgccgcgtaaccgactttcgtccctctctctttgtttgttatcaattcttggatatcgattagtggatccgaaacgtggaatcagaagcagatcccagccatataaacaaaataaacccacattccaaattcaggaatatgggttctgggttggatacttggccgaaacgtggtctagcaagcagatcccggccatataagccattaaagcccatattccaaaatcaggaatattcggctcggtattggttatctagccgaaacgtggtctagcaagcagattccggccatataagtcaactaaagcccatactccaaaatcaggaatattcggctcggtattggttatctagccgaaacgtggtctagcaagcagattccggccatataagccaataaaacccatattccaaagtcaggaatatgggttttattggcttatattctggaatctaaccgcttgctagaccactcttgttattttaacaccctaaaccgttccgaatcctcaataaaatctttgtcccctgctggtgcttcaattgagccaaagtccaactgcgctctgagcttccagctatcaggaatattaaaggcttcctttacttggtcatcgatcagtgggttataatgttgcaagttggcgccaataccattttcagctaatgatgtccaaacagcaaattgggcatttccttgcgcttgttccgaccaatcagcaaagttatcagcatacagtgcaaaatcattttcaaaacgatgaacaatttcttcgtcagtgtagaaaagaaccgttccaaaagcagctttaaagccgttaatcttttccaaagtcttttgataagcagcctcagttgggacctccgacttcagacgctttgcaacaatgtcccacaacttttcgtgattctcattaaacaaaatcacggcacgggttgtttgattgttaaacggagttggtgcccacttgatatcttctttaatcagattagcaatatcatcctgggattgttcaacgttacggcctaatgcataaattgaacggcgtttcttagctaagtctaaaagttgttccttcattgtaatacctcgctttatttatttcttattcaatgtttataagtatatcaacttacttttaataagtaaaggatttttagttaatttcttaattcaatgatcccgatatcaccattaacatgattgactcatcccttgcgcgctttgaatttttcatgtttaacgccacaaccacccctaatactgacaattatcctagcccatcatttagttctaatgttcacacgtcatcaaaagtaacgtgaggcaatagccatgatgacacaaaataaggctggacaaaatcacattgtctcagccccatcacaatttttatttaattttaaatgttaatctaaaataatcacctaatattgactacaaaaacagcgccaacataaagacagcagccagtccaaggacaaccgaaattgccattgagcgtgtccaaaaggcaatgccgatcacaataacagcggccaccatttctgggattcgactgaaagtcactgcataatctggcgaaatgaaaagatccttaacaaccagtgccgtgaataatgaaatgggcacatacctcatccattcattgaaccagtcaggtatttttcgagtacgaaaaaatagtaacgggatcaaacgtggtgcaaatgccacgcaaaaacacgctaatatcagccaaacatgttgtgtcgtgttccattccataaatcctactcctcgtcattaatgtcttcatcaggcccaccagcaaggtttttaattgacctgagccaaccactctttggatcgaactttcggattgtagcttccaccgcaaatccaatgaaagaggcgactacagtcgaaataaccaatccaagcgttgatttggtaagaaccatgaaaaaagccgccaagaagccggataaaacacagattacaataattaaaccgttctttgactgcatcacaatcatgtataaaaacaatgcggtcaaggcaaaatggacaatcgttaaatcaatattaatggcactgccaattaaactcccgatcaggttgctaaccgtccaaaataacaaagttgtgtgttcgacgttcaaagcatctttgggcgtgaactttttatcggttgaaaacttcagatagtttaaggcgtaattttcgtcattcattgacgccgcaaatatcgctgtaaagcctagcgactgcccatgtaagtatttggaaagactcgatcccagtaacgcatacctcaactcaagaaaaaacaacatcaggataaccgataacattggtgaattagtcgccagtagtgaagcaattaaaaactgcgcaccacctgaaaagaccatgattgacaccatcaacgttgtccaaacattaaatcccgaagcatgcagtaaaataccacacgccaaaccgattggaatataactcaagtctactggtaacgatgcgtctaaaatttttttccaatacggcgcatccttatcaattcttgcagcatttctacccaaaaagatttcctccatttaaaaacctttaaattcagatttaactgtttccttaaatgctccgcgcccgacaaattatgccacctaactaaatttagtcaattattctactcaaaatctcagttatgtaacttttcgacacacatcacatttcaatgtaaaaataatgtaaacacaattcaagttcaattatatgggatattgaacaattaataaacacttttacggcaattcattttcaaaagagccgcaaaattgctcgccataggagaacaaacggattggccttttttaccgacttgtttgtgaacaatttgattgtcccctgataagtagctaagtactttggcgcctgaccattagcaaagagtcttgcagtcccagccctcgtattcttcttagcaggtgcggcaatttttttaggatgatgcaaatatttggccgtaatttgctttcgagaaatggccttaggtgcccaaacccacgttttcttttggttcaccacatcaacactagtttgcttcccgtcaggtacctttgccagatgaacgcctttgacctgactattttttgaaacaataattggatgttgctttgtgaaaacaaatttcattaatttagctgtttggataaatcgagctggatccgtggcactatcgttacgcgttcccaaaacaactgtaataattcgatggtgttgccgggtagccgagccaacaaagcaagcaccggccttatcagaagtcccggtttttagtccgtcaacgaccgcgccacgtgcaatttgcttgttgcccagtagttcattgtgcccactaattgccgtcccataaaacgaagactgtgcttggctggtaatttgagttactttaggaaaacgtttcaacaaccgactggctaatagtgcaacgtcattggctgataattcattttcagcgttggcattaacccctttcaaggctaacccgcccgtcaatttattcgttaacccggaggcgttgtaaaatttagcatcggtaatccccaattttttggccgtttgattcattttagcagcaaattggcttgaacttccggaaacttcttgacccaacgcaattgccgccgcattcgcagaagcaactaaagtagcattgactaacgcacgtactgaatacgaatgaccggatttcaatggcacattagtcaatccagacgctgtgctaagtttagccactgccggggttatcttcacaagatcattccaagatagttttccctggctaatttgttgatgcacaatatagatcgtcatcaacttggaaattgaagcaattgccaacggttggttagcattcttctgatataagatttgccccgtattagcatcaacggcaatcgctgcctttgcataaattttgggctgagctgtttccaccgtgctggcactaacataaggctgggtacttaatggtaacgcaaataatgcaattgcaacgagaagtaatttaagcttggacttcatagagatcccttctaattggtagttttaggtgcttgatctttcttggtcagtcgatcaccgtgtttaacggggagatgaatagaaaacgtcgtcaatctttcatcggaactaacactgatataacccccatgcaaatcgataatactctgggcaatcgctaagcctaagccagaaccaccagtatctttattgcgagaagcttcgacgcggtaaaagcgttcaaagatttgatctaaagatttctgagggatctgcgacccgtcgttagaaacatgaatgatgacttctccaggttggccggtttgcgcatccaaataaatgtgcttgccatctttcccatatttgatcgcgttggaaattaaattattaaaaacccgaccaagcttttcagcatctgcttcaatatataatggctgatcagtatctttggcagaaatggtcaagcccacttttttggcttccaattcaaaacttgcaactaattgttccatcatctgatttaaatcaattcgattaattgataacggggtcccggtttgtttaaccttggtatactcaaacagattgtcaaccagtgatttcatctgcttagcttttaaataggcaacttctgtgtattttagcaggtcttcctgactatgatactgcttgtcctggatcaatcccagatagcccaaaatagaagttaatggcgttcgtagatcatgactgacgttagtaatcagttcatccttcgaattttcaattgcccgctcttcatccattgatttaatgacactatcaaccaacgcattgatactctcaacaaccgactgggtatttcctttcaacttgaagccaattcggtgatccaaatgcccattcgcaatataatgaagttcactaataatatggcgcagctgcatttgatgataacgccgaataagacgccaataaacaaccgcggcgtcaaagaccagcattaatgtaataaaaatgttctcccagctccaaagatgaaagtgatcaggtccaattaagatcgatcgtttaataatgaaaatgccatcccggaggcccggatttgtttggattgactggttaatcagaatgataatcgacagatttagcaacaagagcaggatgaccgttacaattccttcaagaaacaattctgttttttcacggccggttaacttcaagatggtccctcttccttcaaataaaattgacaacaatgagacataccaattcttgccaacttagtatgacaataggttggtgaattgatccttttcgaaataaatgactataacttgtttaagtggtttaccggaaagcaaattccagccatataggcaccttaagcccaatattcaagcccggaatatttcttttttggactggttacctagccgaaacgtgctttaagaagcagatcccggccatataagcaccctaagcccaatattcaagcccggaatattgggcttagggtgcttatattctgggatctaaccgctttctggcacactctgttctaatggctctcaatcttatacccgacgccccacaccgtttggattaccttttcaccgtttgtggcatcctcaatcttatctctcaaatggctcacatgaaccatgaccgttttagccgagacaatactctcctgacgccatactcgctcgaaaatttcatccgccgaaaagacccggttaggatgacttgctaacaggtacaggatcccaaattccaaagccgtcagctgaataggcgtgccagtgattgttttgacttcgtgtgaatccttattgattgttaaaggtccaatatccaaaacatccggggtatcatttttaacatgttcctcagttcgtcgtaaaagcgacttaactcgcgccatcacctcaagcgggttaaatggcttagtcacatagtcatcggcaccgctaatcagcccctgaattttatccatatcttcagtcttcgcggataaaataataattggaatttgggaatctttacgaacctctttaatcacttcaataccattcattcccggcatcataatgtccaaaatcattaagccaatatcagactcagtccgcaacttggataatgcttcttggccactatatgctgaaactggttcgtaaccttcatttcgaatataaatttcaagcagttgagcaatctctttatcatcgtcgacaactaaaattttcatcattaatcaacctcattatttttaaattgttattgttataagttatcatttaccgttaaatttgtcgttcaacactgattttacactttctagtgtaactgacaactcttagaaaaccaacttaaaagaaactacagaagtcgcagtgacgcaaaagacagctttctacccagtcatatcactctgctcactaatatgtaaggaatcaaaacctgccatcccaaaccatccttcaaaacacaaaaaagccggggcaaaatgatcttactccgactccaagcattaactcagtgattaattaaactactcgtctcctgaccaacaaccaacgaggctagatgggttccaaatttaatggcatcaatcattgacattccctggctcagcccagcaatgattccgccacaataagtatcaccagcaccaattgtgttaacaactcggtttttctcagcggttattttttcctgcttgccatcatgataatataacgtaccggcttcacccagtgtcactaataccggcgcgttcgttcgttgattaacctgcgtaatttggcctgccagattactcccatttccccagagttctccaacttcatcctgattcgcatgaacaatcacgtgttgcgtcaataatcgtgccataattttcggtgagagataggatactcgcggcgaaacgtcaaacaacaggtaagaatctgatcgacgatttgctagtccatctagaatcacatttgctgttttggggtcttccatttcataaccgcttaaataaaaatattggtagtctttcacgttaatattatcaaaccactctggtcgccactgctgctcgaccccttgaatcgtcacaaaagttcgctcaccgttgggctcaacaaatgacaaatcccagccattatcaccagttgaaatggataatttttcagaaatctttgcccgctgcatttgagcccgaaccatatcagcatattggccattccccaccggtacaaataaatcagcaggttgttcagcatactggagtgccccataaacattaaaggccgaaccaccaatgttatactttcggaaattagcagtcacgtcctgaccagatgaaggcagctttggtaattcgagcacaatgtccacaaacgccgcgccaatgatcaatgatcgactcatcgtgttaccccactttttcgctgaatccgtgcgattttgacaatcagcattgacccaattgccaaaaccgctgcaacaaagacacccaaactattattccgaaagatgccataagcaaatgggccattccaaatggcattattcgtaaataagaatcccgtaaccgtcgaaatgatccaggaaataatgccaccccagttgtatttgaactgcgaattagggtcaagaagcttgatatcatacccccgctgtcgaaacatcacgctatcacagagaaaaatagcaacccaactggccaaacaaatgcccagaaagttcagaaaaatttcaaaattacctaaaaaattacccgaaataaataacacatatactgggatcaatatcacaatagccccatgaaagatcaacgaagtccgctgagaaacgttaataccaatggttgctaaattaattcgagctgatcgaaacgaaataatgcattgtggaattaggccaccggctgcaaccacaaagtaaatcgcaccaatccagcttggcagtgccgcatacatcacgccaaacggatcaccagtgccggctaacgtaggttcaatcgtacttaaaacaacgccgcccgccattaaaatgaataacgggacagcaccacccaacgtcgtattccaaaaagtagcagccggtttagtcgttggcttaacatacgcaccccagtcagccgctgccattgaccaggaaacaccggatccggccgcaacaatactaacagccggcagaaaaccagttacccaatgaccacttggtaaatgaatggccgccgaccaatttgcttttaccaaaaacagccctaatatcacaattgttaaaataccaaagatccaacttaaccaagtttgaatgttagccaacgttttctcacttaaaaccccggaaaataagaccaggccaccaaaaataataagcgagaaaccaaccgtcacattgcttttggtaaaaccaaaaaacttaaataaagaaaccaacagcaacgatcccgtgatgacattcactgccaaccagccaaccatgttgagccaagcgatagtattgggaatcttattaccttgactgccatacgcagctcggctcagcttaaacgttgtgacaccttcccgttggccaatcatcgccacccaaccgggaatcagaaatgacaacgacccgaccagagatgccagaattgcttgaaaaaacgacatgtggtaactcacaatcatcgctccaaacacaaaccccatgatgccaacatttgcagcaaaccaattataaaataattttccgggcgtcagtgttttatcaacagtcggaattttaattacgttgtcgtccaagacgatcacctcattaagatttattttgattagagagtgggacgaaaggaagttgccttttggcgcatgttaccactcggtaataatcgtgattacacaaaacggggctggataaaattacttttgtctcagcctctaaaatccgtggcgggaaacaacttccttgactaattcaatttaaagaatacctgatttctgccactggttcttccactattccgaaccatcccgaaatcgactaatcacttctgcgtattgtttcaaatcatgatctggattttgttcatcgattaagtcaacccaatcagaattgattgtatggtagccctgcttggcaccacaaattgccgttgccatcgcaccaattgtatcggtatcaccgcctaaattggcacacattaaagcacattttttaacatccttagtgaagtaggcaatggccaccgccgcgggaacgctttccgaaatcaacgtcccagtgccgattaaattataaatttgggtcataaatccactccgattgtcaatgtgccgattggccgtataaattgccatctgcaggcgctcatgggtgtgggcagaccaagttggcgcgccaagttcaaaccccaaatcatttgcttttagggcataatcaataatttgatcccaggaataatcggctaccgcagccgtcactgctccggcaatcatgcaagccccactaatcgcaacatcacttgaatgggtaattcgcgtcacctgatcaaccatttgaacgagttcatcgatttgggcaggctcatataacgtgccgatcggcgaaatccgcatccccgccccattagttaacgctttatccgttaccggacgtgggtctttaccagccttcacagctaatagtgccgctttactgctgggtcctaaaatattaaattgccatgcaccaactttgtctgcccaagccataatatgcttaaccaagttagccgcagaaggctgccaatttgtttcaattagcgagtcaagaattgccaatgcctggttcgtatcatcggtgtactgcccacgtttaaagttcttggcaatatcgttatttttgggactattgagaaaatcagtgatgggttgcttaaactgttttttgagtgtttgaattggccaaagctcggatggcattcccatggcgtcgccaattgcctgaccgtataatgcgcccaaaattttatctgttgatctcattaatcggctccttggtttacttaaataccttatcgcgctgcaacaactcatcctgtaaattggccaacttttgggtaatgtaaaccggaaattcgtctgggttaaccaagcgttgtgtggcagccggaatttcagccaacatttccttgctatatttttgaatatcaaacactgcgggtaactctgttttaagactcgttgcatccaagatcttctcttggagcggtactgcatcataatcatcaatcatgtggtcgcgtttggttgccaacggattggctttaatcacatcaattggcttatccaatttttcatcctgcagcgcaatcacatccgcaaaagcatgttttgtgccagggtaataaagtcgatagacctgctttaatccaggcaaggtcagcttttcacgactggcactgactttaatctttggaattaattgatcgttttgctcgatcgccgccagcttataaacgccgcttaaaacaggtgatgacgcactggtaatcaacttttcaccaaccccaaaattatcaagtggcgctccttctccaagtagcgattgaatcacgtgttcgtccaaggcgttggaagccgtgatcttagcgtctgggaatccggcgtcatctaataatttgcgagcacctctggcaagttgtgtaatatcaccagaatcaattcgaatgccgattggctgatgcccggcttgctttaatttcctaaagactttaatcgcattagggaccccagacttcagtacatcatacgtgtcaaccaacaaggaggcattatccggataaacttccgcccatttctcaaaggcggtcaattcatcaggaaaggcctcaatccacgcatgggccattgttccggcagatggaatgccgaactttttagctgctaagacattcgatgtgctggtgcagccaccaatcacggcggctcgggcaccatacgtggcactttcagggccttgtgcacgacgggcaccaaattccataaccggtcgcttgccagcagcatacgtgattcgccgtgccttagtcgcaatcagtgactgatgatttaaaatacttaacaagagtgtttcaaatagctgggtctgcaaaagcggtcctttaattgtcagcatcggctcacgtggaaagaccggcgtcccttcaggaattgcagatacctggcagtcaaatttaaatgtttttaaataatcaagaaaattctctttgaacaaatgaagtgagcgtaaataagtgatatcgctctcgtcgaaatgaaagtcctgaagtgatttgacaacctgctcaagcccggctgaaatcacgaagcttccctgatctggaacctttcggaagaagatatcaaatacaccctgttcttcatcgatcgtttggcgatacccatttgccattgaaaattcgtacaaatcagtgaccattgataaattatccatcattaaatccttcttcatcattatttggtgtttccttaaaagtacattccacttttatggttataaaaataaaagtattgaaaacttttattctaagttaacgcttctgttcaaaaatttcaagtctaaagcgccgctaatttgtaaacccgagcaggccgcccaggccgattttcagttgtggtgcccatatctgtaaataacttattgtgacttttcttaaagttagaattatcgattttgttaacaggtgtcttaagaaacggtgaatagaccattcgagcatccttcaaggtgaatttggcacccaaaaccaaaagaatatttggttgatagtccaacttgtttcgaatccgatcacaggctatttttaaaatccattcatgatcaaaggccaaatgtttcgtcggatcaagattggctttaacaaatttcgcataaaacatggtttcggtactattaatcgcggtttgaaaagtttgttgaccatcactgaacgtatagcaattatccccataccccattgagaaccagcgggcatcagaagcgccgtagccagcctttaattgcggtttgtccggtaaaaacgtcatgtaggctaatgacaaggttcgatcacctggggtccgcaatttattagtaaaggtagccaactgctcggtgtgactgccggataaagccattccaattttttctttaaccaaacgtagtgccgcttcatcagcactctcttgaaaccgcatgaacgtttcgggaagcgcccaatagccattgtagggttgattatcacgcttcaccaacagaatgttcactcggttggtcgtgtgatcaaaactccaaataatgttagtaatgttaataaatggttgttccaagatgttagatgctgccaaatgaaccatccccttatcataagtattgttaatgtttggatttaaatcgtttgaacataagtgacaactatgttaattttagtccattttggggggaatgaaaatagagagtgcaaagagaagcggttagactccagaatataagccccttaatggcatattcccggttttgggatatgccattaaggggcttatatggccggagtctgcttctcctttgcacgtttagactcggtagtcagcccacaaaagattattcccggttttgggatatgccattaaggggcttatatggccggagtctgcttctcctttgcacgtttagactcggaagccagctcacaaaaatattccaggctttggaatatgggattaaggggcttatatggccggagtctgcttctcctttgcacgtttaggctcggtagtcagcccacaaaagattattcccggttttgggatatgccattaaggggcttatatggccggagtctgcttctcctttgcacgtttagactcggtagtcagcccacaaaagattattcccggttttgggatatgccattaaggggcttatatggccggagtctgcttctcctttgcacgtttaaactcgggagccagcccaaaaagaatatcccggttttggaatatggggtcaaggggcttatatggccggagtctgcttctcctttgcacatttaaactcgggagccagtcccacaaagaatattcccggttttggaatatgggattaagagacttatatggccggaagttacggctccttcacacattaggctcgataaccccaaacaccatatccctaaattttgaatataaactaaattaccttataagacagtttcagcaacaaacatccaaaagaaagtccagatactcacgagtgaaacgaccctctgcacagttgacaatcaattagtaacaccagcctgaccaactcatttttaacgatcgcttttattgcctaatctccctacgatttgtacaattaacttgatactagatatccattattgctgttgagaattgaattatccaactcttaatttttttattttgacacttttgctcactagttcacagaggaagtgggaccaatgttaaagaaaatattgatagcaattgctttgggtacattaacgattgtcattgctatatttggtttctttgtcagcacaacatctgcaactgaaatcactccagagggaacagcaaggtttgatagtccacaggcaacaatcaatatttcaaacagttcacagccttatcaggttatttggatgaatgcgatcagagcatggaatcgaactggtgtatttagcttttctttaagcaccagtccaaatgcacaagtgatagctggcactaattcaggtatgagcgccaggtttaccggtctaactaatttaacaaccaacgatcaaggctatatttcacacgtcacaaccaatctaaatccaaaaatattagcaaagtattcttacctgccaactgaacaaaccaatgttgccgaacacgaattgggtcacgcaattggtttattgcacagtgctaataaagccagcgttatgtatatcaacaatcgtacctatgggattcaaaatattgatattcaggcagttcaacaattgtacggctcaccacttggaagtcaggcgtttccctaccaaagctatacattccaagatccttttgttttgaaggtgaagggccagccagaagaataactcggattctgactagtcgttaaatgttccgataagttaatcccgaaagtctgcaaaaagggaccaagacatttttgtcttggtcccttccttcattaaaataaatgtatgattagcggaattttataacatattgtattctaactttccggctcgtagttcggtgcttctttagtgatgataatatcgtgaggatgtgattcccgcaaaccggcatttgaaatttcaacgaactgagcgttgtcattcatgtctttgatcgtggctgaaccggtgtaacccattcctgaacgcagaccgccaaccatttggaagacgatgtcgttgattgatcctttatattcaacttcaccttcaattccttctggaacaagcttgttggcttcattcacgccgccttggaaataacggtcacttgacccatgttgctggctcattgcagcaacacttcccatgccacggtatgatttatatttcttaccgttttgttcataaacgtcaccaggcgcttcttcagtaccagccagaacactaccaagcataacggcggttccaccagcagcaagcgctttggcaatatcaccagaatactggataccaccatcggcaataattggcttgccccatttacgggcaactgaggcggcatcataaacggcagttagttggggaacaccgacaccggcaacaactcgagtcgtacagatggatccgggaccaattccaactttcacaacatcaactccagcttggaataaagcttcagttccggcagctgttgcgacgttgccggcaattaaagtggtatcaggataatgatcacgaatctgggcaatcttgcggagaacccctgcagaatggccatgagcggtgtcaatcacgatggcatcagctccagccttaagtaacgcggaagcgcggtcaaacgtatcggatgaaacgccaacagcggcggcaactaacaatcgatcttgatcatcaatggcagctttaggcgtcgcatcagtcttcttaactgctttgacctttgcgacttcacctgcttgggcttcaatgctcaagtttttgtgaataacacccaatccaccaagtttagctaacgcaattgccattttcgattcggtaactgtgtccataccggcactgagaaaaggaacatttaatttcaaattgtctgccaattgtactgataaatccacatcgttcggcaatacatcacttgctgcaggaattaacagcacatcatcaaacgtatatcccttttttccgaacttttcatcccaactaaccatctatctcgctcctttttaaatatcgattgcctaataacttatcattttgccccgcaacaatcaacgattatgaaaggattctcatcacggtctcatgattgacgctactatgtcacaatctaacttgtagaaattgttttgattatacacgaactttccgaataaataaagcctttttaactattttttagttgaaataggaattatcataaattcatatcatgtattgttcgtgttttactttaaaacggccaaataaaaagtccaccatcgagacaattgctcgataacggacttagtcaatctggatttaataactcgttttaacgctaaaacaacccaccggtaatattccagcgacgcttgacgaagaaagccgcaacagcacccaataatcccagaacaatataagcatatggattaagaattggattaataactgctggtaatattcccgcaaggaagaagataaacatccaaactaagaagaacagaataattaacggaattcgaacccacagcgagtacttatgcttaacaccgggttgaatcaacattgttagtgccggaatacctaatcccgcaacagcagccgttacgacaattcctgtaattcccatagtcgttggatgacttgttttggagaagaaataagtaatcccatacaagaatgaaaagatcacaaagaacaacaacatattgtatcctgcattgggccagtaatccttgatcggatctgccggccgcttaggtggattcaagatgctctcaactttttgatcaactgttccccacatattacgggcagtttttccagacttctgctcagctaataattcatcaaccatttttttgacaatttcaccttgctggtcagcggttagtttagtgccactaattgcctggttgaacttaaacatatactcggcatttcgcttggttaacccaatgttatcaaattgagaatggacaattttcgttgtccggtcccgatcctgatggacattggcgtttttttgccgaacattggcattacgccgcttttcatcactgttactactcaatagctgttcgctccttaaaataatctgattaaattcttcctgacatgagagtcgaatgaaagccggtgacatggccggaagtcgtctttcttcgcacgtttttgttgaataacaaattttgattaacttaaaatggactgaataaaatggtatttgacctagccgctagccagaaccgtctcattagacgttaaatctaaactcaacaatgtcgccatcctgcatcacgtaatccttaccttcaagccgtaatttaccagcgtccttaacagcagctggtgtttcgtatttatcaagatcttcaaaggccataatttctgcccgaataaaaccacgctcaaaatccgaatggataattccggcagcttgtggcgccttggttccctttttaaaggtccatgcacgggtttccttaccaccggccgtaaagaaggtttgcaggcctagaagcttgtatgaagcccgaatgagccgatttaagccaggctcctcaacgccttcagcttcgaggaattctttcttctcgtcatcatccaactgtgcaatttcttcttcgggagcagctgcaactccaatagcttgggcaccctctttttcagcatattctttaatggcaggaaaatacttagaatgctcaggatcagccatatcttcttcagcaatgttggcaacatatagaactggcttactggttagtaaaaacaaacctttgacaattttttgctcgtcttcatcaaaagcaatggatcgaaccgaaccaccgtcttccaaaaccggcttgattttgttaagaacggccaattcagccttagcttctttgtcgctgcccttagcagcccgttgaaccttacccaggcgtttgttaaccgcatccaaatcagcaattcccaactccaggttaatggtttcaatatcatcaattggatcaaccttaccggtaacggtcgtgatgttatcatcatcgaatgcccggacaacgtgaacaattgcatctacctgacgaatattttccaagaacttgttgccaagtccttcacctttactggcacctttaacgattccagcaatatcagtaaattcaaaggttgtcggtacaaccttcttggcggggattaattcttgaatccgatccaatcgtttatccggaacttcaaccatgccaacatttggatcaatagtagcaaacggatagttggccatttcggcaccggccttggtaattgcattaaataatgtcgacttaccaacgtttggcaaaccaacgattcctgcagttaatgacataactcaacaacgcttctttctagtttatttttcagctttaacaaggattttctttaattttcgatcaaactctcttcggggcatcataacgatatggccacatcccgtacattgaatcttaatatcagcacccattcggatgatttcccaacggttcgtgccacatggatgtggcttcttcatttcaacaagatcattgagatcatacatattaaacatcctttctaactcacccaagagccctaatctttaatctaagttgacgtctaacatctcgagaatccggtttaagtcatcctgagatgcatattcaatttcaattttaccctttccctttttacgggaagaattcgaaattgaaacttgtgtcccaaacttctcttgaagttggccttcggaggctctgacaaacggagatttacgtggcacccgtttctttttagtgccttttttaccattaattttggcggccgcctgctccagttgacgcacggtcattgaatcagtgaccgatttcttggccagtttgattaattcctgcttattattgactgaaagcaatgtccgtgcttggcccattgataatttattatcttcgagcatatctttaacttcggttggcagccccaggatccggagatagttggcaatatatggccgacttttacctaatctggaagcaacttgggcctgtgttaaatcaagccgggtcattagcatattataagcttcagcctcttctaaggtcgttaagtcttcccgctgcagattttccataacagcaatttccatcatctgttcttcattgacattacgaacaatcgctggaatcgtttcctgttgggcaattttagacgcccgcaatcgccgctcacccgtcaatagttggtaagcttgaacttctggattgggttgtcgaacaatgatcggctggaaaacgccagaattcttgattgaaactgccaaatcttccaaggccttttggtcaaatcggtgacgtggttgataaggattaggcttaatttgattaaccttaatatcaatcacatcttctttactagtgtcaacattattatcttgaaaaagtgcctcaattccttttccaagaccggttggtttctttttattcgccatgatttgccaacacctccttggccagtttcatgtatttcttagcgcccttcgacttcgcatcataatccataattggtagtccataacttggcgcttcggacaatcggacgtttcttggaatcaccgtttcataaacctcattcttaaagaatttacggacctcagcgttaacctgaacacccaaattggttcgagcgtcaaacatcgtcaacaatacgccctcaatcttcaaattgggattaaaatgtttcttaaccaactcaatggtattcaaaagctggctcaatccttccaaagcatagtactcactttgaaccggaattaagatcgaatcactggcagtaaaggcattaatggtaattaatcctaacgatggtggacagtcaatcagaacatagtcatactgatcttttacctcatcaagggcggctttcaggcgggtttcacgggccatctgaggagtcaattcaatctcggcacccgacaattgaatggttgccggaacaatatctaatcccttgtgttgggtatgaacaatggtttcagccattgattcctcattgaccaaaacatcgtaaatatccttcttaatgtctgctttggcaaccccaaccccacttgtcgcgtttccttgagcatcagcatcgacgaggagaatctttttacctaaggaagccataccggcacccaaattaacagcagtcgtcgttttaccaacgccacccttttgatttgccagtgcaattacaaagctcatctgcatccctcctcatcatttactttgccctaacggttctttattcggtgtcccaggtttacgaggatactttcttggcgtttcatttatttttttgataacaataatatggcgttgttcgtccgaaattggcaacgaaaagtcatagtcatcggccaaccgaccacctaaaattgaaattgcggactgagcatccttcaactcgtcctcagccttggcagccttcatggcaaccattaggccaccaactttgactaacggcaagcaaagctcactaagcaccgacatcctggcaactgcacgagccgtcaccaaatcaaatgcttgccgactggatgactttttgccgccaaattcttcagcgcgagcatgtaccagtgttacgtcagtcagctggagcgtttcaatcaacgctttaagaaaattaattcgtttatttaatgagtcaacaatcgtaactttcaattgtggaaatagaatttttagtggaattgatggaaaaccggcaccggcaccaacatcacaaatagcaagtggttgatctctaatttgtgaaacaaaaaaggcaggcgtcacagaatcatagaaatgttttaaataaacgtccgatcttttggtgatcgtcgttaaattcacgtgttcgttagttgcgattaacagcttaaaataggcatcgaactgctgcatctgttgatcgttaacttcaatgccctgatcaagaagggcttttttaaattgatcgttgttcattatttagtctcctgaattgtgaaacaatctgtttcacgtcttattatactttaccttaaaatcgcttatatgacaagggcagagtacgctaaaagctttcagaaatgaatccgaaaatgacactttcaataaacaatgataattcaattaccggatgttcctgattcttgaaaaaatcaggaagatcacattgatatgatggtttaatcatatgaataatagccatgcttaataattaaaatcagacttaaaatccgttatggctacttggccgaaacgtgcattaagaagcagatcccggccatataagcacgtcacgcctaacagtcaaaacccgacttaaaatttgttatggctacttggccgaaacgtgcattaagaagcagatcccggccatataagtacgtcacgcctaacagtcaaaacccgacttaaaatttgttatggctacttggccgaaacgtgcattaagaagcagatcccggccatataagcacgtcacgcctaacagtcaaaacccgactgttaggcgtgacgtacttatattctgggatctaaccgcttcttaatgcactctgtttcttaacgcactctcatcccgatttccgtactgcgccacatgttccctgacaatttcaaccaccactttggcaacttccgccattgcttccgtgcttacacattcatacgggccatgaaaattgtcaccaccattaaataagttaggtgttggaatccccttagccgtgataaaatcaccgtctgtcccaccacgaaatggcgaaacgtttggcttaatgcccagtcgcttataagtatccaacaccaggttaacaatgtatggattctttctaatcgcatcaccaatattttgatattgctcagttacgttcaactcaattcgcggttgatcaaatcgagcattaatccggtcaacaattttttgaagcaaatgctcccgttcacggaatttgtctgtgtcaaaatcacgaataataatcgtcaaatccgctttagaaattgtcgcattaaaatcggtcactaaaaagaacccttgccgatcgcggctcttttccggaacttcatcttcaggtagcccattaactatctcgttagcaagactgattgcattaaccataagaccataagcattcccgggatgaaccgatgttccatcaatgctgatttcggcctgagaggcattaaacgtttccggttcaatctgaccgggttggccattatccaatgtataagcaaattctgtcccaaatttttcagcaggaaattgttttgcgccacgaccaatttcttcatccggaccaaagcccgcccgaacagtgccatgctcgacatccggatggcgtaaaaagaatttaaacgcaccaaggattgccgcaatcccagccttatcgtcggcccccaagagcgttgtcccatcagaagtaatcaatcgttgcccaataaatttctttaaattaggaaactgctgcgtacttaaaacgatcccctgtttcttgtttaagacaatgtcatcaccattataatctggatgaatttgaggtttcacattttcggcactataatccgctgtatctaaatgggcaataaaaccaattgatgccaggtctttatcagaattgcttggcaaagttgcaatcacatacccattactaggttcatattcaacatcagtgattcccaactttttgagatcgtcaacaatcattttagctagtttaacttggcctaggctcgttggcaccgtctgtgttttgggatccgagcgcgtattcacttttgcatatttaataaacaacgattcgatatactcactgtcaatttcgtccatgctgcccacctacttcttaatttcttcagatgaatgcgtttatccaagacatttggattgattacgttcttctttacttcgcctgctcaattggcatgcccacataataagcaataccaactatcagaataacttcgatgaatttacttctttaatatgtcaactatacgtcaactgacaatttttttaaatggcttgcatatccgatttttctcaaacaaaaagactggaacaatagtcactttgtccagtctccgttcgtgtaaatacgattgctaccaagcaaaaacgcgggacaaaaggcaacttccagccgtgtaaccgaataatccgattacactggaagttaagcgccctttgtcccgctctgaccaaaataagtttatcaattatttttgaattttgctaacttcatctaagaaccattgattaaatgcatccgcatcaatatcaacacaaacattggcatttgtcttaccgtcgtgataagcaccacggatatcaccaactgtttcaccaattgccggaccatctgtgacaacgtcaatccacatctgcttcgtggtaatcgcctctgggtgcaatagatagaaaatcgtattaacatcatgcatcgcaatcccatcatcactgttatcgccgtcatgaataataatatcatgcagcattttaccagtttcattcatggtggctaacttctttagtgaatccggtgttaataacgccttcattgtgatatccaaaccaaccattgtgattggaattcctgaatggtacataattctggctgcatcaggatcagtaaagacattaaactcggccgcactggtcatatttcctttacccagtgaaccgcccattgcgacaattcgttcgatgtgatctttaacctctggatactcactaaataacaacgcgatattggtgtatgatccggttggcaccagcgtaatcttttcatcactactcataatggcatcatgtaatgcttcaacagctgtaacatccaatggcttaggtaagtcctctggaaaatcatagcctggcatccctgactcaccatgaatccgagcagcatcctcaaattctttaatcaagggttgcttggcaccagcagcaactggcacatctttattgaaaaagcggacaatcttctgagcattcttcgtggtcttatcaaccgtcacgttacccgcaacactggtaatcaactttaagtcaatttgtggatcatttaaggccatcgttaaagccgctgcatcatcaattcccggatcggtatccataattatcttaattgtcattgttattttcccctttggaacattattttaaagtagtgcgcttaaaaccaagtcgcacaagaacaaaacacctaatatatacgtcgcaacggtcagttccctgacctttccggcagcgattttcaggattgggtacgttacgaatccgaatgccaagccagttgaaatactggtcgtaaacggaatcaaaacaacaattaaaaatgcaggaaaccaatccgaaaaatcgaacatattgatccgattaagctggttcatcatcaaggcacctgtgataataatcaccggcgcaatcgctgcttgcggaacaaatgatagtaacggaataaaaaacatcgaaattgcaaacatcatgccagccacaattgccgttaagcctgttcggccaccactttcaattgcagaggcactttctgctgccgcaacagttggactggttccaagaatccctgaaataaaactagtgacagaacttgcttgaaacgcttttttgaatttcttcgggttgggcataattccttccaaaagccccatcgattcaaagactaaaatcatcgtcattgaaaagcaggccaaaataaatggaatcgaaataattcggctaaaatcacccttagcaacgatcgcactatacttggtaatatcgccaattccaactgatggagatgcttgatccttaattccaaatagaattccgatgagtgatgtcaccaaaatgccaatgaaaaaaccacctgtcacgttgcgaataaacagaaatagtgtcaacaacaaaccaaaaatcgctaataaggtcgctggtttagtcatatcacccaacgccagaatcgaattttttccctgttgaatgagttgggccttttccagaccaatttcaactaggaacaatccaataccagcagtgatccccgctttcaatgcatccggaatccctttagccaatatctcgcttagcttcgtaaacgcgattaagatataaatcaaacttgaaaccattgaaatggcgactgcttcctgccaagatagccccatggcaacaaccacagtataggtgaaaaacgcgttgacacccattccaggcgtcaaaatgactggtgcatttgcccagattcccataatcagacaaccaaccaaagacgaaataatggtggcaaaaacgcttaaatcagttggaatccctgcatcttttaaaatcatcggattcacaatgatgatataagagatggcgaaaaagccagtcactccggcaatcatttcacgtttgatgagtgtcttatccttcaaagcttcacgaaggggcaacttgttagcgacaacttcttctctttgtttcttatccaaacataaaacctaactttctagctcaaattctaccaaacaaatagtccgacaattccggcagacattagtgaaaccaaaatccccgaaagtaacatcgttccaacgttcttactgattaaatcgttcttttccttatcaaccaatcccttgaaggcaccgataatcataccggtcgttgagaagttggcgaatgatgtaatgaagaccgtcaattgtgcttgataatggtgtgggaagattgcaagattattgatagttccggcaattttacccataacaacaaattcgttggtaactaacttcattcccataaattgagcaaattggaaggcttgattaacatcgagtcccattaaccatgcaaatgggaacatgatgattcctaagatgtgttccaatgacaaccatgggttgaataatgccaaaatcttgtcaatcaatgcagccaaggcaacaaaggcaataacgttggcagcaatgattaagatcaaacggccggcgccaagaattgagtcgcctaagaatgagaagtaaggttcacgtttaccatcagcttgaacatcgccagcctcaatggcagcttggctactgctggagccacccattttagcaatggtatcttcttcaggagccactttaacaggattcagaatactcgtaataatcaatgcgtttaaaacgttcaaaggaatggcagttaatacaaattgtcctggaaccatttgcgtataagcaccaatgattgaagccgtaacacatgacatggacattaaggctaaggttaagttacgttttgctgacatttgctttaattgaagtgatgaaacagcaagtgcttcagtgtttcctaagaacatcatttcaacagcaaagaatgattcaaacttaggtgcgccagtcacaaatgaaagaccgcggccaacccatttgatgacccaaggcaagatcccaatgtaagttaaggtatcaaacaatggaacaatcatcaaaattggtaataacgcactggtaacgaaattcatcgtttttgcagttccaccaaattgtggcgttacccagtttggtaatgcaaaattaattccagtgtaggcaacctgaaccaaccaattgaaaccatcagcagccgccttaacagcatcacggccccacttaaactcggtcagaacaaatgcgatcaacaagttaagtactaaaacaacggcgactgaccgccagttgatatctttgcgactcttggagaataatagcgcaatggctaaataaacaacaatccccagaatattaattgctagatacatatcgtaaaatcctcttttctgaatttataaacaataattgcaaaacaataaacgatccctatcctccctatagattgaaattggttttaagttttaaaccccgtttgatgtgtgaattaattgtttaattcacttaaaaagctatgcccgatggactctttggcaacatcgagttgaaagacatcggcaattgttgagccaatatcggctaaagtatgacggattcccagcgaactgccttcaggatccgccggtacatatgccagcagtggcaaatactcacgagttggcgtggtactgattgtcaggtcatcagcgaacgaagcggtaatgagtaataaatcagtcttatacatctcattaattaaccgggcaatttgttggtcagcctcccgcagtgattgcacatacgcgccaaagtcaccggtctcagccgccttttgtaagcctagaatcttggtataaattaatccatcgatcggtgccactgcttcgtgatgaagtgattgatacgccaacttatccttgttaaccgcgataatatccgacaggttctgattcgaaaaatagctctgataattcgtgataataatcgaacgagcatagttatcgctatatttaacaatcgggtccaggacactggtcacccgaattggatcttgatagtccagcatttcacgaagaccactttgacaatcagtcgccgtattcttttcgtgaattttgccaaaataaccaatcggcttatcaacaggcgcaatccccaaaatcgggtcaccaaaccggatattccctaaccctaatttgctcaaggtcggcagctttaagttaatcccctcgtggctggcgacgtgacccaaagtatctgcgccaaccgaattaaatcgattagcatcactggcttccccgattccgagtgaagccaggtcaataataattacgcgtcgaaaattcattcaagacccttcttttcccctaaaatattcggcataaaatatgtaattctaatgacaaggatactcaataatctaaacgatgtaaactaaaatcatcgtaatgtgaggaagtaataccttttacctaattgattgcgctttcattatatcaaaaagcattcgcagttacaacctttaacttaatttttgtgaaatgatgttcaaaccgtatcacaccgccaactgtgctcaccaatcaggatcaattaacaaatgtaatttgcttaaatttttaacgattcgaagctgattaaccactgagcttcattatttttaattttgtcaacaatgaagctcgaatcaagacataagaaattttgagccgtttgaataatgaccaattgaagatggggcatcaggataaaaccagcatctaatactgctaagcaaccattagcaactaaaataaaattggcgatgtcattttgaaatttttgaaaaaaagacaaaaaaataggatttcagtttgttttgatatgcaaactggaatcctatgtggtagggatgattggggttgatacccacttcataaataatctaatgtcttatcgcctcaatttaactatcttgttgatctactgacgcaaactcgattggttgtttggataatcactattgttaaatttgccgtgagatcaactttcggtgcttcgtgaaactgtactacatgaaactaactcgtatgactgtacttctttggtacgtgattcctgtaacgatgattcgtaataccttgttacttgtacctcaatcaatttgatatcacatcaatttgatatagttgccaattgaactacttcgacttagtacaagcgacctctgtacataacccttttcaattactccatcaggtattcaatactagatcttttcgctcatgcaaccaaatgaacctaatttagttatattcaaatttttaccaccttgaaattaacttggttacttcaacatcctactcatttgaacctctaaaacttgaaacacatgctctgaataaacttgttactccgaaacaattgtgcttaatttcaaaccttcaaactcatattcttttgaactaaacatccattacttcaaactgcgaaacatttgaaaataattctttctacaacattggaacttgttggatcagagaacattcaaagtaggttgaaacccctatgcttcgaacttccttctcccttaccacatctatatcataccatatctggaagcgtttgcaacctttagcccttactttttaaaattattgctaaaagcctactattacggcgatttaacagcaattgaattgtccgagcagtcttattcacgggacatctaataaccaattttagttgagacattgcctatcatgaaaggcacaaacgagcagttaaccgtcactgatctcgcaaacacctatgattactggccaaatatcggcaaaataaaaacgctgggaaaaattgcttatcccaacgttttacatttgattattcaattctttactatctaaaaataaatctaagcggatcaaaaataataaatgataacccgacaattccgataattgccaacgaaataataactggtaggctttcagcgaacccactgacatcatgctcagtatacttaacacttgaaaccggtgtcgtgatcgtcacttttttaccattagtggttgtaaacttaccaggatctttctttttattcaagacctgcttatagaacaaattactaaaggttgtaaagccaactaacttagttgtatttttctgagtattgttcgggtcactcttggaaactcgattggcaaatgaattcttttgaatggtctttgcctgtgactgttcgataaccgactgattaggtgtccgaaccgtttgttgattagcaacggcgccagcactttcagcggcactgttaacctgtgactgtccagctgcagcagaacccggctgtgaattagcaggtgccgttgtggaaccatcggtttgcgatgaactactggaagaaacattaggcttcgtattatccaaaccaccacccgggacaattttatcgataaccggcttaataatattatcaagcccagatccggcagctgctgaccctttatcacccatccccagcattggttggctggaattagacgatgcattggcgctggaagacgaggcacttgccccatccgttgtcgaaccagaattagtactgctactattctggtcaacattatttcccgttgcgtcaccataagaagtcgtcgtgccatccccactggacgtattggccgaactggaagaatcactggcacttgaagaactgcttcccgattcaactgaatcccagtgagtggttactttattctcaccatcagaagacttcattgtcgtatttccctcaacgctcccatcctgagtcgttgaagaatcatacaacgcgtaactgctttgattattatttacttgagctactgtggctgaatcgccattagtgttggtagagacggaatcagcattcccccgaatgccgagaccacaaaacgctaaaatagtggacgaaacaagaacaagccacttatatttgaactttttgttcatggtacattccccccgactttaaatatagtcgtagttacccacctacaatggtaatttatttggcaacaattagcaagtaagttatgcagtttttattaattgtgtaagcagttcgtaacaatgtcatggtatccttataaacgattggaaaatattctgaggagataataagcacatgcaaaaaaatatttacatagttgcagcaattgcagctactttggggatgaccacattaacggccacagccaacgcggctgcaaagacaaatacaccaacgtcaggaaccaaaactgctgcaccaaccaaatcgtcatcaacttcgacgaaaacaactcagcccaaatcaattccagcggctagtttagtaaagagtaccacagttgacgaagaactgccataccacttaaataagggatatgtttacacgagtccggctcttaataaaccagccgggactgccaaggattttgccaaggttacctggtacacttataaaaaagcagttattgaccgcacagctcaaggcagcggcaactccgtttggtacgaagtaaagagtggcagcggccaacaaaccggttgggtctggcaaggtaatctggaaccaatctcgaaaggaacgtttgatatcgcaatgaaaaatagcgactactttaaaggacaaaaaattattaccctgggagattcgattacccgcggatatgacggctatgaaacgttagacaatatgggttaccctaactggcttgcgcgctatcttgatacttccgttaccaatgccggctataacggtgctttcctatgcgaaggcggcgaggaagaaactgacggtgatctaacgccaaccgttaacaatacgaattttaccaactataacgttgctaccatcgcttatggaactaacgattatggccactcgtccaactcaatcagtgacattcagacggaactaaaaaataatatcaaaaaaatgaaatctgataacaagaaattgattatttatggtatcctgccaattccacgttatgatgcccagtcaaactccgataacgtgatcggcaaaggcggctatacgatggacgagttaagagacgccgaagcagctgtttataaagcctacaaaattccggtgttggattggcgaagcgatactaatccgattattacagatgccaaccatgaagaccggctgtacgatgaacgactacatccatgtgctaaaacttatcaactaatgggccgcgaaatcgctcagttcatgattaacaactaccccaaagatcggattaaatcagcaacgaaatccacgacgactaacagtaaactaacaacgaaaaagacgatcactaagaaaaccacaacaaataaaacaacaacgccgactgtcgctgctcataagacagtcaaaaaataatcaccatataaaaaaagcgaatccggaattaaaatccgggttcgcttttttattattcatacttttctgactagctacctaatccaagcagtgaaagccaacttgaagcattggtagaagtggagccggtacttgcagcttgactagcagtcgtacttgaacttgcattattcagtaaaccagtcaatgaatcggtcgaactagagaatgagcttgcactaaaggcaccttgttgatcactatcggcagagaacccatctcctaatagattgttctttggaagttgatcctttttcataacgacactggcagtagcggtataaggaatggttacctgggttcccaccttaattgcatcactgtttgcactcttaatagctggctcgctggtcgttaacttaacaattcggtagttaatacttccaccaaataacgagttcgcaatactatcgagagaatttccaatgatattaccaataccaccaataattgacccaatcccgcttaatcctgtacctgcaagaattgagcttaaatcggtagaagaactggatgagccacttgagctgaataagccactcacgcttggaacagccgttgatgaagcagtcataatggtcttactgccactgctcagcggatcacagtacgtaagataataaaccgtatctaattttgcatcacttaaggcgttcataacatcttgagccttgaatgtaccgcgaacaccgttattagtacttgtgttagtatcagacgctaatttggtaattaaattattaatctgatcctgtccaggtgaaacaaaagcattcttcccaatcgcgtcaccaggtaatccactatagggccggttatttgccgttgttgtgaatttcggtgtcgtggctaataaattaccagctgacttaacatccacgataaagttgactgacttaccgtattgagccgcagtcaacgcagcgttgttagtcgtttcatttgcggttccagtagctggtgcttgatagccgcttggaatatttgaaactgcttgaccagccgtattattacccaagaaggcagcagcggtttgacttgcagagttggtattagtcaacgtttttgaagtaattgtattgttggtcttggaatcaacataatttaccgcaacttgattttggccaatagtagtactagatgatgaacttgtacttccagttgcactagatgtcaaattgtcagacttaatccaaccattaactgatggattgcttgaatcttcaacatagtaataaacggcattattgtcacggccattggtttttgcgccaactccagtaacttttagagcgtctttagagtagttaccctgagttgatttcaaatttcgaccaactttatattgcgtccagtcaggctgaacgtaagtctgggatgaccccttaaagtaataagttgtgttggcgatatcagttgtgacactgccacgagtaaaggtagccgtattcttcaatccaccaacggttcctgttcctttagttggattagtttttccagcgtaaatccagccgcggtattgcttatcaaatgaaacaacctttaaatagtaagaaccacgattagttcttgcacttcgataagcccggaaatagctttgacctgcatcagtcttaccattcaagccacccattgtcgatttcccggcaaccattcgggcgccctttagtgttccggcttttgagtataaagcagctgaaccatttggcaaataatttcgttcttccacattgtaactaagcgttgaattggacttaactttcgcgtaactcttagcacttgcgttaggtgtgttagttgcaaatgcggcgacagcaaagccaaaaactgcagcacccgcaaacgcaaccttaaaaaactttttgttcatgaactcccctcctatatctttatgtaagataagtagctaacagtaattgttaactacctatcattataaactatttagtcattacttccacttatcaaaggttacaattgcgtatcattgacctatgcggcttgtaatgttactaaaattaagtaaaagaaaagagccagccaggtggttggttcttttcagttctaactataatcagattagattccgtaacgaacaattgcatcaagaatggcattcaagatatcatcattgattggtaattcataatatccatcagcattttgagtaatgttagggaagatagtctggttgaatgccttgtgatacaatgcaccgccttcatattgatatgaaagttgaatcttatcaccataatgaatggtagtaggaagtgcatcatagtcaaggttggccttcatataaagtccggttgggtcaatgttatccaagaaaccaccaccgatacgtggaagaatggttggggtaatcttgagataaacagtatccaaaccatccttcttgaaggcagcttgtaaggttgctttagaaatgacatcattcttgctacccttaacatcaggatcagcattgaacttgttcatagcgttagtaaagttaacgttactgttgaagaacggaatcatagtagcaatcttaccagcagcacgtgctgatttgcttccactcaatgagtcataaacagttgcgttccaaacttgactaaccgttgtttgatcattaccaactgacttggtagcaccaagttgtaaggtaacagctgaaccaaacttagctgcagctaaagtagctttttgcgtatcactcaatgaagtgaaggctgaagcattagcagtaccagctaacgtcttagtaattaatgaagtaatagcagtagcatcagtgtcagctaaagtcttaccatcagttgctaaagtagtacccttggttgcaccatctttggtgtagtcaacggacttgatagccttgccggttgcatcagttaagttgatgcgaatagcattgtcagcaatggtatcagttgaaggagttgcttctttcaatgatgattgaagaatccagccatttacactaggattcttggcatcgttaacgtaaacccattggtcaccctcacgagtccgcttagctgcttgggtgatcgtgaacgtatcttccttgtagttagtggtatcagtcgtgttacggccgatcttgtattgagtgtatgcaggagctttgaaggtttgagcttcaaaagttgttcctggattttggatttggtaagttgctttcttttgagcatcagtaagtgatgaagttgtgtcttgggtcgtatcagtgtatttcaagccagttgaaacactttgatagttggtacgaggatcagtcttaccaacgtagatccagccacggtatgctttatcaaaggtaactaccttcatgtagtatgaaccgttgcttaacttagcaacacggtagccacggaagtagtcgttacctttctttgagctggcaaggttttgtaatgttgaagtatcagcaaccttacgagcactctttaaaactccggcctttgtgtataatgcatttgagccagttggtacatagttacgacttgttgcagtcgatgaactagaagcttggttgaagtcaattttatagctctttttcttagcagcgttagcattagtagtactgccagctacagctacaaatgacaaagcagccaaacctacgaataatgaacgctttaagctagttttcataatccgatttcccctctccaaaaagatattagacgcgatatgtaattccttcgccccttcgcatataatagtaacatcaccctaatcgaatgtaaataaaaagtactagtttttacaaccccatttaacagttgtaagaaatcaatggcactcagcttaattccatcaaaaatccagaattgcttatatagcaacgttttaaacgatcttttctctaatcaatcaacaattatacaggcaattaagataaataaaattatttattttaatgattacttaaataaaagatctaattttgttcacaaaatattctgatttagggcataacatatcatattcgttatataggcacactttcttcacagttatttcttactttttaaaaaccagtagtttaaagatttacttgtgattataattacctcaaaagtatctataatcataagttttttccgctaacattttgagcataaactaaataacactgttaacattttttgaactcgcctttttaaacccatttagtaatttaatagttgcctcggttagtccatattcacaagcgttatatggtaatacaaaaagagccaaggcaaaatttcttttgccttgactctttctggtaaagtgactgggtttcaattaaatctaagttttaaatcagattaaattccgtaacgaacaattgcgtcaagaagggcattcaagatgtcatcattgattggcaatgcgtagtaaccatcactgttcatagtgatgttagggaagatagtttggttaaatgccttgtgatacaatgcgccgccttcatagttatatgaaagttggatcttgtcaccataatgaatggtagcaggaagtgcatcataatcaacagttgctttcatgtaaagaccagttgggtcaatgttatcaagatatccgccaccgatacgtggaagaatagttggggtaatcttgaagtagatagtatccaaaccatccttcttgaaggcagcttgcaaggttgctttagaaattgtatcgttcttgttacccttaacatcaggatcagcattgaacttgttcatagcattggtgaagttaacattaccattgaacaatgggatcatggttgcaactttacccatggcacgagcttgtttgcttccacttaatgagtcatatacggaaacattccaaacttggcttacttcagtttgtgcgttaccaactgacttggtagcaccaagttgtaaggtaacagctgaaccaaacttagctgcagctaaagtagctttttgcgtatcactcaatgaagtgaaggctgaagcattagcagtaccagctaaagcattagtaatcaaggtgttgattgcactagtatcagtgtcagccaatgtcttaccatcagttgctaaagtagtacctttagtagcaccagtcttagtgtaatcaacggacttgatagccttgccagttgcatcagttaagttgatgcgaatagcattgtcagcgatggtatcagttgaaggagttgcttccttcaatgatgattgaagaatccagccatttacgctagggttcttagcatcgttaacgtaaacccattggtcaccttcacgagtccgcttagctgcttgggtgatagtgaatgtatcttccttgtagttagtggtatcagtcgtgttacggccaaccttgtattgagtgtatgcaggagctttgaaggtttgagcttcaaaagttgttcctgggttttggatttggtaagttgctttcttttgagcatcagtaagtgatgaagttgtgtcagtagtagtatcagtgtacttcaagcctgcgttaacattcttgtaattagtacgaggatcagtcttaccaacatagatccagccacgatatgctttatcgaaagtaaccactttcatgtagtatgaaccgttgcttaatttagcaacacggtagccacggaagtaatcgttacctttctttgagttagcaaggttttgcaatgttgatgtatcagcaaccttacgagcactctttaaaactccggcctttgtgtataatgcatttgagccagttggtacatagttacgacttgttgctgttgatgaactagaagcttgattaaaatcaatcttatagctcttcttagcagcactagcgttggttgatgcaccggcaacagctacaaatgataatgcagctaaacctgcaaacaatgaacgcttcatagtattcttcatgtttgaattccccctgtaaagatattagacgcgatatgtaactctcgcccctctagaaagtatactatcacccctcgtaactaatgtaaaccgaaaggtactattatgttgaaccccgtttaccattatctcatttatagccaaacgaactccagcgttcccacaactttcaaatcccttttatatcaatgatagtagtcaactacaatttcattcttagaatttcaaaccaagatattcagttcgtcattctcataatctcatcaaaatttaattgtaacgtcaaagaaaattcacactttaaccgcaataaattcaaaccatgacacgttcattatatcgtcacaattccattttggcttcttctcagtgtgataccctaactcataagaaaacaaatacaaaaggcaaaaaagtagtgcccatattttcatccaaatcatcacggtgttccccatttgaaaaaatcttcccatgaaacatttaagcaagcactaattctaaataatcacacaatctaagatcaggtccaagcgggacaatagtcaaaaatctatatcgtaataccttacaaaacgaaaatcccgtaaaatcagcgttttacaaactgatcttacgggatttttgaaaaataactatttatcgaatgatgtcccagtcacatggattggatttctgtgttaagtcgtaattacttagttgcattagccaacgttgcatccactagcgtatcggcaggagctttagaagctaaacgtgctttaacggttacagtgcttccgtaagctgcattcgcaattgcactataatttgcactcttgtcagccgcgcttaatgtactgtatgtgtagccgggtgcatacgcccctaatttggcctcgtcagttgaaccatttcctaattcagttgtcaaaaaagcagcagcattagtcaagcttgtattagtattagtaagtgttggtgttccaacttcatagccagaatcagcgtcaacaatttttgcaaaaacaacgttatttgggaccgggtctgttggaaccggaacctgttcaatcacggcaccagcataaatccagccacgaacagaaggtcgatcttggttaacaatatagtagtaaggcgtgccttcacgagtcatttcaacagatttagtaaccgtaaagttttcgccaccgtatggttctgtatcgtcaatagttttttcggcccgatattgtgaacgataaggtgcattccaaagaacgttggtgatgccagggttggttaatttgacagttgtcgttcccggcattgccgcagtatgagtcgtttcggtatgcttcaagccaaagcctaccgatgcccaatcatcatctggatttgtcttaccaacgtaaatccagccacgatttttataatcaaaactaacgacttttgcgtaccacaatcccttattcgttttagcgacccggtaagcccggaaataatctttggaattttgtgaaccggctaatcctcgcaacgttcctttacttgcaaccattcgtgcaccctttacagttccaggcttggtataaatcgcataattgccagttggaatgacgtttcgatcggctccggcactctttgtcgcgtaatttttggtaactttaacagccttactcttagcactaacagtttgtgagctggccacccccgcagcagcaaatagccctaaagccgtaatcccaataaaaagtgatttatgtaacattttattcatgacccgttcctcctcaatgatgataactacaaatttattatactaccttgaatgataaggaataaaggctattttgtaaatgaccaaaaataagagacattaatataacccctattctttaaatatctgttactcacccagtgacatttctgatcatttaacaaccatttaaatcctgtatttttaaaaccctctttctataattatacattagtgatccatgtgacctcctcgacatttgcaccaaaaaagccaagacaaagatctcgtcttggctttctttctagtgaaccaacaaggaatggcttgaacaaaccttgtcagtaatgcaacctgcttgaagagttgcatcttgaacaaatcatatattttgtaaatctaaaatgatacattgtggtgttatcaattatcaattcaatataaagcaacctttataatcagtgctttatgtaaaaaaggaggtcgagcaaaataaattgcccgagcccccttatttaatttcctggtactagccaacaaactaattgcaaactaaattattgtgcaatgtagtttgtattagcattttggttagcatctttagtgttaacggcatccttggttacgaaacgttggaatgccaccttaacagttgaaccattgctcaacgttgcggcattgttagcatcagaagcagttgcatcatatacatagaagtaacgcgatgcaccgttagaaccaggtacgttttgaccgaagaagccaactttgtcaacaccagtagctttgttaccattgtcaggatcagttaatgaacctgccttggcagtataagcagtattggcaccagcaagtgccttggcaaatggaccatcagcagcgaagtacttagcaaatgagaatgtgcccgtcttgtcgccaccagcaggcaaagcagttgattgagctgaatcagtcaatcctgggaagcctaatgcaaagtcactggccttcaaagcagtgattgatgaaccgttagttccgtcttggtagaaggaaaccttggttgaaccagcaacaggtgtcacatcaagagtcagggttgcaccaaaagtagcgtttgaaagagctggtgctgaagttaagttagaaccatcagcggcaacgtccctgccatcgctagtcttgaatgcatagccggaaggtgctttagtgttggtaatgaaggcacctagtgttcggccgctattatcaacgtagttagcattaacagctgcaccctgcttagaatctgaaccggcagttgtccaagtgttggtcttgtccaatgtcttgccagtggttgtgtcacgatattgaaccttaacgctcttattagcatcaaagttatcgtcaggagtagtagcgccggctttttgtaaaccagaagctaaaatccaaccatttgcagctgagttcttagtgtcagttgcggtaatgtggacccattgatcgccttcacgggtacgagtaccagtttggtcaatcttaaatgttgcttccttatatggtgttgagtcagtgataacacgaccctgtttgtattgtgtccatgcaggataagtataagtaacggtcttgaagtcatttgcagtaccggtttggccgatcttgtaagttgagttcttttgatcgtcagttaaagttccggctgtgaatgtgtcatatgacttgatgccaccagcaatggtcgtcttgtctttaccaccataaatccagccacggtagttaccatcaaatgaggcaaccttatagtaaactgaaccgcggttagttgtcgcaacacggtaagcacggaaattatcttttgaatcctttgatgcagctaaattacttaaagttgattttccagcaactacgcgggcaccctttaaagtaccagctttagtatataaagcacttgttccggtgaaagtaacgttacgttttgtagcgtctgaagtcaaagctgtgtttgaggtagctttggcataactcttagcacttgcttgagtggcagtaccagcaacggcaacgaagcttaatgctgctaagccagcaaacagtgactttttgagatttttcttcaaaataaattcctccaatttttcttgcgtctccgcaaagaatatatttagtataacgcgagaaaatacaagtgacattactaaaattagacaatttcacagatttattacactaaaattacagtagtaaaacaatctaacaaaaagcaaaataaatgcataaatttcctaaaaattcacagaatagtcaaatcttcatagtttaataaatccataaataattgttaaaccggttgcacacacgtggatcaaggcctaaaagacgatttccaaatgtgaccaaaatatgaacattttgtgaatataaaaatgaagtcattagatataattatgttatgtttttttactaaaagagtagtgactctatgtattaaaaagtccgaaaaccggaaatgtggttttcggattttttaaattcaaattattaattatcttgaactggttcagaaacagaataatacgctttaacaggtgtaccatatgtgccatcatctacttttgctacggtatatacaagatgataccaagtaacagaaacagaagctggcttgagaaatcctccagcattatatttaagaaccggataaataggtgagtttaatgtaccaccattgctagcacctaatgatttcaaaacatcagcacctttaaattccccgttaccacttccaatttgcatattaccattggccacgtactgggctcgtgcagcattcttaaaatatgcattagctttggtagcatcgtcctcactagacactgacttgttaagtttgtccttgtaaccaagaacatattgtccccataaattccattggttgttaacagcttgataccaagtgtaaatatcattagctgaattaccattatacgttccatcaacggcaggccctgacttaggagtcaagacagctggggtttgatcattagtataaggcaaaattgtcgagtatcccgcttgtggaacattacttgctacagtctttaaattaacagtcccgccaaactttgattgagctaaagctgttaactgctctggcgacaaactagaaagcgcataaccagtgccagtcaatgatttggtgatttgtgtttgaatattagacgcatcagtcggatccaaagtccaagatgtgccattctgaatacctaatgtatttccattaattgcccctgatttggagtaatcaatatatttgatattatttccatttggatcttgtagataaatccgaactgctttatccgcaaccggtgcagttccctttgttacagctaaagtaacagttgaaccaaatttactttgagctaatgtttggatctgatctgtggttaaaatttctggatagtaactagttggtgcagctgtcttcaaagctgccgccaattgtgtttgcaaggcattttgatcagccgtttgtaacgtccaaacaccgttagttaacaaccctaaagtgtcatccttcttgacaccattcttggtgtacgtaattgatgtaattggttgactatttgatgaatcaaccacattaatcttgatttcattatccgcaaccgtatcagtagtcgtcgacccactaccggaattcgtagctgaagttaacccagagaataaaatccagccatttgcagccgacttagaagtatcagttgccgtaatgtgaacccattgatcattctcacgagttcgggttcctacctggtcaatcttaaatgtggcaccctttaatggactggaatccgtaatctgacggccaaccttatattgggtccatgctggctgcttgtatgtaaccgtcttaccatcatttgtcgttcccggatttgcaatcgtaaatgtgccattcttctgggcatcgcttaatgcacccgtttggaaagtgtcatattgacgaacgccgccgccaaaatcagcagtactcttaccaccataaatccagccacgataattgccgttaaaagtaactaccttataatagatagaaccacgattagttctggcaactcgatatgcccgaacgttatctgttgatgattgagttcccgccaaacgacttaatcgactgtttgacgcaactttacgagcgcctttcaaagtaccagccttgttatataaggcagagctacctgtaaaattaacgttccgcgaacttgcatcgctcgtcattgcacgattagatgttacccgcactcttgtttttgcatttgctgtcgtactatttaccgccccaatagctgtaaacaatcccaaagccgtcgctgaaacaaaaagtgacttcttaagatccattttcattcgattcatcccccgatacatatttgttaaccacgtgtttattataaactgcaacaacatgatttgccatacaataattaggcatctaagaataatggacagtcgttcaaattgtcctaatcatccccatgtcttgatcataacaccgatatatattttgctctacatttcattctttttgtcttatcgttttaatatatctgaaacaaaaaagctttttccaccaaaatttgatggaaaaagcttctataaagtgacaattctaattaacggccttttgaaagataatcggttagaattgataattgtaataaacattaaccgatgatccattacgaccactatcagcattttgagctttgtaagtcaatgatgaccaagccatggctgccgaattggtacccttagtaaacactggaaattgtggcgatttaagtgtggcaatatttgaatttccgttgacgtagttcattacctggttatcagtaaaactcgttccaaaggcgccagtactaaattgcatgcctgatggtgctaaatactggagttgggctgccttcttaaattcactattcagtgttgataactcattagttgacatgttattaacagccgtcaaaataggtgcccgttgagaatcggtcatttgatacaattgatcggccgtatacgtattattatctggaaaggccatcgacgtttgaactcttggcgttgttactgccgtcatcgctgttgaagtaataccccaaccccaatcccaattagcgggataggcccgtggtgtcaacgtactatatgcagaattagttaccaacacattcaagttagtcgagctaccaaatctcgttgaagctacaatcgccctttgagcatctgacatattaccgttatttggtaatgcgtatcccaatgcattcaagacgtttctagcagagttgttaattgagttggcatctgtgtcggaaagaacccatgcagagccattccaagtaccaactgggttacccttagcggcgccactcttcgtaaagtcaatatgaccaaccgtggttccagatggatttacaaagttaatccgagcaaccgtatcagcaatctgagcattactattagcactgatataaacaccatttccaaatgttgcttgggcaatttgagaaatctgggctgatgttaatgtcaagttataaccagttccactcaaagtactattaatttgattttgaatttgagtctggtcattacctgcaagagtccagttaccattaacttgtgaacctaatggtgttcccttggtagcgccggacttgttataatcaaatgatttgatcacattaccattgctatccataatgctaattcgaacggcattatcagcaattgccgttgccttgttaacatttaagttaatggaaccaccaaatttagcctgtgccaacgcacttaactgcgcattggttaatgtatccaggttaaagccggttccatttaaggcgttccgaatactactttgaatggcactctgatcaccagaagcaatcgtccagttaccattcgattgcgttcctaatgggctatctttggtaacacccgtcttggaccagtcaaatgatttgacaacattattattgttacttggatcaaccaaattaattcgaatagcgttatccgcaatcggtgtttgagcctgagttaatccactaaataaaatccaaccattggcagcagaattattcgtatcaacggcagtaatgtgaacccactgatcgccttcacgggttcgagttcccgtttggtcaatcttaaaggttgcattggtgtatggtgatgaatcaagaattgcccgaccaactttatactgtgtccaagctggttgaacataggtcaccgtcttaccatcattggcaaccccggtattggcgaatttatacgtactgttcttcatcgcatcagtgatggtccccgtttggaaagtgttaaattgggtaatcccaccaccaaacgtgccggtacttttaccaccataaatccaaccacgataattaccatcataagaaacaatcttgtagtaaacagaatttcggttcgttgtggcaacccggtaagctctaaagttatcggatgacgaacccgatttggctaaactgtttaacgtaccggttcgggcaacaactcgagcgcctcgcaaggtccccgccttggtatatagtgcattattaccagtaaaggtaacgttacgggttgttggatcggttgacatctttcggttcattgtcactcgagcataagtcttggcacttgctggctgcgcattagcaacgccggctgctgcaattaatccaagagcagccattgaaacaaatagcgacttcttaagatcaaacttcatgaatgaaacctcccctaatttataagtatgaacaaaccatcacaatatagttagcagtcaacttagtttaaagacaatctttcatcaaatgacgatttattcacgttctcctagtccgaaatatggtcgattaattatttaaaaaaacgttaccatcgcccacgtttcgtgcaatatatcttcttctgctacgtctttagtataacgtaggtgacatatcctttccaagaaatgagcttgtgattaagaactaaatcgtctataaaaatcgcaaaaggcatccctaatcagtaatgaatacgtgatctgggatgccttttattttttctatatttttaactttatggttcatcatttgattggaaaatcaagaagcacttacattgaatccaattccaaaatgcaggcgatttttgaccagtttcatcactaaacacgcagaaaagtagtttttgttcatttcacatcagatacaatattttcgaattaggaatccaagaatattggcttcgttgctgaaacgtggttgggcaaacagctcccggccatgtaaacgaataatccggatagcctcaaagcaccagtaacgtgaatgttgctggttacctagctgaaatgtggcaagaccagcagtctccggccatataagcctcttaaaccaatatcccaaaataccagtgaggtgaatgtcgctggctacttagccgaaatgtggtcgagcaagcagctcccggccatgtaaacgaataatccggatagcccccaagcaccagtaacgtgaatgttgctggttacttagccgaaatgtggcaagacaagcagtctccggccatataagcctcttaaaccaacatccccaagcccagggatattggtttaagaggcttatattctggagactaaccgcttgtcttgccactcttactttactatcaacacatccacatccgagttctgcaaaacgtaagtactatgggagccaattgacagtttaccaatcacatttcttccggtctggcccaaaataatcaaatcaattttattttctgccggaaaactcttagataaaaggacttttacattaccgactagtgcctgtgtttccgcatcaatcccctggtcggctgctttcttggtatatggtgccaatttatccttaacctgggcgtactgatcccgataaaagtcttcatttacaccaaatgaagaatccatgccacgatctcgattaaccacccagacaatatacagtttggcagctaataccttcgctaaactacaaccaacatcgaatgcccgatcagcttgtggggaaccatcaacaccaactaaaattcgcttgtatttcatgttacttttccccttcccgatctaatttagaatgtcgtttactataaccaaaataaatgaacataccaataatcaaccaaacaacaaatcgaacccacgtttcccaattcaaaccggcaaccagcatgacacaaaacgcgatcgcaacgattggggtaacggggacacctggtgcccggaagccacggtgtaagtcgggttgagcgtggcgcatccaaagaaccccagctgacacgaggataaaggcggttaatgttccgatattcaccaattctgaaagaatatttaagttaaccagccccgccgcaagtgccgtaatgataccaaagaaccaggttcccttaaatggtgtctggtacttcggcttcacttcgccaaacatttttggaaaaagaccatctcgggacatggaatagctgattcgtgactgaccatataattgaaccaaaatgacagtggtcatcccaaggattgccccaatactaacaatgattgacaaccaagtttgacctgtttgagccaagactgccagaattggtgcatttaaatattttgcaaagactttatatttaacgactccagtcatgataagggtcatcgtaatatacaagaccgttgagataagaagtgacatcagaatgccacgaggtaacgtcttactggggttaattgtctcttcagcactggatgaaacggcatcaaacccaatgaacgagaagaaaacgatcgatgcagccggaataattccggaagctgtgccgttatgaaacgagtaccaaccatatgggttaaagggatgccaattgcccgggtggacataccaaacagtgcaaacaatgaagaggatgatgacagccaatttaatcaaaaccatagtgtcattgactcgcttagtttgagtaattccgattgaaataatccaggtaattagaatcacgattaagaacgcaggtaaattaaaataactcgttacacccggtgtcgtgccaactgccgcagtaatagctgccggaagatgaattcctaagttagccaacaaattgacaaagtaacctgaccagccaactgaaaccgttgcagctcccagtgcatattccaaaatcaaatcccaaccaatgataaatgccacgatttcaccgaatgcgatgtaagaatatgtatacgcggatccggcaactggtgccatggacgcaaattccgcgtagcataaaccagcaaagccacaacaaactgcagcaattaagaaagacaatgacagtcctggcccggctgttaaagcacctttgccggttaacacaaagattccagttccaataatcgcgccaattcccagaaacgtcaggtcccaagttcgaagtgtccgtttaagtggcgtggcatgagcaattaattctgaaacgtcttttttccgaaatactgtcatatctctagccctctttattaaattgccattagtttataacctaattttaattttgtaaagggcatatgtcatattttgtaacatgaatatcaaaaaataagatctcgtcagcaacaaacgtttattcgtactaacgagatcttattatcatatttcctaagacatcaaattttattgtgggttttggaaaccaactacttagctgtaggaattactccaggatcatcagtgtaattgcttacggtaattggttgatccgatgtaataccagctccgcttgcattggctttataagctaatactttaatagtataaggtgcaattacagagccttgtccattaaatccacctgattgatttgctgaatcatgcgtatatacaatttgataccagtataacgtataattaccagtattagtggcacccggttcagcatctcgggttatatgtgggaataatggtgagtaaagagtagctagactctgactatttaaaaagctaacaacgttgtctttactaaacgaggtgttccatgcacctgttgtaaagttattcaatgttggctgttggttattattaacagtgtatttcaacgaactcttatcgacggtttggcgcatttcagcattccagcctctcaagccatcaccatcgccaccggtactggggacatcaaatttaccgttagtaaccgacgtattatccttctgaacctgagcctttgcggtagtatcactctgaccggcaatctttaatggactatcattatataagtctgcatatgaaacttcaaatttaggatttgtattactgatataagagcttgaatcagtaaagagattgttaccattgagggtgcctacatttgttcccttcacaaagctcatcggtaaagtggcagccgaagcacctggtgcagtgtaattagtacccatcaaattaacagtctgaaacttgaaagctaataatcacgccaaaggcgtgtggttattggcttttttggcaaaaaaataaacgcaagctctcctgcgttgtatactttagtcgaccaaaaccaagatacaaaggagact

SEQ ID NO: 647 - DNA, 22435 bp, Unknown
  Metagenome-assembled genome
cacaacccatggcgtggcttgtcaagggcatttgacgttcccgacgttgtgtaaaccgccaaccaaactgaaaccaaaagagaaaccattgtcgaagctaagttttcatagaactttggacgttacctaaagtttttttggaaccttattaccttacagcttatagcccatgtgtgcaagtcgacaatcaacagtgaaggaagctggttttgtcgataaaagtagttaatgtgagaaacagtatttcgcttagatgtttgtaattcgattgttatctggaaaatgtgagaaaaaagatagcctctggaatgtgcctgccatctgtgccgcgcccttaaggcaattcccggtgtaaagaagaagatccagtcagaaattggatttcgtcaatttctgactggatctcaagctggataataaacggtttgtccatacggggctggtgtagacgtgatcattatctgagcaaaaacacgtcacaaaaagcacttccggtcgcttaaccgaattatccaactattcaagttcagaatagctcgttgaactttttatttggttgaaacgtggaccagcaagcaggccccggccatataagccccttaaccttaatattccaaaatcaggaatattaaggttaaggagcttatattctgggacctaagcgcttgctggtccactctgttatttagttattcaaaatccacaagaagataacgaagacaactgccaatccatacatcatggcactgacttctttaccccggcgagcggcaatcatggtgataggataggtgataaatccaagggcaatcccatccgcgatactataagtgaatggcattccgaccaaagtaataaatgccggtgcggcaatctcaaacttttcccaatgaacgtttttcaatgactgcgccattaacacaccaacaataattaatgctggtgccgttacttgacttgtgatgactgttaataatggtgaaaagaaagttcctaagacaaacaggatgccgacaacaacggcggtaaaaccggttcggccaccaacggcaattccggcagatgactcaacgaaagctcccattggagaggttcctaaaattgaccccaccgccatcgttgaagagtcggcgattaaagcccggccgatgtgtgggatccggttgtttttaataaagccggcttgttcagccaaaccaaccagtgttccggctgtatcaaagaatgttaccaacaagaaagtgagcacaacaacgattaattgtaatgaattaatatcgccgatatgtgaaagtgccacgccaaaagttggggctaaactgggcattcccgatacccattgatgtggtaaggggattagcccggttaccatccccagaatggcattcaaaaccatgccaataaaaatggcacctgggacttttcgactcattaaaatgagtgataccaacaagccaaaaattgtcagccaagttgttccgacgtgaagagaccccaaacttactaacgtgtctttacttgattggattaggccaccatcgttcatgccaataaaggcgatgaacaaaccaatcccaccaccgatagcagctttgaagtcagcaggaatggagtcgatgattttctcacgtaactttaaagcagttaaaataataaaaatgactgaagcaacaaaaacacccgctagagcagtttgccaagaaactttcatccctaggacaacggaataggcaaagaaagcgttaatccctaaactagctgaaatggcaatcgggtaattggcaataattcccatcaagaaacaaccaaaagccgatgccaaggcggtggcagtaaaaatagcccccttatccattcctgtgacacctaatacgtttggattaacgaataagatgtaaaccattgaaacgaatgtcgtaatgccggcaatcgtttctgtacggaaattagtattccgacccttaaaatcgaaatacttagcaattgaatttagcatataatagctccctctatagttcggatataataaaaaaagaccatatttatactatcattatagcgggacttgttcaataaacgaattaaattgacaattagctgaattttgtttcgaaatatccttgtgaaagtgtaaagggtttcaattcattaattggctgactacacaaaaaagactggacattttttgcctcagtctctttcattgaagttagcgatgaaacccgatttggtgagattactcggggttacgtctaaatttatttagctaaaaccttagcaatcgcatgattaaagtcttccaagtcatcaggagtccgactggtaactaaattttgatcaaccaccacagacttattttcaactttagcgccggcataatataggtcggggcgaaccgaaagaaaggcggtcatgctgcgtcccttggttaatccggtctggataaagatttggggaccgtggcaaatcgcaaaagtgggtttgttatctaacaagaatgctttaacaaattgaacaaatcggtcatctgcccgaagttgatcaggggagaaaccaccaggtattaaaaggccgtcgaagtcatcaggggagacatcagcgattcccttgtcggcgataatcttcaaaccgtgtttacctgtaattttgttgccagcttgattttcgatcacaacgatttcgttaccctcggcctttaaagcgtcaacgggagatgtaaactcgatatcttcaacatcatttgtgacaataacagcaatttttgacatagtttgtactccttatttttatttgaattcttatcttataataccgccttgacaagatgcaaggaattaattttgtaaaagtttggtaaaatcgagtaaacaatatcggcacttccgtatggttctacaaaagtaccgacatgataaaagtcatagttaagctgtatttgttgcgttttgatctaaatgttttcacttttaaacgcattatcaatcatattatattcttcatccgataaagcgatatttaacgcgtttaagttactttcaacttgacttggtgccttggcaccggggatgacaaccgttacatctgggttcttgatgtaccaagccaggacaacttgggcgatagttgcgtcatggttttcagcgatcggttgaagattgtccacggcgtctgtgattgctcggaaccggctgccagagaagttcggatcgtcttgccgcaaatcgccctccggaaattgaaccggcgtgccatcatatttaccggttaatagtcctgatgccagcgggaagaatggaacaaatgaaatatgttcttgccgcagataagggaacaactccttctcagcatctcgatgaactaagctatactgatcctcaacgacgtcaacttcatgattcttgttggcctcctttagttgatcaagggagaagttggaaacaccaatggcttttatgagtccctgttgctttaattgatttaaaaccgcaatggcttcatcctttggcgtctctttatctggaaaatgaatatagaaaacatccagataatcggttcccaaacgttgcaaactatccttaacgaacttctcaagatctttggggcggttactaatggtaactttgccatctttaacaatttgagcgccttttgtggcaatcttgatttttgaacgatcgtaatctttgataacctggccgatcaattcctcagagcgccccaagccatatgcataggcagtatccaataggttaatgccaccatccaaagcggttcgaaccgactgcataccggttttttcgttaagatttggaaataaattgtggccgccaactgcattggttcccagaccaagtggggttgtttgaacgtctgatttgccgattctaacgtttttcgtcataaaaagtgaaacctcctttgattttctacttatattatgatacagatagtagtgattcaaaaatatttagactggaagttatcatttgaaaaaattgttgattcttaaccaaaataatccaattgtgtcatctttaatcccattattacgccagaatccggatatcgattaccaaatcttttctggaaacccagagtcggctggtgattatatcaaggctttaagggatgttgattggatcttttcggcacttggccccaacgatgttgatttggattttgaggaactatttgatgccatagatgaggtgcaaccaccaattagtcattttgtaatgttgtcggctgcgggcgtcgatgacgagttggtttcaccgatcagttatccaggtgttaaggatcaggctgagtttcttaaacagcagcgttacgcaattaaaattgttgatgaatctgagctcccttatactataattaggttgagtaagttatcagaaaatgatagcttggattataaattatttaatgagggaatcaagatgccaaacgccactgtttcaagtagagcagtcgctaaactggtacttgaggtatttcaaaacaatcaattagttaatcgatccgttggtgtcattaacggctaacaaagtgagtctgtcagtatcgttaatttcccttaattctatacagttaggagtgttatacttggcaattaagttggactcagaacaacttgagacattaaaaacacaggtttctgaagcaaataaaaaatcacattttgttatcatttctgcgatttcaaaaaaggaacattccggcgttcgcctagtcactgattggaataactatttaaatatgaaacggacaaatggcgaaaagtttgattttgagattattcgtgacattgtcccaattactgacaatttggtttattgggcggttgcacaacaaaatttacacgatgcacaagtttccggtcagcaaaatgatcaggtagttgatgatttggaactttatacaaatcgggttatgcaggaaaataaagtccgtgcatagtgaattattcgaattgtgttcacatcttttcaattggtgatagatgtaataaaaaacgagattgaggcaggatgatacgtctgcttcggtctcgttttttgaatttgaaagacggttcttcacgtggcggggtgctaataaaagcagcttcttgctacgtagccgaattatccaaatattcaagctaagaaaatctcgttgaactttttatttagttaaaacgtggaccaacaagcaggccccggccatataagcccctaacttaatattccaaaatcaggaatattaagttaggggcttatatggccggggtctaaccgcttgttggtccactctggtttaaaaagtccccacacaaccaaagttgttggggacttaggacattgggttatcgaatttatgtatccgcctggttttgaccaggcgttattaggagtaaggaccaatcggcgatttcgaacttgaaagatatattgggggtagatcgtaaattcttgcttccgatattaaatcgtagttacgccaaaaggccctcataacaagatcaatgcaagcataaagctttcatttaggtcaattaatggatgcaaacctacatccaccactaataatagcctttttttcgtaatgttcaacgataacgtctttaaagcttttattacttcaaaaatgggtgatttgtgacttttgacggtgttttgtgtgtggtaatatggtgacagagtggaatcacaagcggttagctcccagaatgtaagcaccccagccccatattctggtttagaatgtggggctggggtgcttacatggccgggagctgcttgtgattccacgtttcggccgggtaacaaagacgatccccccatattctgattttgaatgtggggctggggtgcttatatggccgggagctgcttgtgaaagcacgttcggccaggtaaccgaagcgattgaggatgagacaataatcgttttgtccagtctctgttagtgtaaatacaattatcaccgggaaaaaggctggaagttaagcgccttttgtcccgctctgtccccgtgactcaagattataaaaatgtgaggtaaataccgtgacgttacaatttgttcttggaaaagatggttatgaccatcagtcaaagatggttgaaatcctcaaacaacagaaattaactcaaccaggtgataaattcttttacttggttcccaaccatattaagtttgaatcggaagttgaaattttaaaacaactggctgaccccgatgaatcagtcaccgcacaaagtgatattcaaatcttgtcatttacgcgattggcctggttctttctccggaagacgccagcctatcaaaagcagcggattagtaacgcggggatcagtatgctgctttaccaaattattgtcgacaatcagagccaattaactttatttgcccaggaaattcatcatcccggctttattgatcagctagctcgccaaatcgctgaaatgcaggcgggaaatgtaatgccggaaacattgctggagatgcttgaaaacagccagtctcagttatcaaatgatttgcgggataaattacacgacttttcaattatttatacagcctacgttaatcggattgatgataaatattttgacaaccataacgtgttaaatttgctaagcgacacgttgattaacgatgatcttagccattatcatttctatatttctgatttttctaaattaacggctcaagaatgcacgttagtcgaaaccttaatcaaaaaagcggggagtgttacggtgtcgctcattttggaccaagcctatccggttgagctgcccaaggaacctaatttattctatcaacctgccaagttatttcagcgattgtatcaatttgcggctcaaaataagattccttatttaccagttgtaacagccgatcaaccgcgagtagcccctgatctgcttaaattggaaaaatattgggaacagtcaagtagtttaggaaagattgatgccgataaccgaatagataataaatcaattcaggtctaccaagctgataatggttattcagaattaaatcaggttgcgacgatgattcatcagttggttgcaactggaaattaccgttattcagattttttgattttgacccgtcgacttgataattatgaaactattttagacccaatttttcagactcagcaaattccgtactttaaagatattcaaaaatctatggttgaccatccgctggttgaattattagcggcgctatttgatatttatgacccggataatagtcgaaactaccgttatgacgatgtgatgcgctttttgaaatcggaacttgttttgccggttagtcatcatcgtcccatgaagctttcggcatatcgacaggcggtcgcattaactgaaaatttgattttaaagaatgggtatgagggcagtcgttggactcaaaaagaggattggcagtatgtttgggttcctgatgaagaccaaaagccaattattaccgataaagaccgggaaatcactcgtcaaattaacgtgatccgtcatttaattaaggaaacgctacccaagttctatcgtcgattctataaatccaaaactaatcgcgaagcagcaggcctgttataccgattcttaacagatgccggggttgttgatcgactgcaggagtggcggaacgcagctattgatgccggtgatattaaccggtcaaatgaggttgaacaagtttggcggacattttgttcgctactggacgagtgtgtcaatatcctgggcgatcaaccgttcgttgcgactgatttttggtcattaatctatgccggctttgaaggggcaaattattcgcaaattccatcgactttggaccaagtgacagtttctgaaagcggcatggttcaaatgagtaatcgccgggtcactttcatgattggatccaacgatgacatgatgccggctagactaaacaacgaaaatttatttggtgacgatgatatttcacaattacagcaaaatttggatgacaatcaatatttaagtgatccaagtgatgttgcgatggcctttgaaccgtttttaaattatttagcgtttatgtcgccgtgtgaaaaattaatttttacgtatactaacaagttaaatgatgagtcaactgtaaatctatcgccatatgtggcaagaatttcccactatttcgggattaaaaagctgacgcattatccggcgattccagataataatcaaccaatcagcgcggtttatattgggacaaaacgtggcacgctgcatcatttaatccaagttgcccaagctgcttaccggaatcaggcacaactgaattcaatgtgggcgtttgtgtatcaacaacttagatctgatccaacgattggtcggcttaccgatcatctattaacgagtattaattatcgcaatcagccacgtaagttgaacaagcaaatcgtggcggatttgtatggggatgccctgaatatttcgatttctcagctcgaatccttctatagtaatccatacgaatattttctaaaatatggattgcgattacaggagcgggatcaatttgagttgtcatcagcctcgactggacagtttttccacgaagcgcttgataagatcatttctcagattcatgatcaacatattgatttgacgggcctaagtgatgatgacattaatcaattagttgctgaaaatgtctccgcaattattcatgatcccaataattttcagtacgttatcttgaccagcagcaaccggatgaattatgtcacgctacagctgcaggcaaccatccaacaaatggttcgggcattgcgtgatcagcaaaaagtaacgccaatgcggccgcgaaacactgaattaatcttcggtcaaccgactgctaagggcctcaaaggactatcgtttgatttgcaggatggaaagtcagttaatgtccgggggcggattgaccgaatcgattcaatgaaggttggcaataaacgttattttggtgtggtcgattataaatcaagtgataaaaaatttgattttaaccaggcatatgcagggacctcgatgcagttgatgacctatttggatgttttgaaatataacctaccggatttaaaccctgatgatgcagaggctttactagccggagcactgtatctgcacgttgttaatgctaaatttagcacgagtgacttgcaaaaggattcgtttgaacgcgcgttgctgaagaagcataaataccaaggaattttggttgatgatgtggatctggttgagcgtttggacacggaacttaagtccggctattcatcgatatttccatttgaaaaaaagaaaaatggcactcttggggctcggagctcggtaatttcggagaatgagttggatgcctttttaaagcatacagaaaatttgattgttaaagcgtctgagcgaatctttgatggtgatatccaattgtatccggtaaagattaagcagaagtcgtcaatgcagtacacaccgtataaatcgattatgaactttgatccactgttgccggaaaataagtatcatcagattcctgaatatggtaagaaaaagattgcagaaatgctgagggaaggaaaatagaatggattatacaccagatcaacaaaaagcaattcaagaccggcctagtggtaatatcctggtttcggcttcagcaggttctggaaaaacccgagtgttggttgatcgcattattaatatggttgaaactcaggacgttaatattgaccaattactggtcgtaacgtttaccaatgcggcagccaaagagatgcgtgagcggctgcaaactgcgctccgtcaagaattcagcaaaacgaccgatccgcaaaagaaacgtcatttgttggctcagattcaaaaagtggccgtcgcggatattacgacgatggatgcgtattgtcaaaaattggtttcgcgttactactatatattagggattgatcctaactttcggattttatcggatgataccgaaaaggcactgctaaaagatcaagtctggggaaatgtccgtgaagatttatatggtagtgatgccgatggctcctttgccagactgaccgaaaatttttctaatgaccgtagtgatgaaggtctgactaaattggtttatcgaatggacgaatttgccaacgtcaatgaggatcctgacgactggttaaaaaaagcagctgaattttatgaaattggtgatgatggcttgtttgccagtcgcctttatcagcagcagattaagcccgagttgacggatgttttgactcggatggaaatggaccatcgtttgatgattgagtatgcccagcgagctgaattaccaaaagacgaaaaagtatttacagatcagttaaagaaaattgaattgttggagacgcaattaacagcattatccacatggaatgacctttgccaggcgcttaaccaatttgaatttaccgatttaccacggttaagtaaggctagtgacgatcaaaagattttgcataaacaaattggttccttgaatagtaagatgaaggatcagtttaaggcgttagttgccaattattttgttcgtgatgaacaggaaaatgtgagcctcatgcaagcggctcaaaaacgggttcaaaaattgattgatgtccttcaggattttcgtcaggcgtatcggcaaaccaaatttcagcggcatttgatggaatttattgatattgaacgggctgcttatgatattttaaatgcggatagtgatcaagcccggatgattcaagagcgtttgcgaaatcagtatgttgaaatcatggttgatgagtatcaggacaataatcggctgcaagacgcaattttaaacaagattgccaagccaactgaagggaaccgatttatggtcggggacgttaaacagtcgatttaccgcttccggttggcggatccaaccatgtttatcgaaaaacaacatgcctatgccaatgagcgcaacgataacgagctcatcacattggcagaaaattttcgatcagccaggaatattgatcggtttactaatcttatttttgagcagattatggatcaagaagtgggaaatattgattatgacgagcgagcaaaattaaaatttggggcaacctattaccccgatgatttaaaagctaacgtctcacttattttgtatcagactgattcttcggctcaaaatgacaatttggatgaacagaatcaaatcgaggacagcgataccggtcaggctgaaatcattgcccaaaagattcaaaagttagttgatgataaacagccaatctttgataaacgattgggaaaaaatggtggtatgcgtccagttcaatacggtgatatcgctattatttcaccgactcataacagtgagatcacactgtcggatgtctttacgcaatacgggattcctgctgaagtcagcggagccaagagctattttaagacaactgaaattcaaattatgatgtcattattgtcgattattgataatccatttcaagatattccactggttgccgttttacggtcacccattgtcggtttggatgaggatcaattggcctatttgcggattaatcacaagactggtaattattatcaggcggtattggacttttatcggcaatatcctactggcaagccgtcagattatgggcagttgatttatcaaaaagtcgggacctttcttaatcagctggaccactttaaagacgtggcgcaacaggatggactggtagcgttaatttgggacatctataatcaaaccggctttttggattatgttggcgggatgccggcgggctatcaacgtcaaaccaatttacacgcattgtatgatcgggctgctgactacgaagcaaacgggtttaaagggttattccagtttgtgttgtttattcagcggatgcaaaagcgtgatgacgatttggcaacgacggcaccaaccacttcagacaatatggttcacgtcatgaccatccatggcagtaaagggttgcaatttccaattgtttttctgaatgatcttggcaagaattttaatcaacaggatagtaaaggcaattacattttaaatgatcacttgggagtaggaatttcctatttagacacgaatacccgggaagtcaaagagcccctgcaaaaacaagcagttattgatattgccaagaatgccagcctgtcagaggaaatgcgaaaactttatgtcgcgatgacccgagcggagcaacagctgtatcttgttggaaagattaaaggcaagacggttgatgagcaagctttaattgcacagtggcagtcacagaccgacacgcaaagcttattgttaccagcggcatcccggaatgctgctaaaagttatttggattgggtaggcccggcgatttcccgacatccgatgacgttaaatgaatttggtgattctcaaggatttagccaatttgatggagataaaactgattttcaagttgaattttatgataatgataaaatcatcaaacatgctggtcaaaaggccgtcgaaaaagtagctcctgaagattggttaaaaactgtcgatcaaacaaagcaatcagctgatcggcccgatttaaacaaagtggcagcggtacttaattatcagtatccgtatttggccgcaactcaaaccacggcctaccagtcagtttcggaaattaaacgattatttgatgatccggataatgtccagttgggcaactatgggatgctggatgtcgaccaggttgccaaaccggggcgatatactcaaccggatttggcatcaccaaaattcatttcgggtaatgcgaagagtcaaccggcaccaaccgatattggaaccgcgacccatatggtattacaacaaattgatttatcaaccgaaccaagtgagattggcgtgtcatcagtgattgatcggttggtcaaacagggaattatcttaggaaatgtagctgctaagattaatattgatgggattctgaatttttatcagagtgaggtcggcaaaattgtgttggcaaatccgatgacaacctaccgtgaagcaccattttcgctattgatgcgggcaaaggatgtgtttgccaactttaaagatgaccgtgatcaacggatcttaattcatggaatcatggatggctatgttgtgactgatgaaggggcttatttatttgattataaaaccgaccatttaacacctaaaacaacggttaagacaattgttgaacggtatcggggccaaattgaattgtacggtttagcgctcggaaaaatacttgggcagccggttacccacaagtatctatatcttatttctgatggtgaattgataaccgtatagcaaaacatgactgccaatttgaagattaatttgctgttccttacacttcggtaaaattcacccctttaaccataaatattttcaaaggtaatgatataatcgagtaagtatttttgaaaataggggataaattatgaacagatttgtgcaaattattctcgcggttactattgccacgatggtgactggctgttcgaacccaaatagtcagtctaataattccagcaaaaaaacggcggctgttaaagctgaacagccaattaattggaagcaagcttctcaagataagccctaccctacgatcagtcaaaataatgggcgttatattcaggtttcccttgagaaacagcgtgtctatatcatgagtcccaagcatcgggttttgtacacgatgtatgcctcgactggtaagaaccactcaacgcctcgcggaacgtatcatattcagcaagaacgtggtaatttcttctataatcagcagtcaaaggagggcgctcattattggacgtcttggaaagatcatggtatctatttatttcatacagtgccaaccaacgctaagggtcattatattgtgtctgaagcagatcgattgggcaaaacggctaattctcatggctgtatccgattagccgtgccggatgctaaatggattaatcacacggtgccggctggaacaaaggttgttgttaaataaggggctaattatttcttcaaactaattaggttttaggtttaaagcactttttagccgtttcagaaccgatgggatgtcattaaacaataaattaaaatgagttaggagcgattcatttggttaaattcaatacattattagttcgaggcggtaagcctgacgataataatactggtgcagtcaatgtcccaatctataattcttcaacatttcgctatcccaagttggggacggatgttcgctgggattatgaacgttcaggtaatccaactcgggatgctgttgaaaatgtttgtgcggagttggaaaacggcgatcgtggatttgctttttctagtggcatggctgccattcatgcggcgttgtcactttttaagccgggtgatcatattattattggcgacaatatttatggtggcactttccggttggttaatgattttctgaagccccggggaattgaattttcagaggtggatacgcaggatgtgcaagctgttgaagctgcttttcagaaaaacaccaaagcagtttactttgagacggttactaatccactcttgaaggtttcaagcgtgaagcaattggcagaggttgcccatcgacatcatgcaatggttatcgtggacaatacctttttaacaccatatcttcagcggccattagatttaggagcagatctggtcttgcactctgcaacaaagtatttaggtggtcattccgattttacggctgggattattgtgactaagactaaagaattaagtgaccaagtctatacattacagaacagtatcggggctgttttggcacctcaggaagccaacctgctgcgtcgtggtattcaaacgctgaatattcgaatggatcgccatattcaaaatgctcaaaaaattattgactaccttctgagtaatccgaaagttgggaaagtttactacccaacggttgataaatcgagtgaagattatcagattatcacggatgaagccaatggtgccgggggtgtcttgtcatttgagctccaagatggcttggatgctgccaaatttgttaatagcctaaagctgattatcttagcagtaagtctgggggcagctgaaagtttggttgaggttccagcatttatgtcgcattttgaaattcccaagccgcaacgattggaaatgggaatcaaggatgaattgattcgactgtcggtaggtttggaggacgcggatgacttaatagcggacctggaccaggcgtttgcgaagatttagaaaccagagtgtgataagcagcggttagtctccagaatataacgccaccaccccaatcttcctgattttggaagattggggtggtggggttatatggccggaggctgctgcttatcacacgttttggctaagtagccaaaaactgatactttcaaataaattttggaagattggggtggtggggttatatggccggaggctgctgcttatcacacgttttggctaagcagccaaaaaactgatatttccaaattgattttggaagattggggtggtggggttatatggccgggggctgctgcttatcacacgttttggcaagtttctgttggtgtaaacacgattgttaccgagcaggacgcgggaaaaaaacaatttccggctgtgtcaccgaatgatccaaatattcaaatccagaatatctccttgaaatttttacttagtagaaatcaaatcgtgaaccaacaagcaaaccccggccatataagccccctaaccttaatattccaaaatcgggaatatcaaggttagggggcttatattttggggtctaaacgcttactggcgcactctctttaattcagcccgcttgaaaatggatttatggtcagtgaatttgctaatttaaattgaataaattaattaaaacaacgctcattaccagcacaattgcaattaatccaattgaaaatttggtaaaccactggtgattaattttgtttaacaggaaaaaaacaccaatcaaacaaatgacaccaatcgtatacatgataatcagggcggtttttacagcagtatctgcttgaatcatcaatatcacctcattaaaaataattgtacaacagaatctgtcgttttatccaagtaaaatgagccgaacaagttttccaattcaaaaaaaatatcagccggcccatcacctatttaagaaaaagtgatggaccggctgacttttttgaatttaaattaaggttacttaattaataattggtaagcgtatcggggggattcttcactatcggcctcttccatgtaaatagtgccgcgttttgtaaagccgtttgttgtgatgacatgctgcatacctttgttatcaggatgcgtgtcaattcgaacatctttataacccaaaacatttgaaatagtgatcagaccactaatcattttttcagaaaggtgttggccgcgaaaatccgatgacattgcaattcggtgaatcgctgtgtaacggccgtggacaccatttaaccattcaccatcatggatttttaggtaactgacgtctaatccttgatgaagagcggcagtagcggcaattttaccgtcgatgatgagaacgtaagagataccggacttaacatcggtctccagatcttcatcactgggatagccgttttgccattggtcgatttcttgttgttttaaataggctttggcatcacctatgatttttttaatttctggaaggtcttgattagttgcttgacgtaaatatgttgcaggcattaatgctcacatccttattaatatttctaatctgaatgattagataattcaacacgaaagagcattatagagcaaaagtatttagggtgcaatagaaaagataaaaaagttaggttgtcaggttattgtggttataaaatgattattaaacgctgatctaacagcttctatgttgatacacgggcttgaacattattttgtggctgttcttttaggcgtaattttaatgtaactatttgatgtgatggtcactattatcatgggttggtcgttaaatcgaaaaagcaccagctaaaaccttaaattaaagattttagctggtactcattaaaatagtttagatcaaaatgttggtttgcccgaactgaaaatcaaaacgagatttaccaaattgaattgtccttattaatctttcttttggctgtcgtcttttttcttatcttttttatctaacaggtcgtttgctttttcagcgaccttatccttagctttttccagtttttctttagcttttccggatgcattttgtaacttgccctttaattcgagcttgtcatcaccactggcttttccaagtccttcttttgtcttaccggcaacttgatctgatttattttttaaatgactcattatgacacatcctttcttatttctaacattatcatatctgattgatccatcattcgcaaaaatgatgatcggaaaattactgaatattaatcaaggtggtgctatgattattgtgagattaggagtgatttctggatggctaacaataaaattgcaaaaaagcagaaagtccggtcaggtcaagcgactcatcaagaatcaaatatctttaaagttcttggattaatggcatcaagattgcttggagaaaattcgtatgccaaaagttcgatttattctgaaagattagcgcggggggcacgggaatatttagaacggccgttaaagacaagcatgtcactggcagaatttaaaatgaacaaagcaactcagatggggtatcttgttgcggttaaggatttaatggacgtgtcctttgatcaatttactgcaatgacgctctgggcaactggtcaaaatacagcccaggtgattaatcgtgctgcgggtagtgactattcaacttatctggatcaaagtaccaatccgcaacggtttactgctggatatcgggcggccgttattcaatttgttagggcagttgccggggaaaacggggtgattggacagtttaatcaagcattaaaagcattaactttttcccaacaaattgctttgactaatggtttgtttgcccatacttacgattatcttggcggagttaacccgtttcaaaaaatcaaaagtaatgccagcgctttgtcgtccactaacgaaaaagttgtgaagggcattttagcagaggccaatagtggctttttaactggccaggttgtcggtgagcatggtcagtcagttattggtgattatgcttatcgcggagatgattttaccagtcaacatgatctaccggcaatgatggttcaatcgttaaacacacatagtctgaccgatgccattaataaatttgttaatgtgacgttgaaacaacttattaattgtctaagtgcgattggcttggctgcgtttgtctatcgatctttaactcccactaaccgtgatttgattggtgtcccggaaaccgatgacactaatcaggacaaaattattgatgcgaccattcagcatttttctactattaacaataaaattgattttcccgaaacaattactgaattggcagacaaattggccatcctggatttaagcggcaccggtaagtcaagaagttcaagcttgcaaaatcttcaacaacggtacagtgtcgttttaaataatgaaaatcaccccgttgttaatgatcgaggtgagcttgttaaggttaattatggtgtctttgaattgctttatgaaacattaaaacaaacaattggactgccactcattgtgagttacacagtaacaagaaaccagcttttaactgaaattagagctggtgtgtatttggcatcacgtcgagtgagtgaaccggatctgcgacttgaagcaactttgactgactttgtccgggatgttgcccgctaccaggttgaccagttgatcggcttggttattcgtggtcaaaatgatcgtgcggccaagaaacaggctggcagcttgggcgcttttcatcatttgatgcgggtagactctgatctgcaatcaatcaatccacagtatggtgccttaatgaaggacactaagaagttgtattaccagttatatcagagctcatttttgactcaggacgctcccagtcatcagtaatttccatagacggataacgattaaaactcgaaacacgattgagagcattaccggtacctgatttaatttaataaggtatctgaaataaaagacggggctgagacaaaaataattttgtcccagccccgtcttgtgtaatcacgattattaccgagtgaaaacgtgcgccaaaaggcaacttcctgccgcgtaaccgaattatccaaacattcaagcccggaatattcggataatccgattacgctctggaagttaaccgcctttcgtcccactctcgtcttttattaatatagatataatcgttaatatgctggatttctgattagcatggcagatcccatgccgcctcccatacacagcgaagcaattccgtattcacggtttgtgcgctttaagttgttaatcagggtggtaacaattctggcacccgagtcgccgagtgggtgaccaagtgcaattgcaccgccattaatgtttactttgtttaatgggatattcaaatcccgggtgactgctacacattgcgaggcaaaagcttcattgatttcaaataggtcgatgtctgcaattgtcatccgaacctgcttgagtaacttactgattgcataataaggtgcgtaccccattatttttggatcaatgccacattcggcgtatcccattatttctgcaattggatttaagtgttgttgctttgctttggtttcagtcataagaagcagggcggctgcgccatcgtttaatccggcagaattgccagctgttaccgttccgtcttctttaaaggcaggttttagttttgacaatttttctaaactggtgtcgaatcggacgggctcgtcttgactgattgtgtgactgccgtctttgtctttaatttttattggaataatttcatcggcaaaataattgttcctgattgcatttattgcatgttgatgggaaagcagtgcgaattgatcttggtcatttctactgacattgtattgagcagcaacgttttcagcggttaaacccatgggacggtttgaaaacgcgtcaagtaggccatctttttctaaaccatcgtacattgtcactgagccaaactttgtagactgacgttgattcatattgaagtaaggaacgtttgacatgctctcagtgccgcccgccaaaatcatttttgattcgccaagtaaaagtgacatttgtgcctgacgaattgctttaagtcctgatccgcaaacttggtttatagtaaaagcagttttattttgtggaatattactattaagttcaatttggcgtgcaacattttggccgttaccggcttgaattgcatttccaaaaatgacttgatcaacttgatcggcagattggcctaaattgaatagcactttttttgatacaatggttgctagttgaacggcggaaaagttcttaagaacgccacttagttttccaatgggtgttctttttgcatccgtaattacaattttctccaaaggtcactgaccccttttcattattttcaagtgctagtatacagggttccggatgtgtttgcagggttttgtgatcgcttttaatgtttcgtaattctttcttgccaaaaaacttttcaagaatttcgaaaaaagtgttgaccgatctcaaaatagctggtagtatattactcgttgcttcgatgcgactaacacatataccaattgcttcttaaaaagtttttgttgacttacaagattcgatgagatataattgttattgccgttgaggtaaaggaacataaggattttgaatgacgaacgtttttaaaatgcaagtcagaaatgtttgtgtttccgaggtagacctttgaaaactgaacaaaattttcgacaaacgaatgtgtagggcgcttcgatttttaatcgaagccaaacatttgcgaagtcaattcgctttgaataaaagtaacaacaaaataatcatgagcttatttcgagcttatcattttaactataagatgagagtttgatcctggctcaggacgaacgctggcggcgtgcctaatacatgcaagtcgaacgcgtcttggtcaatgattttattgatttcaggtgcttgcacttctgatgatttaacactgggactgagtggcggaccggtgagtacacgtgggactggcccagaagtggggtataacattggaaacagatgcaatacgattttcataaataacgaaaaccacatggttctatgtttaaagatggtttcggctatcacgtttggatggccgcgcccgcgtcgtattagctagttggtaaggggtaacggctaccaggcaatgatacgtagccgacctgagagggtaatcggaccacatgactggacacggccaaactcctacgggaggcagcagtagggaatcttccccaatggcgaaagtctgaatggagcaaccgccgcgtgagtgagaagggttcgggctcgtaaaactctgttgttaagagaacgtatcagagtaactgttcatattgacggtatttaaccagaaagccacggctaactacgtgccagcagccgcggtaatacgtagtggcaagcgttgtccggatttattgggcgtaaagcgagcgcaggcggtttctttaggtctgattgtgaaagccttcggttcacccggaaggaaaagaaggcatcggaacactgggcacttgagtgcagaagagaggacagtggaactcagtgtaagcgtgtgaaatgcgttaatatatgaagaaaacacaagtggcagaaggcggctagtctggtctgtaactgagctgaggctcgaaagctatggtaggcgaacaaggatagataccctagtgtcacacataaccgtaaacgatatgctagtggtttgacgggtttccgccttcagtgctgcagctaacgcattagcatccgcctgtggatacgagccgcaaggttaactcaaagaattgacgggggccccacaagcggtggagcatggtgtgttaaattcaatgctacgcgaagaaccttacccaggtcttgactatttcgcaactcaagagaattagaccgttgcccttcggtgagacgaacagggacagtggtgcatggtttgtctcagctcgtgtcgtggatggttggcgtagtcccgcacacgagcgacaacccttattgatcagtttgccgcataagttgggccactctgcagtgagactgccgggacaaacccggaggaaggtggggatgacgcaaataatcatgcccctatgacagggatgacaca

SEQ ID NO: 648 - DNA, 23485 bp, Unknown
  Metagenome-assembled genome
gtcttgggacatcgtttttacttctttctatctgaattattggctaattcaatagtagggcgatgccctatttatatgcaaaaaaagattgataccttacggtatcaaccccaaaaattttagacccgttaataataactgtcatcaataggctgtggctggaacaaaattctttgttccagcctttttctataatttcgattattatcaagtgaaaacacggcagaaatttaaccgcgccttgtcccactatcagtcttttgtttttcaaaggttctggttaggaaatagtgagtcatttttgagcacctggttttgtttttgatgagattatgcgaaaatagataagggaaatattcgaataaacgtaaattcatagtgaggggactgagtgcttgtttaaaaaaagaactgaaatcagatttaattctgttattatctatgcactaattttgaatgcgggtgccgcattcatgtggccgctggtaacagtttatttacacaattatctgcataaatcattaactttagcagggatgacaattttggcaatgtcgtgttttatgatgctggggaattaccttggcggctatttgtttgatcgctggtcaccatttagaaccgctgtaatcagcgtcttaatatcgactggggcaattgttgttttaatttttttccatggatggccgatgttttcgattatgctattatttgtaggccttggtgatggcgcttgtatgacattattaaattcgtatgctgccagtattaaaagccggtcaactcgggccatttttaacattctttatattggtcaaaatttagggattgtgattggtaccttaatggttggggtccttttgaagaatggggttacaacggtttttatcgttgccgctattttttatttaaccttatttgtcattacactgattgattttaatgtgccggtagatcgacgggcaccaataaaagcgtccgataaagtaactcccggtgcccccattgaaacgaatgccaattggctggttttagcaatttgtggcattgtgctggctgtttatttagcgtatgccctttgggagagtgtgatcgctgttcatatgaccagtttgggaattgcgtttgaaaaatatagtctcttatggacattgaatggcctgatgattgtctttggtcaaccaatcattaatcgaattggcaatcactttaaaatgagtacccaaacttacgttggcgtggcaatttttgcggcttcttttattggtcttatttttgcgaaagaatatcctgcatttattgttgtaatgattgtgactacgattggcgagatgattggcttccctggaattccagcttggattgacagtctttcaacacccaaacaacgaggaaagtatcaaggctactttaatctgtttttgtcggctggacgagcacttggcccactgttgggtggcattatccttgattttgcctcatatcgagttttgttctcctcggctgctggattgattctgtttttcctaattattttgatggggacaagttggcagcgaaagcaaaaaagtctgagagaaccttaaatcagtttatttgttattgatgtgatataaaaaatagagagtgggacgaaaggcggttacgtggcaggaagttgccttttggcgtacgtttccactcggtaataatcgtgatgacacaaaacgggactggacaaaatcacttttgtctcagcccctattttttgtgtaggtccaattattatcaagtgaaaatacggaagaataacttccgatcgtagaactgaacaactcaaacggtcacaatctatttaatcctttaactttttgccaacaactgatagatgcgttcaacatctctgccagttccacgaagttcgtagtcagctagaaagggacaattaaattgagatgcatagcgctttgcggtcagacaatactgttcgttgaaatttcgattaccactgccgataatcccacgacagagcgaggcgtttttgtgataagcgatatattcccccaatgtattggtcatcagttctttaacgccattgtcaataccgttaccaccatctaggtatgtggggacgaacgcaaagtatggttgagtctcatccgcaaaatcagtttgttcactaatttctgtagatttgatcaacgggttgtgagcatcttgatcgtgcatgccaactgcgtatttggttaaatttttgacgaatgaacgggtgtttccctcaattgatataaataaaattcggattggattcaaaacttgcctcctcaataaaagatatctttaattagaatccgtgtaaaggattacatactatctaatactttaacgattctttaaagagtaatcaagatcgattctgaataattatcattttatctgatgcgtgttggccgtcaggtggcattaccgttttttgtgatgatcagttgcctgagagtgcgctaattttcgacttcttgaggaagccaactttatcatcccggtgacaatcatagaaatcaggacaattaagaaaccagccactgataataatttaccgatcccaattcctggagtggtgtaagttaaatgaattttatgggttccagctggtaatgatgcaccaacaaagcccttgttgacaacaaacgtgctggccttcttaccatcgattgtcaattgccaaccatgtgagtaaggaattgaagtgaccaaggtgctggcggattgagtatctgacctgccgctaacgtgattatcattgacttttaaattagtcaatccagactgttttagtttggatatttgattgtcataggacttgttaaacggcattgcgacgagtttggcagatttgaatttaatgtttttgaccatattaaaattcaacttaacccgtttgcgagccttggctgagtatcctaaatttaagacaatatcgttgatttggcggtagtttgaaagattatcactatcatattgtgcaaatccattatgaaagccgctggtgcgggcatcaaagttataaccaccaaaagttggcgttagcaagctgtgacgggcaacatcgagcttacccagatgagaatacagtttgttttgcaacagcaatttattagccatccagttgttatggtcagtcatcgtggcgttggtctgcttaattcccgaaagaaccagataaagttcggcatttctagtttgctttggcttattaaccttcaaatagtattgaagtggcttacccattacatcagttgtcatctttttgaggttatttcgattttcgtactcattattttcaagaatcatccgattagttgccagtaagtccttggttttcgttaaattagcacctaggctgacttgggcgtgaggctgatcaatcacttgtttttgatccttatcgccaagaacccccagacgataagccgtgagtttcttaccggaatctatgaaagctgatcgatcaacttgaacttgatatctgaggttctggcttggagatttgtaattaagtggatgagtgtcatgctgattattaacaaccgcaccttgagtcataattcgttcacggtttaatggatcaagttggttatattcagccgttgaaaccgtcttaagctgtgtataggcaagtggcaacgcgttcctgtttttgtaaattacagttccgttcatgttttcgatggcggaaaccgcattgactcgagattttgcttgaaagattaatggtttcccattagcttttttaacgagttgatagccatacggaaccattggtggtttttccgtgttagctttagcaaacatatatttaacgccgattaagtcattgaaggctgttcgataatctccttgagcgatcggagtattcattgaaaattgactattaccaaccgatctggaaaacttaccaagatacccgttttgaagtgttaagtagacagaggtgttattgataccggaattaattgaaaggtcagtgttggtatttgtatagtttgctaaattttgtaagtgctggttgtagtgataacgcggtgccattgaggttctgaagaagccgggttgatttttgatatacgtttgcgcattgttgtaataatctttaccaaagcgggtggcgagaccacggttcagctgctgaattgcaagattactagcatttggactgtaaattccgacaatgttagaggcaatattcagcatgaagatgcctaaaattaataagattcgtgtaagtggccgccacttaaaagtgaagatgatgagtaacgcgattattgtgagaaataggaaaccatatgaaacggcatcatgggtttttagatttaaaataaatccgtttgttgcccaaacaaggacaattaatagtattccagtaccggttagccaagccacgtcttgcttggttaatgtatccaaattatcaatcaaagccattgttgcgaggccaaagataatgttagccagcaagaaccagcgattggaaggtgttgagatcgcattcatgattgcaccaaaagctgggatcagaatgccaataaaggcaacaattaatccaacgttttgccagaggtaacgtttaaaatgtcgaagggtataaacgacacccagaaatgacaaggatgagatgccaactactaaccaaaaattcattgcccgtccggttgttagaattgagcttggcatctttagatagtattctggcgggaaaaatgccattccgtttgcaaatgcctggtgaattcgggtcgactttgttgcaaataaagcagttggcagaaaaacaactgcagacattccgagcccgagagcaacagaccaggccatcttcgcaaatgattttccaagatgaaagctggcagattttcggagactcaaagtttgaatgatcgtgtatacaagtgatccgattgcgagaatccaagcaaaataaaagttggcaaataatgttaaaaagaccgctaaggctagtggaatccaagatttattgcgcataatgcggtcgatgccgtaacataacagcgggaagaaaattaatggcaaaataaagaatggatggtgcaaaccagtagaaagcgcatagccgttaaaagcatatgcaagtgatccaatgattcggctaatttttttgaagttgtaagttgatgaatacaacataaaagccagtccagaaacgtacattcgtaagaaaatcaggacagcaaatcccagttcaatgtgtgactgtggaaataagataataaggtagttaaataaatcaccaatgacatagtaagatagattggttaattgatcagaccccagaccaatgttccatgcccagtgagtaaatccctgactggggttggaaaggaaggctgcgatcatgtggcgaagttggacaagaattgggtaatgctgagcaaaaccatcgagttcccaaatcattgaacgaccggtcattgcaagagtcccaacgatgacactgattagaactgtaaataacaccgtatatgtcacccaagctggtgttttttgccataactttttcaagaggatccccctttaagtagtgtgtgaccaccaggtgagatgcttggggtcgcaatttgaataggctaacgattaatcgttagtgttaaaaatggttatcgggccatttggtttggacacgtgctatccaagccatccattattattatacaaagatagcggccggaaccaaaacctaagttttgtcccggccgctatcttaagttaaaattaatttgattcatcgtctgaatcggtattctgatcaccgtttgttggttgaggttggcgtttggtaacctcaaaccaattgatgaatgaattttctaagtcaattactttgaaatcaaagttctcaaatgaaatttcctcgccacgtttgacgtctggatagttatcctggaaatacccggctaacgtcacggcgtctgaacttgtgaattctggaaaatccgcgtcaaagtatcgttcaaaatcatgagtggttaatttaccacttacttggtaggtcccgttaggctgtttgaaaatgtactcggtaaatgatggatcaatttcatctcggacagttccaaacaattcttcatagatatctttatcggtaataatccccgaagttccaccatattcgtcgacaacaacaacgattggtgtccgtttttcaatcatttgatgaaggacatcggtgattggtgtcatctccggcgttgttgaaatatttcttagcaggcggtccaccttaacacttgagtcgacttgagactgacgaattaagtcgtaattgtagacataacctaagattttatccttatcgttgttggcaacaactggaattcggctaaatttcttttgtagataaacttggacggcttgtttgatattagttgtgatatcaataaccactaactgggttcggtcgatcataatatctttcgcaactttatcgtttaattgaaaggctcttcgcatgtataggtagtcattttgctcaagggcaccacttttaaccgcgttctttgataagcttaaaatttcagcttgtgagaacgactcggcattttcattggcaaatggtaatcccagtaatttgacgatcccattggctgaaacattgagtaaccagacgaatgggtaaaacataatgtgaaaataatggagtggtgttgaaacgaagttcaggaccttcattggcatatcaatactaatgtttttgggaacaatttctgttaaaacaacttccaaataggttagaatgataatccccaaaacagcaccaattgcatgtgccgtagtaggattgattggcgaattgtggacttccataacgtccaccaaaattgttacgacaaatgattcaccaatataaccaagaataattcctgccaagctgacaccaacttgggtcgtcgataaatattcgttaagattggttaccatgtgaatttcgcgattaagcttggtaactttttttcctttagtgatcttcttatcttttagagctttttttctttcttccaatgcgctcagccttgattgaacaagtgcaaactcactggcaacgaagaaagctgcaaagaagaacgtaactataataatcaataaattggtcattagctggctatcgcccaaaattttattcctcatttcaaaatatatttgattaactgattatgtaaacatcagattacatctaattatacgctgatacaagggattttttaagcaaatgggcagtttgatggacttttttcttaattttgtggcaaatcagtgctacgcttaacatagacaagaaataaggggatgtagatatggctgaaaaggctaaggaaagtgcagaagaaaaaaaggcggatgcagaagagaaacccgaaagtaaatttaatttctcaagtgatgaagtaaaaaaagctgtcgatttgattgaagaaaagggatacattactaaaatcgactttaaagaaatggatgacgatgattgggcaaagggtttctccaaagaaatcgacaaggtattccaaaagagtgatgaagacccatacatttactatgaaaagtttgactttgttggtggtgatattgattccattatttggaatatggatgtcatcaaaacgcgtgaaggtgctttggagaagttggctgacgtgctgaagaagcgaattaagtaaaacagagtggaccagcaagcgtttaggccccggccatataagccccctagccttgatattcccgattttggaatatcaagttagggggcttatatggccggggcctgcttgctggtccacgttttaaccaaataaaaagcgcaacaagatattcccgattttggaatatcaagttagggggcttatatggccggggcctgcttgctggtccacgttttcaaccaagtaaaaaggtcaacaagatattcccgattttggaatattaagtcaggggggcttatatggccggggtctgcttgctggcccacgtttcaaccaagtaggaagttcaacaagatattccagacttgaatatttggataattcgattacgcggcaggaagttgtcctttatcccgtatttttgcttggtaataatcgtaattagacaagaagaacggccggaagttgccttttgtcccgcgtcttcgctcggtaacaatcgtgtttacacgaacagaggctgggataaatgacgattgtctcaacctcttgcttagttatgtgagggttaacgtttgataatgcagccgtttcttcaggcatgaattatcgtaattgattagtttttgtactgtttgcctaattcatagaccagctccggttcattgcctgttcgctgatttcgattcataatgtcgagcattgattgttcgtcatcgcttaattcaaaatccaattcggcattttccttaattcgttgaggtgtctgtgattttggaataatcgaaatgccgcgctgaatatcccagcgtaatacaatctgggcaggtgtctttccgtggtgcttagcaattttttcaagcattggattgtccaataccaaaccacggccaaggggactccaagcttgcgtgataattgattgtttggtattaaagtcaatcattggttgttgcgtaaagtaagggtgggtttcaatttggttgacaaccggcatttcatcggcctgagttttaagcagttccaactgtgaccgggtaaaattgctaacaccaatcgagcgtactttcccctgtttctttaattcttcaaaggctttccaagtttcaaaaaatttatctgcaattggccagtgaacgagtaggagatccacatagtcagttcccaattgttctaacgaaaactcagtgctattaatggttaaatcgtgtccctgattcatttcagtaactttgtcgatgataaacaccttgtcccggctaacccctagtctggcaatggcgtctcccagaactttctcgtttcggtagtattgagcggtgtcaaataaccgatatccggcctcataagcggtctgaacggattgggtcatgagctcaggcttgttaattttataggtaccaaatcctaggatgggcatctgagtcccgtctgctaattgataagtacttttatctggttcaaacatgatttccctccaaaataatatcacgagtattttaatgttggtctggctgattgtttctctgattaattggctatcaaaccccaatcaactttaattgatatcaacttatatagtagcaattattaataatcattgaaagcgcttagctaaatcattcccctaagccgcctaaatgataaaataaagtggttaagatacaattggattagataaaagatgaaggtgatgggatggggtatttatttttgacgttggcaattgctggcgagattattggcacaaatttattgaaagcttcggatgggttcaccagtttggttccggccgtggcgtcgttaatttcttatgggctttgcttttattttatggcattgacgctaaaaacggttaatctaaacgtgacatacgcaatttggtctggcgtcggcattgttattacaacgcttattgcggtcttttattggaaagaaccggtaaattttgccagtattttaggaattgggttgatcctgatcggggtggcgatattagatctgtatgggccgtcatctcattaattaaatttaacgtgatcttaaaataatttaaacttcttgaaatgccgtacgaaaatatgtgaatcttttgggttattttgtacaatgatggtaaagcgaggtgttgataggatggctgaggtaaatttatcaaatatcaatcctgatcagggattatctaacgcgcaggttaatcagcaaattgaaaatggtaagaaaaatgctgctgaacaatctctgactagaagcatccaggagattcttcgcgataacatttttacactcttcaacctgattaacgttgtcttaggggcgttagtcttttacaccggcagctataaaaatttgttgtttttgggaattgccttttttaatacggcgattggaatcatccaagaaattcggtcaaaacgccaagttgataaaatggtgttgttagcagagggaaaaacgaccgttattcgcaatagtcaggtgattgaaatccggccggaaaatatcgtgcttggtgatattattgtccttggccggggggatcaaattccggttgacggaaaggtgttggttagtcgcggaatggagattgacgagtcgccgattactggtgaatcggttaccatttcaaagcaagttgacgatcaagtaacgtcgggaacttatttagttggtggctccggaaaaatgttggtcacgaaagttggcaaggatacgttcgtcaatcacatttccaatgaagctaaaaaaggtgaagatacctccagcattttattgaacaccattaatcgaattattaaagttttgacgtacgtgattattccactgggaatgattttgtttgctgccaagttatttggcggtacagggattaatcgagcaattttaggttcagtagctgcgatgattggcatgattcctgaaggattagtgttgttaacatcaatgacactggcagtttctgcaatgcacctggcccgcaagaaaacgttggttagagatttacccgccattgaaacgttggctcgggttgatatcatttgtctggataaaacagggacgattaccagtggtgatttgaagtttgttgatgccattcctttaaaaagggacgtttctgcgactcagctaaagcggctaaccgctgggattacgtatgccacgggggatagtaatgaaactgctaatgcgattaaagaagcgattgatgatcctaagatggtttcccaaaagattgtcccgttttcatccgatcgaaagtggagtggtgctggctttgagaatgatgatgactatgtctttggtgcacctcagttcatttttaagcaattaagtgagggcaccaagcagcaggtccaacattatgcgagccagggataccgagttttggcggttgccaaagtggatgatgttgatgtaaaacaagttttgaaaaatccagaactgattgggttaatcttaatttctgatgtgattcgacccaatgcttataatacgtttcagtattttaagaaccaggatgtggtcattaaagtcatttccggtgatgatccaacaacggtctcaacgattgcccagaatgccggaattcaaaacgctgaaagaaagattgatatgtcaacgatcactgatgacgttgactttggcaaaatcgcaacggaaaatacagtatttggtcgggtgacacctgatcaaaagaaacggctgattagctcacttcaagatcgtcagcacacggttgcgatgactggcgatggggttaatgatctgttagcgctgcgacaagcagattgcgggattgcgatggcttcgggaagtgagagtactaaaagtattgccgattttgtgttaattaattcaaactttgatgcaatgattgatgtgttaaaagaaggacgccgggttatcaataatattgaacgagtagcttcaatgtacttaattaaaacgatgtattcggttgccttgtcatttatttttgtgtttatgaccgtcggttatccgtttgagccaatccaattaaccccaatcacgtccttgatggtagggattccgtcgtttttcctggctttggaaccaaacttcagtcgaattacaaaccaatttatgaaacaggtcttgattatttcaatgcccgcggcaatttgtattgtgggttatatcatgttcattgagtttattggaacagtctttggtatgcgttacgagtttacgtcaacgttgtgtgtcctattaaccggggcaatttgctggctggcattagtgatggtttcgcggccgctgaatcgattaaaggttgggatggacttacttgtattagcagccttcctagcgatcattgtcttctttaataatttgttttcactggtctcattctttaataaggatatctggctgtacgggattccattgatagccactgcctatccactgtatatttttatgcagggtgtaattgcgacgtttttgaataggcgtgaggcaaagcgtgcgaaaagacgcgggtagcatgtcagatgatgcttttaagccgaaagtatgccaattgacccgatttgtatttatgtccttgacgtttttgagcttgacagcacataataagtgtttttcgcaggtgactaatcgatatcggctttaccctgataccactaagaaatcgttaaaaattgcaatataaaaaggtgttaaaacaaggattaccttgtcttagcaccttttattaccagagcggcctcaagatctttgtttgagtttaagactcactttgagaactgtatgtggaattatctgaaattatttacgggaagctgacttcttagcagtggtcttcttggtagttgacttttttgtagtcttcttgccaagagccttcttgtaagcagcggcagctttcttgtagtttgctttagccttggtaaagttcttcttagctttagtgtaggccttcttgttctttgtagtcttagctttagtgtaagctttcttagctttggtaaagttcttcttagccgtagtgtaagcttttttggctttagtgtaagcctttttagcagcagctttcttagtcgtctttgcaggcttcttaggagttgttgatgatgatgttgtcgtaggttcacttgaatctacagatgatgaactaactgttggtgtggttgttgaaccactggttgcagccgttgaaccactagtagtagatgcactagtagctgttggtgtggtatcagcgttgttggcaagtgcgttggcagatgcaactgaaccaacaccaaaaatagtagccaatgctaccaagttgattaatgttttcttcataaaagaaacctcctcgatttttaacccaatgcccaatacagttctacattctctaacacaccataatatgtaggctaattctaaaaattaacattgatggggtgtgcatgggcttaaataataaatcaatcggaatgattgcacacatttaccattcagcccattgactagtttagcactaactctttaataataacacccaacgatcgttatcagtaaaagttaatcactacataacccatagaaaatgttaacactcattatagtgtgttaaggtgattttttgcaatagctttttactaaaatttattagcgaactgtaggcttgcaataaattgtcctgatgaattaaaaaatgaaatagtgtggtaatcaggttaaaaacgttttagctaatatgtgtgattaaattgttaggggaccagactttttatgtcataattacgggaatttgcatcacaaaaaaataattggcatataatccgaataaaatgttactattcgtgatagctgtatatgagttgtactattcgattttttatgaggattgggtgatttttttgtcgagatatttgaagtttttccgagagcctttcttttactattttttagtagtcagtatttggttcatgagtttttgtagttatacgtcaccgttgttttattttgattattcaccggataataattgtttttttacggttggtaaagcaatgatgcatggtattctcccttacagggacgtttttgaacagaagggaccatatgtttacttgattcacggcattgcgtcactaatgagtggccgttctttattgggaatgttcccctttgaagtgctgagcttattaatgacgatgatcgttgtttacatgattgctggtttatacatacataaaagtactgccggaattatcgcgattttttcgccggtctttcaactctttcatccgtattacacctatggcgatacagtcgaatccttcctgtttccggccatgttgatgctgatttattcattgctacgggcggatcaagagaatcttaagctgtctaaggccggttgggcaattcagggatttcttgttggactcacattcttaatgaagtacacacttttaggtggttggattattttttatatctggatttttattgagtatgttactgataaacgatatcgggatattcagcgattaattttatggagcttattaggctttttaattgcaattgttccttggctgatttatttcttagtaacgcattcattggcggcctttattcacgtctatttctatgaaaatatgcatgtttatatgctgtcggataattcggtgttcgccaagtttcttgagtcactaacaatttatagcagttttctgcgccaagatccgttaatctttgtatgtggttttatcggattgatttacttgatgtttacaaactcgatttttaaaacatggcatggaaaagcgttgtttgtggcgatgatgattagtaacgccgcttttgttgtttatggatatcatgccggccaggtctatcagtattatgagttggcattcttcccttatattgttgtgccaagtgtgtttttactaattcaattatttaagttttatcaatttaagattacaaaagttaatgagtcacaaatttttattgggagtgtcttaatcagcttatttttagtgctgggggttaataataatattttaagttccaaaatctttccgaataatgcgtcagtgacattacagtccacgacgaagccacagcagccggctcagattatttttgggaacatcatgcggcagcagagtcatggtagaccaacattattgaattatggatcaattgacatgggattttacacaacgtctggcgcgttgccaacgaattattatttccaaaactataatattgcgtataacaaggcacctcaaattatgaattcgcaaaatgagtcgattaagaaggctaaaacgcagtgggttgtagtgaatacaccagctggaaagaatattaagcagtggcgcggtacaggaagtaaaaaaatcagtgcagggaatctaaatccaggaacgaaaaagatttcaaaagtcatgttaagaaattatcgagtggtggcactgcacactcaaaattttgaaaataccaatgtggcgtattggttgttaaaaaggaagagtgcaaaaccaagcgattagtttccagaatataaggcccttaggcgctctcccttgtttggggagatcgcctaagggccttatatggccggaaactgcttggctttctgtacatttagcaagtccggagcataatcaatatttttgtggaaagccaatatcagctatggggatgtctgaggccgcacaattaggaatagtaggccaagtaatatgcgaattgtaaatgattttaattgtatcgtcacaaaaaaaacagttgggtcgattacgttcggcgacctactgtttttttctgaatagctggatgacacaaactgttgtattttaatttcacattacctagtcgttaagactagataatgtgatataataaaatcaaagaggtgatcccatggaatcgagtaaagaacagtacgaaaaatatgaacagtgggaacaaaggctaaaaactgcagaactgccattgtggtcagagctaccaaaatttgatttatatatggatcaggtgacagcactggttaacgatatattgggaccgattggtgttgatcaggtaacgcctgcgatgattaacaattatgttaagcataaagccattatcgccccggtaaagaagaaatatcagacaatgcaaattgctgatattattctaatcagtctgttaaaaccggcattttctttagaaacaattcggcatggcattgatcaggtgacggcaaatatttacccacagcaagcatatgacagttttattaaacggttgatgttttcatttaaaagtatcgatagtcgaaatagtcgtgccttagctgaggacaatttgaacgataagttgatgcaagttgccgtgaatgtcattattgaccgactccaatctgaaaaattattgggaattattgaaaaacctttgactaaaataattaaatagtgaaccgtttcactttgaatcaactgtaatcggttacatttaagaggggcctgaaattcagactcctctttcttcatgcatactccgacaagggaagaggaagtcttaataatttatgtgattttttgcacaaaagtatttacatctcagaaaaacgtgatatcattatccatgtgaaagagataacaaagaacttttcattggaggaaagcaatgatagaaaataaagtaaaagttgaaaagaagaatgaaaagaccgatgttgacactgtaattaatcagttggtttcaaaagcacaaaaagcacttaaaattatggattcatttgaccaagagaaagttgatcatattacccatgcaatggtaatggccggccaagacaagcatatggaacttgccacaatggcatatgaagaaaccggccgtggtgttgctgaagataaggcaatcaagaatatgtacgcaactgaagaaatttggcacagcattcggaaccacaaaacagttggtgtgattaaagatgaccatgaacgtcaattgatcacagttgctgaaccacttggtgttcttgctgggatcacaccagttaccaatccaacttcaacaactttgtttaaatcaatcattgccatgaaaacgcgaaatccaattattttcagttttcatcctcaagcattaaagtcatcaattgctgctgcaaaagtggttcgtgatgccgcaattgaagccggtgctcctgaaggtgtcatccaatggattactgagccaagtattgaagcaaccgataaattaattaacaatcccggtgttgccagtacattagctacgggaggccctggtatggttaaagccgcttattctaccgggaaaccagctttgggtgttggtcctggtaacggtccggtttatattgaaagaaccgctaaaattgccagagccgtgaacgatttggtcctatccaagacatttgataatgggatgatttgtgcgactgaaaacagtgccattattgatactgaagtttacgatgaagtaaaagccaatttggttaagaacggcgtcttctttatcgcaaaaaaagatgagcccaaattgactgaagcaatgtttgatccaaaacgtggcagtgtccgtggaccaattgccggtcagtctgctaagaaaatcgctaaaattgccggcatcaaagttccggaaaatacgaaggtactggcagctgaattgacgggggttggacctaagtacccattatccggcgaaaaattgagcccggtcatttccgtctataaggctaatagtcatgaagatgccttcgaaattgctgaaaagttgctgaactacggtggcttgggtcatactgcagcaattcaaacgatggatgacaaaattgctcttgaatttggcaagaagatgaaggcagctcgggtattggttaatacgcctggtggatttggcggcttaggtaacctttataatgaaatgacaccatcattgacgcttggtaccggttcatggggtggtaattccatttcccataacgttactgattacgacctgttgaacattaaaactatcgcaaagagacgaaataatatgcaatggattaaattaccacgagtttactttgaaaagacttcaattcgttaccttgacgacatgccaggaattaacaaagtctttatcgttacgacacctgggatggttgaacatggttatgttgacacggtcttagatgagctaaagcgtcgaccaaatgaaattgagtattcacttttctcagatgttgagccggatccaacgactgacacagttgaaaagggggttgcccagatgcgtgcattcaagcccgataccattatcgcgcttggaggtggttcaccactggatgccgctaagaatatgtggctgttttacgaagatccaacgacaagtttctttggtgctaaacagaagttcttggatattagaaaacgggcttatcgcttcaagaagccacgtaaagcacaaatgattgccattccaacgacctcgggaactggttcagaagttaccccgtttgctgttatcacagattctaaaacgcatgttaaatacccgttagctgactatgctttgacacctgatgttgcaatcgtcgatcctcagttcgttcaaacggtacctaaaggcacggttgcagcatcgggattagataccctttgccacggctttgaatcatttgtttcaacaatggcttcggattatacacggccattatctttgcaagccattaagctggtatttgataatttaactgcgtcatacaacggtgatccccaagcccgagaagaaatgcataatgcagcaactcttgccggaatggcctttgccaatgccttcctcggaattacccactcggttgctcataagctcggcggtgaatttgggattacccatggcatcgcaattgcaatcacggtgccgcacgttattcgttataacgccaagttaccggaaaagattgccgtatggcctaagtatgagtcctttagagctaataaagattatgctcaaattgcccgctatgttggcgttgaaggcaatacggatgaagagttaattgaagggttggttcaaaaattcattaacctggctcattcagttggcgttacgcttagcttgaaagcccaaggtgttgacaaagccaagtttgaagcttcacttgacaaattagcaacccttgcttacgaagatcaatgcacaacggctaacccaaaggagccactcattgctgatttgaaacagatcatgattgatgattacgaagggacaaacgttgaaaagtaagctgataagttttgacttgaagctttgtacctacaatcacaaaactgattaaatgaataaataagtgagaagttgagacgattgtgaattttgtctcagcttttttactttatcatcgattctggttaagttaatggttacttataccaatcattagtaatttataattttagcataagtcactttaagtgcttctggttaatgttcatgataacctataaatgtagacatgtaaccgtttccgttataggaggagcattattatgaaaattggcgtacctacagaaactaaggctcaagaaaaaagagttggtgtaacacctagtaatgtcggtaatttaattcatgccggccaccaagtagttgttcaaagtggggctggaatgggtgccggatattcggacgatgattataagcaaatgggagcaaggattggatcggcggaagatgcttgggattgcgatatggttattaaggttaaggagccattaccatcggaatatcagtatttacgtgatggtttaattgtgtacacatacttgcatctagctgcagacaaggaattagcggaggctctgattgacagcaatgccaccggagtagcttacgaaacgatgatcggaccacgtggtggtttaccattgttatttccaatgagtgagattgctgggcgaatgtcggttcaagtgggggctcattttctggagcagccacaccagggaaaaggtttgcttctagcgggtgccacgggtgttaaacggggtaacgtcgtgattattggagctgggactgttggatttaatgctgccaaaatggctattggacttggcgcgaacgtgacaattttggatattaatgcgcaacgtttagctgaggtagaaagtttctttgacggtaaaattcaaacattgatgtcaaatcgccataacattgcgactgcgattaaagatgccgatcttgctattggagcagtgttgattccgggggctgctgcgccaaaattagtgagtgaagaaatggttgccagcatggctcctggatcagtaattgttgatattccaattgatcagggtggtatttttgaaaccagtacccatgcgacaactcatcaggatccaatttatatttctcatggtgtgagtcattatacggttgccaacgtgccgggagccgttcctaagaccgctaccgatgccttatccagtgcaacaattccatacgcattggaaattgctaataagggattaattcaagctgctgaagatgacaacacgatcttaactggaattaacacttatcaaggagatgtcactgagcaagcagttgcagaaagtttggatatgccttatgcaaagtttgatgccaatttgacggtttaattcgatgaaagatagtcgaataaatattgacttggttcagcgaaatgccaatcgtggtgatcgcgaacggactcttgggctgtttgacttatcaattttggggatcggggcgattattggaacaggaattttggtcttaaccgggatcgttgccgcaactgacgcggggcctggagtggcaatttcattcgtaattgcagcggttgcaagttgtatgattggcctttgttattccgagttaacgacaagtattcccaattccggaagtgcttatgtgtatgcgtgggtggcgattggtcagcgaatcgcgtttttggctgggtggaccctgattggtgtttatattacgaccaccgcgactgtcgcaaatggttggacagggtatgttaaatcatttttcaaagaaattggggtgactttaccgcacgcgttgttagcatccccttttgatggcggactgattaatttacccgcacttattatgatttgcctgatgacgtttgttttgacacgggggacaagcgagagtaagtggatcaacaatgtgatggtgattgtaaaattagcagtcatctgcctattcattgtgatgagtattaccagtgttcaagctagtaattggcgcccgtttttaccatatggcatccaaggtgtctttaccggtgccgcaactgtgtttttcacgtttttggggtttgatgccttggcaacttctgctgaagaagttaagaatgttaaaaagaatttgccaagagccattattttatcgctgattgtttcgacaacgctatacgttattgttagtttgattatgactggggtcgttcactacactgagttaaatgtgccagaatctatggcgtatgtcttaatcagtcagggtcatcatttgtcagcccaactggtttctgttggtgcaatcctgggaattacagccgtggtttacgcttttgtttacgccgcgtcgaatattacaatggcaatgagccgagggggctttctgcccaaaaaaatttcattcataaatgttaaaaccaagagtcctaatcgggccctgtggcttattggcgggattgccgcaactctggcaggtttcatcaatatcaagcacttagcggttatcgcaaacgttggttcgctatcggttttctttttaatctcattaattgtgattatcttgcgtcaccgtcagcctgatttgaagcgtccgtttaaattaccatttggggacacaattccaatcttttcgatgttgatctgtggcttcttgttgttaaatacaccattacacgcatggattatctatacggcttggttgttaattggttttatcgtataccttttatattccagaaaacatgtggatattgaacagcgtgaagaacaagaagcattaactgccgagaatcaagttgtttaggcagcatttcaaatgtcagaaatagtgatgtaaaggaattgttgggaaaagctgatcgaaaatcttctgtaatgacatttaaattgttgttgcagaagattttttgtttgaaaaaatctaggctatactaattggtatatttgtaaaatttaaagatatgaggagttctcaagtgatgattcgtggaatgcgtgagattaaagaatttgttagcgaacagttaggccatgaaacttctggtcatgattttactcatattatgcgggtagtcgcacttgccaagttgattttaaaaggtgagccgaccgctaatgaggaattggtgttggttgcggcttacttgcatgatgttgctgatgataaagtagcgaccaatccggcggctaaaagaaaagtcatcattaacaaactggctgaagttggctatgatgactcatttattaaaaaggtttttgaaattatcgataatatgtcgtacagcgctaatttaaaagtgaaacaccaactgtcgattgaaggtcagattgttcaggatgctgatcgattagatgcaattggtgcgattggaattgcccggacattttactttggtggtcattttggcgagattatgtataatcctcggatcatgcctcgtaaggatatggacaaatctgagtatcgtaaacgggggacggtcattaatcatttttatgagaagttatttaaattgaaagatcaaatgaatacaccaaccgccaagaaaattgctgaacatcgccaacaagtgatgctggcctttgttaacgaatttgttgatgaatggaatgggcttgtctgactggttgatagttaatagtttcatgttaagcaaacacatcaagatgacagacttcgaaaaatgaggttaaaggttccggaaaggatcaaattaaaaattgaaatcgcagtaatgatgatggttaagcggcgcaactcagtgaataaagttgcctgccacggggtgaaagatattaaaagtgacaagataattatcgtgatgatggcctgccaaaagccttgacgggcgttctgaaagtcggctggactcaggtcaaagccaccaatacaaatgttagccgctaaaatgataaacagcagtagtccctgccaatgaaaatcaggtgataattgcagatcgacgcttaatggtaactgggtgaattcaagcagccaagtgtaactattaggaatcaggcatttagccaaagctaatgttgctaagcagcacccaaagatgggcgctataccaataaaaagattgccgatattttgataaaaattggcttggttccaacggtgattgacgtagcctaacgtcgggttgctgttagttggtaggctgattaagcgaaagccggtaatccggtggccgaaaatcatcgcgacaatgagatggctaagttcgtgaatcatgattcccaaaaagccaaaatagagctgactattgattccaaatcggttggcaatgtgttgcttggtgttacgattaagccgtgatagtaaccagataaaaaagaaaggcactccagcaattaatccgagtgcccagacaatatttgtgataatttctttaagcattatttttcgccggatttaaaattgaactgcaacactgagccaagtatacaagtaggccatggagacctatgcttaatagtgaccaaactaattaagaaaggacttctccatgacccaaaccaagcatactaccc

SEQ ID NO: 649 - DNA, 9305 bp, Unknown
  Metagenome-assembled genome
gggacatcgtttttacttctttctatctgaattattggctaattcaatagtagggcgatgccctatttatatgcaaaaaaagattgataccttacggtatcaaccccaaaaattttagacccagaatttagtgaattaagaaagtgggagctgggacaaaattacttttgtcccagcccccactttgtgtaatcacgattattaccgagtggaaatgtgcgccagcaagcagaccccggccatataagtcccctaacttaatattccaaaatcgggaatattaagttaggggacttatattctgggatctaatcgcttgctggcccactctggtttttacgtcatttattaaattgtttttgaaattaagtactaaacgaggagaatcgtgttcctaatcgttcctgctttgaattcggaagttccaaccggccgctgccaatgccagcaaactcaatattgtgaccactaagtagtcgtagcggccaccaataaaggaacgttgaacaaatgagccactgccgttattttgactggcggccataattgcggctaggataccaacgccaattgatccagcaaattgttgtaatgtgttgaaaagtgaattcacgtctgcagtattttgtttaggaacatttaacgaagcatttgaaatcgtatttgagaagcccatgttaaagccaaatctcaataggcaaaatgctaacgtaattatgattgccgttagccattgttggacgattataaatattagactccctaatgttaagcagcttaatccaattataattggtaaggcgtaaccatgtttatcagcggttcgacctgcaaacggagaagtcaaagcgccaataattgagcctggtagtaaggttaacccggcgatcattggtgaagtatgcaacacatattggcaatagaccgggataacaaatgagatgccaatgttaacaaattggaggcagaagtaagtgaatgcagacaatgacgtcgttcgttgttttaagattcggatatctaatagacgtgtcttgccatgggtatcgctataaataaaaattgccaaactaattagtccgacgatcagcggcagtatgaaaggtatactaataattggtgccgttgcggcctgactgacagcgtaaacaagtgccgttaatgttaacgcaaggaaaaataggctgagggcatcaaatgatgattttacaccaagtggcgcgattcgaatatatttagttcccaataaccaactaatgataacgatgggcaagaccaaccagaagatcattcgccatgaaagcagtgatgagataacgccaccataagttgggcctaatgctggggcgagagaaatgaccatcccggccaatcccgtcatggaaccgatccgccccttgggaatctgggtgaaaataatgtgaaacatcaatggtgttgaaaggccggtcgccatagcttgaatgattctgccaattaataatattgaaaagcttggtgcgattgcgcacatgatgtcaccaatgacaaaggcgatggccgcgaaaaaatgaatcccgcgggatggaaatcgtttgagcaaataagcagtcgttgccattacgattgttaccattaataggtaaccggttgttaaccattgaacggcgtcaagagtaacgttgaaaatcttggatagttcaggaaaggtaacgttcattgaagtttctgttaagatgccggtaaatgaaagaagtgcggctgctagtaatgccagcaaggtttttcgtttaatgttttcatttaagtcattattttgcaaaactttttctcctcgtttttgtgtaataaatgacacgaaaaaagagagctaaatcgcgttaacgctctcaagtaatgcttgtggatccgaatctataggttcatccaatcgaggtcccaaacaacgcccattgctttttcgccagtgtgaacggtgatggccggactaatttgatacgtactgattgaggccgctgggaagcgatcatgtagggcagttacccaagcttcgctaagttggggattatttgcatccgctactgaaatccgaattggtagctcaattttggcagtcgagtcttgaatggttgtgataattcgatttaacgctgatttcatggttcgttccttagcgaagggaacaatctttccgttgttgtcaaatgttaaaattggcttgatttttagaagattgccaacgaacgccgatgtatttgaaattcggccggttcgttggagatgtgacagactatcaacaacgagacagacgtgaattgagtcgcgtaactgctcaagtttaggtagaatttcagctgcattagcgccgtcgagggccattttcccggctaataatgcgaggtcggcttcaccggcgctggcaattttagaatcaaaaggataaactttgatgccggttacttcgcgactgtaagcgaccaggttttgatagaacgtggtgattccggatgataagttaacgcagataacttcgtcgtagccctcagaaatcaagttgtcaaatgccacctgcatctgacccatagtcacttgggaagttgtgggcaattttggcgattcagccaacatttttaagaattcctgggaggtaatattaaccccatcttggtattcggtgtgatcaaaaataacggtgatgggcaggatagtaatgtgatatttctgagctaaatctttgtcaagataactggcactgtcggtaataactgcagttttcataaataataaattcctttttcttgggattgttttaattgtacgcttgttgggtggggttataaaggaagagagtgtgccagtaagcggttagatcccagaatataagctaccccaacctaatattccggttctgaatattaggttggggtagcttatatggccgggatctgcttactggcacacgtttcggcatggtagccagtaattattccggttctgaatattaggttggggtagcttatatggccgggatctgcttactggcacacgtttcggcatggtagccagtaattattccggttctgaatattaggttggggtagcttatatggccgggatctgctcactggcacacgtttcggcatggcagccagtatcattccggtttttgaatatagccttaggtagcttatatggccgggatctgcttactggcacacgtttcggcatggtagcaaatattccaagtttggctattaggctgaggtagtttaaatgactgggatccagcctccctttgttcaatcacaaatgagacgacaaaaaaggagttgggcaaataaagttacccccaactccttattagttgattacatcgttatctattttgttaatttaattattaattagttgatcgatcagtttatccaatgaatcgacatagctcttaagtttggcattaacagctgcttggctcttgtcgacaacttcaatgtagaactttacttttggttcagttccggaaggtcgaacggcaacccatgtttcatcatccaaccaatatttgagaacgttggatttaggtaaagagatggtcgaagttttgccatccttgtcagttaagactgaggtgctgtagtcagcgtgacttgttacctgatggccatttatttcagataatgggttatcacgaagttctgaaagaatatgagccatcttatctttaccatcaagaccgtcgaattctttggcaatcgtcttctcagcaaagtagccatactttttaaacatttcgtcaacaccatcatataatgtcttgccctggctcttatagtaagctgcaacttccgcaagtaacaatacggtctgaatggcatccttatcacgtacgaatggtttaattaaataaccaaaactttcctcgaacccaaacaagaaagtgtgatcgtgagcggtttcgtaatgatgaattgcttcagcaatgaacttaaagccggttaagacgttgttagttgcaacgccataggaagcggcaatttttacagctaaatcagttgatacaattgatttaacaattgtcccgttttctggtagtgtgccggcctttttcttggcagataggatataattaagtaatacgctcgcaatttggttgccacttaatagttggtaattgccatccggctgacgaacggcacagcccaatcggtcggcgtcgggatcactggcaattaagacatcggctgaaacccttttaccgagcttctttgccaagtcaaaagcttgtggaaattctggatttggaaatggtgttgttggaaactctgggtcggcaatggtttgctcaggaacaacaacatagttcttaaagccggcttcttctaaagcgcggcgggcaatcactttaccagtaccgtgaagtggcgaataaacaaacttcatgttggcgccgacattcttaatcaggtccaagtcaatgttgactgtttttacttttgcaagataatcaatatcgacattttcaccaattagattcatgacaccagactcgcgaagcgtttgttcaggtgttacctggattgcaaacaagtcactattctttcgaatgtatgaggtgatcaggtcagattccttgggcggcatttgaccgccgtcttgaccataaatcttaaaaccgttatattgtttagggttatggctggcagtgatcattatgccggcgtaggtatgcaaatgacgaacagcaaatgataactcgggtgttggccgaatgtcgtcaaagacgaaggtggggatgttatgaaagcctagaacctttgcggattcatgagcaaattcctttgagtggtaacgagaatcaaaactaattgccacaccacgttttctggtggcatcatccagcgtatccataaatgatgccaagccttcagcagcttgacggaccgtgtaaatgttcattcgattggtgccggcgcccatgacaccacgcattccggcagttccaaatgaaaggaccgttccgaaggcgtctttcttttgatcaggatcatttttcatattgtttaaattaagtaaaatattagctggtaaattaggttgttttgcccattcttggtaagcactctcagtattatcgttcaaagtgggatcctccttatatttaaactcagcttcattatagaaatttttggggaactcgtcaatgagtttactagctaaaaatgctaatctgacggaacattatccagctacttgagtaaacaaatagatatttattttagtaaattaactaaatgggtttataattaaaattgagggttttatttcattaattaaaggggtggagaaaatggcaacgattaaagacatcgcgaaacgtgctggtgtttcaattaccacagtgtcgcgggttttaaattatgataaaacgctatcggtcagtgatacaacgcgaaagaaaattttccgagtcgctgaggacctggactatactaaaaagaagaaggccagtaccacccgtgacaatattgcaattgttcagtggtacaccgagaagcaggaattggatgatctatattatttatcaattcgaatgggtgctgagaagcaggccgagaagatgcattacaaagtaaaacggtattttgccaatagccaattaactaaaattgataacgtcaaagcaattgtggcaattggaaaatttagtgatgcacagattaaaaccatgctgaaggcaacaaaaaatattgtcttcgttgattatgatactttggcgaaagggtacgattgtgtggtaacggattttgataacgcgacagaaacggttttaaagcatttcatcgatcacaacttgaagcgaattgggatgctttcaggcgttgagtattcgactgaccacaagttaaagattgttgatccgcgttttgaagtctttaagaattatctggaaaaccattcgttatatgatccggcaaatgtctttgtgggggactttacgctgcaatcagcgtttgatttggttaacaatgcattgaaagcatcacgtaaggattttcccaacgcgttatttgtgtcaaatgatgcgatggcagttggcgctttaaaggcgcttcgcgaaaataaggtcaaggttcccgaagaagttagtctggtgagctttaacgatacagcggttgcaaaatatgtgattccatctttgagtgccataaaagtcgatacaagcaagatgggcgaagtcgctgttcgattgttggatattgagtctaacgaggatgatcaccacactcctgaaaaagtaatcgttggaaatcgactaatcaaacgtgaaagtagtgtgtagtcctgattgttgaacttaaatttagcggactatcataattggagtctgagacaggttacagcttgtctgggctcctttgtttttgttagcgtcatttggatttttatgggacttttgccgttaaatcaacatctaaccacccaatgaatgattgacttattgtttattacatttataatttaaagatgtatattgaaattaaatttttaatggggatgtagacgttttacgtgtttcggcgtttacaaatatgccaataatttgtaaataaaaacgggttattaggcaggctagcagcataattcatcgaatcctggtcatcgtttttctcggcaccgttatggttttcgttacggtctgatacatacttttaaatttgctgcaggagacttgatgatcgttccaaaagaacatgaatacttaattgggtggtaaggagaaagcaatgaataaattcttcaaaaaatatattggaatcgtcatcgtgtggttaatcttgattattgcggcgattatgacgatgccaaattcttccaggctggtcgccaaccagggacaggcaaaattgccggtttcggtgcagagtcaagttgctaagacgataaagaatcactggggacctaaagttagtcatacacgtcaagtatttgttgtctttaacagtggcagcaaaaagaaattaaacgacgcgcaaactactcggataacgtctaccttatcaaatttagataacaagcaaaagggtttggatattgcgtcaattgttaagcctagtgatgcaaccggtctggctaatcaatttatttcaaaagacggaacaacccaattagctgaattgactgttggtaagcgagactcagttcgtaaaatgaacactaatttgaaacaggcaaccaggactgctggtgttaaaacgtatgtgaccagcagtgacgttttgaaaagtgattcacaacaggcaactaaagctggaatttggaaagttgaagtcattgctgcggtggttatctttttaatcctggttttaatctttcggtcattatggatcccggttatttcgctgctttctacggccgtttcctatctgatttcgctcagtgtcgtctttaatttggcacgacattttaattttccaatctcaagtgacacccaagttttcatgctggttattttattgggacttggtacggattttagtattatgttatttaatgaatttaagcaacagctgcgaagaggcagtgaccagctggaggcaacgttgttagccaggaaaaatgctggtaaaacaatcttggttgccagtctgacactaattgtcggtttcgggttactggggctggcaagtttcaatgtgtatcggtcactggcaggcgtggcaattggcatttttgttttactgttggtgttggctacctttacgccattctttatgtttgtgctggcagagcggctcttttggccttccaggaatcttgaggctcataattacagccgatcatggggattcttatcgacccaatcggttgcccacccgattattgcgttaattattgcaggagtggtggcaattccatttgtgttagccagtcagggacgtcttaattacaatcctgcatctgaattgaatagtgacagtcctgccaaagtcggatataaagtcattcaaaatcatttccctaatgggcagggtacgcctgtgacgatttatattaaagctgatcataaactacaaaatgataaggatttgatgcaggttgatcgagttaccaagcagttacaggagcaaaaagggattcacagtgtgacgtctgcaacgcaaccccatggtattccactgggacaaatgtatgttaatcagcagattgaaatgctcaatactgcctttggaaacactgaaaagggtgttaaaggtgtttctaaaaaactgaaaaaggctagtatctcgacttcgtctctaggacagataaatagtcaatctcgggcaatctctcagatgatgacatctattcaacaacaatttaataataatggtatttttgaaactcctgagcaaatggttaatcaaatgcagaagcagttacgcgatacgcatcgtcgacggttaacccaggtgcaacaaaatattatcttagttgcgcttcgtcggaccatgaatgatcaggaacaacagtcgcaaatgaacagtgcattatcgagtattggtttaaagacaaatgcgattaactcaagcacaacgtcatttagaaatgagctaaattcggttcaaagtcaatttcgttcttatggcaatcaactaaacaactttggcgtttcaatcggattgtcaaatgcctttttgaaagatgtcggtcaatcgccatcaactaaggtattttatatctccaaagcgattttgaagagcggcatttataagcaaacgttcgcagagtatatgtcaaaagaccaaaaatcaactaaattagaggttattttggatggtaatcccagttcaccagcagctatgcgaactgttcggggacttcaaaatcaagttcaatacgatctaaatggaacttcgttgaaaaatgctaaagttgccgttggtggagatacatcgacaatggctgatactcagcaaactgctaaagcaagtttcaaaaagattgcgattatcgttggggttgcaatgacacttattttaatgttagtcgccggctcaattctccaaccagtttacatgatgggcgctttaggcgttacttacttaatgtcattaggctttactaaatggtttagcggccaatttcttgaacaaaagtttttaacttggaacatgccgtttctaacctatatgatgttgttaacgctgggcgttgattagaagctgtttagtatcttttaagaagtaacctgataaaagctaacgaaaccatcatgagactagtgttgagcttacgctcacagttacgccataaacggtgataatttcccaaccaactaaatg

SEQ ID NO: 650 - DNA, 60568 bp, Unknown
  Metagenome-assembled genome
tcttgggacatcgtttttacttctttctatctgaattattggctaattcaatagtagggcgatgccctatttatatgcaaaaaaagattgataccttacggtatcaaccccaaaaattttagacccaagtaattttgtcccaacccccttttgaacctaatttgttaagcttcactttttcgcggaacaaaataaaactttcttctaatcattatcaattatccagaataattaaattccgtggcgcagttgtcagtcgctgattaccatcctttgttaccaacaaatcatcctcaatgcgaacaccgccaagccctggcaaataaacacccggttcagccgtcatgacattattttcaaccgaaatgttagattgccaacggggaccaaaattgggaccttcatgaatatcaagaccaatcccatgaccactaccgtgattatagtaatcacccaacccctgactggtaatataatcacgcccagctgcatcaacctgctgaccattagcaccgggataaatagcgtcaaacatccgtttctgtgcttcatgaactacctgatagactcgccgcagtttctcacctggatcacctaatgcaaacgttcgagtaatatctgatgtatacccatcaacataatagccaaaatcaaccgttaccatatcggaaagtgccaattgcttattagatgccgccccatgaggcagcgcagaccggtatccactggcaacgatggtatcaaaacttggcttctcagcaccatgatccagcatccaattgtttaaccaattagaaacctgacgctcggtctggccaatttcaataaatttaattagttgattgaacccttcgcttgcaagtgcggttgattttcgtaatgctgcaatctcctgctgatctttgacttcacgctgcttctcaacaagattatcttctggaaccaactggtcaccaaataaattccttaacgtttgaaacagctgaaaactaatggaagtttcaaagccgatctttttggcctgatgatcatccaaggcgtcctttgcgattttataataatcgcgggtaatttttagcgaaaatgatttaggcaacctggcctcaagttcctcttgataacgggcatctgtgactaaagtcaaagaatcgggtgtaactgccagacaaccatcgcctgctaaaccatcaaattgaacaaaatattttaagctaaacgggtttgtaatcatgaaaccgtccaagcccagttgcttaatggtagcttgaaactttttgattcgctgattcatattaatcactctcctgcttcatcaaaaataacgatccagtatcacaatatcgttaaagataatgtttgaaaatgccattcatgtgtcgctcattcaaacacgtagtcttctttatcgaccaataatccaacaaatgtcataacgagtgttgcagctaacagaaatagcagcacaatcacccaattggtagttagaccatgcagccaaccacaaatcattggacccgttgccgctaaaatgtaaccaaatgactgccccattcccgaaacggatgccgtttctcctggcgttcgcgttttgagtgaaaataacgtcatagcaacactgaacgccatgttagtcgaaaatcccagtgagacacatgccaaaattgcaaacccaaaactgatatgaatgacaaataaacttgccaacccaacaataaacagaccagtaattgtccaaatcattggcgcttgtttggttagactggaaataattcgtggcacaacaaacgcaattggcaaagccaccagctgaagtaatcccagcaaatagccggctgtgttttgtttgataccagacgccatcaaaattggcggcagccaagttaaaattgaatagaataataatgattggattcccatgaaaccacctaacgcccatgccaacggccgcttccaagccgaaacttcagtcgttaattttttttgagcatcagtttttgaccgccgttggtctggtctttctcgctgaagcaataatgcaaaaataattgcgataactgggataattgagataagctgcatcattctttgccatgtaatccattgactgataactgaactaaacccagccgaaatggagctggataatgaaattgcgaagacatacatgccagtgtaagtaccaatcttcattggaaacaaataagaaaccaaagttggcgccagcacatttaacattgcaattccgctaccaacacagatcgttccaattaataaactcggaaacgaatacacccgcacaaagtttccaattgtgagcagcagtaagtccgccactgtcaccgttaaaatgccaaaccgtttaattaaataggttactgttggtgatagtaacgcaaagcaaatcagcggaatggttgtcaaactgcctaaaaaccattccggcatcctaaacgaactttgaatgttagataaaataggcggaacagcagtaattgccgtccgcaaatttgcgccaaccaaaaaaattaaaagtgcagccagccaaaccttttcggtacgtgactgcggtgtttcttgcctcatcttttctccctcaacttactatcaaattaataaatctattccaaatttttctctaatatcctcattttacgaccaaattgatcattagcggtatcaatctgctgatacccaatcttttcgtaaagaccaacatgtggcgtcacaatatacgcctcatgaaaaccaattcgaacaatctgttcttcagccatcttaacaagtttttggctgagatgttggccccgatatgcttcactaacaaacacaaacccaacaaatggtgacagacccgttccttcaacaatatcttctttcacgactgcgcaaaagccaaccaacttgccctgatccgtcatgataatgacacgttcccaatcggtaaaacgatgtgccaacatttgagctgccagaaactgaccacccttccaggatacccttttaatttgtttggcaaaatgatcccataaatcatcagactgatctaatacaaaacttttcattatggcttccccgcaattctcgtattaggttaattataatccgattcaaagattaatgaaaatagcacaaaaaagaaggcctttttaaccaaccctttaagtagattaattcagattgccttcagtttaagttgttaatcaattatatcaattaggaaaacgcagcttggcatttcttttgcgatgaccgacatctataatgagaactaaaagttaaaaagaggtattctcagatgaaaaaaattgctgtctattgtggcgcatcaacagggcataaccctatctacagaagagccgccactcaattagccgactggttggtcagccataatgttgaactggtctatggtggcggtggtgttggcctaatgggcgtcatttccaaacggatgctgtcaaggggtggaaaagttcatggtgtcatgcctaaagaactggttgaacggggcgccgaattagttgaactggccaggctttcagatcttaccgttgttaaaaacatgtctgcccggaaagaagaaatgatgtcattatcagacggctgtattgcactgccgggcggtccggggactctggaagaaatggcccaggcgttttcttggtcattaattggagataataataatccatgtgccttctataatgtcaatcattattacgacccattggcaacaatgttcgatcagatgaccatcaatggctttttatcaaaagccgatcggaataaattactcttttctgattcattagatgaaatccatcaatttatggcaaattacgtgccgcctaaaattcgtaaatactagcgggttggcaccatctttttgatgatgacaaaataatcaaacagggctaataaaacaatgcatacaactaacaaaccgataataataccttcactgtttattaatccagcctgaaacataccggacggcatatcgatgatggcatgaaaaacgattgctagcggatataaccattttttaccgacataattaacagctgcccagaccacaatcgataatccaatttgaataatgaaggcacccactcgttcaatgagcgaatttgcaacggtcgtcccggcattgtcaacgattgaacggatcgttgcactcggcaattttgataagatggccgtgttatgtgcgttaacggcagcacccatcataaacatgttcaacattcccatcgcacctagcataatcatttcggttccaccatgaccaatcccataggcaattgccgtttgaaaaccggaaactctttttttcagataccggaaaccaatataacggccggtttcttcaaaaataccagctgcaaaagcaccgtatagcgcataaatataaggatgatcattagctaatgcaattgatccatttgctgcgggatgcagaacaattgcgtgcaaaatgggttccaaaataagactggcaacaataaagaccgctaccccagtccaaacgggtaacgaggtcaccttaagcttggagcgttttttgtacacccaataagtaataaatggaattaataataagatgagtccaaccacaattatcaggccaaaagaactgcttggcacaactgacttagaaaccgacataagaaacacctccgccttttcttatacaaccattaattatcatccatatggaatagaatactacccaaagctcaaaacgtaaatggtgtgacctaatattcttaaaggcaaaacaaagaacggcctgagaaacacctcacctgacatgatttagataaccaaagagaaatgcgttaatccaaaccaatttttggttgctggattaacgcattttcttaaatgataaatttttattttttggattaacggtccacctttatgccgacaaactaataatcaagcgatcgtgtcaatcgcatccaacgtgtatttaccggcaataaccgtgacttgaacgtggtgtttgccaacgctaagtccggtgatgattgtgttctctgaccgttcaccgcccttttgtggttggtagttccaatggaggatagtgccatcaaccaccacttgtaggtggctcacactttcctgagtcccaattaatgaaaaaccagtgccagtaaagtcaaaagcgactgccgttgagttatccactgccggttgaccataggataatgttcgattccatttcgtatttcctaatccgcaaacatgttcccagtttccagtataaaccaacccatcatctaaattatcgaaccggcgtgaaataagtggcccattttgatgaatttttcgaacagaaatttggttgatttgtgtatgataataaccactacccaacttcactcgaccactaaagtgtgggttatcggtatccacatagttaaagactattttcccgtcaacacttgccttaagctgattaccatcatccgaaaagctgacatgatgatactgactaacatccaagctgtcaacgtatcccaactcaacaatccgatcatctttaatcaactgacaagaaccatcggtaaaaagcttgaatacatatggcgcactttcaagccgccccttaacatccgtcatttcattcaacccaattccgaaatagtttccagtaggtgaattctgcaacgtttgatcatcaaacttcatcgaaacatcaacgacatagtccgtccacttatcatcaccaaacgttaaattgggggcaaatgagtattcccaatcaagtgcccgctgcttttcagtgatttgctgaaccataacattcttaccgttacggttaacaacctcaaatgcaccgccttgatcagccgtataccttggggtgccaccacgtgacttcaaataattcttcggataatcttgatattgaaagtcatcttcataaagaatgccctgatcattattaatccctaacgtgtaatcatcgtgagtactctgtaaacgatggtaaacaacttcatcgtcatgggttaactcaagggtagttgctgtgacaatcgagtgcggattaacggtgattttagctcgaccatcaatcggagtaatggtttcgcgaatctgtttcatttgactatcatatgaatctgctgcatccttggggccaatactctgccaaacagtcaatttttggtttaactgtcgaccaacattcttaatttgaatgcggtatgtccttggctcgccactatcatttaccatgataactgaataattcgatttatcaggagccattaatgtcatatagctgggggctgttgtccgatgatccaaattttcggttccaccaacaccactatcacaagcactggttaaataccgccaagcattctcatcatcccaacctgctttggcaaagtcactgaaatgtttcatacactgtaaaccaacattatcaaccgcaaaataccccgaccatggtctgctggcagcaattaattccttatgactgtaattaactcctggataataagctgaaactgccggttgaaaaatgtataagctccgccgcgattcaacgtaacttttaattagccgattagcaacgtccaacccactctggacaccgccaatgccatcaccattgctagccttaacccggtatttgccaaaagtcattggggcaatcccctcactgtaccaaacttcgtgattaaaataatcggctaatttagtgaatggcttatggcgaccatcattggtattgtaatggaaacctaccgctggcactttaatccggagatccttatcagcgatcatactgtcgccaaaatcagtttcataattttcgtctgccgcaatcagcttaattcgctgataagcatcaatcggaaatccagacggaaactccgattggtcatttgcaatccggtttgcgaaccatttaatccattttgtcatgggatgctttgtttcatttcgatccggatcaacgtaatcgatcaaataaccatattcttgataagcagcaatgatcgtttttttataccattgatacattggctcataagcttggtcatcaacttggttattcggatcagtcgttttaacattaaaccatctttttcgtaagaagcccggttcaccccaacgcaggacacaagtttttaactcaggttgaatcgcctttgcgtcggcaattaattgaaatccggcaccacgccttacgttggcctgatcgtcagcactccgcattgtggcaggctcagttcctgatgacgtgtttgcatcatcacccatttcaacttttaacattctcattagtggatgtttcccaccaaacaggatttgcaaaatttgatgataactatcttggtgttcccatttataatctaacaatagccttgatgaattattacagctaagataaccaaagcccttaaacgtatttgcgttaagggcattagtatcgagttggttaccatcaatcacgaaatttgtttcgttcattgtgaaatcccctctatttaatagtgattacttatcagctttccaatcaagtggcagcttattccaacgcttacgtaaataaaatgccgctgcttttggttgacggccacgggtaaagattccctttttattaccgtttacccgcatgtttccttcaacagtttggaagtccgccaaattccaaggttgttcgccccggatgaaatcatacgaatcaaagacccgatcaaacatttccaataactcaatttgatactcctcactccacataattgaaggtaacttatgcagaccgggttcagtatcagcaccgtattccgagaaaacaatcggcttatcaatatccgattttttccattcgtcaagttcagctcgtaaaccggcctcaccatctgaaatctcatatccccatttatgataccagcctgggtagcggtttaggagataaaaatctgggaaccttaagcactttgatacgtcaatcgtgtcatcttcatttaaggtaaatgtccttggtcgcttctcgggatcgagattggcactgtccttaaacaatttttcgaaatatggtacagcagacttcttcgatgtatcaggctcattgagtaaactccatgccaacacgctaggatgatttttatctcgtttaattaaatcagtaacctgatcgatatgcttcttatataagtcatgaatccaatcaccatcgaagaatgactggtctaacccccccaagaaactagccgctgccattttaaatccaacagccggcacttcatcgataaccagaatgccttcacgatccgcaaacttataaacttgttcgtcatatgggtaatgagaacttctaaatgaatttgcaccgatccacttcatcaaattaacatcgcgacgctccacattcatgtcaaagccacgaccggcatatatactgtcttcgtgacgaccaaagccccgcaaataaactgacttatggttaaccaaaatttggtgacctttaatttcaatagttcgcaaaccaatctgatccccatattcatcaaccggtttcccgttgtcaatgagcccgaatctgatggtataaagataagcatcccgaacattccacagggtaggattctttacggtcaaatcgccatccttaccagtactggttgccacaacgttgccgttttcatcagtcaaactgaccttaaaatcaccatcggtatcagcattcactgaataatgaacgattgcttcatgatcacttatttcataagtcgttgaataatcataaatcccattcttaggcacagccaacagatgaacacttcgatttaaaccagagtaattataaaaatcaaaaaatggtttagccatctttttaccattttttaacgttgccgtatcaccggcagggagtgcatcccggtgaagctcattattaatcttcaccgaaacaatattcttttcaccaaacttcacagtattggtcacttcggctgtaaacggtaagaacccgccttcatggctgcgaatttcttgaccgttaacgtacacaactgcacgatgggttgcagcaccaaaacgaatttgaatatcctggccttcatagtatttaggaacaaagaattctttagaataccaaaaatcaccggtatattcacgagcatctttatctgtaaaaaaatcattaaaactggcaggaaccggcattttgatcccattgttgaatcccttctgccaaccttgagattccccctcggcagccggatcaaatttgaagttccataaaccatctagtttctggtcagaacgatattggttaatgattgggtatagtagacctttttccattatagatgaatcctcctttaacacgtattttctaattacttttcaattacgtaaacgctttcttttcttaactctaattttactatatcatataaaataatcaatagttttagtaaaatatattttgggaaattctattcaatgcacgattttttccaacttactcccctacgatatcagttgatatcatcaagatatcacactataattgatattatagttttatttaatttactaaaatcaataaattgatcaactgttttactttttagttgtaacttaagcgtaaatcaatcatttatcagactaattaaggagatgcaaataatgactaaggattcattaacaacttcttgctatttgtttgtttactttgcaggcgagaaatacgatgatggtgaaaacatctatatggctgtcagtcaagatggcttgaattggcaagacctcaatcacaatcgaccaattcttcaatccagcctggggacaactggtattcgagatccatttatcattgctgatccgcaaaataaaaaatactatattttagcaactgacctcaaagtgcatgggaataacgattggcttagggctcaacaagctggtagcacatcgttattaatctggtcatccacaaacttaattgattggcgcgctccccaacttgttaaagtggcacctgatgattttggctgtgtttgggcacctgaagcaatctatgacccggtcaatcacacattcttagtttactgggcatccaaaaccgctgctgatcattatgaaaagcaacgtatctattacgccaatactactgattttcgttattttagtacacccaaagtctatatcgatcgcccatacagtgccattgatactacgatcatcaaaaatgatgagcgctacttccgctttacaaagaacgaaaccaagaaatttattgtcgaagatcaacttgattcgttaaatggtcaatccaaggttattaattctccaagtctggttagcaaccaaggtgtcgagggtcctacttgttatcaattaaccgataaaaataaatggattctattagttgataactatgcccaaggcggttactatccattagaaacatcagacttatcaagtggtcaatttaccaaagtaccttccgataagtatcaaatgccaagtcgggcaaggcatggaacggttatttcaatcagtcaaaacgaagctaaccgacttctatcagacaacgatactcattaatcgtaggaaaagagagtgggacgaaaggcggttacgttgccttttggcgcacgtttttactcggtaataatcgtgattacacaaaacgggactgggacaaaagtaattttgtcccagtcccgtttgtattgctatttatttcttatcccgcttaatatgtgcacttggttcttttgatagcatctttgaaaacacatccgtcagagtttcactctggtcttcaaatttcttgttcaaaattaattgccgaaactcttcaattgaaaggtgttcaacatctttaaatggtaacggtgagttgacatcagacgattgatttaacccggtttttaaggtaaccaccagtccctctttgctatcaagcgttacggtataatattcataataactaggcgtttcataatttcccgtcagttcgtgatgctgctgaaaatatccagtaataaaattcgcaaacttttcttttgattgaagggagtccttccaatcagatttatctgcagccattcattattccttctttcgtcacaattcgatcatcagcaataagtccatagaactaatcaagctcagttatctaacccgtttaatcattgcaatggcaataccaccgacaatctccattccaattgcgaagataaagattgcatgataaccaaatccttcaacaatggctgaggcaaccatggcacctaacatttgacctaatgtatttgccaagttaattaagcctaaatctttaccagccgtatcagatgatggcaaaacatccatattcaaggcaccatcaaccgagttgtacaacccattaccaaaggcagcaatgacagcatatgcaaacattgcccatggttctttaacaaatagtgggaacaaagctgcggcaccaagtgcaaaggttgcaataacaaccggggcttttacccgcttcattttatcagctagtgggccaccaactaacgcgaagaagacaccgatgactaacataatcattgagaaaattgaaattgacttaccagcctgaccggtactttgaccaatataatcagtaaacaggaacaacaggaaagttgttacaatcgttgacccaacaaccatgaagaacttaccagtcaaagccaggtaaaagtcgcgagcatcgtgagtggggaagaagaagtatttctttaacgtttctttatcaagatgaacttttggttcatcaaggttgcctttttcttgaattaagagttcgtgaatgatggccaatacgaccgtgcaactcgccataacgtaaataccaaccttgacgttccccaggaattgagcagccaatagtgcaaacccttgttgagcaatcgtaaatccaacaccataaaatgttgaaacagttcctcgccattttggcgcaacccgatcagaaatctgcggataaattgccgccgcaattgcattttcagccgccgccgcaataatccaaattaaaataatggccattatcgatttgacgttggcaataactaccagtgagatagcgattacaattgttcctaaaacaatatagggtttccgtttaccaaatcgcgaacgggtaacatcagaaaaggcaccaaacagcaagttagcaatcgcaccagtaattgatgcgactgttgctaagataccaaccgcccaaactttatgaaccggatctagattagcaaacagttgcggaatcaggacacttcgcgttgaaccaattggcccataccagcaaagtggtgctaaaaacatagccgacgaaaccatccaaggtaatttaggttgttgtgaatctttaattttagcattggtaatttcaccaacagctgtcttaactggttccttagaatctttattctgagacatgacatatcactccattcgataaaataaattacagagatagaaaagaaatgttaaacgcttacaaacagattgtagcgctttcatttagtaatgtaaatagtattttagtaaaatattcgaattaatatatgagttttcgtaaatttatttcttgaaacgactattaaatcgcaaggttaactgatttaccttctttaaagaaaaatcaatctttgattatatctagcgttcggaataattaaattgcaaaaaactatactaacatggtctccttttactaaaacagataaacaagttaaaaattaattaatggcacaataaaaaagtccggtttgcgattttcgaaaaccggacttttcactaaaagtagataaattatttgctgctctcacgattaactaattcagtggcaataatcgttagttctggaactttcttaggattcttgatccgttgtaaaagcatttcaatggctcgttctcccattagttcagtatgaacatgaaccgtcgttaaagctggacttgtatatttggcaattgcgacgtcattaaaactgatgatactaacgcgatccgggactttaatgttgtgctgctgcaacgcacgcaagacccccacagccatcgaatcactaccaatcataaatccatggggaagtttatcacccaacttcccaattgcctcattcattaattcaaatcctgaatccggtccaaaaggtccctgaaagacaaaatcgctattataaagtcccttttcgcttaagtactgattaaaagtcgcaactcgtggatcgcgaacgccctgcttctcagtaaccgttaattctttaccggcaatcatgccaatatcattaatccccttttcaataaaccggtcaacaattttcctgactggtgattcaaaatcacttctaatacaatccagcccatattgaagatagttttcaccaatacaaataactggcaatccataggacgctagctctgttacttcagtcttatcgaattttccaaccgcaataatgccgtcgaaatttttaattcgatttttatcgattgattcgtacgttacccgctcaatagtggcacccaagctagcagctttattttcaataccgtattcaatttgtaaataatagagatccgataattcttccttatctgtatgccactgaacgatggcaatttgcttaccggttttaacttggcgcttatttcgcttcttatactgtaatttttcagccacttcaagtactcgccgacgcgtatcttcccccacagacaaagtatcatcgaagtttaaaattcgtgaaaccgtcgaaatcgaaacaccagcttcatttgctacatccttaattgttgtcatcattaatcacccattaatattcatttggtaaaacttcccactttagaaatggttattcgctaaaattgtgcctaaatctatactaatttagtgtaacacttggactaatcgcaataaacaactatgtcgataattaaagtggatcaatcaaatagcgccaacatatgtaaaaaatgagtcccaaccctttaaaaatacttaggtaaaggattagcactcattaagagactcacacaaacttattttccaatcattacaactaccaaaccgcttctaaaattcagctagcattattgatgaggtatgatttttaattgaaattgaaagctgattgccatttaattgaattttcggaatgattaagttcccgttttcatcaaggctttcaagttcgcgatcacctaaataaagtgaaaccagtgtatacttgcctggttttaggacaccagtttgtaaaggaatctttgttttaggaaaaagaatattcgtgttaggctcaggaaccgataattcggctttaagttccttggataacccgattattccggtaatcccaacctcagtcctgtaaaaaatggcattattaatattggtcgaaatttctttttgattgtccgtcccatagtctggcgccgcaaaaccgccttctgctaaatgaattgtccgcttggtatcaattttatgaacccgaacatgccaaggcattgatggtataacaaagtttttaatctcaacatcgtcccatggcttccaatcactgtaaacataatcatcatgaatcgcataatcttcatatttgaacgctgtccgccagaaattttccgtttcggaaaccgctaacgtattatcataagccccctgtttcagcaataccgaccctttaggcgtgctaaaaccaaacgtcgttgaataaacatacttttcatattttgcttcaccatgagcatgttcatgtgagtgttgcccagctgtaaatgattgaacctccaaaccagttttgctgtgggcaattaacatcctgggttcgggttgcttcttcaaaggctcaaacttaaagtcatcgctttccttagttgtccaaaatggatcatcgtccgttaatgcgaagaaaataaacgtctttaacgcccagtaagcagaggccggaccattgtatccttcagcaaaattcatatttggatatgaatacccaatcggaatcagcccatcggtttgaaaaatattctgccggaaccaccaacgtaaattctgcaacaatagatgtttaatatcacctagcgtataaccatccggtagatcaacgtgcgcataagcataggcagcccaaaatgctgcttgggcgaatcgataatccaaactgcgtccaaatggaagcgctgcgccatcctttgcgaaccagttggcatagcttggcacgaatgctttagcacgttctttcagtagtttggcctgtttgttatctgttttggccaacccaacagttaaaattgtaaagaactgataggcaaatggaatatagttatcaatttggttaacatagccatcatatgaccagccatggcctaaatattgtggatttgtgatggcataatcatcgtcaatcaacttctgattatcgtgatatcctgagtcagtgataaattgattaaccattgctcggaaaaatagccagtttgtttttggaattgtcttatgattaacctgatccatccaatccacaattcgtttctgctgaacagtagacatttgatcccagaaggtcgatttggtttcatataagaaggcagttaaggcacccatttcaacaaatagttgatcatagtcacctaactcgccaccccaatagtcgggcgaatcggggtcagttcccgctaaaataccttccgtggttagttcataccaatccggatgttcataaatacgctccctgtcactaaaataggggcctagtccccagagaagacgcatgaatccttcaatttcagttttttcttgaatatataccgcaccactgtcgctcattcggaagcggcccttttgtttctgttgagccagaacagtcattgccggtgccaaaatatcagttaaagctgctttgacatcagctttactgcgcaacggattatctttaatttgttcgttaaataatttgcgtttcaattaaaattcacctcgtttgattatttttgtaagcgcttcaacaattaaagaatactgcttattttactaaatttcaacataattttactattttaatgattttaattagtgatttaattaggataatatcaattcagtaaagaaaaacaccggtttgtaaggtttcaatctgatcacaacacatgtaaaaattttaggaaaataaaaaagatgagactgggacaatagtcattttgcccggtctctgttagtgtaaacacgattattaccaagtaaaaacacggccggaagttaagcgccttttgtcccgctctgatttttgaaataatcgtggattgatctcgtcgatagcagctgatcatctaatccatccattttgatttttatctcttggtttatatctatatttcctgccgtaaagcagccatccggtgcccactcaagagtttaattagttcaatcattgcaaccaccgaggcaataatgcctgaaaccataaacaagctttgatccgtcccaccaacattaattaatttgccaacatacgggcagaggaagttcgccgaattggtcgcaatcattaaaatcgtgctggcatcattcccatactttttaggaacaaaggaaagtcccttggaaaagataaacggaataaataggccgaagctaaagccaaccccaatggcacccacaaaacaggcaatcgatgaatcggcggcgctaattgtaaagacgctgacagcctcgatcacaatcgccaacagcaatgtatattttttagcaatttcatagaaaataccataaattaaaccgccaataatcgttccaaccgacatcatgaccaccgcgcttgatccaacggctaatgggccaaaatgattgttcaaaatataactcggaatcttaacattaaccgtcatatagaacaccatcacaataaataagacaatccaataataaccaaaccgaatttttgatgtcgttgtcaccttctcattcacaaaggttgtttctttaaaattagttgcatcatatcgaacttcgggaacaaacattaaatataaaaggaatattggaatgctaattaaatagaaggaaaatgccatcttccagctcgtattcattaaaataaggccaacaatcaatgcaccaccagcggcacccagtccttgaaacgtattttgaaagcctagtaaacgttcacgttgctgcccagtatatagtagatcaattaaactgatacaaagcgcgttaaatagaccgatcccagctcccatcacggctctggcagcaagcagaatcaaaacatttggtgccagcattgaagccagagcaccaaccgctgttaaagctgtgccggtaagcacaagtttctttgttccccagcgttttaccataaaactacttatcacaatcgctaaagccattgtgaaagatggcattgttacggttaattctgccgtttcttgtgtcatgcttggaaatgttttcattaagtccggaattgttgcagccgttgcaccagttgacattggcaataacgacaacgctaatagtgaaaatgccctcattcctgatttcttttgcatccttttatcctcccagttcaatccacccacaacatatctttaaagatcaaaaacattgtaagccaaaatgaaagcgaaagaaagattaaataactattttttctaaaagaacctaataaagcgttatcacggtgttttggaaccgtttatttatgaaaataggctttgaaaatcaatattagattaattttcagagcctagctaacaacaatcatattcaaattatttagggaaagtcaatgataaatcaatttcaccctacttaccaatagcaatcgtcctggaaaatcctactttaaattcataacggttaatttttcccgtgacatcgataagatactattatgaacaccttgagtccccattccagatgccttaacccctagaaacggaaaattatcaggtcctctttgtggtcgaccatttacttggacagttccaacttgaagcttccctgcaagttccaaagcctcatctaaatctttggtgaacacgctagcctgcaaaccgaactgcgatttattagcaattcggagcgcttcctcatcagaatgaacccggataataggtagcaccggcccaaacggctcaacccaagcaacatccatatcttgggtgacatggtccaataatgttggtgccaataaattttcctgacgatgatttcctgttacaagtgttgcacccttgcccaatgcatcgtcgattaacctttgaacaaagtccgctgatttatcatcaatcaacgggacaattgtattgtcttcgtctggattcccaacggataaaccttcaacgcctgacttaagtttctcaactaatttatcagcaacctgatcattaaccaatacccgtttcacggccgtacagcgctgacctgaataagcaaaagcaccgccaataatatttttagccgttacatctaaatcggcatcctcgcaaacaatggccggatccttgccaccaagttccaagaccattgggaccataattgacttttctgaaagatgctttccagtttgggtactgccagtgaaactaaccatattaatacccggatgttcaatcaaatagtccccaatttctgaaccatgtccagttaataaactaatcaaacccttaggaaggccagcttgatcaagcgcttcaatcattttaataccactaattgatccctgggttgctggtttgaagatcactgcgttaccagccatcagcgctggtgcaatcttagatgctgataaattcacagggtaattaaacggtgaaattgccaaaacaacgcctaatgggactcgttcaataatccccaatttttcttttgagccaccgggaaagccatccccacggacactttgaccatgcatatgcaatgcctcttgaactgtatatctgattaaatcaactgtcctaagaacttccttcttagcgtcatcatagtttttaccaacttcattcattacagagattgccagatcatcggcggattgatctaaatgatctgcccaacggtttaaataggcgccgcgctcgccaagtgacaatgaggcccatgcaggttgcgctttttgagcttgctgaattgcttgatcaacttcgtcttgggtaactgcttggactcgcccaattggctgatgctgccatggcgaaacaatttcaatcgttcgtttagaatcactgtcttgccagttaccagctaaatatgcttgatatgtcgttaagacatccattcaatcaacctctttttcataatttttgactaaatcaaggtattttcatcccgctttcattagtcgtttaactagaaattatagtgtcctcatttatgaaagtcaactgaaaatgtgatataccagctcatttgacaccctataaccattaatcagaaagatcgacagttaaaattgttttcctgacttttgtgaaaatgtctctgaataaacacaacttagttttcaaaataaaaaagctttgcaaaatagcatcatctactttgcaaagctcaaatattatctcgaataagatcgaatggggtttcgaaacgccatgtcagaaatagcgtttacttattcgattgataactttttaatagtgtaacatgaggtgttattaggtttcaacctttttgaaactcaagaagaagcttcgtcattggtttaacaatctaaacaattccagcagctctcaaaattaatccgatcaatcaacaactactttgatctttctaacgagctcagtaaccatctttacaagattagaatggtcacttttaaatgccaatcctgccttcttctaacactgaacatctgatacaaaaagggggaatggaagacgcgttcaatctcccatccccccttcttaatgatttgatatgacaatcagattacttattcaaccaaactctcatttgaccattttcacggttagcccatgcatagtacggaactaaggttaagtccacatcctttgcatcctcagaggctacctccgtgtataatggggcatctgttgagtcagggtcttgtttcttggcagctactttgacaacaccaacaccgtctaataatttatcatcatagtgataacttggtttagcgtcggtattgacttcgtagtcccaaagtggggcttcattatcagtttgctcagcggcgaagacaactggtccccgttgaacggcaaccttaccaaagtcagccttaactcgattgtttgctttcataaacttaacactcatatcaagtgtcaaatcaatggttaatgatttgccatcaacatcgaagtaaacaaagccgtctttaagttcaggatcagccttcttgccatcaactgaaacgtcgtaattgttaaccgaccaacttggaattcggatgcccaatttaactgattcgttgtttggattggcaatttcgtaatgaatatcaccgctccatgggaagtggttagtttgcgaaatcttaaccccattgtcgaattcagcattattggaaatgaattggtgactcaggatagtgtcttcgtcaaccgtgtaaaggtattcgtcaacagaagtgatcaaccgtgccaggttggcagggcagcatgcacaaccaaaccaatcagcccgatgagtcaagatatgtgacttgcctgggttacccttgctggcagctggatcagcttccaacgggttaacatagaagaagtgtttaccatcaagtgacatcccgcttaaagcgccgttgaagagttccttttcaagaacatcagcgtactcgcccttagcatgaatattcaacatttgtcgagcaaagaatgacatgccgactgaggcacaagtctcaccgtaatccgtatcattgggcaagtcatagtcgtaggtaaaggcttcaccagtagtggtttgaccaatgttaccagtgatgtacatttgccgtttaacaatatcgttccagaagcggtcacaggcagctaataaatctttatcgccagtgtaacgggcaacgtaagccattccggtgcaaaggtaaacgactcgaacagcatgaccatgaggcaccttttgatccttgattggttctgcggctaagtaatattcacgaggaaaatcacgcataccgggaatcaaatcacgatcagtactgtcaccgtcagctttgatctgcttttcaaagaaggcaggatcttggccacgctgggttaagaagtaatgcgctaaatcaagatacttctcgtcattggtaacttcatagagtcgtgacaatgccaattcaatttcagggtgaccatcgtatccaggaattttaccttcttcaaggccaaaatgcttgtcgatacagtcagccatgcgtttagcaatgtccaaggctttttcattaccggtagcattgtaataagcaacaccagcttcaatgtagtgacccattgtatataattcgtgagattgctgtaatcgtttgaatttacgttccggagcatcaatttggaagtaagtcgataaataaccgtcgtcgtcttgcgccttggcgatcaagtcaaccaaattatcggtaatttccttcaaatctggattgggatggtaaccgaatgaatatgcggcggcctccaaccacttgtacacatcagtgtcttggaatgggaacccatagtgatggcccttcatttcgccggcagcaatcttcaaattggcaacagcgtgactatttttgtcttgaccgttgttttgcggatcttcagcaattgaaatatcggcttcgtcgttcatcactttccattgatatggtaagacttccttaacaacgagttcacgataacgtttccaaaaatctgaagtaacttccaccttatctaatttgggtgtcgttttaacttgcataaatgtgtcgtcctcctaagatatcacttaaactgtttttaattaacaaatcgattagttgttggctgcagcagcttccgctttcgcattccgttctgcaagatcagctttaacaactggttcatgattttcccacttacggtaaacaatcatcaagatccagctgattgcgtaaatgatgactggaacccagacaaaggtgaagctgattcctgaaagactaccagcagattgagtggcgtgagcagcgttgaaaccgaaggcactcagaatcattgaagcgataaatgaaccgaatcctgaacccatttggatacagaatgaagcaccaatcgccgttaagaacccgttagcacgaacaccggtcttccattcaccgaagtcaacggtgtcaccaaccatggcgaagaacatcgtgcaggcagagccggaaccgatacatgccacacaccaagcaattaatgctgaagtcgtgtttgaaccggcaaagcccatccaagcttgaccaaccatggtcattgccaggaagaagacggttgtgccccacttgtgcataaatttaacgaagaatggaacagatgccatcccaataacctggataattgtgaaaccgttaaagaatgaaattaatgatttgctgcccatattgtactggaagtaataaggcattgatgagttacgaacaataaatgctgtccagtaagcaaggttggcaacaacgatcaagacccaaggccagttaccctttgtggctttcaaactttccttaatactaattactttttcgttttcgatgttcttttcacgcatatccaagaaggctacgatcaaaagaataaaggcaacgattgagtaaaccccaacggctaacgaccaaccgcgttgttcgtttccattgcctaaaacaccggcgaatggaatgatgaaagttacagcgaagaagttaccaacattcccaagaactaaacgaattgagttggcttgcatcctgccgtcagtgtcagatgtcaagtttggcaatactgaagtaattggtgttgacattgccgtatatgataagtcggctaaaatgtacatcacaccggcatacagaactttagccgttccgctcaaagcaggggtggtaaacagtagccaaacgaagatggcaaatggtaatgacatccacaggaaccaaggacgactcttaccatatttactgtgggtgtggtcaaccaggatccccatgaccggtgcaccaatggcatcaaagatccggccgattaacagtaagacaccggcagttccaactgagagaccaaaaacgttggtgaagaagtaaagcatgtagctactaataatacagtacagcaggttcccggacatatccgtaaacccataggtaatctttctgtgccatggcaacgtgtcgcttgccaataatgcttgggcagatgctgtatttgcatctacgtgatttgagtttgaactcatgatactagcctccatatagaataatttaaacgcttacataaagatgagaaaaaatagctgacgcttgaatctggttaccagtgctaaccaatcacaccggcttttaaaacaatcaccctctcgttgaattgagttaaaagaattgattcatattacggttattatagtaagcgtttccagatgaataaaaaaggtctataatagcacaagaggtgattttatccgactagttaatataaattaatccttgaacagaccgctaagacgcccgttactcatacattttgaacatttggtgatgatttccgatgtttgtgtttttcttaatttgtgtaggtttggtgatcatttccgacatgagattggaggctctaaaaaatgttattttcaacatttacaattgcaaaaacacttctttattacaaaggtggtgaattcatcgcgcatggtccgtggaagcatcgtcgcatgtaccataagggcgattacgaactcattttatgtattaagggaccgatttatttacaaattaacgatcaacgctttacgttaaagccccacgaagtcttaattgtcccaccatttacaacattttatggttatcaggactcagagaatgacgttgatttttattggcttcacttcttctcgcaacacaaggaagacgcttttgagtccgacgaagcaacgatgacttctgaagttcgggcaaacaaaaccgccaagcacaaaatctttcttcctatgtattttaagttaactgattatgaagaggccacaatcctaattcaccagatcttatcgatccataacgaactttcatttattgaggaacgcgactatttggtatctgcccttttaattcagctctataagtcatactttaatcgacctgattcaaatgaagacagcacccggattaattatatgaaagaatggattcgggccaacatgtccagtaccctgaccgtagctgaaattgccaaccgggtccaccttaatccggattatctaacacggctatttaaacaatgtactgggatgaccactctgcagtacctcaaccacgtcaaaatcgaagtggcaacgctgctgttgatccgaactgagatgccaattaaacaggttgctgacagctcgtatttcaacgatccgaaagtctttatgcgtcgattcaagagctcaaccggcctatcaccaactgagtatcgcaaatcatacaacctgattcatttaaacaatcctcacgttgacccacaaattccaattccaaaacgaattgccgattcgattgactatattcctgaaaatggcgatattccagagtaaatgcatcacaaaattgatcctgtcaagctcgtaagatttagttttaatgacattttccagccaatattaccaattatttaccaccggttttcaattgatcttcattaagttaaaaccaagttaaaagccttttgcaaaggcgccattcatgttactatcacgatgaacgataaatgtgatatgggggcaatataatcatgaagaaataccgaaaatacgggctggcagttcttggcctaattgctggtggtatcttaatgggcacatcgacgacagccaatgccgcactttacccatcgagcacattaccgcaaaccaacatggttgatgtatccagctggcagggaaatttaactgccgctgactaccaaacattagctgctaatggtgttaaagctgtcaccatcaaagcctctgagggtcaaggatacattaatcccgacctcagccaacaagttcaatatgcgcaacaagccggtttaagtattaatttttaccattttgttcattttacaagtccgtcagctgcaaccagtgaagcccaaaactttgtaaacgccgtccagtccgtgacatcatcaaaggacgttgtcatggttgccgactttgaatcctccgaattaggatcccttggcaaggcaaacaatgatgctaatttagctgcctttgattccgcactgaatcaagctggttataacaagactgatttatataccatggccagctgggttggcaaggtaatcgacaccaactcggctaatgcaggctggattgctgactacccggctgcacccagcggttccaaatatcccaacgccaatgcttggcaatgggcttctgattatcgattcccatcgattaatcaaaaccttgatgtcagtcaattaaataacgattattatcttaactcgacggctgcaagtaccggatcaacaacagggagctcaacagacactaccagttcaagttcttcgagttcttcaatcagttcatcatcaagttcaacgccttcctccagctccagtaagcaacctggtaatgttgtgatggttcctggaccatctaaatcctcaggtagtcaatactcagcagcccgatcaaattccgtcaaactggtttggcgacgagggatgaacagtcattactataaaacaactgctggtgcccgttattcaaaacacctgggaactcgctacggttataacgctgatctaccaaatgttacttgggtcacagatgcacaccaaaaattatacaaaaagaatactggcaaatatgccatttactaccacgttaagagcacgactggtaatcacggtggctggatctggcgcggttatctcaataaatagatagtaggacgaaagttgtctttcaggccacgttcttgataactcatagttttggttgtcactaagcataattccaattaaataaacacccccgatacctcatcaaaacgctaaggtatcgggggtgtttattgttaaaatccattcaatcatcagttgcttactgtttgacgactaatgatcatgaaaaatcgaaacgttatgaagaaacgtccacttgcttttatgagttaagatagtagtcattattcatctggctgacatcaaggctgctcgtcttaccaccaaatttataactgcttgaccactgccaggcatttgctgcggcatatctcaccccagttggattagttgggtatgatgccagccaccccttatttttagaagtcatgctaatatagctgtcaacccagtttgcgttcgtataaagatcggttttcgaatatccggcagctttaacgactttattgaaggctttcacatttcgattattagtcgcaatgggcagcttagccaattttgatgcttcaaaatcaataaccatcaccacattcttctggttcgttactgactcaactgctttaacaaagtacttggcttctttcttcgcctgtgccttagtcgtaaaattagcaaagtgataaaaattaatgctcatccctgactgaaccgccgtatctgtttgttgcccaagcagtggattcttataaaacgtgccttccgttgcttttatcgtaattgctttaacgcctgaattcttcatattttggtaaccaaggttactaatcgcaccctgccaagctgacaaatcaaccatgtcggtcttgggctgacttgccaaaacacttgtactgctaatggcgagaaagccgccagcagtcagagcaattaacgctgcgactatcttttttgatcttttcatttatttattcactcctgctaatccattttcaaaaataacgataatgacaaatataatagcaatataccataaaacccgactattccgaaattagaatgatattgataaattcttctgcctcaccaatctaactactttagttaaattcacatgacaatctcagccaccctgtcaatgttttgtaataattttcagttttgcttaaagttcgccttgattgagcacccttgattgattaaccaagtgggcgatgatacgcttgatccaattgaggagggatttaacaatgaaatttctaactctattcttaaagctcatattgattgtccttgggttaatggttctactactttgcactttgggattccctgatttatttgaaaagctcaaaataatctatccacattacttccttgaacaatcactttttatagcaggtctttacgcatcagccattctcttctactttgcttcgataaacgcttatcgcattttgaatcttatcgatcatcacacggctttctcaaccacggcacttaacgcgattattaaagttaaaaaagccgtctttgggatgggtgtttgctatatgtttctcttaccatttatctatcgcgttgccattatcgaacaggcgcctgggctggttctgatgatgggcgccatcgtggcgattccatatatcttagccacttttgcagcaattcttgaacgattactcaaagaagcgattcaactaaaacctgttcactaaaacgactccaaaaaaacgggaagcccagacaaagattatctttgtttgaacttcccgtttttgatttataaacttattaacaactaactcaaatcattacttctccaagatctgtagcaaactactatattgacttaccatccatgacttgtaatttttgccagatggtaacgtttcagtaactttcaaaacaggaacattactcttatgagcaagtgcaactagattattaacggttttatcgtcaacctgtgagttataaacgaagaaggcaattttatgtgacttaattccattttgcatcgtcttgattgtttgtggtgatggatcaacacccttttcagtatcattttcaaattgaggattgccaactttaaagcccattgcctctaacgcataatcgaaaaccggttcactcgtataaacatccttatttttgcttgttgcagcaactttctttaattgtgcaatcttcgtattaactggcttgagtgaattaatgtacttcttcgcattattcttgaaatattgcttgttctttggttgaatcttaccaagcttagttgcaatggtattggcaacttttggcattgtctttggattataccaaagatgtggattatcaccattctgtttccccattaagtcgttaccaactttaatgtaatcaacgttcttggtattcttgactaatttatccatccagccatcgtaaccaattccgttggcaagaacaacttttgaaccaaccacgtccttggctactttggttgttggctcataatcatgaggatcaacattcggattggtaattactgaattaaccgttcccttatttccggcaacggccttggcaacctcaccataaaaatcagtggtggccgtgattttaatcttaccattgcttggtgacgagctttgtgaacagcctgcaccaactactgccagcatgaccaacaatcctgccagcaaaactgttttgaatctaaacaacttatgtaacataactctacctcttcctattaaatagtaacgattacacttaatgatcataatataaaaaaagttgtttgtaaatagtaatcatgacttttacaaacaacttttttgctttaggttaaattgtgataatttgttaagaccaaatgataaaactgcttcatcgtatacttatgatgaaaatacttcttactagttcggctataatacccaaccggatcagtatggtcggagccgcccaaatgtttggcaactgagttatgtgaccagaccgttcccttaccatcatacgcggcatcatttggcttaagattgtatttattcaaaatatatgccgtatagtaagctgcattttcaacttcatgagcaaagctggacttactgtgcatctgaacctgttcaaattgaacgaaacgcgcattacccggataaccaacgccccaacaaagataatcggtgttggcaatattaataatgtgatcatcatcaataaaggtgtggacaaaagcgttccgataattcttcttcatataagcgatctcgtcaaaaatagttgaattagaattgcctgtttcatggaccacgactccctcaggcttgcctttaccatgacgatacttatactttggaaaccctccccaaatctgcttagtgatcgaaacatttgtaatgttatgacttgcaatgtaattgttaaccgcagaagcactcacttgagtatctgctaccaccattgatatcatcaccacaaatccgatcattatcaattcaattaatctcttcattattcctaagcctcaccactttatcttttgcattcaattaatatgctagtcattatggactcaattttcaagaagatgtgttctgataagttcaataatgacgctcactcggctaattcttaaactctcaatcgccaacctggttttaagccattaacgccactttcgataaaggaaccgaattccagaaccaatcgagaaagccccaaaccagacaataccaatcattgtcaaaataatacctaatttaaatcctggggtcgcatacttcaactgaatataatgcctgccagctgggattctagcaccaataaatccttggttaactttaaaagttttaattggatgatcgtccacttttaactgccaaccgggtgagtacggaattgaagttgctatcacctgcggttgactgttaaaccgtgtgtaaccagtaacggcatcattagttactctttgggattgcagaccagttcgttgaagtttgcgaacctgacgatcatagtttttgttaaatggaactgcaaccaatttcaaacgcttgaaacgtaattgtttaaccccagcgaatcgaacgaccattgactgttggggccgctttgaatagccgagatttaggaccacgtgctgccggtcttcataatccgacaaattattcattggtaattgtcggaatttcgctaaattattggcgagtcggacggaaacactgaagccgcctaaatcaggtacttgggcagctgttctaagtcgatcaattttttgtaatttcgaaaccggggtccccgttacaatagaatcagctcttaaagtgtttaatcgatccatcattgaatgacgagtctctgaaatgccatcaataaccagatacagttcactgttacgataacgttgcgggtgattaatcctcaattgatatgacaggtgtcggccttgagcgtcattatccattaaatgcaaccctgaccgattttccttcgtattccgggaaatcactgccctattttgagaaatgatcttatttagcggtttgccgtttggattaaggccggttgccttttcccaaattgccaccttgtttgctggtaacgtagtttgatacttcttagccgtatcccggtatctggcattcggagatttccgcaatctagccatgactgctttaaccggattatcaacaagatgctgatcaaacagacgggttgtataagaaaccgagtctgttttgggattaggctgagtgcgcgaaatacctgaaaccggcttttctacctgggctccctgtaaaagggactgttcccgctgcagcacatccatttcatgataatcagttgctgaaatgacatgcttttgcatataaactaacggcaacgcaaaatcagattttaacaaaaccgttccagagtgattacttaatccaggaactggcaattctggaaaatccgtaattgacccattaggatttctgacaaagtgaaacccatatggaattgcttgtggtcgtttaacaatatccgtttttgcaaacatataacgaacgcccagcaaatttaacaacgttgtccgactatcaccctcaccaaccacggaattaacaaccgcttgagcatttccaagtgaccggctgaatttataaagataaccgttctgaattgaataataatcgcccaaatcatgagttcccaaaatcattggaatattgttgccagccgttcggcgaggataaaaattggtcatcgtggttgtccgataaaatccttcattcttaggcaatcccttttcagcaccatcatagtaattttttgcccatttcgatgctgttccagtccctaattcggaatccagatttcgactgttatttggactgagccatccctgaccattactaataatgttaactaataccaaaccagttaacacaagtgccacacttttagccgaaaggttcaacgacttttggcaagcaattaacagtagaaaagcgattaaaaagccatatgcaatcaaatcattttggggaatcttaagtgtgaatcctttacttacaaaaactaaaacaatcaaaaccgatgttgccccaatcagccaccgtaaatcactactggttaaatgaggtaactgatcaacaaagatcatcacagccagactaagtggtagcaccgttaaaaataaccaacgatttgatggtgtcgaaagtgcatttgcggttgcactgacttgtggcaataagatcgcaacgaatgttaatacaataatagtcgctaaggctcggtattgtttaaaatgccgcaacacaaagatcgctgccagaaacacaaccccacagaagttcaacacaagccaataatctttaattgtcgtgctggtgattaattgatttggtatggataaatagtatttaggcggatataacagcaaaccattcgcaaacttcgcgtggtaagcaattctggttgattgaaaaacggctaataaggttggaaataagactaccccagccattaataaaccggtcacaattgcctgaccaagacaatatagaatcctaagtggtggtaaatgatccggaatgatcgcccgcaaatgaaagtatcgggttagtaaataaaccaatgtccctaatgccagcatataagcaaaataaaagttgctaattaacgctaggccaaccgcaatggctaacggtaaccaattttgtccatgaagtactttttcgatccccatcgcgagcaatgggaaaataatcattggcagtaggaaaaacgggtggtgcattgaaacatagaagttataccccgcaaacgtataaatcaacgtcccgattaatttactgtgacgactaaaggaccgctgatttgcccaagcaagaaatgatagaccaacgaaataaagtcggacaagaattaaaacttgatacccgagctcaagttggctggcaggaaatagtgcaatcaaatagctaaacgggtcaccaacaatatagaaggcaaatgtcgtcaactggtcagcgccggcccctaagttccatgaccagccaaatagcgactgatgagccgttccttgtaaaattcgttgaaattgcgccaaaatcggaaaatgttgggcgatgccatccacattccaaattaacgtccggcccgctaaccagggtaacgagtaggttaataaacaaataatgccaaaacaaattgtatacagtaaaaatattggaatctttcgtgtcttcctagttgaacgggtcgttaccgtatccattagaaaaatacccctctctgttatcggcttgtatgtatttaccaatgatgaattaaacctaaaacaactattcttattgtgtatcctaatgcgtttccaaaacaagctaaaatgaaaagtttaatgtttttaatcgtaaagtcacagaactgtcattctgggagtgcaaataatagtcgcatgtcgctttctgatgtattatgaaaacgaattcagatatttaaatttctagggaggcttatgaatatggcaagttttgaaaaaagaggcccagaggaccgcttattatcacccgacaattcagttttaacaattattgactaccaaccagtccaaatcaattcgattggctcaatgcgacacgctgatttaattaaaaatgcagaattggtagctaagattgctaatctgtataaaattccaattattctttcaactgttaatgcccatacttcaagaaattcaccaaccattccttcgttacaaaaggaaattggtgatgttccttcatatgatcgttcatcaattaatgcatgggaagataaggaatataacgcggcaatcaaggccacaaaacgaaagaaaattattattcttgcgctatggaccgaagcttgtttaaccttcccaacaattgatgccattgcggaaggctacgatgtttatccggttgtcgatgccgtgggtggaacatccaccatttctcatgagacagcgcttcgtcgggttgagcaggccggcgcacatttaatcacgattccacaattagcttgtgaattacaacgtgattggaatcggactgataccgtacccggctttattcaagcattaagtgaagttggtgcctttacccaattctaattaatcactcaaaaacagtaaaagagactaacaggttattgtcaaaaagcccgttagtctctttatttatgtgttttaggaggaaagtaatgatatgtcgtttaaatctatactaatttcgctaacctgttttacaagtaagaagcgatctaatcatgttcagaagttgtttgtcgtgctctgccaaataccggtttcaggaaatgcaaacccaaaccgagaaccgcaccggcagccgctggcactacccaatccattcccaagttggcaaatggtaggacgccatgctggaaggcagttaaggcttggccaaatgcactttgactaacgacgggaggaaatgcagagaccatatcaagtagtgccggaaccgttgtaaaaccgacgacaaatccataaacaaccggatcacgatgaaacaacggtgaaaagacagataaaaggatcaaaaccattgcgaatggatatagaaacatgagcattggtgttgaccataagataatctgatcaagaccaaagttagccgtaacaaacgaagcacagcacataaaacccaaccacgtgcgataactgactttagaaaaatgtttgtgaaaatcttgagcaaaggcggcaaccaagccaacggcggtcgtcaaacaagttactgtaatcaaggttgctaatagtgcgtggccaaaaccaccaagataataagtcaccaattgattgaaggcaacgccaccatcaaccgagaggcgataagtcgataacgttgttgcaccgatccagattagaaccacgtagatgaacccaattgctgatgtcgcgaacagacctgctttagccgttactttcgcattactgctgggtttggttttaccgagttgacgaacagcagtcacgacagtcaccccaaatgccaaaccagcaagtgcatccatggtgttatatccttgcagaaaaccgttaaagaaagaggcatgtttataagcagcggttgccgcttgaccagctgcgtgacccattggatttaaaaaggccaacaggaaaacgctgaataatagcaataagaataccggattaagaaccttcccaacactggtcataatgttggactccctaaatgaaatcagaaatgccagtccaaagaatactgctgagaataatagcaatccgacatgtgcccacgaagcaggaatcataggttgaatccccacggtaaatggtaccgttgcagttcggggtgtcccaaacagagggccaatcgttgcatgaataaggaccatgaaagtaagcgcgaaaaccggcccaaggggtttaccaatatcgtaaaccccttcggaacgggtaacactaacagctaacactgatagtaacggtagtaacaccgcggttaccaaaaagccaaccgttgccaacacccaatgtgaaccggccaattgccctaaatgaattgggaaaatcaagttaccggctccaaaaaatagcccaaacaacattgaactcacgataaagtaatctttttttgataatggattcggatttaagtcttgtaaatctcgcatttatgaagaactccctttgtttttgatagaatttttaccagctgactaatcggaccaatactaatctgagattccaagaaaaccacttccgtttcatcattgagatttgagttaatgacagttagaactttaaaccttgataacgacaaataaaaaagcacccccaactcagtctgacactgaattaagggtgcttatggcacggtaccaccttatgtttgcagctctatcactaaagctgcctttcacgtacggctaaaaaagcgatacgctaacacgataatgggtgtcaccaatgcacgttactttgtcttcggtacatcgctcgaaagggattttcacgtttatcgttctgcttcctctcaccaaacgaagctcgctttagaatcgtaaaacattactcaactttctcacagcgttttctaactatttgccaattatactaatatcctgtcatagaaatgtcaatagtgacaattaaattattttaattagttgtcactaataacacaacctgtacaaaatagaaagcgattccaatctgatatctaaagctctataatggaattgtatataatctttcaaaggagtgaacatttatgtcaaaagtattaattgcaggtaggattccagaccatgccatgagtattcttaaagatgctggactggatgttgatgtttatgatgatagtcagaatttgattacaaagaatgaattaatcaatgacatcgcagataaagactttttaattacgccactctcaacacaagtggacaaagtggtcattgacagtgcacccaatttaaaattaatcgcaaattatggtgccggcttcaataacatcgatattgcctatgccaaatcaaaagggattcccgttaccaatacaccaggtgtttcaacaacatctgttgccgaagtaacggcggggcttatgctaagcctctctcaccgaattgttgaaggagaccaggtgatgcgaacaactggattcaccggttgggcacccctcttcttccttggaaatgaattagcacataaaactttgggcattattggaatggggaatatcggtcaagcggttgccaaacgaatgcacgcatttgatatggatattttatacaataaacatcaccaattagattcggaaaccgagcgcaaacttggtgcaagctttgcatcagttgatgagattgtgaaaaaatctgatgtcatcaccattcacgcaccggcaactcctgaaactcatcacttattaggtgcagatcagtttaaggcaatgaagtccaacgcccttataattaatgctgctcgtggcccgattatcgacgaaaaagccttatacaatgctttagtcaatcatgaaattgccggggctgcattggatgtatacgaaaaggaaccccatgtcgacgatggttttaaagcccttaagaacgttattttgacccctcatattggaaacgcaactgtcgaagcacgtaacgcaatggcagaaattgttgctcaaaatacggttgctgttgatcaaggcaacaagccacaatacgttatcaataatgttgaataagctgcaatagactattaggtgacatgtacaaatttaaaatagttgcccactttcaatcacaatccagtatatgtaaaacgagaaacagtaatcatttttgaaggttactgtttctcgttttaggttttcgatcaatcattttttgacatcaaaaggtcgaagcaatgtttattcttcctcttctaatttttatggtgaacccttctattcaggaaacaccctatattgttttgcgaaccatccgtgccggattgccaaccactactgtattagctggaatgttctttgtgacaaccgatccagcgcccacaatcgcattttcgccaaccgttacaccaggtaatacaactgtgccagccccaatccaggcatgctttttgatatgaacagcttgtggtaataagtctcgtcgatggccattttcctgattatgattaaccgatagtaaactgactttgggcccaattaatacatcatcctccagataaataccaccaagatcaacaaacatacaatcacaattaataaagactctcttgccaataaaaatatgccgaccaaaatcagaattgaatggcggattaatatcagtcccctcttggataggcttaccaattacttttttaataagttgccgccgggcctgccgagtattggcaatatagttaaattgccgtagtaactctgtattctgctcaacaatacgatcaatttcactaaatctcgagtcatcaaataaaatttgttttcccgccaaagcatctgccaacaaactattttctgaagtattaaaactcatctattaactgcctcccgttcgaaattatctttcaataaccagtttaaaagttgacgcgattgatgtctaatacctataatcaatcatgattaataacttagtcctataggaggcgttcaattggaaattcgcgtattacgttattttttagcggttgctcaagaattaaatatgactaaagcctcaaaaaaactgcatgtttctcaacccaccatttcgcgtcagttaaaggaactcgaaatcgaattgggtgtcccactatttaacagatcaaaacacaaaatcgaattgactgaacatggcgattatttggttcaacaggcaaagcatatcatttcaatcgctgaccaaaccacaagcaatatgaatcaaaataaggatctttccggtagcattaccattggcagcggcgaatccccagccgttcgattgatcgccaaagcaatcaagtcccttataagacaatatccgcatatccgtgtaaacatcgttagtacaaacgctgatgaagtcagcaaaggtttgcgaactggtatcttcgatttcggggtcgttctcggtccaaccaacaaacaaaactttaattttcttactttacccattgagaatatctgggggctattgatgcctcgcgatacccgacttgcccggaagagaacaattacacctgccagcctaaatggattaaaactaattgcttcaacccaaacaggggttaatcagcaatttgatgaatggcttggtggcactcatcatactttgaacatcgtctcaacctacaacctgctttataatgcttcactgttggtttcggctggagttggctacgcacttacttttgatggcatccttaatttaaatggtacaaatcttgttttcaggccactttatccacaactaacggcccagtcgactctcatttggaataaggaagcatcatcctcttcacctgcccaagcgctcttaaaagaaattgtcaaagtcgttcacgccaatgcgagcaagtaaaaaggacttgatctatcggctatccaaaatcaacctggccttttagatccaagtcacttataacaaccattacaaattgagttaaaatagcaataataaatcctgggaagtgagaacatgtcatttagcgccgtggcttcatatttagttgcctgcttatttagtgcgatcaaagcattaaccaattttttctaaattaaagtgtggtacaacacaaaaagctgaccggaaatggtcagctttttgtggaagttggatgttattttagttcaaatacattttaaaataatgattatttagagcatattattaattcaagatgcttagtcagcttgttggaatgatcccttagttaatgcagaagccaatacccaaccttgtccctttacataaaagaacgtttttgccttagttgtcttggttgcagctgtcttcagcgaacgggttactttataagttgttccagactttaagttgcctttcttagtaaacgttactttaggtgcatcagcgtaaactaagcctttgtaaacagctggtgaagcatctttggtgtgataagtctttgctttgctaaagaattgagcacccttattagcaatcgtgtaggtcgtccctttggcagccttaacagtctttgtagcaactggcttggttgcagcattggcagcaagtggtgcagcaaatgctaatggtaatgcaagtgaaacagcggtaataacggtcgcaaattttttcataacaatgatacctccttatttatggattcattctaaccacgttacaaaataatgtcaatgaaatgtttttgtaacctaattggcttaattaaaagttaaactttgtgaaacattccaaggaatttttacacaaagactgatatatcaatatttatagtagatttttttgaaatagtcatttatcaattcttgaataaaaaagcaccgtttttgtaatcatttggtaacataagcgagcaacccccgacacaagtgccccttttaagcctaaaaagggcgcaggataaaaagggcttaatttccatagtgtaattggattgttcaaataggctctcgttggataattcggttacgcggcaggaagttgccttttggcacacgtttccactcggtaataatcgtgattacacaaaacggggctggacaaaatcacttttgtctcagccccttcacgctattacaaatacgtcttcaaaaatccttgtacccgtcgccgataagcttccgggtcataccaaaaactttcggcgtgagtcgcatttttaacgatccacaactgctttggcgctttggttgcccgataattttcgtaggccatcttcaccggcacataagtgtctttaccaccatgaataaacaaaattggccggtcattcttagccagttgatcaactgatgaggcactccccaaataaaaacctgaatgccgtttattaatttcacttaccagtggttcaacaggatatttgggcaatcgatactgttgctttaacaaataaatcaattcttcgcggatactggcgtaaccacagtctgcaatcaatgccttgacttgagatggtaaagattcaccagaaaccatttcgaccgtagcgccacccatactgacaccaaacaaaacgatttgactatctgtcccaacataattaatcacgcggttaatccatttcaaataatccagtcggtctaaccaaccgaaagtaatataatcacctgagctttcaccatgcccgcgatcatcaggaaccagcgcattgaatcccatatcatgaaacattttcgcgtaattggccattgtttcacgattccctttatagccgtgggaaataataacggtcttagtcgttgactgggcagctggaatataggttgcaaccaccttgttctcagatgaacgatcatttagataccatgtttcggatggcactttatgaaaccaatcaacatattcataataactatcagcatacttttgtttttctttagaagtttctggaacataattaactcgtttaaaagcaacgttaaataatttgtgactaatccagaagctgccagctgtaatagcggttagtggaattagcaatggttttagtgatgattttttctgcattaacatttatggcacactccttcttacataaggttcattataacaactttccttcagagtgatgtcatttagtgcttcacccaaggtcatatttaccagatcttattttttacaataaaatcccttcaattcaacctaagaaattccgtttttcttaagatggcttgaagggagtcatttcaatttcatttttatcatttttcgaatgtatttaaatcgtggtggatgtgagataatatcagttaacgaatttagaattttagataactttcaattaatcaacaaatcgctcacttaaaggatggtgcttatgaaactttcagttcttggacccgccggcacgtttaccgatgcagccgcaaaagcctatttaaaaacccagcctggtacaacagttacgcttgactatcaccccacttttgatcaggtttatcaagctgtttgccgagacaaccttggtctgttacccctggaaaatcagcttgacggttatgtgtccgcaaccttacaacgtttacaaactgccgacgtcacggaaatcggtgaagtcactatcccagttaacttcgggttagtggcaaacgttgccaacttaaatcaaattaagcgaatctatgttcaatttaaaactgaagggcagtgccaaaatctactttctcaattacctagtgtgcaaatcattacaacatcatcaaatatgatctcattggaaaaatttcaaacgggcgagattggcgacgctgcgatcattccacaatcagaaatgtcaggtttgcagtttccgttaatgaagaatcatgttgcggatcaagatgataacagcacccgattcatcatttttaaaaaccaaccagccaatttgaatgaattatccaaacaaacccttgatacaaatcactttaaggccccactcttcgttacaccttccttcaacgaccaaccgggaacgctatataagatattaggttactttgctaaggctaagctaaacttaattaccctaatgtctcttccaaccaaaactgagcttggtgtttactcgttttacattgaagtttccgggacgcgcgatcaacaggaggaaatattcgcaacgctcacagaacttgcttcactatatcacgttcacctactcggtttttacgctgtttgagccgtttgagcttcgatttctgcccgttgcttttcagcagctcgccttttagcttcattttgtcggtgatattctgctaaatgaaccgcttgggtaacaaacaagtgagtcgcagcttcataatgatatttacgacccaagttcgcgatgtagccattgatataatcaacttcagttgggcgatccttaatcatatcctgatacatggaagggtaatgaagcggcatatcaattcgggtattgtgatccaaagctgccatctcttcatctcgggttgaaaccaaatgaatgccggcacgagcacaaatgtcataagcttcatcaattaattgacggcccatttgataagcccctttgaaattaccaaattcacccatcggaatttcaaacattgtacaaatcgtattgataacagagttaaaaataacttttgtcatcaaagttccagtaaagtcattagttaaagttggattcatttgggccttctttaactcattgaatagttgatagcacatgtcatccggcttttcattcaacgggcacatgttcatcataccggcaccacgtttgcccataaaatcaacttcaccgggacctggtaaaaccgtggcaattaaagcagtgccaccaatgattttgtcatcggcaaagtacttctgcagtttttcaatgtggcccatcccattcatacaggtaaaggcatactgacgatcattaaagaagtgctcgcagcgtttcaggtaatcttccaactgcatttgctttgtgaagaaaatcagcatatccggatcatcatcataagtttcaggagtttccaatttaatctttgtcaggtggcgatctttatgatcccgcataacgtagacgccgccctgctcacggattttatcgatatgtggttgccaagtatcaataaacgtgacatcgttgccggcctcctgcagtaaaattccgtaacgtaaccccattgcacctgcaccaatcattgcgaacttcataaaaatcactctccattttctaatatatttttgactaaaaaaagcgcccttgatctttttataagatcaagggcgcttatgcgtggtaccacctttattcacgatctgctcacacaaatcgtctcttcgcgtacagtctaagacgacgatacgctagcactttaaggggtgcccaccgtaaatactcatttcttcgcatttactgcttagaggttactttcacctaacaactcattatcccttctcacttaacgggactccctgaaatgatttcgcaaagttactctcctcatcgctgcatttctttcaatcaaattttaatgtgcctttaatctaacccatgaaattttaattgtcaacataaattttaaaaataatcgtttttagttggcctttaatataaaagaatcccgttaaatgccaaggaaactaacattttaacgagattatttttcaaaaaatagatttaattttcacccaacaaccgttttaaacgagcaattcgttcatccaaaggtgggtgcgtatcaaacattttaactaaaaacggcgtgcgtccttgcttagttaccggttcattgatgtaaagagccgcccctttagccgctggattagatgttggagtggtatcatccttcagtagggttagcgcgtcaattaagccctgcggatcacgcgtcaagttaacgccggaaacatctgctagcgactctcgttgtctggaaaccgcgaactgcataatttgtgcgattggtaccccaataatgcgaataatccaaccaccgatccagatgataaaaccaaagcctaagactgccagccaaaagtaagaggagttctttgagtcattatcacgatcattgccaccgaagaatcccatccaattaccgccgcgcatcagactaacgcctaaaataattaacgtcgcacctgctccagcaataaaggtggttagggcaaccgtgattgaagagactcgaatatcataattcttaatgtgagaaatttcgtgggctaaaaccccttcaagttcttctcgatccatcatctttcgcaatccgcttgtaacagcaactgctgcatgtttcggatcgcggccggtcgcaaatgcattcggtgccgggtcatccattaaataaatatccggcgttggtatgttggccaccattgcgagatcactgacaatattaaacagctgtgggtcatctgattcctgcaattgaacggccttacttgatcgcattaaaatattggtaacactcatgtacacaattactgaataaatcgctgctccagccaaaaagcccagcattgtgtaaacgggaatcataacatcaaaataatcattctgattcgcaaatatgcaaccgatcagaaaaccaatgatcgcaatcagaatagtaaagccactcatcacaaaccaggtgcggtagcgattttgtttaacttgctgatttatggtatccatgatcagtcagtccccctttaactaaaatttcatttgaggaacttctttagatgcttcgggaacttccagataactatgggcagggaaggttccgaatttggcaactaagttacttggaaaagtctgcagcttattattataagccatcacattgctgttatagttttgccgagaaaaagcgatcttgttctccgtattagacaattcctcttgtaacgaaagaaagttttgatttgcttttaattctggataattttctgaaacggcaaacaaatgattcaaggcaccggtcaattcattatcagcttttactttgtcacctaaactcgtgttcgggtcagaaatctgtgaacgcatttcagttaccttggtaaaagtttcctgttcatgcttagcatatcctttaactgtttccagtaaattgggcaatagatcgccacgtcgttgcaactgaacgtcgatttgactggcagcttcgtcaaccagatttcgctgattaaccagcccgttatacaacgcaatcacggcgaaaatgataatgacgatgataattccagaaattagtaatatcattttgggtcctccttgttctatttgactacaaacataccatatcagggtggttcggaaaagatactttggcctctaaccttaacaattaactaattcttgtttttttgtatacaacttaattgtaaatcaaggatttcatccaggggttaaatgacccttacaatcgcgtcatttaattatttctttacacgatattaaaaaaacactcctttgtctgtttatagatagaaatagccatgctttctggtataaactcatttgacctgctttgacataataagttatcaaaaattaataataacagctaatttccttgactatcctgaatagaactcttagtgtattattaaatatacattagaaaattattaggagtgaccttcatgaatgggcaaactgtagtgccgccggaattaaataaacatatgattcgaatttttaaagaattccatgaacatccggaactatgtcatcaggaatcttggacaaccaaacgaattaaggccgaattaacccggatcggaattccattgctggactttccgatcaaaagtggtgttgttgcggaacttggaaccgatggcccaatcatcgcactgcgagcagatattgatgcactgccccttcaagaggagagtggtctgccttatcaatccaaaattgctggtgttgcccatgcctgtggtcatgattttcatattacggcattgcttggtgccgcaaaattacttaaaacgcaagaatcgcaattaaaggggcgaattcgtttcatcttcgaacctggtgaagaacgacacgtcggggcagtcgaaatgattgctgctggcgttttaaagaatgttaaggccatttcaggcatccataatatgcccaccctgccagttggaacagtgggcattaagactggtaaattaatggcttcaaacgataattttgacgtcacgattactggagttggctctcacgctgccatgccacagactggtcgcgatccaattgttgctactgccagtattatcatgctattgcaaaccatcgtcagcagaaatatttcaccctcggatcggttagtattaaccgttggccaaattcgtggtggtcacaccaataacgtcattcctgagacggttggttttaagggaactatccgagccttttcggcaaccgaccgcaaacttgctaaaaaacgattttacgaaattgtcaatcagactgctgctgcctatgaccagtcagctgccatcagttgggatcagggaccggcaccagttgataataatgaagacgtgactgatattatccagcatgcagcagaaaccttcatggatgttgtccccgcaatcccttcaaatgctgacgacgatttcgctacctatgaagaatatgttcccggctgctacgcgttcatgggaagtcagggacagtcaaatctccaccaccctgacatgatcgctaatccagacggacttcaatatgctgccaaatatcatgaacaggccgcattagcattgcttaatgcattaaaccatcacgaaagttttgagagggactaaccataatggataaaagtgaaaaactacaaatattaaaagatctcatttcattccggactgttaacgataatgaacatttagtgaccagctatttacacgatctgttagctaatcatggtatcccatccaaatatgttcaatatgccgagggtcgggataatttagtcgcagaatttgatactggaaaccctggcccggttcttggtttttccggtcatgctgatgttgtccatgagggagttctttcaacttggaccacaccgccatttgatcccagtgttcgcgataatcatttgtatggtcgaggcacttctgacatgaagggcggtacagctgggctaacaattgcgttcattgaattaattgaatcacatcaaatcaaaaagggaaaattgcgactttacgttacaatgggtgaagaggtcggtgaactcggttctaaacttttagccgacaacggattggttgatgacttggatgcggttgtaattggtgaacccagcggtgtttcaaaagaacgtttagatgactatgttgacagcggcggggctaagttcccatcaaaattagcggcccagcttcatcaagtcagccacgataatggcgccgcagaacaacattttattttttacgctcataagggctggctcatgtataaagtaacggcgcatggtaaagccgctcattcctcaatgcctaaaatgggcgttaacgcaattgatatgctgattaattactacttaaaagaaaagcaattttatcaaacgattaaagcttcagatccggttttaggtgagaccgtctatgcaccaacaattattcagggtgggaaacaaattaacagtattcctgacaaagcaaccctccaagttaaaattcgaacaatccccgaattcgataaccagacaatcatcaacaaacttcatgaaatgatcgccgaactcaatcagcgacctggctacaatctgtcaattgaaattgccagtaaacgacctgtcattaatcatccaggttcaaagattattgatattgcacaaacagccgggaaacaccatcttcatgaatcacttgatttaccaacgattggggtatcactgggaaccgacgcttcagaatatacccgggtaaatcctaaaatggacgtggttgttttaggaccaggaaacaccaccagccaccaacacgatgaatacgtcgacttaaacacgtactttaacatgattgatacttatcaagaaattggcagccaatatttaaaataaccatcagaaaccagttttcaataaatgaaaactggtttcttttaagttaccgtttattgaaaacagatcattcaattttcttatagatcaacttctatcttccaaaaaatcggcaactaatcagaaagcaagtgattgattagttgccgattttaattttgttatcaagcctcattttacttatttatccaattgataatgcttcttcaccaagtttgataggtaagacaataatccgatcatgaccaaatacatcagcgatactaacaaccagactttaaagccctccatatttcgtgaaatgataattgtcccttgctgagtcaattcagcaaccccaatggccgataatactgaggttcctttcaatgcaataataaattgattaatgaacgacggtgccataattcgcaatgcctgtggtaaaacaatgtatcgcattgcctgccaataagacattccgttcgactgtgcggcctccatttgtcctgaatcaaccgcctcaatgccacctctaacaaacgatgccgtataggcgctgttctccataacaatggtaatcaccccagcgataaataatggaattttttcacctgttaagttcggaatcccaatataaacgaagaaggccagaaccatgacgggaatactcttaaaaacaaacgcatacgtcgatgaaatcccccgtaagagtttacttggcagtgaacctaggacacctaaaatgatcccaataatcgtcgcaaaaaagatggccacaaccgtaatttccagcgtcattttgataccgttaataaatgacgttgagttactctttaataagccaaagtaagttcgatccgatttagattcaaccggaatcgctgacttactcttttcaccagtataaaagtggacaattttagcatacgtgccatctttcttaatggcggccaagccagcgttaaaccgcttcaacagttcagcgttttgaccctttttaacaccaaaagcaactggatttttattcttggcggcgccaaccaattttaaattcatgtggttttttatcgagtacaataatgtggcagtcgaatcaattgctgcatccgaattaccaactaatacattgctcaactccgtgttactatcattaaaccgttgaacccgaaacccatatttcttctggacgctttcagcatattgttccgaagttgacccggttttaacagccactacctttcctttcaagtctttgtagctcttaacgtcactgtttttaggaacggctaatgccaaaccaacattgtaataaggtttggaaaaatcaattttctctgcccgttcaggagtcgccatcattgcagcgataacaccatctacctgattaccctcaagcgcttgaaccgcaccggcaaagttcataatcttaaacgtatatgtaaaattttccttcttggcaattgcccgcaaaatttcaacatctaagcccggatgcttcgtattataagatccttgcttattctgaatttcaaatggtacaaaggttggccccacaccaatcgtataatgttctgctgattttgcggatgcaatattattcattaaaaacatcgacgcaaaaattatcaatcctgaaattaggatttttctaatccacttcaaaatacccactccttaaaagtcgttttataaaatatagcattatatcagccttataggaagtgaaatcatttttttatttacttttttactatataaatgacgtttttttatcaaacaaacacttgtaatcacaattcttatgagtgtttctctaattttaactatttttttattcaccttttaaaatattaatacatttaatgccttggatgacataaaacatcacatttactgccaaaataaaaaatcatccaaacgcgagcttgaggcgtctaaatgatttttaatggttagcttataccaatccctgtgccaacattgcctcggctactttttcaaatccagcaatattcgcaccggcttgataatttttatccagatggtacttcttatcagcggcttccgacttttcaaaaatatcttccataatatcatgcaatcgattatcaaccgtttcaaaactccatgagagccgttcactattttgactcatctcaagagctgaaacagctacgccaccagcgttagcagccttggcgggtccaaaaacaatgccattcttgcgatatgtggcaatcgcttgaggatcacttggcatattagcaccctcacaaagatatttcgcaccatctttggcaattaggccagcttgttgttgattaatttcattttgagttgcacatggtaatgccaaatcataatcaacatcaaaatcccaaactgagccctcgtggtattgagcagttgcaacccgatcagcatattccttaattctgccacgctcaacttccttaatttgttgcacaattttgtaattaatgccacttggatcatacacataaccatcggaatctgagcaggtaatcacctttgcacccaactcagttgctttttgaatcgcgtaagttgccacattaccagcaccggaaaccttgatttttttaccagttaacgtatcgccctgtgctttaaccagtgcatttgtataataaagcaaaccaaaaccagtcgcctctgtccgggccaaactaccgccaaatgtgagtccttttccagttaggacaccattttgataaccattcaaacgtttatacgcgccaaataaataaccaatttcacggccacccacaccgatatcaccagctggaacatctagatccggcccaatatgacgttgaagttcggtcataaagctctgacagaaacgcatgacttctgaatcagatttacctttcggatcgaaatcactaccgcccttggcaccaccaattggtagaccggttaaactatttttaagaatttgttcaaatccaagaaatttgaccacgcttagcgtaacactgggatgtaatcgtaaaccacctttatatgggccaatagctgaattgaactgaactcgccagccgcggttaacatgaaattgaccatcgtctgattgccagggaacccgaaattgaattgcccgttcaggttcaaccaactgagccaataaatttgctttaatatactcaggatgctgttcaagtaccggctctaaactatctaatactgtaaaaacagcttcttgaaattcaacttgatctggatcgcgacgttgaatgtcatcctcaacagattggatatatgatttagcattgctcacgataaattcccactttcttttgacattgtatcaacggaccaacatacagcttactaaaggtaacttacgtcggtatgttatctatattatcagaattattatgaaaaatcttctcactttatgaattttttactaattaatcataatactttcgtgttaatctctttaaagctgtattttttatcaaaaaagattccaagtgcccttaaagcactcagaacctttttctcattgacagaattatttaatttatcgaatgggaagcgaaatgtcagaaataacgctcaattattctcccaataatttttgttagttgcagtcaagttaatgactccaaaaaaacaattgtaaataaccaaatcttagattaaggcttagtaaccgatactaacctcttgctaccactaacatagtaaccattaattagttgtaaacgagtagtcaatccgtggttaatcacccgctttactttgagtgaggcaccttttttcaagtgcaacactcgagacgatctgaccaaactgacacgatgatactcataagcacctttcgcagttttaacatacatcgttgcatgctcactctgccaatatgctggagctaccaaattatggttagcggtgacataatggccattactcaatttgtagtgtagtatgccactctttgacctagctgcaccaacgaccttaaaggttgtatgctttgccaatttgccaactcgctgactttgcttaaaacttgcttgacgatacatataaatactatgtttagtgtaggcaagaaatggtctactttttttaacttttgttgttgaagcattagtcgacgttgtctgattatttgttgaatttacattcgttgatgacgaacttgatgagggaacagcagatgatgaacttgaactactcgacgaagtggccgttattgatgttggctgtgaaggatttggtatgacattcccaccactcgtattttgatcaattggtgtaaactgcgcatagtcaatttctggcgtaccaattgcttgagataatacgaaggaattatcacccttattcaaactgacggttccatactgggtaaccttacgagtcccataataatttggatcagcattagtccatccatgggtccaagggaatgaagcgtcagctaatttgctaccgtttaaggcaacatgatcagctgcaatactttgatcaccatttgcatatccaatttctactttataatttccagccgctagtgcatttgccgtaaaggtaatgctactttctggtgtattcatataaccaacatatttatcattagatgcgtaactaccttgtttgataacagcagtaccggttaacttagaattctctgcttcaacacgaattggatcagaagccgctctggcagatacataagtaatgtttgacgaattattcgtgctagaagatggagtaataaccaagcgataaccatatgaagccgtcatgttttttacaggaactgatatggaaccgttattgataggaactgcccctgtcgcagtgaccttgggtgaagcaacagcagtatcaacaccataccacggtgtttcttcaactttaatattaactgaattaccaaatttgctaggattcaaaccgctaacattaatcgtattatcaccactagttccaccaaaaataacagaagcttggttttgattgtcattaatattggcaatacttgccaactcaccattagtggtccttgtgctggttgttaccatatcgccagacatatcaccataccatttaaatagccagtagccaccatttggcttttgctgatctgtcagcaagttgttcattcgaccagcgttataccagtatgctaaacatgcactctctacatctttagcattctcaaatgattgaacataatgaatcatttttccaggtactgctaaatcctgatcagcaccatactcattaagacttagtggcaaatgagcaatgcctaacttatcctcaagttggttaaattgagcgtcttcttgagggaatgctgcagcaccccatacatgccaagatatcacattcggtaaggtaccattcttcttagccatagttaggaaatctgacatatattttggctgccagctattaatacttggtccaacaatccgagcatttggcgcaattgcgcgaacatgctcaaaggtttggttccagagatcatagaagtctggccatccattgttatgaccattaccattcggtccaaaccacgtaccattaggttcattccaaagctcatatccatagatatctttagcatatggcgaactctgacactctctaaccatctgatcaactttagctaaccagtctgccatattcgaaaaatgatatggccaaccattatagatttccggcaaacgaaccatcattttaccgccaaccttatcaactaatggtgccaccttatcaaattggccaaccggagttggttgtttatttgataactgttgtgcattcatcggatcaaccgtaaagagaatcggctttaacggtgtgataagatctgcacttggtgtactaccatccgacatcgattgtaatccaccagaggccacatgccccaccggacgaataacattggttgtatcaacatcaattgaatccgctttaacatttacacgattcccaatgaacccaagtgtacaaacagttacagctgtaatcagaacacaacgtaacaggtgatttatcctcacatcaaacacctcacaataaatttatttaagcaacatacgttgttattcagcaatgtaaagcgcttacatatacttgcaagacaaaggctcaaagccaagaatactatgctaatagttttttgagcttttaatctttctatcacaatcaaaaattattcagtgctacaaagacaatttatacacgcgtcctgctaagatcattagtaatttgactttccattttttcatatcgttgataaagaatagcaggaataattgccaaaccatacatcagaattgtgacccaattaaaggaaatcccgattccagtcaatgcatgagcagtttgtgcatgatttgcaatgtaaccaaacgatgacataatgccaccattcatggcacctgcaaggcccattcccattgacatacaaaacgctgaaccgatcgttgtcagaataccggccgcattaacaccatttttccattcaccataatcaacggcagaaccaagcattgcaaatggcattgaaaccgcgattcctgaaccaacgttggcaatcaaccaaccggcagttgcgccaacagcacttaatccagaaaacataattacaaattgacctaaaacggcaatcagcagtcccatagcccaaatatgactcttggacataaatttattcagaaacggaatcgagatgacaccaatgacttggatgataccgattgaattaaagaaggttactaaatctttattattgaaataatatgtgaagtagtaaaccatcgattgttgtcgtccttgttgagcaacccagaaaagaaagttcccagcgacaataataaaccaaggccagttcttattcatagcgtgaatacttcttcttaaagtaactcgctgactacttggaacaataactctttctcgaacgtgtccgaatgaaaagagtgttccgcacaaattcaaaatagcaaaaattatgataaaaatacggaatcctttaatgtcattaccgccaccaaaaaacgcaaccaatggtaatgttaacgagttgataacaaacacacctaagttggaaccaaccatccgccaagaatttaatccaacccgttgactaggatgcgatgtaatcaacggtaagatagttgtaataggtgcattaatacccaaataaagcacaccgtaaatcatgtacacaacggcacaatagatcgcttttgccgaagcactaagactaggtgcccagaatagcaagacaccacttgctgcgtatgggacagcaagccataggaaatatggccttgccttaccatatttagaatgggtcatatcaatcaaggttccccaaacaggtgcaccaacggcatcaacaattctggcaactagtaaaataattcctgttgcagctgctgaaattacagcaacatcagtaaagaaatacattaaataactgttaacaacggtcgcaaccaactgaccggaaaaatccaaatttgcataactaattttttcaaggacaccaactttttcttttgttgaaccagccggatatttagtgtccctctcggctacagttttttcatccataaagtaattcagcccctttcaaaggatttacttattcgtaattttaattaaataaacgtcatgtgatttaatctgaattgagttatcttcagaaagagaaacatcttgatctttccagatatcataacctttcagtggaattcttaattcagacaattgtcttcctgatacatttaaatcaccatcggagatattaaagattgcaaagtattgactttctggactcgttgcataccaagtgatcatgttatcatcccggtaagtttgatatttctcagtaatatgatcatccatctcaagtagttctcgatttgttagtaaactagttgtccaatcatcatcaggaagctcaccgcccataatcaatggcgattgcatcattgtccaaagcgtcatcatagtcttctgctcggctcgggtaaaacgagtttggcgatttccaccaggaccatcaactgatcgaatgccgatatggccaagaggtaacatatcacaatcaggccaatttcctggacgtgcaattggtgaccacttctccgcacgatcaaacatatttaacaacaatgaccattcgtcccaaaaatcatcagtaattcgccacatatttgcatttctttgtaagaaggcaccattctctactggtgctggaccaggtgacaatgagagaaccatatcacgaccggttttatcgattgcttttcttaaagcttcaacttcttttttatatgtaccgttataaataacagaattggcaatatcatcgcatttaatgaaatctacgccccatgatgcatacaatttcatgagtgagtcatagtaaccttggccttctggcatatccacatcaacaccatacatgtctgaattccaaggacaaatattattcaacgcaacatcacgtgcagttttgtcagtccccttaataggcgtagcattatgaacagcctggcgagggattcctctcataatatgaataccaaacttcaatcctaaatcatgaatatagtcagccagcggcttaaaaccatttccatttgcagctgacggaaatcgcttatcgtccggaattaattgagaatagttatccattactaaagatgcaaagtcatgatatttagatgaatcagctgtcggttcataccattgaatatcgacggtaatatattgccatccatactgctttaaatatttactcatgtaatccgcattacgtttaacctcttcttcacgaacagaggcgccgtacccatcccaactattccaccctttaggtggtatttgagcaaattgtctaaaactctttgtcatacttttaaccttccttgcaaatcattcaatatttttaattcatatagtcctaagcaataagactaagagagttccaataattggttaaccactgaggcttgtgcacagtttatatattagccggccaagaaaacggtttcaatgtcatcaaaagtacaattagtgttaaaaagtaactagccatggcatatttggtgttcaaaagtgacaaatgtgtgtattcttgaaaaaacacagggatcaatcgataacgtttttgaaaattaattaacaagataataaaaaagagattgaataacgattactattatcgtcggtctcaacctctcaaatacttccaactattcggctttataaaatgatgacactcttcttcatcataaaggtaaactcataaattaaattcataatttttatccattgcaacatcaattctcattaacattaaggtatcttttaagtggttatcagttttgggttataatttataaaagtgaatacactcctaaaactaaaagatccactaaaacaattgctataagtgtcaatactaatcgtccatgatttttcatagaaaccaaccctccttatactttcgttgtgaaatatcgtggaattattttaaatagttgagtcttaaaaatgattattcaaatcgatttctataattctcagtatctttcgtaatgggcacctctggatcaaatttactgctatccaaaaacttttttgtgtatgcatgtcgaaattcagacggtgttaagaaaagattttccttaaacaccttcataaatctcttttcatcaggataaaacgacatacttgcaatctgtttaattggaagattggttcttaacagcaattctttagcctgttgtaatttcaaccggttaatgtattgaataactgtttgattagcttgttgtttaaaaattcttaccaaataatgcggatttaaatcaaacgcatcagcaacttcgcttactttaagtttttcgcttaaattagcccgaatccactcctttatgccatcaattcttgcttcttcctcagaaattggtgttcccaataatgatttataatagttttctgaaagctcaataatcaatgttgttagtaaataatcaacagacatcgatgtgaaataattatttttggccacatccaaaatctgatttgacagaataaagaccttttctaaacttggcattttagactgaagtggcagcactgcttgctcctttttaaaaaagctctgaatttttttattgtcatatttatcaatctttaaggattttaacccgtgtggtttggtaaaaaaatgaaaccaaaagtactgagtatctttaggggattctttataaccatgaagatgatgatatggtggtaaagcaaatatttccccttcttggactgtgtaatgttggttatcaacctgtaaatatatagtaccctttatcataataataatttcaaaattcccatcatgatacatatgtttatgcttccagtgaattcctgcagtgaacttcccagatgagatgtgtaacactggttctctaatatcaaaacatgtaataacattcatggttagctaaactcctttcgcaaaacttcgaaagtgataaaacaacactaaatgtacattaatcagttacaaaacgccacttttcatatacaatacaccatttttataaaaagtgaaaccggttacaataaattatgtaatatttattaggagatgaatacttacagttaaaaactttatatacaaaataaagattattgaccttttggctaaggttaatcaaagtaaaaatatggccttaattttcaccgaataatagtttttaattaattcggaattgattaatttattcttagctatcttggctttttatgaatattcactcagtcacgtaaatctcaaacttactgaaaattaaagcgttattatattaatgcatggagaaaggacaacttttatgacaaattttattgttcaaactgactcagccaaattaggatttgaaatctatcaagataaaatcattttaccaatcgttaattcaaacgacttaagcaatgcagattctgaaataaaacagcatcttcaacttgctgaagttcaaataactggtcgtaattttcaccacaagggggttagctttgtagatactaatcccggccgcgatttacgctatgtcagtcatcatgttgatgacgaatcagacggaaaaatactagccattattcaagaagatactgagaaatcacttcgagttactaacttctatcatctatacaatcagtccgctattattcaaagttggacaaagcttgaaaatattggtgaagaagcattagggattgaatatgtttcttcttttgctattaccggactaaaccagttcaaagacttgaacggtaattatgctgagcacaatgaaatttatattccaaacaataattggactgccgaagctcaatggaaacaccaatcacttaaggatattggcttggattactgggttgatggtgaaaagggccaagcatccactaaacgaatcagtatcactaacaattcatcatggtcctgctctgaatattcacccaatgggattttggttaatactcaaacaggtgaatcagctatttggcagatcgaaaacaatggtgcctggcactacgaactcactgatattggtaagggaaatcttttggcattacggctatccggccccgaagaattagataatcattggtggaaaaaccttcaaccgggtacttcatttacaactgctaaagtagcttttggtcaaatcaatggtgattatgaagcagctcttcaagcaatgaccaagtacagacgattaataagacgaccaaacaaagatgatcaaaaattagctgttatttttaacgactatatgaatggtctttctggtgatccaacgactgccaaagaaattccgttaataaatgcagcccgtgacgttggttgtgaatatttcgtaatcgactgtggttggtatgcgccaggatattggtgggatagtgttggtgaatggcaaccctctaaggaacgcttcccggatgggattgaaaaattaattcagtacattcgtgatcaaggattaacgcctggactctggctggaattagaggttatcggaattaaatcaccgcttgctaacaagctgccagacgattggttctttatgcgtcacggtaaaaaggttatcgatgccgaccgttaccatttagactttcgtaatcctaaagttcgtgaatttgcaaacagtgttatcaaaagacttgttgaacagtatggggttggctacatcaaaatggattataatatcactaccggtattggcactgatcacaattcagacagtgctggtgatggtctactggaacacaatcgtgcctatctcaaatggttggatgccattttcgagaaatatcccgacttagttattgaaaactgcggaagcggcgggatgcgtcatgattatgcgatgcttcaacaacatagcattcaatcaatgactgatcaaactgattatgttcgaaatggtaacatcgctgctgttggtgcctcggttgttgcaccagaacagtgtgcgatttggtcatatccactgcaaaatggagatgacgaagaagttatttttaatatggtcaacgcgatgcttgttcgcattcatcaaagcggccttttaaataaggtaaccggtcatcgcttggaattagttcgggaaggaattacaacctacaaaacctatcgtgacaagatcccatcaatgttagaagctgtttagtatcttttaagaagtaacctgataaaagctaacgaaaccatcatgagactagtgttgagcttacgctcacagttacgccataaacggtgataatttcccaaccaactaaatg

SEQ ID NO: 651 - DNA, 74841 bp, Unknown
  Metagenome-assembled genome
aattttgaccattatcgaactaggattcaaatggaattatttgcttaattcaattaatgcaaaagaaaaagcaaatcctttcggatttgctatataagctgatatcaacctcagttgacaaagagcccaaaataagggtcagtgacaaaacatacctgttttgctcacgaacccattttttattggcttattttcatatgactgtcatcaaccagagagttagctttgattgtgttgcccacctcacctatttttctaggttagttggtgattaacagattagttccaaacaatgaatacttatcaataatgcttcattacacgatcgatttgccgtttttgatcacgacgcttgattgtctcacgcttatcatactcacgttttcctttggcgacaccaatcagcacctttgcaaagccattttttagataaacttttaacgggataatagtaatgcctttatcctgagtgctttgtgctaatcgccgaatttgtttcttgtgcaataacaattttcgatttctgagcggatcatgattaaattggtttccttcagcatattcgctgatgtgaacatttaccatgtaggcttcatcattcctaatttgcacaaacccatcttttaaattgattcggcgagcccgaatcgatttgatctcagttcccgttaaaacaacccctgcctcaactgtttcgagaattgagtaatcatgacgggcttttttgttttgggccattaaattgtcgttactatgttgctttttttgcttggccatacaatcaccttacttttatcgcttgttgcgattatggttaccaccacgggaattgttggactttccgtgccggttgttcgagtgaaaattattggaattagaattggaatggccatgacgatcgttattccgatgattattatcgcgatgttggtacgaacgctttggcaacatgttactagttggcgtctcttcagggttaaccacatcaaaatcaacggcactttgttcaacatcaacgttaacaacctttacccgaattggttgtcccatcttatatgttcgacgagtatttcgaccaaccaaggccataaattgttcaacgtactggtagtagtcatcgtccatccgactaatatgaaccaaaccttcaaccgtatttggtaattcaacaaacaagccaaacttcataactgaactaacaacaccatcgaattcttcgccaagatgatcattcatatactcggctttcttcattgaatcagtgtctctttcagcatcaacagctcgtcgctcgtattcggaagtagttgtggcaatttcatccaaaacagtcgcatatttcttctttgtttcactgttaataccattatcttgatagtaatggattaaccgatgaaccatcgtatccggatatcgacgaattggtgacgtaaaatgcgtatagaatggcgcagctaggccaaaatgaccaagagattggtcggcataacgagcttgcttcaagcttcgcaataacataaccgagaccatcatttcttcaggcttaccggcaactttctttaagatgttctgcatggtctttggttgaacatgttctggatcacccttgacagtaattccaaaagccgtcaatgtctcaaaaaaggtcttaattcggtcagcatccggtgtttcgtgcactcgatagataaacggaacatgtttttcgtaataatgcttggcaactgtttcattagcagccaacatgaatgattcgatcattcgttcggccaaaccacgaacccgaagcttaatgtcgatgggatgtcccttttcatcgacaatgatctcggcttcgttatcatcaaaatcaatggcaccgcgagatttacgatgcttatacaaaattttatgaagctcacccatttgttcaaacatcgggactaattctttgtactgattcattgttttttcatcatgagattccagaattttattgacagctgtataagtcatccgcgcctttgaacgcattaaactggggtgaatccgatgcttaatgatattaccggatggatcaatttccatctcgcaactcatacataaacgcaattcgccctcatttaaagaacaaataccatttgaaagtcgacgtggcaacatcggaataacacggtcagttagatagactgaagttcctcttctaaaggcttccttgtcaattaaactccctggcttgacgtaatgactaacatcagcaatatggacgcctaaatgataatttccattcggtaacttccatgctgtaaccgcatcatctaaatcttttgatgattcgccatcaatggttaccaagttttgcttggtaatgtcttcacggcctactttttcagcttcggtaacgtgatcaggaatcgtatctgctgcctgaagaacttcttctggaaattctgcaggaatgttatgggcatagactatttctagaatatcaattccaggatcatcaacggagccaattacttcatcagcaatgccgaccatgtaatcaggatgcttggcattgggatattcagtgatttgtgcggtgatcacttctccaggcgtcgggtgcaaaccaacatcgttaatgtaaaattgatatttggcaatttttttgtcggttagcttaacttggccataatagccattgtcatcatccgatttagtaaatggaccgactacccgcttgtatttgcgatcggtaattgccgttacttttccctctggtcccttgtcggaaccgggttgagcaggccggacaatttccatgtcaacggtatcgccattcaatgcgttcatcgtattgtcaggtgcaatataggcatctggagcaagatcgtcataggcaacaaagccaaaacctttatcattggcatgaaaaatgccggataatttttgtttctctggatttagctgaaatttaccctcttgagtcacaacggcaacaccatcacgttctaggcctgcaagctcttgaacaatcagcttaaaagccgctgaaccatggtatcttaaaacatcggcaattttttcgacagtgaaaacattctcgggatatgtccgcagaacgttttcaattttattttttaaatcattatcttgcaatctgtattcctcgtattattcataaagtttggttaaaaattcgcttaaatcagcctccaattgctgatgagctgaattaacggtaatcatatgagtggcatttggatattcatgataactaacatcactattcaccaactgatctcggacttgtttggcactggctggattaacaatctcatcatttaaaccttggccaataaaatagggccgcttaattttggggagatcatcggcaacacccgcactaaatgcagaaattttagctaacaactggtcaatattcgcatctaaccagtctaatttagtattcataattgcctcgttagttttgtatcgaacaaaattcgctttcgccatctgcataaacgtattgtgaacgctaaactctcgtttccgaacaattggagaccctaatgaacccccaccaattaaatcagaatcgttttcaagcgccttggcagcaaaaataccgcctaacgaaattccgaaaatgctgatttgattaatgcccttgtcacgcaaaaattgaatggcattttgggtatcctgccaccatcgttccggagatccttgaagaagaatatcactaaagtcaggtgtcccgtgaccagtcaacaacggtgcgtagattgtgtagtcgctgcgctccaatcgtctggccaacaatctaacatcaacaggaccactggcaaacgcatgcagcaatacaattcctttggggccatgttcgaaataaaaagattttgttggagattgcatagtgcccatcctttctgtttcacaacctcaattataataaaaatccccctgcatttaaacaggaggatagaaatactaatgagatgatacccaaactaatccaagtgatagtgcaaagaaaattatcccaagaataagcgtggtcttctgcataaatgcttcgaatccacgaggcttttgtttagcaaacaagtcatcagcgccaccagtcaaggcagacattgcgtcattagtctttgatggttgcattaaaactgcgattgtgattaagacacaatcaatcaataataatgttattaatagattgtacactttagtgcctcctaccgttaaatcggcttaatactactcctactaagttaacacattatgcgtaaatccgccacccttttgcgaccaagtttacttggctagcatatttaattgttgaatgagctgaattcgattttgagctgacacattaatcaccaacgtgtcaccccaacgcaaaacggtgtgaccagacgggatagtctcagtgtcgcctctttgaatatttgtcagtaaagttcctgttggccatttaacttcactaaccattttaccagccatcgctgaaccagaaaaaatcgtgatcataattgggacggtctgactttgaccagttgtccgtttaacatgcagcagctgctgcaacattgagtgataaacaggctggccacccaataggtccaaagccccatacgcaaccaacgaaacagtcgctaaaccaagtaaatgagtaagagttccaaccatctcagtgatcaacagaatagccgtgaatggcgctttactgattgcagcgaagtaaccggccattcccataatgataaaactggaaaaataagtagcattcaataaattcaaattgattgctgattgcccaacaattgctccgattaagccacccagacaaagaattggcaaaaaaataccgcctggtaatccacttccatatgaaagcattgaaaaaacaaatcggataataaaataaagaatgaggatcgccactgaatagccggcagcattcagttttaaaataatgacactcccaccacccaaaagctgtggaaaaataacccccagaggaatcaccagcacgagtgggattaacccgtttagccaagcaggcagccgactaaacttttgataccagcgacccactcgtaaaataatcaactgatagccgcggcctaagacaccaagaaccaagcccaagaagaccacccagccaaagtatttaattggcagcggtgtacttttcatatataaaacgggtttcattccaaaaacattcattgccaccatatcagaagtaattgccgatgttagtgagaccacccaaatattggttgaaaaattatgataaatctcttcaaggacaaacaacgtgctggcaatcggtgcgttaaaagccgcgcttaatccggccgcagccccggcagaaatcagcacctgtcgatccaagcccacttgctttgttatcagggcaactccctgacctaacgtggaacccaattgaatggatggtccttcacgtcctaaatacaagccactgccgattgccagaataccaccaataaattttcgccatagaacgggccaccactgataatcaagatcgcccaacagctggccctcaacttgaggaattcctgatcctttaatatcgggttgttgttttaaaaggaacgcgacaatcagtccaatggttacgttgactgccaaacaaccaataattgtccagggatgatctgccacttgtccatagaacctttgcattaaaaccagcaaatgctgaattgaccaacgaaatattgaaacagttgatcctgccaaaataccaattatcacgccgctaaaaataattttaatttgcgataacttataactttcatgaatttgcacgtcgagacatccttctaactaattctgctaataatcatagcataattaatgcagccatttaaaactcttttgacaagccaacccaaccaacagcagccagccaaacaaaagcgtttgcttggaatggctctcaccggtttgaggtaattgtcgttgttttgacctttgcttacgccgattagaattcttagcaaagagtctccggctattacgaccgttttttcgttgccgtcttgttaatttatcacgtttcacttgtttctttgttcgcttcttagaatgaaccattttagattgaccgcgtttactcagtcgcggtttattagttttccgttgctttgctacagctgtttgttgcgtattttcagtgtggctcactgcaatatcagccgatggtgttgcttccttgacgcgattaattgctgctggcggatcctgtttcgggttaacaattgaagattgccgacgatcatctggtttcgctgatgttgtttctttgtgatacttaacatagatgttcggcataagtaatcgattaatctggattgagttggttggatcctcagcacggtagccatcaatcttttgaggtgttaaggtgtattccgttccatagcttgcttcaacttctctggatgaaatggtttcaccgttttcatcaatattacaaattttcaggataagccttcttggatgataatgtagtgtcagaatattcgttttagaatcgtatttttgggtatccaaatcatagccataaaattcaatatcttcatgagtgaattgacttaaatctgcgcttaaaggcttaatttccttatcaaataattggtgtccgttgttatcaaatccctgggcatgaactatgagttgtttttggcttaagtcagaatttttcttgggcgagcgcggtttctttcgttttcctttacttgttattgcccgccgggaagtcgctcgacctttattaccatcaggttttgaatcatggtcagtttgacttgatgcgtcaattattttttttgagtcctcctgctgatcaactgatgagcttcgattagattcaggctttgaatcttgtcgattatttaatttcaactggttttgaatccgcaattggatatgagtatcgttctcatggcttttttgattgaccttttcaggatggactggtgtgtccttattggtctgaactgttgctgactgtgtttttttgctatctttagcacgcaagatagcatcaatcttatgattggctggattatctgcggaactcactgaagatggttggctgcccgcgggctcatttgacttatttttcgatactaaggtgggattttgaccggctgtcccttgacgttgatctttttgtggcttttcttggcctcgagttttctctttttgacttagcggtggctgtgatgtaacgagtgtttggggctgactgttagtggccgctactggttttgcaaacttttgtttctggtctgttggtttcgaatcactatttggttgtggtagtggcttttgcgcgattactttttccaatggctttgccaactgcagggtatctttagaaaatcgttggttgtctggtaactgttgctctggtttttgaacaccaacggttttagcaccgccttctgtttgatatctcaacgtaatgacctgatttggatccgtaacaacattagaaacatccaagctgttttgcaattcgtatcctttaaagtgtggaaaaacttctaaaccaacatcgtattttagtacgcttcccatgtcgcgaaccggaacattaatcgttggatgaacgtcgtggccagcttcatcaataaatcttgctgtgatgtgtgtgtctgatattggtgtgatttgttgatgtgtttccaagttcttcataggatctgatttctgttgacgaacattttgaactgtattgttggcttggatcacttcctgctgcagtagcggtaccaacccgacaatgccgactgatagtacaatgaactttttcaaaattaaaacctccgtatttttgtttgatattaaagactcatatattagctacgcaaaatacagaggtttctatttgacaagttgtaattgataataactattttaattgtgatcccgatatataccaatttcaggtgatggcatacaaaaaacaccaaccgaaatgaaggttggtgtttttaagttacatatcaaaaagtctatcaagttaagcgattaaatcatcccaacttgttaactattaactttaattacttgtttagaatatcgtttcgagcttgttctgacaagttgtagaatgaatgaacacccttgtattgagcaacatcgccaagttggtcttcaattctcattaattgattgtacttagcaattcgttcgccacggctcattgaaccagtcttgatttgaccagcattcaaagcgacaaccaaatcagcaatggtcgtatcttcagtttcaccagaacggtgtgaaatgatcgcagtgtaacccgcttctttagccatttcaacggcttcaacagtttcagttaaagtaccgatttggtttaacttgatcaagatagcattggcaacacccatcttgatacccttacgaaggtagtcagtgttcgtaacaaataaatcatcaccaacaatttgaaccttcttgccaagacgtttagtagccatttgccaatcttcccattcgttttcatcaagtgggtcttcgattgaaataactgggtacttgtcaacaatgccttccaacaatgaaacaaattcgtcagcagtatatgacttaccatcaccctttaaatcgtacttcttagtttcagtattatagaattcagaagcagcacaatcaaaagcaatcgcaatatccttacctggcttgtagccggcacgctgaattgcttcaacaaggatttcgaatggttcctcattgttctttaaatcaggtgcaaaaccaccctcatcaccaacagcagttgagtaaccgcgttcgtttaacaagttcttcaaattatggaatgtttcagaactccaacgaatggcttctttaatgctaggagcaccaactggcataatcatgaattcttggaaatcaaccttgttgttggcgtgcttaccaccattgataacgttcaacattggagtaggcaacaaatgagcattgaaaccaccaagataattatatagtggcacttcaagttcatcggcagcagcacgggcagcagctaatgaaacaccaagaatcgcattggcacctaatttacccttgtttggcgttccgtctaattcgatcattgctttatcaattgccaattgatcagtcacatcgtagccaacaatttctttagcgatgatgttgtttacattgtcaacggccttggtaacgcctttacccatgaaacgattcttgtcaccatcacggagttcaacagcttcgtgttcaccagttgaagcacctgaaggcacgatcccacggcccattgcacctgcttcggtatacaattcaacttcaacagttgggttaccacgagagtccagaacctcacgagcataaatatcagaaataattgacatattttttctctccttaacgaaagttgtgaccttttgtacaaggttcactctaattctattagtttaatgccgaagtttcaacaaaaaactgacattcttattatttttgtagaaagttggtaagcttaagaaatgaatccgatttcaagctggcaccgccagcaagaacgccgtcaatatccgtttgagccagaatttcatcggcgttatcatcgttcacactgccaccatataacacacgaacctgattagccaagtcatcagaataaagatcggcaatggtttgacgaatcagatagcatccctcttccgcctcgtcggtactggctgttttaccacttccaatggcccaacttggttcataagcaacaatgatatgtttggcttgttggggatcaatcgacttaagtgcgttagttacttggctgacaacccacgaaatccgatcggaagactcacggcgactcatcgtttcatcacagcatacaattggcgttaaatggttgcgaaaggcagcatgaactttcttattaatgatatcatccgtttcattaaaatacttgcgtcgttccgaatgaccgataataacgtgagtaacacccatttcatgtaatgctttaggactggtttcgccagtataagccccttcatcttcataaaaacaattttcagcagaaattaataaagacgatcccacattttcctgaatcatgctttccagaaacaacggcgaagcagcaatacaagtttcggtaaccttaggatccggtaatttacccttaatatcttgtaaaaatttaacagcttcatcaaccgataaattcattttccaattaccggcaacgaacggaattctcataacaaaatcattcctttacattttttgacttaatgccattgtaaccaaaaataattttaaaagccataaatatactagaccaatcgcaaaaaggacctgctaatcgcaggccctttcacgtttatttattatcaatagcggcaataccaggaagtgttttaccttcaagatattgaagcgatgcaccgccaccagttgaaatatgagtcaatttatcagcaacacctaattgcttaacggcagcagttgaatcaccaccacccacaatcgtagttgcatcagttaatgaaccaagaaattcaccaactttaagggttccttgagcaaagtttggcatttcgaagacacccattgggccattccaaacaacagtcttggcatccttaagcactttttcaaactcatcaattgacttaggaccaatatcaagagccatccagccatcatcaatgtcgccttcaacaactttatgttcagcatcgttactgaaacctttagcaacaacgttgtcagttggcaaaacaatcttgtcgccacccttttcaaggatactcttagcaacatcaattttatctttttcgatcaacgaatcgccaattttgatacctttggcagcatagaacgtatatgtcattccaccaccaatgataatcttatcagctttaccaagcagattatcaatcacaccaattttgtcagaaactttggcaccaccaagaatggcaacaaatggacgttgtggattgttaacagcttcacccaagaattggatttccttttccattaagaatccggcagcaaccggcttgcctgattgatgcatagcttcggcaataccgacgttcgaagcatgttgacgatgagctgttccaaaagcatcgttaatatattcgtcacctaatgatgcccaatattcgccaagcttaggatcattgcctgattcgcgtttaacatattcaccatttacaacatcttcataacgggtattctcaactaaaaggacactgctgtcagccatcttattaatggcatcttcaagctgttgaccctcagtaaccggaacaaaaataaccggcttgttgagtaaattagaaaggcgttctgcaaccgggcgtaaagaaagtgccttcttgtcctcttcttttttaattctgcctaaatgtgaaaacagaattgcctttcctttatgatccaagacatatttgattgttggtagtgcagcttgaattcggttgtcatcaccaataacaccatctttgattggaacattaaagtcaactcgcattaatacttttttgccttcaagatccaaatcagaaactgttaattttgccaattttgaaacctcctacacaattttatttgtgattttcagattctttatagataacaaaagacggagaagacgccctcctccgccaattgcattgattaattattaaagtgaagcaaacttcaacaaggtacgaaccatgttgcaagtgaagccccattcgttgtcataccaagcaacggttttaacaatttggctgtcacctgaagttgtaacttcagtttgagttgggtcaaatactgaaccatggttgtcatcaatgatatctgatgaaacaatttcatcatcattgtaaccaaatgcagggttatcaacagtgtgcttcttgattgcttcgttaacttcgtcggcagtaaccttcttgtcaaggattgcgatcaattcagttaatgaaccatcaataacggcaacacgttgtgcatggccttgtaatttaccagcaagttctggaattaccaaaccaattgccttagcagcaccagttgaatgaggaatcgtgtttgctgaagcagttcggttattacgcttcttcttagtcttaggaccatcaagaatttgttgtgaagcagtgaaagcatgaatagttgtcatagttccaaccttaacgccaaattctttgttcatgaagtaagccataggtgccaagcagttggttgtgcatgaaccagctgaaacaatgacatcatttgagttcaaggtatccaagttaacacctggaacaaccgtcttaatctgaccagcaggtgctgaaatcaagacacgctttgcaccagctttgatatgagcttgtgatttttcttctgaagtgtaaaaaccagtacattcaagtacatagtcaacaccatcattagctacccaaggaaggtttgaagcatctttttcggcatatacaggatattccttaccgtcaacaacgatacccttgtcagttgatgaaacttcaccagggaaacgtccatgggttgtgtcatacttcaataaataagccaacattgatggagtggttaaatcattaattgcgacaacctcaatttcgtcggagtgcaattcatgaattcgcttgaatgccaaacgaccaattcggccaaaaccattaataccaatctttacagtcatactaagttttcctcctttaggaaatagaaaatataattaatagtacagatacaatcgtaccactaaatgaaaacaaagtcagcacccttgtgaaccaaggctcaaagtgcgcctcgagtaaacattatttaattactcaaattcgagtatagcagaccattttataaatgcaacgcccagaatttagtaaacgtttccatatgacactttttattacaccttgaaatgtaatcgattttctagtatatttatatagtaagttgcgctcgtagtgtaatggatcgcacgtaagattccggttcttgaaatgagggttcgattccccccgagcgcattattaaatgatgtttctaaagataataataaaagtctttactaaatatctttatgagttttacatagaacatttacctcaacagttattaaatgagtcattcacaaaccggtggttcatttaccataaaaagagcaggcagcttggacaatttaatttgtccaagctgcctgctcttttaagtaaatactcatttttaagtttgctaatcagcatagctgttctgagtgatgcttaactatcggcctcaactgtcggttgatttacgtgaaagctgataccttgttctgcataaaagtcgacaatttcctgtctttgagattcaaatttcggtggcagcgataaatcctggcccatcgttaaaattggttcctctaaactaaaaccgggggtcaacgtcgccaactcaattcgattatcgcccggatctctgacatacaagctcttaaaccagccacgatccgcatattcctcaatatttagatgtagtccctttgctttatcccaataactaaataaggtcggtttgtctggcaccgccaaagcaatatgatcaatactgccacggccaaatcgtgtcttaacatcgtggttaccttggaaaagttcaattgattgaccatcttcgagagcaacttgattattaacaatcggaatccccaaccaatcatggaagaatgccgctgtcttttgcggactcggaacatgtaattcagttccgagcattctggtgatttgatattcagcgggaatgtcattgcctggtacaacccgcatatcagtcaagacttccgcagtctgaagtaacttcacttcaacattatcgggatcaacaaattgaatgccattatcaatatcaatcacgtcaatgccacgttcgcccaacctctccttccaaaaatccagactgttagttggaacagacaatttaatgttgttgaaaaaatggctgccgtcagttcttctacccaacattggaatcacaaaaaacgttacaacagttccaggcgtccccaaataatcaccataaaataaatggcgaatctgaatgttctcttggttaactgtatttttaactaatcgcattcccagtacctgggtataaaacttaatgttaacttcagcatcttttgccaataaagaaatatgatgtgtcttcataacgcgccctcctggttcgaacggttttaaaaaagaaattaataatcttcatatgatacatttaattattattagtatatcatgaatgaagccgctttcttaataaagcgacgtttctcttgaaagccctcatgaccacctcgaaagtaataattacaattcattttcttatttttgagtagctatttgggattaaataccgatttaaaaagaagttcataatcatcgatgatgctaaaataaatgtcaatttaaattgagcaaaacatttgaccttttttgaccaataaactaaactgttaacatgaacttggcaaaagccatctatcataaaacctataaggaggcattctaaatgaatttagtgccaactgtcattgaacaatccgctaatggtgaacgtgcgtatgatatttattcacgtttactaaaagaccgcattatcatgctttctggtccaattgaagacgatatggccaatgcaattatcgcccaattactcttcttggatgctcaagactcagaaaaagatatttacctttacatcaactctcctggtggtgtgattacctcaggaatggcaatttacgatacgatgaatttcgtaaaagctgatgtccaaaccatcgtaatgggaatggctgcatcgatggcttctgttttggcttcatctggagctaaaggaaaacgctttgcattgcctcacgcccaagtcttgattcaccaaccatctggtggtgctcaaggtcaacaaaccgaaattgaaattgctgctgaagaaattctcaaagcacgtaagatgattaataatctcttagctgagaattctggtcagccaattgaaaaagtcaacaaagatactgaacgtgataattaccttaccgcgcaagaagctgttgattatggtttgttggatggcattatgacaaacagtgccgaaaagaagtagttttttacaataaacttattcattaacatcgctaaaaagggactgggacaaaagtaattttgtcccagtccctttttgtgtaatcacgattattatcgagtcgaaacgtgagataaaaagcaacctcctgccgtataaccgaattatcccactattcaagcccgaaatattcggataatccagttgtactctggaagttaaccgccctttgtctcactctgctttcctggatttaatttcatcaagccattgtggctaaataaaccaagttaattaatgttttttagattttctttgtcaataaaaaatttgacctcgccagtttgagtatcaaccttcgccaacacttcagcagtcttaggaaaaaccgaattcgaatcgacaatgatttttaagggcattttatttccatatgtttctgttttaaagattctttcagtcatcttaactccctctttcatagataactttcatttgctaaaataatatcactaaccatcaagttagtcactactaatttaactttttcaatcagtgattgaaggatgagaggagtcggcaaaagccgcaagaaaaatgaaactaattatttcgccagccaaaaagatgattgttaacacggatgactttgaagcaacagaactgccccaatatttggaaaagactcgtcatattttactcgcgatgcgccaattatcttattctgaactccaaacattatggcataccagtgataacctcacccaagtgaactatgaccaattacaaaaaatcaatctaaccaagcaattaacacccgccgttctcagctttacaggaatccaatatcaatatatgacaccagatcttctaaccgcaccggcacttgattatattcaaaataatttgcgaattctctccggcttttatggtattttaaaaccatttgacggcatttctccataccgcttggaaatgcaggctaagttagccattgatggcaagaaaaatctgtattcattctggggtgaccaattataccaggccattagttccaaacacgagccaatcgttaacttggcatcaaaagagtactcaaaaacgattagttctttcctgcagcctcaggatcaattcattaatatcgtttttggccattttatcgatggtaaagtcaaaactcgagccactttggcaaaaatggcccgtggggaaatggttcggtttatcgctgaaaaccaacttcaaaagattgacgatttaaaattctttgactcgtctcactatgagttcagccaacgtcattcaaccaacacccaactcgtatttattgatcgctataaataagctaaactaacgacagccacttggttgaaatatctgcgcactaaaatctttgatcacatatttaagtctggattaccttaattgctaaacggcccggaaccgattaaaatgaacttgtaagttaagaatgaatagatgcttaacaattggaatcgaggccatttaatttatgaaacttgatagtacaagaacacctgaagaaactgtcaacgtgaacgcaccagaatcaatcccaacggaaatgaaggcttgggaagttgtcaaaccaggaccaatcgatggtgatccttcaccactccgatttacaacaaaaccagttcctaaaccagcccgtggtgaagttttggttcacgtcattacttgtggtgtttgtcacactgaccttcatgttactgaaggcgacttgccggttcataaagatcacgttaccccaggtcatgaaattgttggccgggtagttaaaaacgggcctgatactagtcgatttaaacttggagaccgaattggcatcccatggttacgttggacctgcggtgtttgtgagtattgccgggctggaaaagaaaacctctgtccgaactccctttacactggttgggatcatgacggcggttatgcagaatacgtgaccgtaccagaagggtttgcttatcgaattcctgaacgatttgactcagtcaccgctgccccattactctgtgccggcatcattggttaccgagcctttgaacgggccaatgttcccgcaggcggtcggcttggcctttatggttttggtggatcggctcatttaacagcacaaattgcaatggatcaaggaatcgaagtccatgtgctgacccgtggaaaagatgctcgccagtttgctcttcaattaggagccgcatctgccaatggtgcttatgatttaccgccggttaaattggattcggcgattatttacgcacccgttggggatatcgttccaaaagctcttgaggcattaaaaccaggtggcacattagctatggccgggattcattcaaccgacattccacaattatcctacactgatcacattttccatgaaaagaacttaaccagtgttgaaagtaacacgcgacgcgatggtgaagaattcttaacccttgccgatcgtttaaaaattcatccaaaaaccactgaatatccattggcacatgcggatgaagcccttaagtacgtttcccgcggtgatattgagggtgcttgtgtcttgcgggttagtgaaggctagtttcgttattagagataatcaagacggattctgatgattcattaattgctctaaaaatcttgtcaggaaaataaaaggtcctgtaaaaccaattatgcattggctttacaggacctttttttcaatttgaacaatgattatcttagtagtcagccactaatcagattttttaaatcacgcgctttcactttcatcaagtttttccgcatactcattaatctttctgagacgatgattgacgcccgacttagaaattggcccaccttcaactagttcaccaagttctttaagactaacctcaggatgtttcaaccgggcccgggcaattgaagctaatttagggtttaatttgtttaacccaaccacactatcaattaatttgatgttttcaatttgtcgactagcagcattagcgaccttattgagattggcattctcgcaattaactaatcgattaaccgagttacgcatatctcgaacaattcgaatgtcttcaaacttcaacattgaactcgttgcaccgattaactgcaggaaatccgcaattttttcagcttccttcaaataagtaatatagccactgcgacgcttggttgtccgtgctttcagccgatacttattcatcatttcggcaatcatatcattatgattttcgtacagtgaataaatttctaaatgatatctggatgtttctggattgttaaccgatccactagctaaaaaggcgccccgtaaataagagcgaatttgagcatcttcggtgagcatctggtttggaacccgctcaacgatagaaacaccatcaaagattcctaaatcatctaataacatagttgctttattttcaactcgcaaaatgtacaaattgtttttcttaagtttcatttttcgacgaacactcagttcaccggtgatgccataaaacttagagagtaattgatacattcgtcgtgcaatggcaggattttctgatgatacatttaaaacaaaatggtgattagagattgataaagatccatttatccgaattaaggccattaactcagcttttgcattatctctgtgaacagtcaaggacgttaattcttttttaacctcacttgcataggacatttaatccctccttgctttgggtaattagccatcaaatagtccatgactaatttgcatcatcaaacgagcggccaattaaattcaataactcatcggcaacttcctgaccattgtgaaacgcccctcgatcctttagctcaagaaaatcagcagaaatcacacgacatcccatcgctcgtagaccagcaaaatcatgtttaacgggttgagaaatttcgttccattttttgtggtcaatatattcagccggaacttctttaatattaactaaaactgtgttaataaagttcatccccaaatgtcgattaagaacgcgaacatgatcagcctcagtgaagttttcagtttcacccttttgcgtcataatattgcatatgtaaacaatatccgcatcggtctggcggagtgcctcgccaacattttcgatcattaggttgggaagaatgcttgtaaataaacttccaggtcccaaaacaatttgatcagcattcataatagcatcaatgacctgttcaacagcctctggtttatgggaatcatcatttgtttcaacccaaacccgcttaataagtttaccagccgctgtaatttctgattccccactcaaatgagagccatcgctaaattcagcgtttaattccagtggttcgttagccgccggataaatgtgaccatcaactctcatgatcttgcttaagatctgaacagcatcaaaaattccacccttcatttcggagagggcagcaataatcaaattgccaatcgcatggccggcaaaaaattgatctgaactcgcaaatcgatattgaaataaatccttttccaaatgtggcaggtccgaaagtgcaaccatgacatttcgaatatcaccaggtggcacaacgttaatgtaatttcgtagaattccagacgaaccaccgtcatctgcgacggtgacaattgctgtaatatcaacatgtcgatttcttagatttctcaggataactggaagtccggtaccaccacctataacaacaattttgggctgatgggtatgaagtgcatcaatcatgatcagttaccctccttggttttatgacgatcaatgtcccggtgtgtaatattgacggggtaactagccttcaaatctgaacctaatcgttgtgcaatcgcaacagaacgatgttggccacctgtacaaccaatggcaatcgtcagactggccttcccttcctttttatacgcgggcaatgtaaatttcaacatatctaataattttttgtagaattcttgagcaccctcggaattcatcacatattcctcaactggtttatcaagaccagttttaaagcgcatgtttgcatcataataaggatttggcagaaagcgaacatccatcacgatatcagcatctaacggcaacccgtatttaaagccaaatgacatgacttcaacgtggaacgtgtgggtttcatcagttgactcaaaattatgaaagacttcctcgcgtaaacgtcgtggtgacatattagttgtatcaacaaccaaatcagccgctcttttgacgttagcaagcagctcccgttcttttttaataccgtcaatcacacgaccgttacgagcaagtgggtgagctcgtcgagtttctttatagcgagataccaacttcatatcagaggcgtccaaaaaaataatatcaacattattatcatcgttccgcttaagatcattgaacatgccgataatctcatcataaaaaacctgtgatcgtaggtccatcacaagcgcaattttattaatatcacgctccattcgaatcaattccttaaaccggggaagaagtgtcgggggcatgttatcaacacaaaaataacctaaatcttcaaaactttgcattgccactgttttaccagcaccgctcataccagtaatgatcacgaattggttgttcactgccataatgatttcctttcgtataacaaactttataaagtataacataccaggcgtatcattttaagaggaaagatagttcttaaagctttctatagaatgatagtacagtaaaagcctgccggttacctgtccagccgtcattcaagccttacttttgctcagcattaattccaggcacaaaaaaagctacctgcttttagccgctaaaaagggatttaagccaccattggtcacagtcatttaaattaccaattgtttttgattaatacattttgattatcaaaaaaagaagctgggacaataatcgttttgctcagtctctgttagtgtaaccactatgattaccaagtaaaaatgcgggacaaaaggtaacttccggtcgtgtaatcgaatcatccaaatatccaagttcagaatatttagataatttggttactctggaggttaaacgccctttgtcccgctctgataaaaatcgatcatcaatttacgccttgctactcatcttttttgcagacgctttctcttttgcctgttcagttagctttcgatcgcgctccaagactggcttaagatactgacccgtgtaactttccttaacctcagcgacatgttcgggtgtcccggttgcgacaattctgccgccgccatcgccaccttctgggccaagatcaatcaaataatccgcactctttacgacatctaaattatgttcaatgattaacaccgtattgccttgatccactaatttttgtaagacacccaacaatttacggatatcttcagagtgaagaccagttgttggttcatccaaaatataaaagttgttgccactcgactttttgtatagttcagaagctaatttcattcgttgcgcctctccaccagacaaagttgtagccggttggcctaaagaaacgtaacctaaaccaacatctttaatggtctgaagttttcgactaatttttggaattgcattaaagaaatccaaggcttcatcaaccgtcatatccaaaacatcagaaatattcttacctttatattcaacttctaaagtctcggcgttgtatcgtttcccgtggcaaacttcacatgggacatatacatccggtaaaaagttcatttcaatttttaaaataccgtctccgtgacaggtctcacaacgaccccctttgacgttaaaactgaaacggccctttttaaatccacggagcttggcatcatttgtattcgcgaataatccccgaatgtcatcaaaaacacccgtataagtagccggattgcttcgtggtgttctgccaattggcgtttgatcgatattaacaattttttcaatattcttatagccggaaattgatttgtactttccaggtttctctgaattatgatttaacttctgagctaacgcccgtttcaaaatatcgttaaccaacgttgatttacctgagccagaaactccagttacaaccacaaattgaccaagtgggaaatcaaccgttaaattttttaaattattttcagctgcacccgtcaatcgtattttcttaccactacccttacgacgcttttcagggactgggataaaccgtttacctgacaaatattggccggtaattgactttggcgatttttcaatttcctcaggagttccaaccgccattacgtggccaccctgttggcctgccccgggaccaatatcgataatataatcagctgcccgcatcgtatcttcatcatgctcaacaacaatcagtgtgttacccaaatcccgcatcttttttaacgatgaaatgagtcgatcattatcgcgctggtgaagcccgattgacggttcatccaaaatataaagaacgccggtcaagttagatccaatttgtgtcgcaagtctaattcgttgtgcttcaccaccggaaagtgttcgagctgaccgggataaagttaaataatccaaaccaacattttgcaggaaggttaatcgatccacaatttctttaataattggtttggcaatcattgtatcttgctcaccgaacgtcagagaacggaaaaaagctagttcagcggaaatatctaatgccgaaacttcggcaatgtttttacgctgctcacccattttaactgccaatgcttttcgatttagacgatatccgtgacacgtttgacaagttaattcagtcatatattggcttaaattgtcccgggtccagtcactacttgtattgtgataacgacgatcaatattattaatcacaccttcaaatggcccatcgacatcccgaatgccaccaaaatcactttccaaaacgaaatgaaagttctttttagagccaaacagaacaaaattctgttgcttttttggtaattgattaaagggtgtatccatgtcaacgccctcagctttgcacgcttgggcaagcatgtttggataccattttgaaccacttggattccaaggcgctaaagcaccctcatttagtgttttttctctatcgggaaccaccagatcagggtcaacttccaacttcatccccaaaccatcgcagtcgggacaagcccctaatggtgaattaaacgaaaacagtcgcggttccaactcaccaaccgtaaagccacacaccgggcaggcataatgttcagaaaacaacaacgggtctcgttttcccataaaatcggcaatcgcataaccgccactcaaacgtaacgaggcttccaatgaatccgataatcgattgttgatcccgtccttaacaataatccggtcaaccacaatattaatatcatgctttttatttttatccaactcaattggttcatcgatgtcgtaagtttcaccatctatttgaactctgacaaaaccttcacgcttaatcttttcaaagatctttttgtgttgccccttacgaccacggacgattggtgacagaatttgcaatttcgtccgctctggtaatttcataatctgatcaatcatttgatcaaccgactgactagaaataacggtgccatcgtttggacaaatcggcacaccaacccgggcccagagcaatcgaaaataatcattaatttcagtaacagttccaacagtcgatcgtggattctttgatgtggtcttttggtcaatcgaaattgccggactaaggccttcgattgaatcaacatccggcttatccatctggcctaaaaactgtcgagcataagacgacaaactttcaacgtatcgccgctgaccttcagcatacaaagtatcaaaggccaatgagctctttccagaccctgataagccggtcatcacaaccaacttatccttgggaattgtaacgttaatattttttaaattgtgtgcccgcgcacccctaatagtaatcttatctattgccaatctgccaagtctcctttagctcatttcaccctttaattccatgatcgtatcacgcagagtcgctgcttgttcaaagtctaattttttagcggcaccgcgcatttcttcagtcagtcgagccagcatctgcttttgatctttcttactcatctgttcaaagtcactctcgacaaaatcgtcctttttgcccgcatcatcagttgctttagtaacagaaatcaacgaccggattggtttcttaattgttgttggtgtaataccgtgctcctgattatacttcatttgaattgatcgacgccgtgcggtttcatcaatcgccgctttcatcgaatcggtcatttcatcagcatacataatcacagccccatgctcgtttcgtgaggctcggccaattgtttgaatcaatgaccgctcattgcgtaaaaagccttccttatcagcatccaaaatggcaactaacgatacttccggcacatcaattccttcccgcaaaaggttgattcccactaaaacatcaaattttcctaaacgtaagttccgaatgatttgtgttcgctcaagcgtcttaatatcagaatgcaaatattgaaccttaatgcccaagtcctttaaataatccgtcaagtcttcagccatctttttggttaaggttgtcacgaagactcgttcatttcgatcgattcgcttattaatttcaccaaccaaatcatccatttggcccataattggccgaacttcaaccgttggatcaagcaggccggttggccgaataatttgctgaacaacgtgcttagtttgatccatttcataaggtccgggagttgcagacatataaacaacctgatgaacatgcttttcaaattcatccagcttaagtggtcgattgtccaatgcactgggaagccgaaaaccataatcaatcaattgctgttttcgagctcggtcaccattatacatcccccgaatttgaggcatggtttggtgagactcatcaacgaccaacaaaaaatcgtcagggaagaagtcaagcagcgtgaatggtggctgccccggcttccgacggtccataaaccgtgaatagttttcaataccacttgtatagcccatttcacgcatcatttcaatatcataagtcgtccgttgctttaaacgttgggcttcaagcaacttgccttctgattcaaatttcgcaacttggtgttccatctcgtctttaatctcaggcaacgccaaattcataatatcatcgttggttagaaaatgagtcgccggaaagatggcaatatgttcacgatcaccaatcacttcaccagtcagcgtatctacttcgcggattcgatcaatctcatcaccaaaaaactcaattcgaaaggcatgttcgttccaagctgccgggaagacttcaacaacatcaccgtggacccgaaaccgaccacgctgaaaatcaatgtcatttctgtcatattgaatatcgacaagttgacgtaataaatgatcccgctcaatattctggccaactcgcagtgaaacaacatgatttcgatattcactaggatcacctaacccaaagattgatgaaacggaagcgacgacaatgacatcatttcgttcaagtaacgaactagtggcggaatgtcgcagttgatcaatttcatcattgattgatgaatctttttcaatataggtatcactcgaagggacataggcttcaggttggtaatagtcatagtaggaaacaaagtactcaacggcattgtgtgggaagaactccttaaattcaccgtataattgccctgccaatgttttattatgagataaaaccaaagttggtttgttcacttgagcaatcacattggaaattgtgaacgtctttccagtaccggttgcacctaagagaatttgtgctttctcaccctcatcaatcccattaaccaactttttaatcgcctgtggttggtcacctgttggctgatacttggataccaagtcaaatttatgattattttctcgttcaatcattattgtgcctcctgacaaaaacgcgcctgttgtctgctctgacccaactaaagtgtcctgatcatctcattaattaatttcagtaacgattaaaaagctaagtaatgctttttgataacaaacgctttaaacaaaatcggaaaaatcgggcattgaaataatcactattttatcttaacagtcatggcaaaacataaattctgcaaagctaaaacatggaacacaaatgatcagcttccgttgcataagtatttgattcatagattaaaacacgaacgtatctgaatcaggcacatacttatttattagaagcttaccatcttgtgtcccattggcccactaacagaactattctaccatacgaacatactttcgcaaaccattttattctgaatcctcttttaagactcgccgcgtcaatttctttaatttatcttgggtcgtgaagctctctgccaacatgtccggaataacttttgagataacgtattttacacaatgcatatcacgaaattttagcatggtcgataaactctctttatacatttccggataaacttcctcaggatttcccttttgaatttcaccaaatgattcatataataaatccagtttatccgcaacggatagaatcttaccttcaagagaatcatcttttccttcagatagtcggcgacgatatgctttttgaaaggcttcgggaatttcgtttttaatgaaattcgccgttaacttatcatcaacatctgctaacatttctcttaaaaccggtgttgcatactttactggtgtcttaatatcgccaataaacaattctgtataatcatgattcaatgccttttcgtatagtagtcgccaattaacatcttcacctgcattttcttcaacatcgcctaagaactgagcaatctctgttaccttaaacgaatgagctgctactgaatgttgttgaaacttaaaatagcccggtgcccgattgattaattccagttcatctaagctttccaaatattggtgcattcccattataattcccccgtatctgcaaaaaagactgacaacaaatcattttctttgttatcagccctctctcattgcttatttagttttattgtaatccaactgtcaatttaaacaaaccgacaagattatttttgggtaacacccggcttatttgtctcatccttatgggattcaacatatttgaatgcttgttgaccagcaatgccaccctcgccaactgcagtcgtaatttgacgaagttcttttttgcgaacatcaccaattgcataaataccaggaacagccgtctccatttgttcatttgtcttgatccaaccatctttatcagtaatgttaagatttttgaatggttcagtcatcggcagtaggccaacgtaaatgaagactcctgaagtttcaattgttgaagcctcgtgagtttggttattaaccactttaacaccagttaccttcatatcatcaccaacaacctcagtcacattggtattccacacaaaatcgatcttatcatttgcaaaagcacgatcttgaataacttgttgggcgcgcaattggtcccgacgatggataaccgtcacgtgatcaacaatccctgctaaatatgaagcttcttcaatggctgagtcgccaccaccaatgacaacaacatgcttattccggaagaatgccccatcacaaacggcacagtatgagacacccttgccaccatagtcatgttcaccgggaattcccaatttcttatactcagatccagacgcgataataacaactgttgcttcaatctcatcactatcagttttaatcaacttggtttggcccttatcttcaattgattcaaccgaaccgtaaacatattctgcgccaaaattgatagagctatcgtacatctgttgagccaaatcaggacccataattgatttgaatccaggataattttcaatagcagccgtattattcatttgaccaccatagattccccgatcaatcatagcgactgacaaattagcacgggaggcatataacgcagctgtcatcccaccaggaccggcaccaataattacaacatcataactttttgccatttggatcctccttatttctttcgatattcacaaacattaatttactatcaaaaagtaagtttgtctagcaaaagagcttatttctttttatcttcttgggttaattgttgaccaagatcctttaaataagttcgtaacccactggaaatttctgggtgccgcaagccaaaaatgatgttcgtctttaaccagcttaatttgttgccagtatcaaatcgttcacccttaaactcatgagcaaaaacgcgttgggtttggttcaatgtgtcgatggccgaagttagttgaatttcaccactagcatccggtttagtttgttcaagaatgccaaaaatctcaggcgttaataagtagcgaccgatgattgcaagatcactcggtgctttttcaggagatggtttttcaacaaattttttaacattgaagagacctggatgaacctcttcagaaggggcaataacaccatactttgaaatgtccttgtgagccaccttcttaacggccaaagttgatgcacccgttttttgatagctgtccatcaattgcttggttaatggcaccttgtcctgcatgacgtcatcaccaagcatcacaacaaacggttcattactaataaaacttcgtgccgtatagatcgcgtcccccaaacctcttggatgggactgacgaataaagtagatattcatatcattagttttccgaattgtttcaagcatatcgttcttatgccgttcttccaaatttaattccaactcggggtttgaatcaaaatggtcttcgattgatcgcttacctttgccaatcacaattacaatatctcgaatacctgactttttggcttcttcaacaataaattgaattgttggtgtatcaacaattggtaacatttctttaggtaatgcttttgtttctggtaaaaatcttgttcccaacccagcggctggaatgactgctttcgtaactttttgtggcattgttgacctcgcactttctattattaaactgatttattcaatttctgaacgaccttcacgcgtcattaaggcattaatcgtttctttaatatcggcaccatcatacaacacatggtaaatggcactggtaattggcatttcaacaccgcgtttctttgataattcatacgctgcccgtgtcgttgcaatgccttcaattaccatgcccatgttttcaatgacctcttttaaggatttccctttccctaattcattgccggcacgccagttacgtgaatttgtacttgtcgcagtcacaatcacatcaccaactcctgataagccggtaaacgttagtgggtttgcgccaaatgacgttccaagccgagaaatttcagctaaaccgcgggtcattaacgctgccttggcattatccttgtagccaagaccatatagtgcaccggcccccaacgcaataatgtttttaagagccgcaccaatttcaacaccaatcacatcgtcactagtataaacccggaaataatgattcataaacagatcctgaatttctttggctgcccgctgattgtcgctggcaaccgtcactaaagtaatatctttagtcacaacatcttcagcctgactaggacctgagagaacggaaattgattttcgattttggggattaatttcttgtgacaaaacctgggataatcttaagtaggttttttcttcaatgcctttcgaagcatgaataatgttcacttgctgattccgcttgttcaaaatagccgcaacctgttcagcaaccgatcgagttgcctgagttgggacaacaaacaatatgtaatcaacattgtcaactgcttctgccagatcgttagttgccacaattgattcagagaacgtgaaattcttgatatatttggaattagtgtgcctttcattaaattctttgacctgacctaggttatatgaccatagcttaacgtctgacccattctcatctaataaactcgcgaggacactgccccaagaacccgcaccaagaaccgcaattttcttacccataattaaactcctttatgtttaaatcaaacttaaaatctgctgccaaggatcattttgaaaccatttgtaactgattaccttgaagataccacggattagtgtgatcccgtcgacgataaaagatcaaaatgactgccccaataaacagaacaatcgacagaatttgagaaacccgcagattaaaaagcattaaactatccgttcgcatcccttcaataaagaatcttccaaaggaataccacattacataagttaaaaatacctcgccttgtttaaagaaatgtggattatgacgcaaagtaatcagcaccaggaatccaaaaaagctccacaaggattcatataagaacgttggttgccgataagcaccactaatatacatctgcgaaataatcggctgcggtaaatgtaacgctttcaaataagccaatgatgttattttaccaaaagcctcctgattcataaagttcccccagcggccaattgattgtgcgaggataacggttggcgcggcaacatccaacatcaaccaaaccgggataaaccggctgcggcaaaaccaaatcaccacaatcattgcgccaatcaatgaaccatatatcgcaatcccgccatcccaaatcttgataatttcaccaggattgtttttataataaccccactgaaaaatgacataatacaatcgggcacaaatcaacgcagccggcagtgcccataggatcatatcgtaaatgtcgtctggattaatgccacgtttttttccttcggtaacggccaggtaaaccgctaagatgacgccactggcaataataataccgtaccagtgaacttcaattggccctaaatgaaatgcaattggattcaaagccgtactagctaaattaaacaattgatctatctcccattacaaagctttctcaaagacaaattagtcggcagccgatatggcaactactaattcctaattacttactcgtctttggcgcattatttttcttgcccttatcatcttcaccaattaaatttttatttttttcttcgacactggcttgttctttcttttgagttgcatcaactttactattaaccttaatcaaattattcaaattacgatcaaacgtttcagttgcgtcataccccattgattgagctctgaagttcattgctgcagcctcaataatgatggccaaattacgtccggtcttaacaggaattgtaattttgggtacatccacatcaaaaatatgaacatgttgcgttccgttgcccaaacggtcaaacttggcttctttagtataattcgccaaatgaatgatcagggcaacctgagtttggcttcgaacagccccggcaccaaacaacgtcatcacatcaataatcccaattccgcgaatttcaagtaggtgccgaagaattgccggtgcggttccaaccagtgtttgttcgtcttgttggtagacttcaacccggtcgtcagcaattaagcgatgcccccgtttaaccagttccaacgcagtttcactcttaccaatcccactatcaccggtaattaagataccaagtccgtatacatccaccaaaacaccatgaagggactttctttccgccagtttatcttctaaataattggtcatattactaagaattcgcgaagtggtcagttttgaccccagaaccggaatgtgctgttctttagcagcctccaataattcgtcaggcggatctagctgggtagaaatgacaaatgccggcgtttgaggctgacacattttcttcatgacatccaaaagcgtctcatgagtcatcccctttgaatatgaaatctcagtaattccaagcaactgaattcgcttagctgggtaataattaaaaaatccggtaagctccaaacccggacgagaaatatcactcgtcgaaatgtgtcgttggtctaagtactcttgaccataatacacatctaatctggcattggttaccaaatccgctacacttacactgtcagtcaagatcatccctcctcaaataatcactataattttatcactttgatttgtatccgtctttaacgttttaaggtcgtcgaaaatattcggcaataattgtactaacaagcgacatcaatatggcaacaaacatcgccatccagaatgatgaaaaccgaaatccagctcccacaattgccgctgtcatttccagcatgagcccattgatcacaatggtgaacagtcccaatgttaataaattaattggtaacgataagattgtcaaaattggttttaccaaccaatttaaaacaaccagcacaaccgatgcaatagctgcaattccaacactggcaacaaaaaaactggcaggaaaaaagccactaattgcaacaaataaaagtgtatcaaccacgacggtagtcagaaatctcaagattggcctcttttctgatggtcattaacatccttttcatcaacattgtggagaacctttcttgactggctatctggattagttgtgctaaaatttgatttcatttgattaaaaaaagacgtcgttgaatgatcgcttggaacaataactcccattacgatataagaaagaaaagccacaaagcccactccaggtgtcaacaataaaacaatatacagaattcggaccaacgatgattgccagccaaaaaactcagaaatgccacctaaaacaccagctataattcgatctgatgacgaccgatgcagcttcttgccgttattcataacgtatccctccaatttagaaaatcttctatattaaatcatcacaattctattctaagcgtatccaaaaaaagcactgcaatcaagtatgcagtgcaaaaaacagccattcttaatttaattcaataattttacccgttgcaagataaacggtccattcgcaaatattagtactgtagtcactgattcgacccaaatctttggcgacgttcaaatagataatcgcagaatttacaatatccgggtctttagccatggcttgatagcttggcgccgcgatattattgtataaatcatccatcttctgatcatacgtccgggctgtctccttggctttagcctgatccgcggtaccataggaatccatcgaagcatcatattgttcactgacaccccttgccattgtcgcaatgatcgtttcaacttcgctgattcgaggttcacctttaatctgaactgtctcccgggcaatatttcgtgcatgatcaccagcccgttccaaatcagtcacagccttcaagatcccgacaacttctcgtaaatcgccagtcaccggctgataaagggcaatcatttcaaaagatcgcttttcaatatgaatttgtaggtgattaatctcgtgatcattagtaataattgtcttggcagcagccacgtcgtgatcaataaaggcttgaccagcgttggcaattgcttcgctcactagggcacctaatttcataaaatcggctttaagggtcacaatctcttcgtcaaaaacttttcccatacgcgtctctcctatccaaatcgaccgctaacataatcctccgtctgcttattatcaggattcacaaacatcttgctggtatcatcatattccacaacccggccttccatgaagaatgccgttttatcggaaattcgcgaagcctgttgaagattatgtgtcacgataatgattgtgtattctttttctaactctagtaatgtattttcaattttagcactggaaattggatctaacgcgctcgtcggctcatccatcaaaatcactgaaggagaaactgctaaaaccctggcaatacaaattcgctgctgctggcccccggaaaacgataacgcgttgtcatacaagttatctttaacttcatcccaaaccgccgcctgcttgagactccgctcaacgatttcatccaatttttgtttgtcacggacaccagcaattcgcagaccataagtaatattatcataaactgaaaatggaaagggattaggttgctgaaaaaccatgccaatttctttccgtagatcaaccaaattagtttgaggtgaataaatattttgatcatgaaatttaaccgttccagtaattgtcacgccatcaatcatgtcattcattcgattgaggcaacgcaaaaatgttgacttgccacatccggacggcccaatcagcgctgaaatttgatgcggttcaaaatctaaatgaatgccatgaagtgcttgaaaatcgccataatataaatcaagattatctgctgtaataattggatctgacattttgattcctcctaaggcttcgaatctgtttgatgggtaactgacaatcaacttcggtcgacattatccatatcaaccaaagttaccagaaacataatcatctgtcagtttcattttaggccgggtaaacacttttcgagttttgttatactcaatggcctcccccatattaaagaagacggtataatcgcttagcctagccgcttgctgcatattatgcgtcacaataataatggtatagtctttttttaattgtcgtaacgtttgctctagttgagctgttgaaacaggatcaagtgcactggcaggctcatcaagaagaaggacatccggtttaacagctaatgcccgagcaatacaaactcgttgggcttggccaccagaaagagataacgcgctcttgttcaaactatctttaacctgatcccaaacggcagcttgctttaacgttttttcaacaacttcatcaagcacctttttactatgaacaccacgacgttgcaaagcaaacgtaatattgtcataaattgatttggcaaacggattaggtcgttgaaacaccatcccaatccgccgacggacttcatagacatcaatgcctggttggttgatattaaccccttggtacaaaatttgcccgtttactgtagcaacatcatcattcattcgatttaaagatcttagaaatgttgatttgccagagccagacggtccaattagcgcagtaatggtatttttttcaaattgaatatcagcattgtgcatggcgagtgatttgccataataaatctctaaatctttagtttgcattgtaattggtgtttcctcagggttaaactcataaataaatctatctgattgttgatctaacttttgcatgatgccacctcctatttttgagtcattgtcattctcaactttacttgaaccattaaatactcgtcattttttcaaaaacttttcggccaatgtaacgagcggaaaaattaaagatgagaattgctaaaaccaatactgcagctgagccagaagaaactttcgttagatccggcataatgccttctgaattaattttccaaatatgaaccgctaaagtttcagctggacgcaacggactcaggggactatcaatattaaacggattccaatcactaaagtttaacgcaggtgcactttgaccagcggtataaataagcgcagcagcttcgccaaacacccgaccggagcaaagaataatcccactgatgattccgggtagggctgctggaacaacaatgtgaataatcgtttcatatttagacaaccccagacccagaccaccttgccgttgatcatcagaaacaccggataaggcttcttcaatatttctagttagcagaggaaggttaaatattgtcagtgttaaagctcctgagataattgaaaagccataattaaattgcaccacgaacagtagaaatccaaacaaccccacgacaactgaaggcagtgaactcaaaatttcaattgccgtccgaatcatcccggtaaaccaattatctttggcatattcattcaagtaaatagacgcaccaagcgcaattggcaatgaaattaacattgccaacaccaataagtaaaacgaattaaacagctggataccgattccgccaccggacgtgaatgctttggctggagttgttaaaaaatgccaactcacatttggcagaccggtaataaaaatatagccgatcaaaaatgccagaatcaagacaacaaatcccgcaattcctcttaaggcagcaatggcaattcgactttgtttttgagatcgattcattttttaaatgctcccttccgaccaataaagtgaaccagtaaattgaagaacaatgacattaccagcaagactaatgctaatgaccacagggcatcattttgtaaggatcccattacggtattccccattccggcagttaacacggatgtcaaagttgaggcgggtgaaaccaaattatgcggcatcaacgccgcgttaccaatcaccatttgaacggccaaagcttcaccaaacgctctggccatcccaaaaacgactgccgttagaattcctggagttgccgctcgtaaaaccactttccaaattgtttgccacttggtcgcccccagtgctaatgacgcctgccgataatactttggtaccgactttaacgaatcaaccgtcattgaaacaattgtcggtagaatcatgacaaataggacgaaggtgcctgacaggattccaaaaccgctcccaccaaatgtatttctaacaaaaggtaccaccactgataatccgataaacccgtaaaccaccgaaggaattcccaccaacaattcggtaaccggttgaagaatcttagcacctcgcttaggcgaaatttcggtcatataaaccgctgttccaattgcaaacggcgtcgatacaactgctgccaaaatggtcaccaagaatgacccaacaatcattggtaaggctcctacagcttgatgaccacttggcgtttttgttcccgggttccagagcgtcccggtaaagaaatctttaaaactaatatgatcattgaaaaaggttgacagccctttagttgcaacaaagacaatgattcctaaaacgattgccataatcagtaaaagagccgaaagacttagtaaatggccaaatcgttcgtaacgggccgtctttgactttttcatgagttgcttagccagcttttgattttgcatcacgattcacccgatcctttcgaaatctttccctgccaagttcgctgatagtgcatgtccttaacagaaatatatcctaacttattaaacaaggtcgtttgaatatgtctattttttaagtaatttaaaaactgcttcgttaagcctttaggttcaccgcgggtatagatatgttcataggaccaaattttccacttgttgtccatcacgtttttttcagtcggtgcaacgccgtcaaggctgattggttgaactgtttgattgacataaccaaacgaaacgtaactaattgcccccggagttgatgagacaatttgccggacagtcccagatgaatcctgttcttgtgcaaccgcactttcgtgaccctttaagccatattcttcaaaagtgaccctggtaccacttccttgggaccgattaatcaacgtaattggcaggtttttgccacccagttgatgccaatttgtaattttcccagtaaaaattgcgattaactggcgagtggttaagttatgaatgccaacccgatcgttcacaattggggcgaccccaacaacggcaattttatgatcaactaacccctttggattaatccccgccttttcttctgcaaacagatccgaatttcccatttgaacagcacccgattcaatttggcttaatccagttcctgaaccgccaccctgaacattgataaaaatgccgctgtgttcagccgaatactcttcactagctgcttccactagtggttgtaaggccgttgagccaacagccgttatcgactgctggtttgtcgcggttttgcttcggacgctgtaagcaccaattccagcaagaacgactaccaaagcagtgatccatttaattactgtccgtttgcgcatctgacattcctccttaaatctccaatattcattgtattaaaccaatgtaaatttttgaccggataaatgtaaaaattatgtaaatagatcatgggggttcgcttttaacccggaaaataatttaacttggaagttggcagccacttattgataatggacacaaaaatgctttttcgatcatttgcttaatataacgtaaaagtacgtggctggtacaataatcgtcttaaccagtctctattagtgtaaacccgattattaccgagcgaaaacgcgggacaaaagggctctttccaccctcgggtgatttctgcggtacaatggactcgaattcgaggcgataattatgaatagtactgatttaattgatctgccgggaattgagattgaccaagttaagaaaatggctaatcaatacgatttttatgggcatgcgacggctcaaaaggcggtttgtccagcttgccatcatgctagcacaacgatcaatgcccgtcatttacgcaaaattcaaggcttacccattgccaaccggactgtttggttaattctaaaaacgtgccaattcgcttgtcttaatccacgatgtgattgtcatttcttcatggccccgctgagctttatgactgcccaggcccaacggactaatcggctaaacgccctaatcctgcgaaccgttgcccagcgcagttccaccgcgacagcggcgttacttcaaagtaccggtattcaagttcataagagtgcaatttgtaatttgtttaaaaaaaaacgtcatgattgattatcagcgggtccaacacgttggtattgatgactgggccatccggaaacatcaagtctatgccacaataatcgtggacttggactcgcatacaatcattgatatgttacccagccgcgatgaatcggccgtggctcattggcttagaaagtttcctaatctgacgttggcggtccgtgatggtgccgtgttttatcgtcgggcaatctggcgagataacccaaagattattcaggtttctgatcggtttcactttcaaaaaatggtaatgggccacttccatcaagcaattatgcatagcctgccaacgcggattaccatttcaaaaccggtaattacgccaccaattaatttatcacctggtcaattgcgtagtgcaagtggcgagttttggcttcaaaagaaacgactgatcaaggcggttcgctcggcccataatcagggctggaaaatggcagccattgcgcgcatgtttagtctagatccacggacagttaaacgttatctaactgctaagccgcactggcaaccgcgacatacgtataatccattattcaaatttgctaaacagattcgtcagctagtggccgctggatggacaaacctggccatttaccaccaagtagttaaggaagggtatccgcgcgcttatcgcaccttttgcgactataagccatacgtcttaaaacggtttgctcaacctgagccaacctatctatcacgaacaaaaattgccaagttgatttatcagcgaactggcgcttgtgtttggaatgccacactggccagtgtcttagctcgacatccgttagtcaaaaaattattaagcctcttttttgatttcttattgctctgtaaacagaccaacgttactgctttgaaaacctggttagtccgggcgcgaagcttacacgaccgcagtattaacgccgcttgtgcttcaattaaacgtgattaccaagctattttaaactcaattaaattcccaacttattccaatggaccggttgaggggaaaaacaccaagactaagttgattaaacgaagtatgtttggccgtagtagttttgttgtcttaaagaacaagatgttactactggagaagctttgaaggggcttcactcaatgatggaaagagccgacaaaaggcaactttcggccgtgtaacattcaatccgggaatatctcgttgaactttttacttagctgaaaatgtgggccaacaagcagatcccggccatataagtcccctaatttaacattccaaaatcgggaatattaaattaggggacttatattctggggtctaatcgcttgctggcccactcagtttgtacgtttaatgataaagaaacttcaaatttaatggaaagcagtagctgcccacgataatgactaaaaacaattttcatgatattaacggccgtgttaaatagcataaagatgacactttgcttgatcaactttcagttatttgatgccgctttcccatcattttctgtaacaataggaaattcaattgtaaaggttgagcccacaccacgttgactcttcacatgaatcgtgccgccaatcgaatcaaccaactctttaacaattgccaatcccaatcccgttccgctcactttttgctttgtccgggaatcatcagcccgatagaatcgttcaaacagccgtgaaatatctttttgagcaatcccaatccctgtatcagatacatgaagctgccagtaactgtcattgaccgtgtacgtaatgtcaatttgaccgtttggtatattgtatttaatggcattactaaccaaattccgaaggatccgggtcagcatgctcgcgtcagtattgacctcaactcccgaaccaacttgattattgatcgagatttggtgaaccttggcgaccgattggtaaggtgctaattctgaattaacgaaatcatgaagattcatcgattgataatcatagttggtcccattctgaatatgtgaaatcgtcaaaacatcattaataagtgaggtaagttgaccactttgttcgtcgataatttttaaaaattccactaatgttttctgatcatccattgcgccatcaagcaatgtcttcgcaaacccggaaatagcagtaacgggcgtctttaattcatggcttgcatttcttaaaaagtcgatttgcatttgcttaacattaataatatctgaaatatcgtacataatgactaaaatatgaaaatcattttccagttgattgtaaaccacgctggtatcccaagtaattggctgatcgccaatactgcggacttcggcctgttgcgattttcgatcattaaaaacgccgtcaataagtgaaagcaactggtaatttcgaatatcctgcgtgtagggatgaacttgcgtcaaaatatttcgttccaacatcgtcgacattttatggttggcaaaaataacgtcatgggctgaatcgattaccataattccaacgggcaaacttgaaagaattgtgatcagctcagtgttactatttcgaatactttttgcctcatcttgctgtcgtgattgtaattcatttaattgatcagccaaacctttaaagggattatcaggtgcaacaaacaatggcgcagctggttgatcgtggacaatattttcagtcattgtttgcaactgcttaatcgttttttcgtgttgataataataaatgcccagtacaatcgtcacaatcgttaaaattgtcattgccactaagctaaggaaaaaccaatcccgcttcattccggaaaatgcataaaagttcattgccaatgtaacaatactcaatccaacggttgccaggatttgtttgctaattttactcagaatcgtcatcccccgtagagaattcataaccaaaaccgcgaattgtctttaaatatttgggctgtttaggatccggttcaattttttctcgtaagtgggcaatttggatatcaaccattcgactttgaccagaatagtcaaatccccaaacaccttgaagcaattgatcacgacttaaaacttggttctcatgactcaccaggtattgcataagttcaaactctttcggtgtcaatcggagatttttagaattagcgctgaccagatattttttatggtcaattgtaaacggacccgttgtttcaaccccgccatcactgttacttggattttgtttagcagttgcttcacttttttcgtagcgacgtaaaactgcgttgattcgagcaataacttctctgggactgaaaggtttggggacgtaatcatcagctcccatttccaagccaaacaccttgtcaaactcagtatctttggcagttaatagaatcactggtgtatcgttacgatccatcctgacttgctttaagacatcctcaccactcatctgcggcaacattaaatccaacaatacaatatcaaattttccattttcaatctttgataacgcatcaacaccattggtggcactttgaacttcaaagttagcctgttttaaattatattccagcaaagtcacaattgcaggctcatcatcaactactaatacttttttcacggtaatcctcctaatcgatggggtgggtatatgttttaaccccaatttcatggggcgagttcttgaagatggcggtttcagtaatctttagttgatcatttcgatcacgaactttgaaccggcaataggtcgaattggtggacagcgctcgataaaattcatcttcgttggcaactggaatttcattcacagttaaaataacatcaccaacttgtaaattcatctttgcggctggtgtttcaggctgaatcccaattacccgaatgccatccatcacctcgctatattcaaatttttgccgattgtcttcatgtttggctaaccaaatcgataagtaatagccaagtatcagaataaaaattcctggaagaattgtcttggcagcaacataaccaatcccaaccaaaacaatccccagtccgcttaaaaccattaacgacttgcttaaccggatgaagaaacttcgtggcacgcttctctttacggttaattttaatcccaacaaaatcggaataattaaaaccgcgtatgaatgaccgttaatttgaaacattggtataaagggaaaacgactgacaaaccaattgcctggaaccagcatcaaaaatgggatgatactcatttcgttaaatttataaacggctacccgattatttcgctgatttctagccagtgatggagatgcaaatttaccaccattgacatggagaaatacacagcttccaacaattatcagggtcaaaataatcaaaaagttaagcgggttaactttgagggcggtaagtccaatgttgttaaaccaagtaacaaatggcttcaactgtggcacatgaggaaccagaattgttactacactaaccaatccagcggttgtcaccggaaaaagctgtcccggaaaaatcaacaagccgaccaatatcagtagctcatacaaaaacaaccattgaactgaaacgctcagaaatccaccaaaaacaatcgaaacaacgactcctaaaatcaaaccactccgaacaaagtggcgcccctcataaaaatcttcatagattgcagaactaaaaagttgacgttctcttttaactcgatttctatgtactaaatacgttcgaatgacaccaacccataatgctggttgtaacagataaaaacaaagtgcgattaataatttcatagacatttccctcatccttgatcatacagctagtatatcatttattattcggcgaataaaagggcatcagaaacaagaatttcctaaaagtcgttaatttttggggaaatacttagctcaaatcatgattccggttataattatttgatgaatcagattatccaccccgctgttacagattaggctttgattgatactaccagttgaggtaattaagttggccaaatactaaacgattttgtcaaatagatagtttccagattgacttaattataatcagagtgtaaacaaaaaggctcgacaaaatgattcattgcccagccctttgactattttttgaaaatactattaatttacgcgtttaattaatgcatcacccacaaacaaatcattctggattcttctgacttaattgccattgcaagtaggcattaataaatggatccaaatcaccatccatgacaccattaacattagccgtttcataattggtccggtgatctttaaccatcgaatagggatgaaatacataagatctgatttgagatccccagccaatatctaattgttcaccctcaattttggccttttctgcttgtttcttttcctgctcacgttcatacagcttagacttcaacatattcatagctgtttgccggttttgcagttgtgaacgttgtgcctggctggcaactacgattccagtgggaatatgagtaattcgaactgccgaagaagttttgttaacatgttggccaccggcaccactggaccgatagacatcaacctttaactcgtcaggattaattttaattgaaacatcatcatttaattccggcatgacgtcaactgatgcaaacgatgtatgccgtcgtccagcggaatcaaacggcgagattcgtactaaccggtgaacgcctttttctgatctgagataaccataggcatcgttaccactaattaatatcgcaacactattaattccagcaacttcccccacttgataatctagcgtttgaactgtataaccatgcgactcagcccaccggctatacattcgcaacagcattgatccccagtcctgtgactcagttccaccggctcccggatgaatttcaaggatggcattattgtgatcatatttgccgttcaataacagccccaactggtaacgatctaattctttcttcagctcagctgattcagtcgtaaactcatcttgcatgcctgaatcaggatcttcagaaatcaattccaaagtcacctttaaatctgctaacttgtcagacaattctttgaaacgatctcgttttgtcttcaatgagttagtctcatcaattagtttttgagcgctttgctgatcatcccaaaaaccaggttctgccattttggcttcattcatcccaatactttcactcagggcatcgaagtcaaagcgacctcctaaaaccatcaatggctttttgcatttctgcaatctgttttttggcgtcacttaattcaaacgtcattataaatctctccctttcaaatcttgctgcaaattattgaagcatcagcactctaaatttaaagaaagaacccaaacaataaccaattgcccggattctttcaacaaataatttattaacgttgcatgttttgacgaatttctgctttcatgaatagacgggtagcgtcgtaatcaatatcagaaatcatttcttcaaacattttgtatccttcacgttgatattcaacaagtggattttgttgaccatagccacgcaatccaattgattgacgcaattgatccataatatcaatatggtcggtccaatgcgaatcgacaacccgaagaataacaaccttttcaaattcaagcatttgtgaggcatcatacagttgctcttgcttttctttataaaccttattagcaaagcccatcagcaattgcttaatctcatcagcagttttcccttggaaatcattcaacgaaacttcatctggactcaccattgcactaatcgcaaagtcaagaattgtttgaagatcccagtcctctttttcaccctgagtatgcaaatcaacaattcgacccactgtccgttcaatcattggcataatgacccacttcagcgacttggtttcattaataacctgttgtcgctctccataaataacttcacgttgttgacgcataacatcatcatattgaagaacgttttttcgagaatcatagttattaccttcaacccgtttttgagcagattcaacctgtttcgtaatcatcttggagcgaataacggcgtcttcaccttgaacattcatatgttccaaaaagttcttaattttttcagaaccaaatcgacgcatcaaatcatcctcaagtgataaataaaattgggaaagacctggatcaccctgacgacctgaacggccacgaagctgattatcaatccgtcgagactcatgacgttcagtaccaatgaccgctaagccaccaacttcaacgacaccagggcctaatttaatatcagttcctcgtccagccatgttggttgcaattgtaacggcacccttttgaccggcgttcataacaatttcggcttccttagcatgatttttggcatttaaaacaacatgtggaattttctcttcatccaaccgttttgataagtattccgaagtttcaacagcaacggtaccaattaacattggctgccccttcttgtgaagttccttaatcttacggataacggcatcaaattttgattccaaagttgggtacaaaacatctggttgatcaattcgaataacaggcttgttagttggtacgccaacaacttccatgttataaatctctcggaactcttcagcctcggtcttggcagttccagtcattccggcaagctttttatacatccggaacatgttctgataggtaattgttgccatggttttactttcttcttgaatctccacgccttctttagcctcaattgcttggtgaagaccatcggagaatcgacgtccctgcataattcgaccagtaaatgaatcaacaatcaatacctcgccgtcttgaaccacataatctttgtcacgaagcatgataaagttagcccgtaaggcttggtccaaatggtgagttaaagccgtattgtcagtatcataaaggttctttaaattaaagtacttttcagccttttcaattcccttatcagttaatgaaacggtcttagtttcaagatcaactttaaagtcgtccttttcatgtaaggtcttagcaaatcggtcagttcgttgatatagttcagatgttccggttgattgaccagaaataattaaaggtgttcgcgcttcatcaattaagatggagtcaacctcatcaacaatcgcaaaattcaatggtcgctgaaccatttcttctttgtaagcgaccatgttatcacgcaaataatcaaacccaatctcactgttagtagaataagtgatatcggctgcataagcctttcttttttcatctggacccatctcagcaaggttagcgccaaccgttaacccaagccaattataaagctcacccatttcggtagcatcacgttgcgataggtactcgttaaccgtaacaacgtggacgccttcgcctgcaagtgcattcaagtaaaccggcatcgttgcagttaaggtttttccttcaccagtcttcatttcagcaatattgccttcatgaagcacaataccacccatgatttgaacgtggaatggatataagcctaaaacccgccgtgcaccttcacgagcaactgcaaaagcttctggaagtaagtcatctaaagtttcacctttttgataacgttccttaaattccggtgttttggcttgtagttgttcatcactgagttgacgatactcttcagcataagcgccaacccgatcagcaattttgcttaatcgcttttgctcacgcttatcactttcaacccatttctttaaaagattagtagccattagtagattcccttctaaaataaaacttctttttcaatttcttaattaaatttgtgaattgcatacccattaattgtaacatcttaggttgctattgaaaacaaaaacataactggtacagcattcaattatcatagaccattttcactgaagagaaaagcctgaaatctctaaaaaaacaattttcataaaaaaataataatcttgttaccgttaatttttgatggatgaagatatcttacaaagtggtcgaaacgatgatgaaccacaaaacataaatagtgtgatttgagctctgaatcatagttcgcgccacccaaacaaaccttttcttcactttacttttttcatcaatagccgtcaccatgatagcaaaaaaggctggacaaatagttgtcacagcctttttttaaaataataattaagtctcactacattaggctaattaatggttaacctgatgcataaacctagtcttccccggtttcgatcaaaccatagcgaccatcatttcgacggtagacaatatcaatgtttgatgtatcggcatcttcatagatgaagaaatcgtgtccaagcatatccatttgaagaattgcttcttcgttgtccattggcttcaatgccaatcgtttagttcgaacaacatcaaattgagactggttatcatcgtcagaatcatcagatgttgttggcgcctcatttggaacaaattccaagttcttaaagcccttttcacgagacttacggttcactttggtcttgtatttccgaatttgacgctcaagtttatccgttactaaatcgatacttgcatataagtcattggacatttcttcagcacgtaaagtcagatatggtaaaggaatagtgacctcaacttttgcttgcttatctggataaaccttcaagttgacatgagctgtattcttcaagtctttctcaaagtacttctccagcttgctgatccgtttttcagtataatcacgaatcgcttgagttacctcaatattttctccacgaatgttaaaaattagcataacgctctctcccttcaccattaacggtttaatggtccggcaatgaaagtgatttcattactggctacaactttagtataattgaaagttcgctttttaacaatcattgtctctggaattatttatctggcaagggtcaatccttttactgatgcggcttttgcttgatataataacctggctgcgtgtcggatcgtcgcgccagtagtatagacatcgtcaaccagcaaaacatcacggccaacaacggttttggctaaactaggaatcaacttaaacggttgaattagttgaagacgctctattcgattcttttcagattggcggtaatctttttgttcctgtttaacagctaacacattatcaacctttaaattagaaatcaatccgagcacctggttgaaccccctggtttgcatggtactctgactaacaggaatcgggacaatcaaacggtgggtagctttaagttcatcctgaatctgacgggtgaaaacacgcctaagtcgatagtcgccaagaaacttataacgtttcatatagtttttcattgcgtcattgtattcatacaatgacgaattaacaaattccagctgagctcgattatgccatttcaaacaatcatgacatgggctacccatatttgttaacaatcgacgaccacaaattcggcaggttgcaaccgtttttaggtctagaaatgtagcagcgcatttccggcaaattattgtccggatatacttgctgaacgaaaaaattttctcaaatgacacaatgtcgttaagttgattatgacataataaacatcttttcataattgacgagcccgctggttcatccgcttaatttgtcgatcacaagatttaatatttgctgttcgagtttcgcaataaaataagacccgccctttcggccgatcactatttcgaccaactcgcccggcaatttggaccagcgctgcagccgaaaatatctcatcatccgcttttaaaacaatcacatcaattcctggaaaagtaacgccacgttcaagaatcgttgttgtaattaagaaatccagctgccggtggcgcatcttggcaactttttcaattcgatcaggatccgctgaaaaaacagtttcgtatttggcaacaattccagcacatttaattgctatcctgacaagtttaagatcaataattcgaggaacaaacaacaaaaatcgctgcttttcgttgattagtttaaaaattgtcttgcttattttgggtggcaactgtccttgcctaatagcttgatctaaccgccgggttttaatgatcgttatctcaggtaaaagatgaccatgataacgaataggcaaatagctaattgataaagtctttctttgaacctgattaagcagttgccgatctggcgttgctgttagaaagagcatagcgccgtttctcttaattgcattttgaacggcaaagtgcagcattggattcccggaaaatggaaaaacatccacttcatcaatcactaggacatcaaaggcatgataaaaacgaagcagctggtgcgttgtacaaattgtgatttgacaatatttgtaagattgcgtacttttcccatgcaataaaacgatcgatgtttgatcaaacgctgcttgaattcgaggaaacagctcaatgcacacatccacccttggagaagcaattccgatccttaatccgtgtgaaagggcgtaagcaatgcctttaaacagcatttccgtcttccctgccccagtaacagcccataataagtgccgttgccgctttttgaatatctcaacaacctgagtcgcacacttttcttgtagattcgtcaatttcccctgccaagacaagggctgttcgttaggcggaaataaattgggctccggcaatgttactaacggattaagtgtatccatccgctgcatctgaatacaaacataacaataaaaatgtttgttcggtaattgtgcatccctggtttttaattttgaaccacaacgattacaggacagccggccggttttattgattgctgggcggatcgaaatgttgggtaattgctttaattccggtgaaagttctgataaactaatttggcgtccgtacaactctgaactatcattgatcatagatgatcacctcaatatttaattacgaaattattggaggttttttattggaaaatttaacattaacaattaaagctaatggtgcccacgaaattgacatcaagaaatcacgattcatttgtacacttgccagaatcaaagatgaagctcaggctaaatcaatcatccagcaagttactaaacaaaatgagaaggccaaccacaactgctatgcatacgttttaggaactgccgaccagattcaacgtgaaagcgataatggtgaaccatcgggaaccgccggcatcccaattcttgaagtactaaaaatgaatgaactgcataatgttttggccgttgttaccagatattttgggggcattaaacttggtgccggcggccttatccgagcttatagcaatgccacttcaacaacgattgatgctgttggaatcgtcaatttggtaacaaaaaaagaaattaaattgacaattgattacaatcagcttgacaagctaaaatattttttggataccaacaccattccgatcgaatcaaccgattatactgacaaagttaaattaatcgttccaatcgaagaaacacagctggctcattttgttcaacagctcaaagacctcttaagtgatcaatttgcatacgttgagggtgaaaataaaatttttgaggttccttactctcgggctgccagacaacgaaaagaaaaaactgaaaaaggttaaagtgtttctcaaacacaagttgctttcatactcagaatggatgaatacgtcaaccagtatggacgtgaacacgctttataatcatattaacttgatttcttcaaaacgttcaatgaatcatcataagaggttcggccaaccattaaagtgccgagccttttttgtcgtctttaagattggtaccgagtaaaaacaccaaattggcactaataataaattgtttaacaatgataagcaaaaattaatccagcctttaataatcctatctattaatggtacaataaggttatataaaaagcgcttacacattgtttttacctccaaaatacataaataggtttaacattaacgatcaaaaatttttaattctagaaaggatcccagaatatgaacacgccatttacaaaaacactattattgttctgtggagaaatgtttgaaatgttattaataaccggtggcctaattatattgggaaccaagagtgtcagtattaactccctgatttttttgttattaatgcttgttatattaacctgccaatttattcacgctcaacgaaagcgtcagaaacattagttttccttaacaagctaaattgatctcatgatgcagaatactggtgacaaaaataggaatccacgaccaaatttggttgaccgtggattcctattttagcaatcataattaacgatgacctcaacacacttgccagcagtaatcacctatcatctcacatttttaccagttaacattcatgcgtgtccaaactaaacaaaggcgctgggtcaattgattattgtcccgaattctaaaaagagctggtcttaaaaaagcacgttctgcatgaactcgtttctaagatcaactctttataattttaaatcaagtataagcctgtcaatatgtacatgatgtgaaagtcttcgcacaacaccctatccatgccttaacataaacttcttttggctttagtgattactcttactagttgtatctttaactaatcgcttaatcccgtttaacagcggttgtcgatcttcaccaaccaaaccaatcgtttcgacaaacagctctaatccaaacaaaaccgcaatggtaagcaagattgatccccacaacgaagaaattggataaagcagtgaaatgaacgaaaagatcaatgcaatcccataaataaccagaacggtctgtcgatgcgtcaaaccaatctgcatgagtcgatggtgtaaatgccgtttgtccgcatgagtgattggttctttgttaagtaaccgacgaaaaatcgcaaataccgtatcagtaattggtactcctaggatcataaccgggattaataaggtaatgaaagttgcattttttaatccgaataaggagaaaaccgaaatcataaaaccaataaaaagggccccggtatctcctagataaattctggcaggaaaaaagttatacggcaaaaaaccaatgcaagcggcaaccaatgaaaaaatcatgattgaaacaaaaatatttccaatattcaaaaagaacataccagtaattcccattgtcgttaaagcaataatggcaactccggtagctaaaccatccaagccatcgattagatttaccgcattggtaatggctaagatccaaatccaagttatcggaaggctcgcccatcccaaatgaagcgtaaagaacggtaacgtgattgttgtcatcttcacaccagccgcaaaataaacccacaatgcagcaattgaaattcctaacactttttgcctaggttttagttcaaaaatatcgtcaatgattcccgttaaaatgataattgcttcaccgccaaatatcccccacaacaccttggttggaaactgattcctcagtaataccattgttgtaaatgtgtaggcaataaaaacagccaacccaccaatcgttggcatcggaatcttattgactcttcgtttgttgggacgatcttcagctccaactagaaaagcgagttttcggataaatggggtcaagactgcagaaataatcatggtagcaaataaagacacaatgatctcaaatttcaaatttagtaacctcacttaattcctcacatttgtttattacatcaattatacaaacgacaaaacataaaaacaagccaaggtttattatctgataaacacaacctatttcaaaagatgtccggaccaattgttgttctgttcacaagccagaaaaatttgtaagccttttaattgtgttattgtcaaaaagcacttatactttgagcaagtaaggtaatagcaatcatttgtatttaaaattttcttgaaaggggatcttcataatggctgacaaattaaaaaattcacaagatgttaaacctgaaactaaagaaaccaaagacgcccccattttgattcaaatgggaattttcgcaggtattttattcgtttccagcattatttcaccaatgttcccagcaagctttccagttccaacacccgttatcggcttggtcttactctatcttttattaaccgtccatgtcataaaaattgaatgggttgaaaagtttgccaacttcctaattgggtttattgcattcctatttgtgccatccggcattcaattaacagcttcacttgatattatgcgtgcacaaggcgttcagctggtggctacaattgttatttcaactgttatcttacttgttgtaatcgcttacacagcttcgttctttatctgggtaaaaaagacagtctttaaacgtgatgtttcggttcaagaataagaaaggtaagaaggtgaatcaaccatgacagcaactcaaacaatgattatcacgtatttaggaacacccatttttggtatttgtttgtcacttgccgttttcctgcttggacaatggctgtttaaaatcagtaagggatttttcctcttccaacctttgttcgttggaatggtcttaggaatttttgttctttggctcatggcaagagcttttggggtcgatacaacttggttctatacaaacgcatataaacccggtggtgacgttattttttggttcttaaacccagccaccattgcatttgcagtcccattgtacaaacgaaatgacattgttaaacgattttggttagaaatcttactatctctaattattggccttttcatttcactattcttgatttacttcgttgccaagactattggaatggataacaatggaattgcttctatgttacctcaagccgcaacaactgcgattgcaatgccaatctctggtgcaatcggcggaacaccagcaattaccgcgatggcatgtatcttgaacgccgtcctgatttacgctttagcaacttggcttattaagatcttccacttgaccgaacctgttggtcaaggactgggattaggaactgccggccatactgttggctctgccaaagcgattcaattaagttcagccgccggagcaatggcagcgattgccgttgttattatctcaattgtcgttgatctagttgtcccaacattcgcacatatgatgggtcttattcattaagatcataattattaatgattaaaaacaaaataaacaaaaaggcgtttagtttcccgactgtatggacggagaactaaacgtctttcttgtttcacattttttaaaagtaattgtttgattaaaaagtaagaaattggccaaataatttttgcatttttggataacaaccattaatgaacaaccctaaaaaaacttttgaaccataatcatttcttggccatccaatataatcaactactcacgcaaatgataattatacgttgaaataataatattctgacgagaatttaagattgtccgtaaccttaaactcgtctggttatgcaaaatgttttcccaacgatgttttggaacaaactgtggtaccaaaacagtcgttgaataattccggtcagcagcccgtttagcaataacgtcacagaaacgcaatgttggttgggcaatcgaacgatatgaagagtgaatatcaacaaaccggacatttggaaattgccgcttaaactgttctgaagtcttatgttctttttctggatttgaatcaaaggaaacgtgcatggcaatcacataatcaccaattgattcagcataactaatcgcattagcagtaaccctagtaacaccgctaaccaatacgatgaccgttgaaccgtcaaaatgatgagtcgtcgtaatttcagtatcttcctcgaccactcgtaattgttccgctactcgtttgtagtgtcgattgattttataaaaaatcttaattaaaatcggcatcacaatcagatatggccagacatttgggaaacggagcaggaacaaacaggttaccagtgcaagcgaaataaatgccccaataaagttaataactgacttaatttgccagttctttccacggtgacgataccaatgaataatcatgccggattgagatagtgtaaacggaataaaaaccccaaccgcatacaacggaattaaggaattggttcggccgccaaaaatttggattaagacaatggcaccaactgccaatgaaatgatgccatttgaatatcctaatcgatcacccttatcaagataagcgtgaggtaagaatttatccttcgctaaattataagctaaaattgggaacgcagaaaaaccagtattcgcagcaacagccaaaatcatggcagttgataattgaagcaagtaataaataatgccatgaccaaacacggcaacgccaatttgtgaaagaaccgtttcatgattattaggaataattcctaaataataactgagatacgtgatcccaccaaagaaacaagctaaaattgtcgccataattgccaatgtagcggaagcattgtggctctttggctttttaaaattaggcacagcattactgatcgcttcaacaccagttaatgaagaagaccctgatgagaaagctcggaagaacagaaccaacgtcatccccgcaaccggtgtcccaatatgcgctgccgcgtggtattcaatattgccattcataatattatagccaccgtaaatcaccatggctaaaataacaacaataaacaaataaaccggcaaagtcagaaatgaagcggattcacggatcccccgcagatttaacaacataattgccacaacgattaaacatgaaagtaagacacgatgattatacagtgacggaattgccgaggtaattgcttcagttgcagacgttgtcgatacggcaaccgtcagcatgtaatcaaccaacagagagccaccagctatcaagccggcgcgctcaccccagttggtgctcgcaacaacgtaagcaccgcctccagatggatatgcatgaataatttgttgatacgataatgtgattgcggccaagagaatcaaaacaagtgcagctacccaaatttgatacatcaaggcagcggctgataatgtgattaaaatggtcgtaatttgttcagtaccataagccactgacgataaagcatcggaagatagcaatgccaaggctttgaacttggttagggcctgaccgccctcatcagtggtttttaacggcttcccaattaaaaaccgttttaaatatcgccacataaatagtttctccttttattaaaatctaccattcatattgaaccctaaaatgatagtcctaaatacgtgtaaaaacaagtatgtaatgctagctgaatactaataccatacaatacaaaccaggcagcggcaaccctagctgcttttagtcattcagtcagctttttgaaattgcttaatttcccaaattcgccacaaataaccaaataaaaaagaacctcactaaatgttaaatttaatgagattccctttcgatttaaagatcagtcattacatgcccattccaggttgtggtgccattggagcagctggtgcatctttcttaggttcatcagcaacaacagcttcagtggttaacaacaaggctgagacagaggcagcgttttgaagcgcagaacgggtaactttggtaggatcaacaataccatcatcaatcatatcttcaaatttaccgttagcagcattgtaaccaatgccagacttttcatccttcaacttttcaacgatgactgaaccgtcaacaccggcattttcagcaatttgtcgaacaggttcttcaagagctcgacgaacaatgttgattccagttccttcatcaccctcggcgtctaacttggcaatctcactaataacattaatgagtgctgttccaccaccgggaacaaaaccttcttcaacggcagctctagtggcattcaaagcatcttcaatgcgatacttcttttcttttaattcggtttcagtggcagcaccaacccgaacaactgcaacaccgcctgataacttggcaagacgttccttcaacttatcacggtcaaagtctgaagttgttttttcgatttgggtcttaatttcatcaactcgtttgctgatcgcatcttttgcaccagatccgtcaacaattgtagtagaatctttagtaacgttaatcttgttagcttgtcctaattgatcaagagtagcgtcctttaagtttaagccaaggtcatcggtaatgaccgttgctccagttaaaatagcgatatcttgaagttgatccttacgacgatcaccaaaaccaggtgctttaacagcaacaacgttaaaggtaccacgcatcttgttcaatacaagggttggtaatgcttcaccaccaatatcatcggcaatgatcaaaagtgaacggccttgttcaacaatcttttgaagtaatggcaagatatcttgaatatttgtaattttcttgtcagttaccaaaatgtacggattgtcaagatcagcttccattttatcgttatcagtgaccatatattgtgacatgtagccacgatcaaattgcataccttccacaacatccaagctggtttcaacaccacgagattcctcaatggtgataacaccatcatggccaaccttttccatagcgtcggcaattaatttaccaacttcaggattagctgatgaaattgatgcaatctgtgcaatatcatctttggttttaacatcatgtgacatcttgtgaagtgcatcaacagcagttttagttgcttgttcgattccacgacgaatgccaactggattagcaccggcagtgacgttcttcatgccttcattaacaattgcctgtgttaagacagtagcagttgtggtaccatcaccggcaacatcattagtctttgaagcaacttcagaaactaatttagcacccatattttcaaaatgatctggtaattcaattgccttggcgattgtaacaccatcatttgtgattgttgggttaccagccgtttgttccaaaacaacatttcgacctttagggccaagtgttgctttaaccgtatctgctaatttatcaacgccctttagcattgcgctacgagcatcttcagaaaactttacttgtttagccattccaattttcacctcaaaaatttatttttgattgaacatttaaattgttgaactttttgattttataatgaattcacatcgttaaccgaattcattcagccagctcatttaagagctaaaatctttttcgtcttaattattcaacgattgcgacgatatctttttcatgtaaaacgagataggaattatcgttgtcttctacttcagtacctgcgtatttatcgaacatcactttgtcaccctttttaacaacgggcgcaactttttgaccattgtccaatgtccggccgtcaccgactgaaacaacagtccctgtctgtggcttcttcttagcattatcagctaaaacgatgccgccaacagtcttttcttcttccttttgtgtttcgacaattacgcgatctcctaatggttttaacacgttaagtccctccatttacaacaattttttagcatcattagcactcttatgttaaaagtgctaatcactgtttataatatattattttttgacgtgaattgcaagtattttttgccaatcgtaaaaagagtaaaccaactcatgctttcaaaacgaggctatggtgttctttaacaacttttgttaaaaatcatcttcaagactatctacttcaaattacctggacttctcaacgctaaagttaaccgataattcaaaataactaaccccatataagtatcaagttacaagcggcttccagccatataatgaccttagctcgattcttttagaaccaaacgaaattatgactgtaattaccattgagctaaaatgtgaatccaaaagcagcttccggattcactctaaaaaaagcgccttggaatttcttccaaagcgtttattacgattgtgcttcccctaaaaattatttactgaaattatcgatgaaatagattaatgtttgaagttcgttagtcagatcaacgttttgtaccagcacatcctcggggacattaattcgaattggcgtaaaattcataatcccctttactcccccagcaacagcttgttcggcaaccgcttgggcggctttagacggtactgtcaaaataacgacttgaatctgctgttcatggagttgatgctcaagttctccaattggataaaccggaaccccatcttcgattgtattgacaatatcctgattactatcgaaagctgctgaaattctgacattactatccttatgaaaattaaaattcaataaggcatgtcccaaatttccaaccccaataagtgcaacattggtcaaatgttcctgattcaatatttgcttaaaaaatgatagtaagttatcaacgtcatagccatatccacgtttaccaagcgcaccaaaatacgaaaagtcacgccgaattgtagctgagtcaacttgaacggcttcagctaattccgttgatgaaattcgctgcttgccagtgtcatgtaaaatgtttaaatatcgataatatatcggcaatcgtttcgcggttgcgcgtggaatattttcagatgtcaagaaaatttcctcctatttcaaaattgttgtaaccgagtactttgtgaatccctctttgttcattattctaccatatcggagcagtttgtgaaacatgtttcaaataattacacgaataatttaagggtttcattaatttatgataaaattgaatagactatagaaaggtggccagatcattgataatcttacaagcccaagacttaaccaaacgatttaacggtgaaaatattttttcaaaagtcagcctggctatccaagaaaaaagccggattgcattggtcggtagaaatggtgccggaaaatcgactttggtcaaaatgatcatcggcgatcaatccatcgacagcggcaacgttgtgactaaaaagaatttaacaattggctatttagctcaggataccggtttaaactccgaaaagagtatttacgctgaaatggagtccgtgtttgccaacctaaaaaaacaggaaacaaagttgcaccagttggaagcacaaattagttctcccagaatggacaccaactcagaagagtttaaagaaatctcaaagcaatatgataatattcgggctgatttcgaacaacacaatgggtatggctacgatgccgaaattcgtggcgtccttcatggttttggctttgatcaggctgactatgaccggccaatcaacgaactttcaggcggccaaaagacccagttggcattggctaaactactgctggaaaaaccagaactgcttattttagatgaaccaactaatcatctggacgttgaaaccatcacttggcttgagggctacgttcaaaattacagcggtgcccttttaatcatttctcatgatcgttacttccttgatcgaattgtcaatgaggtgtacgaactgtcgaatggtactttaaatcactacactggaaattacactgattatacgcaaaagaaagagcaagaagtcgccctgcaatggaaagcctacgaaaaacaacaatcccaaattgataagttgcaaactttcgttgacaaaaatattgttcgagcgtcaacgaccaaacaggcacaagctcgtcgaaaacagctcgaaaaaatggatcgaattgaaaaacccattggtgattcaaagacagctcggtttgcatttacaccaacttccaaaagtggtaataatgttttaaacgtaaataacgctgctgttggctatgcaaccatcctagctgagccaattaaccttgacatcaaacgtcatcaagcaattgctattgttggaccaaacggcgttggaaaatccactcttttaaagagcatcttaggaatcattccctttattaaaggaaccgtccaattcggaactggcgttgatacgggctattatgatcaggaacaagccactttacaccctgccaagactgtcttaagtgaattatgggatgatcaccctactacccctgaaggcgatattagaagcattttagggagctttttgttttccggtgacgatgtggctaaaatggttcatgacttatcaggtggtgaaaaagcgcgattacttctgacaaaattggcaatgcagcacaacaactttttgatcctggatgaaccaaccaatcacttggatatcgatagtcgtgaagttttggaaaaagctttaaatgattttgatggcactatcttgtttgtttctcatgaccgttacttcattaacaaagtagcaacttcagttgttgagttgtcaaaatcgggaacaacactataccttggaaattacgattactatgtagataaaaaagctgaacaaattgcaatcaaagaacatgaacaggctaaacgtgaagctgcccatccagaaatccaaccagtaacaccgacgaccgatgacaaaaaaaattatgaaaccaacaagcaagcacaaaagcaacaccggaaattggccagagaagtcagcaacttagaaaaccagttagatcaattaactaaatccaaagacgatgttgaaaaagaaatgactaagcccgatgtctttaacgatttagaaaaactgactcatctacaagatcagttaaacgatttaaatcgtcagatcaaccagactgaagctgattgggaagaaaaaagtattgaattagaagactttgaataactctaatgcccaacttatttatcctgtacacttcaagatacacaataaaatgggattagaatcaaacatagccttagtttcatctgactctcctaatttcgtgtgttagcttaagtaatgcgtttattcaccggattttaaaaaatcaacctcgtactcctgaaaggaatacgaggttgatttttttacgattaaacactagtgatttcatgcttggccttaatccattcaaattctaatcccggattggcatttaacgttgcatcgccgcgaatgccatggcgatataacatttcaccggcagcgccaaccattgcggcattatcaccacataatgctaacggaactaattccagcgatgtattcttaaacttttccaattcatccgttaagcgtgcacgcaaccctttattggcagccacacccccgccaagaattaattgcttgactggataatcatgcaacgcgcgaatagttttgtcggctaaaacatcgatcacagcttgttgaaaactagctgccaaatcattcttatttaaggtttcgtgaacttgatcagcgtgatgaaccgtattgataaacgcactcttgaggccactaaaactaaaatcaaaattatcgtcatggtccattgcccgtggaaaatgaaaggtgtccttaccacggtgagccatttcgtcaacagtctttccagcgggatagttaatgcctaaaactcggccgatcttatcataagcttcaccagcggcgtcatccctggtttccccaatgatctcaaatttaccttcttcaggcatataaaccagctcagtgtgtcccccagaaacaactaacgccattgccggaaattcaatcggttctacaagacgagccccataaatatgccctgccaaatggtttaccggcacaagtggtagatgatgggcccaggcaacaaccttggcagcagtcacgccaattaacaatgcccctaccaaccccggcccataagtaacagcgacagaagttaagtcgtcatacgatacgttggcttcagacagtgcatcctcaatacagccggtaatctgttcgatgtggtgacgactagccacctcagggacaacgccaccaaacctttgatggcttttaatttgcgtggcaacaatattggagaggattttttccccgttttcaatgactgcaacactggtttcatcacagctggtttcaaaagataatactaaatcgcgtgccaataatttcaccgttccttttttatcaaccaatcttggttatatccatcatcatattcagggcatcttcacgatcgttaaaataataatccttcttaacgccgttatcaacaaacccaatgtcacgatatagtttttgagctcgggtattactgactcgaacctccaacgtgaccttgttatattgcatttgacgagcttttttaataattgtcgtcaccaaaaaataacccaagccgtgattttgaaaattgggtgcgaccgcaacattggtaatatgacaatcttttgtgtgatcattaagggagcagccaatgaaggcgactaaccaatcatttcgacgcaaaaccagatagagtcggtcattttttcgcattagttcacttcgaaatgctcggtcatcccacggtgtttgaccgccataaacggctcgttcaatccctaaaatctctgggatatccgggatcatcgctttagctaaaaaatattgcgtcccgttgatttcaacatcgtgatttttgatatccaaataccgttgtcgtaactgtgcttcccgattataaaaattttgattaaaccaatttttaaattttctccacataatcatgcgtatcctcatttggatgaagcttcttccagtcagcttccgctttggttaaacgtaaataccgcggtacaaccgcatctacgttggtaacggcttttaatgccataccatattcaccaagtaaagccgcatttggaatgcctgcaagttggtcagcgataatgagttgatcaccaagagctgccttcatatcatccttaaaggaatccgtgtcccccaagattagaattttttgatcatattttttgatgagattaagccagtcagtcaaattaatatgctggtcgtcaatgatcgtctcaggcctaccattcttatttcgataaagacctgtaaacatattctgattacgaccatcaaaaatcgggttaattaatacatccggttgctgaatatttagcgctagagtcaatagacttgacaccatcaccaattcaataccaagtgtctgcgcaatggttttggcagctgtaacggccatccgaatacccgtatatgagcccgggccacaagccacaaccactcgttgtaaatcttccggagttaaatccgatttctttaccaggtcctcaataaccggcattaaaaattcagcgtgttttcgatgagtggtcaatgttgtctgcgctaataaatggctatcatccatgacagcgaccgataatggtcgatttgaagtatcaattgctaaaattttcattgtaattagtttccgttcctcttcttccaaataaatgttgcacttgcagaaaggacatcatttgaagtaatttcatgaactgttttaatcttatcattatcttcagaaccgacaaccaccgaacttgttacccaattaccatattttacttcattttcaaagcgaatatcaattcgagttggcatatggtgaattaaaaagtccaaaggcagcgcatccattacccattccaaatagtgcgcattattaacatgaccgttaaaatcaatatcacttccacgaacctgatactttttggaagccgttgggatttggtcagcaatcttctccggtctcgataattttggcagtctcctgactttctcggaatgatatggtgtaataatatcttctggaatatcagtaattttgcgcgcggcttcgtccattaacacccaaatactatctacctttactaattcgtttccctgctcatcatgtaaccaaaattcacgataagcaaaaaagcgattataaaaagttccacgagttgtcattcggacggtcatccctgtcttaggaagtcggttaattttaaaagaatacgaagttacaacccagccaagaccgtactgctgaataatggattcctgatcaacacccaacgcctcgttttgatgatcagatgcaagaattaaaatattaatcaacattgcaatcgtaatgtgattggttaaatcactttcataaaacggaatcgtatgatattcgctaaatgctttggcggtcattggcaagacttctttctttacttattaatgttatgaaattcattataaacaatctgttttcgaagatggtgatgcttggcaacccttttgatagcatcgttagtattaagaccactctcaacataaaaattaacttgttgatctatcgtcaaatttttaagcgggtcaacttggtgattagtcggatgatcattgccagcaacaataatcacaaattctccccgaatttcagttgtattggcccagtcagtcaatgtgtccagatcaccgcgaataaactcctcatgtttcttggtcaactcgcgacaaaaagcagctttccgtgagcccccaaattgagccaccaatcctttaagggtttttttaagacgatggggagcttcataaaaaataattgtttcctgccgattaactaatttcttaagctcatccttttgttcattaggcttacgtgataaaaagccgtaaaaataaaacggttgaggagccaaaccagaagcgatcagtgcggtaataccagcattagcaccaggtaatggaacaacattaacgccttctttaatgcacgcaaccactaactcatgtccgggatcactaattgaaggcatgccggcatcactgacttgagcaatggtcgttccctctttcaattttgcaagcagctccggaatcctttgaaccgtattatgttcgtgaaagctaatttgcttggtctcaatttcaaaatgattgagtaacttttgcgtgtttcgggtatcttccgcggcaattaagtcagcatccttcaaaacattgactgctcgaaaggtcatatcatccaagttaccaatgggggtgggcacaagatataaggtgccatatttactttttgtgtcaaaacttttttgagtttccaacaaatctgatctcctaatctcgacggccatagatgatatcggtacaaaaaatacaatcctcaccattttcacgtcgtttcccatagtaagaactgcagacatgaaagccttcattgtataacttttcaagattctttcgtgacttcgaaagtcttggtgaattgctatcagtcttttcggtaatttgattaattcgatcccgtaagtgctgattttcaatttccaactcagcatttttttccattaattcaattaatgactcgtgtaaatgagagaacttggcggcagtttcggttagatgagtatccatttcttttaattcatcatacaaattcggactttccactttatttatcacctttcaaatcaactctatgacttagccattgtgagaatctttaacgttgcagcctcaacaatgttctgaaagtttacattcgccatcatgctatggttcatatctaacaactcatctaacatactcaatagttgcttatctgtccattcattagccgcctgacgcgtctgatcaataacagcaggatacttaatcttatcttgactcaaagtatcgtatttcacttcaaggacatcattaaacgcgctaatcatcattgaaataataatccgttggcgttctttgctggttattaaaggcatcaaagccatttgaatataaggcattgccatcagattttctttaacgagataaacaaaccacttttcaacgacttcttgcacagatgcaaaccagttatcttttactaatccctcaatctcactcaaactatttgtcatcgagatcaataaattgatttggctgggcagaacgccaccttttttaagttcacctatcattaaatctttgcttaagctagggaattcaacaacctgggtgcgagaaatgatcgtgggcagaactaaattgcgattcttactgattaggaaactaacaacatttccagtcggttcctcaataaactttaaaaggctgtttgcggctccggtcgtcattttatcggcgtctgaaataataaaaacttttttagagccctccatcgcacttttcgtaaactcacttttaacatgccggatttgatcaaccttgatgctttgaccatcgggttccgtaatgacaacatctggatgatcatgattcataattcgctgacattcgggacactgcccacatgggtaaccatcctcggtgacatttgtgcaaaaaagccgcatggcgactcccattgcgactgcaaattgaccggcgccctcttctcccgtaaagagataggcgtgagacaattcatttttggtcactaaccccataaattgtttaaaaagcgccggttgttttactcttgcagttttagcaatttcttctgccataaatgttcctctctaaaactgatggaattgttcaatcggtaagatcatcacggttgcaccacctacctgaacttcaattggaaaagtatgttcggccgtatctccattcaaactgacaggtggtgtcataaattgttggcgagctgaacaggtttccttaatcaactccagtgttaaatcgactttgtcatcatcaaccgcaaccagataggttgtattaccggaccgtaagaaactacccgttgttgaaaaacgggtcgcaataatatcatgggcaacaaacacggaccgcaacttgttagcatctttatcttgaacgattgcaattactaatttcatagctaactctccttaaaataatcgctggcaattcgatgaataatcttgatggtctcagaaaccacttgatcaaatgactgagtcgcatcaattgaaatgtatcgatcttgatagtgttctctaactttcatgtatccttgatgaacccgtttatggaactgaattgtctcaacatccaaacgatcaattttactacgatcccgatgttcagcaattcggtttaacccaacttcaacaggaatatcaaaataaattgtcttgaatggcatcagattctcggtggcaaattcattcatccgagcaacttgctgcatcccgatttgccggccagacccctgataagcaacagaggaatcgacatagcgatcgcaaagcaccaacttatttgcttccaaggctgggatgatggtttcaactaagtgttgtcttcgcgcagcagcatagagtaacgcttcagttcgataatccatttcggtgttatcccgatctaaaatcacacgccgaatctgttctgaaattttgttgccgcctggttcccgggttacaagtagctgatcaccaatctcttgacgaaattgctcaactactttattcataaccgtcgttttaccggctccatctggaccttcaaaagttataaacttgccattcaacagagattccctcacttttacatttaaattaattgtactgtatgttttttggactgtccataattccaaaagaaaagagtgatcaacaaacatggttacacattgtgactgacggttcagcaaaaattagtgtcataaattgtagcctgattaatcactcattatgcacaaatccagtcaattacaaaccagttagtctgttcatttttatcgtttgcccacgataaaaccgattagccagattatctattcaaacttatcatgatcgtagctaataacagatggttgaatttgattgttcttgatctgacgaattcgcgcttccttatatatgaagaaatatttttgccttgccaaggccgtttcctgagcaatttccagatcactgtcggcaacagcatcttgggtttgggcggcatggtcccactcttcttttaaatggttaattaaatcaagtagtcgttcatcatattctgatttaatattgtgtcgtttatatctgctaaaaagcatgataaataaatcccctttatcaaatttcagttcgcccttgaaccgctttataaagtgtcatttcgtcggcgtattcaatatcagcccccactgaaagaccatgagccagtcgagtcactttaattccagcgggcttaatcagcttactcaaatacatggctgttgcttccccctcgggtgttgcattagtggcaacgatgacttctttaacttgactattgctttgcaaccgcttgatcaacgacgtgatattaaggtcttcaggtcctttgccttcaattggcgacaaaacaccatgcaggacgtgatataagccatggtattcctgaaccttttccatgaccataacatctttcggttgctcgaccaccaagatggttgtttgatcccgagttttatcccggcaaatctcacacggatcctcatcagttaaattaccacaaattgaacagtaatgcagatcatttttagtcgcaacaagcgctttggaaaaggcttttacatcatcctcattcatgtcaacggtgtaaaatgccagccgagttgctgtcttactgccaattccaggcaatttcatgtaactatcaattaattttgcaattggttccggatattgcataattatcctttctaaactaacaaaagctaaaagcgcctaactacattcccggaatgcctttagtgtatttgccaagtgtgctctgagttgccttttcaacctttgccaatccatcattaacggcagccaataccaaatctgacaacatttccggatcatctggatcaatggcctcaggtttaatttgaatatcggtcatcttgcgatcgccattaaacttaacagtgaccatatcgtcaggcgcgttaccggtaaattcctgttgtttcaaattttcctgttcctcaccaagttgcttttgcatcttcttcatttgtttcatcattttgttcatattcataccattcatcataattaaattcctccaaattagtcgttttttatatctaaaatatctttgccaaatagttcttcagctttttttacgattggcttagcttcaacttcgtcaaccgaatcaactttttttgttgcttcagccggttggctttgatcacccggcttactttttaattcatttttatgattttttaaatagtcacgacggatcccgggccattgattttcaggaataaagacaatttgtggcaccctatcaacaaggcggtcaagcccgttctccaaagcatcctttaaatccggatccccctgtgctttttgatacaagaatggatactgaaatgcaacaatcacgccatctccacttgcggctaccggcgctgaaacatgcatcaccgaccgttggggaaccgatagtgccgtcattaaatccggccaaatccctttgaagtgatctaattgtttgcgagttgctttacccaaaattgggtagatcttggctaattcaatgtgactatcggcaggcttggcctcaatcgacttgggcgttgtctcaccaacatctttagcagccggttggccaactggttgagtacttttaagcgcctgaacctcttgttgtaactgtgtgacggcctcggtcaattgcttaattttggccacatctgttgagttaactgaactgccagtcgttgctgcttgttgcggattgtcagtaaggtgagtaatcttaactgtcagcacttccaaataaacatccgggtgggcggtaaatctcagagaattagcaatttcatttaattcattaatcatttggtaaatactttgatcgctgatttctccactcagtttcttaaaatgatcatcaagaattcccagctccatttcctcaaccatttgtggatcctgttgatatagtaggacatcttgacaataactggttaaatcttcgacaaatcgacttgcatctttaccgccatctaaaattttttgaacggtgattaaagctgatttagtatctttgtcaacaatttgctgcatataagtcgtcaataattcattggtgacactgccggtaaccagcaacgcgttttcataagtgatctgatcatcaccatatgacattgcctggtccaaaatactcagagcatcacgcataccaccctcagcagctttagcgattatcttaagggccttatcatcgtattcaacgtgcttttggtcaagaatatatgccattcgatccaaaatatccttgggcttaatccgtttaaaatcaaatttttgtgttcgggatattatagttgccggaattttatgtggttcggtagttgccagaataaagataacattagctggtggttcttccaaggtttttaacaaagcattaaacgcaccggttgacagcatatgaacttcatcgatgatataaactttatagtctgcttgagtaggcgcatacttgactttatcacgaatatcacgaatctcttcgacaccattattagaagcggcatcaatttcaatcacgtcatttaaacgaccttcattaatcgctttacaagtctcacattgattacatggctcaccatcttttaaataatgacagttaaccgccttggcaaatatttttgctgcggaagtcttgccagttccccgggggccggtaaacaaataagcatggctaatttgtttagtaattagggcattttttaatgtgcgcgtaataatcgactgaccaacaatctcgtcaaagcgttggggccgccatacccgatataatgcttgataactcattactaaaccctccagaatatgtttaaacgtttcttaaaccagttgtgaaagtcgtcttgaaaacagtagtacgtcatataacctgatttgcaggttacctaatcaattcacaacgaaaaaagaccaaaagaacatctaaataattatatgatgaattgactcagattgccaccttagcgacacaacagaaagaattttattaatgccgagttgaaattctaatttgcataatgaacatttacgttgcgttaatcatggcaagcctgccactcatccgcctatctttttggaaataaaaaatctcccagcaaaatctgctgggagtctaatttccataaacaagaggcacagtgtcgatgatacttagtgctgcttccttccggacctgacacagttcgtaacccgacccttgcctcagggccttgcggcaatatccatgataccgtactttccagaaaaatgctagtgactttttctttttttctttctggcagccttaaagaaatctttcatgatctgagaacactgatcagcaagaatgccttcagaaaccgtcacttggtgattcaagcgtgagtcttccaaaacctggtaaaggcttcgaacagcaccagccttttcatctcgggaaccaaaaatcacgtgattaattcgcgaattaataattgccccggaacacatcaggcaaggctcaatcgtcacgtacaagtcacagtcgatcagccgccaactttgtaaataggcacacgcttcctcaatggccataatttctgcgtgagctaccccatcgtttaaatgctcacgcaaattatggcccctaccaataattcggttatccttcacaaccaccgcgccaattggaacctcaccaatcagaaacgctttttgagcctcagtcaaagccactctcataaattgaatatcagtttgtgatgccattgcctaacctcacgatcgtttaatactttgaagaatataataccctttatcgcgttttaaaatatcgcaattaccaaataattgagtcattagtttctttgcggaaggtgctccctgctttttttgcaggactactgtcaatgtcccttcattaagcaaatgatcaaccgcaccggcaatcattgcatcaactacctttttgccagcgcggactggtggattggtcacaattgccgcatataagtccgtaacggcctcatacacattgctctcaaaaatgtggacactggatgatacgccattctcagaagcattttgcttagctaatgaaagcgccagttcgttaacatctaccatatccacttggcgatcagggaacgctttggcaattgcaatcccaattggaccataaccagtgcccatatccaagatctttccttctggaataatgtcgtaattaacgtttgcaacaaggacgcgactgccatagtcaacggtatgtttagaaaacacaccgttatctgaagtgaacgctaagtcatttccgagtaatgtaaaatcccaggtaattggttcggaagcaacgtctggatgctgtgaatagtagtactgattttctgacataataatctcctaacaataattagtttagggtgtaggcccatatttggtatttcattgataaaacatcacaatatattgtggttaatcgttgattttttgtaagtttagtgtaaactagaatcataaatcaaaacgaaattgaattcggagaaggtgttgaaaatggctaaaattaccctatattctaaaaataactgtatgcaatgcaagatgacaaaacgttacctcactgaacataacgttacattcgaagagcataacatcaatgaacaaccacaatatgtagattatcttaaagagcgaggctttatggcagttcccgtagtcgatgttgatggtcaacaagcttttagcggctttcgtccagatcaacttcagaccattgccggctaatcattgcccattttaacatattgattttgaaagcaacgggcgaaaccattttttggtctcgcttattttattccctaatttaagaaagtgtggttttaaatggctctttgtcaactgaggttgatatcagcttatatagcaaatccgaaaggatttgctttttcttttgcattaattgaattaagcaaataattccatttgaatcctagttcgataatggtcaaa

SEQ ID NO: 652 - DNA, 83497 bp, Unknown
  Metagenome-assembled genome
ctaatcaaccatcatggttcgaaccaatttaaactttgctctaaattaagggtgacgagggcaattcgcccgtcacgatcaagtgatggttagcccgggtaatatggatcgcttgcgggaagccattgatgtcgccggcaaatgcgtttaatcgccagagatttcttgccaccatgtaaccttactttcagcggtagcggtgttcttgatactttgggcattaaaaggacgaacgaagttcgcggctgatcgccttgcctaatcgtcgatcagcggacaatttttttaaacctgagttaataaagcggttatcaggggtggggctttcgaccacgtcatccaaagtagtaaacggtggaccactttggataatcagccggcaaatcacgccaagtacagccatttttaagggaaatagaggcaaggcacagaagatatcataaggatcaagttgtttttggtgagttcgttttcggaagctcagatcctgacggatcaaatcgaattgttgccgagaaatatcgctttggtaatgatgactaaaatgttgcatatgatcaccaacttttttgacagtagtttatcaaattatttggtcaaaatcaaagatactaaacagcttcttacagtatttacctgttcatgaaatatcgacagacaaatcctgatagcaagtccagtaccagaatgattaatgcctcgattttaattggaacggttgttatttttgccgttattgtgattggcgttacttttgcatcacttattccatcaggcgttttgactttgattcaagtcgcaattgcgatgatctttggtttaattattttcggccttgttgtgccggtgatcataccaggattaatgaaattaacttatgagggttttgatttcaagtggcggaacctaaagcataaaaagcgttcaaattagcagccgggttttcagtattttgagataattgatcggcgaataaacataaacagagactagacaatggttattttgtccagtctctgtttgtgtcatcacgattattaccgagtgaaaatgtgtaccaaaaggctgtgcaaccgaattatcccaatatgcaaatttagaatatctcgttgaacttgttaattagtcagaaaacttggatcagcaaaccccggccatataaagccccctgatttaacattccaagaacaggaatatctcattgaattttttacttggttaaaacgtggacgagcaagcagatcccggccactctgtcatcccagtaaataggtaaccccggttgattcaggaccaataaagcttgccatttctggatttgttgcgatcattgaaatcggaacaaatgggaattcatcgctcaacattttgtataaaaaagttgcgcgttgtgagccaccagaatgaagaatggcaagtttaacaattcgttcatggtgcatcgtccttaactgctgatcccaaaatttgttaaccagctcctcttttcgaccccgagtgacgaatgagaattcattgttagtgaattgaagaatgtattggacgttcatctgacgctctagcaatccacgcagttttccgacaatttgatggttaactaattgaagattgcactggacggaaaagtagattcgggtgttgttacgaatgttttcaagatcagattgaatttcatgtaatggtttttccatttgaatgtcttttgcggcggtggtgacttggtaggctaggccagcggcagtgacttggctattaagcacggttacccgactacttgtctttttcgcagctttaacagcattagcgtaagtatcagttagtttgtcgctgagatggattgatagaatttgactaccatctgcaccaagttcatcatatgttttaacaagtttgtcaacgctaacttggccaatgacgggtttcttagtagattggttataaagttgcaggaacttctcactgctaatcttattgacatagccgtatagtttgccatccactaaaattggtgggttcatgacgtggatatgataattgtggatatcagctggggataaatgaatggcggagtccgttacaattttgatattgctcataaagttcacctctttgcgaatttgatgtcatagtagttattgtaccgcaaaaaatcgatagttgataaggttcgcaaaataataccaggaaagtctaattttgggcataattagataaagcatacaagcggttttgaaattatttatatgggcataaggttctctaatttttaatgagtcattagtaaatatgagtgaatcatttataatataagtcaggcactatttcaaatgaaaggactcggaaagattgaaaggtaaatataaggtttctcagtatattggtgttccacttgaaatggatgattctggaaattatcaaattaaacaggatgaacaaggaaattttaaacttcacagttggcgaacgggaaaacatacaaaaggaaaatatcagaaactgggacaggtatttatcacagagaataatctgatggttgccattgttaaggcgatcccagttgcctttaaagatcgtcatgattacacgccattgcaacggtttacgagcgaatttgtttcaaataagttgttggataaagcccaagggaagctataaaagtcggtatgataattattgtgggaaaaggttaggcaattgaagacttttttgttaagcgactggggcaataatcattttactcagttctttttggatagtcataattattactaagtggggatgcaagggaaaacatagccctaataccgattgcttctaaaatgtaaaaaaacacctaacacgagttgtgttaggtgtttttggccgaaaaaaattactttttaagtaacttttcagcgtctgctttaagatcatcggttgacatgtccatatatttttccatgtcttgaccagttttcatggtatcgtgatcattcttttccatgtaataatcccaaagagcatctcgtactggaagtttactatcgctccagtcgaaagcctcattcatatgcttattcaataatggggattctgcacctggttcttcattaatatcttctgccataagtaaaactacctcctttttgtatctatatccattatagatcaaatttgaaatatgcaacaatttttaactcaattcatgaaagaatttcatttggcaggtctgattttcacgatccaattggttttaggatcgggttgattcaaccgatcaatatctttaccaatctccttgttgcggtcaatgacttttccagcaatgggtgatttaagcgtctctaccgacttgtcaccttcaatgtctaataggtcatcatcaacctgaacatcggtaagctgagttggaaaatccgcgaaagtaatcttgccaatttgctgataaacagattcgtcaattcccaataaataattgccatctggatcgactgtgtaccagatgccatctttgaccttggcctcaactggtgcagctgcttttttaccagtgaaaaaaattttgattttttgccagaaagaaatttttgccataatgacaccgcctcgatattatttacttcaagtataacgtataatggacaatagagtttgaaaacggtttattttgcaacatttgaaatgaaaaatagtggtttattggaggaatttaccatgtacttaattgatatttctagaaacggacaaccaagctatgacgctcgggtcaatcaatcactggataattattttgttaatgatttaaagctacccggccatggattcatgttttatattaataaaccatctgttatcattgggcgaaatcagaatgcgtgggcagaagttgatattgactatttgcatgaacacaagattgaactagttcggcgaacatctggtggtggcgctgtttatcatgacatgggaaactttatttttgaaaatattttaaccgataatgctgacgactttggtgattacgcacactttgcagaaccggtcctgaaagctctccgtaagttaggcttagatgtccaaatgaaagaaaacagcagcgacttgattttaaatggcaaaaagtggtcagggatgacgatgtttaaaagtggtcagggtttggcagccggtggcacgattatgtacgatcttaacattgagaatgccaagcggagtttaaccgagaatcaacttgagaagcaaaagcggttgggcgtgttgtcaaaacggagtgaaatcgtcaatttgaaggactatttaccagatgggatgacaatggccgatcttcgggagtatctcttaaaagagatttttcaagtgaagtcgttagatgacattgaaacctatcacatgaccgatgaggactggcagcgtgcggataaacgattagaagagacgtatggcactgatgcttggaactttggtcataatcccggatattatgactacgcggataaagagctgtcagcggggaaattagggataaattggaccattgatgatggtagggttgaacatctaaagcttaatcctttctttaagcttgatggtgacgtggataccattgaggcttatttaactggtaaaaagataagcgaaagagttgtaaaaaaagcggttaaaaagggtcactttgctaatattgatcctgatgaattagctgattttttgatcgaaaaattagattaattatttaaaagagtggggcaaaaaacggttagcttccagagtgtaaggggcttatccaaatattccgatcctgaatatttggataagcccttacacggccggaagctgttttttgccccacgtttccactcggtaataatcgtgattatacatgaaaatggctcagagcagaggtcaaacgaggctacacggccggaagctgtttttgaggcctggtttagtgactaatcattatttgttatcaacttttttgtggcacttgattagtgaataaaattaataaacatctttgttactagtgtttaatttgtttggttaacagtctgacaattagggatgttaatctgaataaaaagaaatcaagtgagaaggcaaaccggtcaaaccttattccagttagtaaccgggttcgcatttttgaggatcaagaagtcataacttatagtggttgatgaggcgaatacaaaccgaaaagtaatcgcaaaccaatcaactttaaacgagtgaaaagttagatcataccaattttgatttcgcatcaatccggttcgacagccaaagtaattatcggaacgctaaatctgtattcacattattttttaaaaaactgttgacaaattctaatcaagtactcataatacgaactatcaatttgaataacacgttcacgttaattcaattacagagaagttatccgtggctgagaggtaacgttggattcggcgaacgttttgttcatgctttatttttaagttggtgagctgaaaggttagccagcttcggcgttggccgttaaagcaattaacgagtgaacacagaatttgtgtttatgaaggtggtaccgcggccgaatgtcgtccttttgtcaatctgacagaagggcgttttttatttgcgatttttttgaactatccagttaattgttttaacgatgatttttacataggaaaatgagaaaggaagttagtattatgaaatatacagtattaggtgcaggtgcaatgggattgcgttatggtgttttacttcaagaagcaggttatgatgttgatttcgttgatacttgggacaaacaagttgaaacaattcgcgcgcaaaagggggtctatgtatcccgagacggtcaaaataaacatcttgtcccggtaaatgtttattaccccgaagagtatcaaggcgatccagatgtgttgattgtttttactaagcagtatcaactcacggatttcctgaaacgttgtgagcgattctttaatgacaagcagtatgttgtgacttgtatgaatggaatgggccatgttgaaaaacttaaccaatacttccctaaagaacgattattaggtggaacggcattaattggaactgtcctgaataaagccggcgatgttgattttattgggcctaagggtgccggctcaatgaatattgccaatgaaactgaagagcccgaccaaatgacgcatcagattgttgatgaatttactcaagctgggttaaatcctaatttgacgactaatttcttaggtaccttaatggcaaaagtaatctttaattcagttatcaataccctttgcacaatgtttaagatccgaatgggtgaatacattcaatcaccagttgctaaaaagctgggcgttcaattgattgatgaagccttcgacgtgtgtgaacgggccggaattactttattaaacacccgacaggaggaatgggagaccgtttcctatgttagccgggtttctaatccacttcatttcccatctatgtaccaggatatttccaagaatcgccaaaccgaggttgattatatcaatggttacatctatgaattaggattgaagcaccattatgaagctaaaacccatgattttttgagaaatctagttcaccttgctgaattttccgggacgtttgacgttgatggttatattcaatcggttcttgaaagtgataagaaaaatgttcaggcaacccaacaagctaaagcatagttggggatgacccgatcacatattaagcttaaatggttatcattcaagttaagcttaaattctcgttattttgacattttgatttcagaaaattagcatggacttagatggatttataataattaaattcttcctgcccaaattcaaattgttgaaagaagggaaatcgtctacctcagtttgaggtagcattcataaaatggataaaaaattacttgaaaagttgccaattaaaccagttattgactaccattccgttggtggcggtgatgtcaatcaagcatataagttaacaagtgaggaccaccaaaattactttctgctgatgcatcaaagtgataccaaagatttctataaagaagagattgccggtctctacttacttggtcaaactgctgagacaccgaaagtattagccaatggtatgtggaaaaatgatgcctatctgctactgagctatattaattctcaatcatttggtgatcagtacgcgcttggccgggttgttgccaaaatccataagcggaccagtgtgaatggtaaattcggctttaacgctgatgatccggagggcaagtccgatcaaggaggtgtttggtatcctgattgggcttcgttcttcatcaatgagaagttggaatatcgcaaacagattatcattaagcgtggattgtggacaggcgagatggatgctatgtatcagcgagcgttaactcgttttaaagaattgatgacaactcatgattcgaagccgtcactgcttcacggtgacttctggtctggcaatttcatgtttgactcaaaagggaacccggttattattgatcccgcaactttttatggtgaccgtgaatttgatattggtgtcacccaggtatttgctggatttgaaccggaattttatcaaggatatcaggatgaatatccatttgataagggatacgaagatcggctgccgttctatcagttatattacttgatgcttcatctaggtaaatttggtatgacctatcaaggaagcgttatgcagttattgaggatggtgtcatagaacaaactcattaatgttataagggtgcaggatatggtcgagccgttattggcttcgatcacatcctgcacctttgtatgttgaaccccattgaaatgcacggaatgaggataattgagaatgaactggttaacaatcgtcatttgtctgctaaaatagatgtgaacagcatctgaaaacgctttcgatataggtaaacaaatgaaaggatgattcataatgaatacactagatgcgattgttaacagaaaatcagttcgcagttatactggggagccgacttccaaggacgaacttgatacggttttgaagacagcttatgcatcaccggttgcgatgggaaaatatggggatgtttcgctaacagtcatttcgaacaaggaacttcttcaaaagttggatcaaaatgctcagcaaacatttcacactgatcgatcaatgctctatggtgcaccaacgtttatcattgtttcggctaaactggttggatcaccagccgataattcagcttattcaaatggtgcaacgattgttgaaaatatgaatcttggcgcagttgaattggggttaggtgcctgccatatttggggtgtcattgccgctttaaatcagaaccaggcattgcttaaagaactaaatattccagaaggacaaacaccggttgctggaatgacattgggtaagaccaccgaaacttatgatccacgtaaggttgatacgagtcgaattcagactaagatgattgattaatccataaaaatttgataaatggtattaaaaaaatgcaagttgatttcatatgttgagatcaacttgcattttttgaaattatcgcaaccaaagtttcttacctggtaactaactttcacgattagaacgtttcccatccacagaaaattcaaggtctactgataatatataatacaaccggttaactttaatttttttgttcggtgattatgtctttcaaggaagcttggaagagattcccagcttcctattttgtcactatttgtcataaaagaggtgaagtgaaaggcaactaacagtggttaagtggctttggaagttaaatgatctttgttaccatattgggtttaataaaaaatgatattaaaaaagccagcgacaaatcgctggctttcgagttaataactatttaattagtcgtcaacaacagtaacgttggcagcttgtggtccacggtcgctgtcttcaacgtcaagggttacgtgttggccttcgtctaatgacttgaagccgtctttattgatagctgagaagtgaacgaatacgtcaccatcgtcagtagtaatgaagccataacctttatcagcgttgaaccatttaacagtaccttgtttcataatatatgaaacctccttgcgctttttgcgcatcataaattttaatgcatctagttgaactgattccaaggaagttatttcataaaactataaaacaagtacctttgaaaatcgactcctgaaacacattgactataatataccaatattcgggtaacctgtcaacgtattttgcttggatcaattacttagcacctacggattccgttgatttggtaggaaccactgcaatttcatctttatttaaggtaacattgaagtctttaacgtctgggttttcaagataactgtttgtcagtttatcagtgatttctttggtgataacccgatgcattggtcgcgcacctaattctttactatatcccatgtcgaccaatttgtttttagcatcagcagcaactgtgaagctgataccacgtgacttatcaaccagtttattcaaatccgttagcatgagatcaagaatctttagcagatcaggcttggttaatgaattaaattggatgatatcatcaattcgattcagaaattcaagcttaaagtacggcttcaatcgatcaatgacgttttgtttgttatcggcttcatcctgaccagcattacttgtcataatgataacggtattgctgaagtcgacggtgcggccttgagcatctgacaatcgaccgtcatccaggatttgaagcaaaaggtttaagacatctggatgggccttttcgatttcatcaagcagaatcaaactatatgggtggcgacgaacttgttcagttaatcggccgccttcttcgtaaccaacgtagccgggtgctgaaccaatcagcttgctggcactaatcttatccatatattccgacatgtcataacgaaacattgctttggttgtgccaaatagttcctttgctaaggccttggcagtttgagtcttaccaactccggttgggccaacgaagagaaagctgccaattggtcggttgccttcagtgaagccgacccggctacgtttgatggcggctgaaatggcatcaatggcgttatcttgaccaataacgttgtgtttcatgtccttttcgagattatttaattgactgacatcatttttatcaacatcagtaaccggaacgccagtcatccgttcaacaacatttttaattgtttccgtcgtaactttgggaacttcaacttttgtaccattatcaatggccttaatttgaccattaactttatctaacttgtcacgtaacttggctgttcgttcaaaatcttctttcttagaagccgcaatcttttgttcgttaagttcactcgcttcttgctgcaaagctgacttatctttggtaattgatgagcccattgcaacttttgcgccggcttggtcaatcaaatcaatcgctttgtcagggttcattcgatcctggatataacgattgctaaatgtcacagcagctttcaatgcgtcgttggtatagtgaacattgtggaacttttcgtattttggtgctaatcctttaataatagtcagtgtatcggcttcacttggttcattaaccatgattggctggaaccgacgggcaagcgcctgatccttttcaatgtcacggtattcattactggttgttgcaccaatcagctggaagtcaccacgagccaacttgggcttgaggatattaccggcatccatcttgtcgccttcgccagtggagccggctccaatgatttggtgaatttcatcaataaacaggatgacattcttattctttgaaacatcatcgattaattgcttcattcgttcctcaaattgaccacggataccggttccctgaacaagtgaaacaacgtcaattgaaatgatctgcttgtttaaaagtttctcggaaacatcaccattaacgatcttttgggctaagccttcaacaaccgcggttttaccgacaccggcttcaccgatcagtactggattgttcttagtccggcggcttaaaacttcttccatttgctcaatttctttatcacggccaattacaggatcaagttggccttctttagccattttagttaagtcggttccgtattgatctaataatgtctgtttgttttgaggagtgcgctcttgtgtttgaactggaattcgatgcatttcttgatgaccgttacctgctggaaaattctgcttgaagaatgggtcattaaaaagatcatcaaaaccagcgtcaaaaatatcattagccatatgcaattcccccatatttgtcatttttttgattgtgtgttccaagaaggagaatgtatgttcccctaatggacaactatatattatcatgaattagttatgatggcaagaatttgccttaaacttttagttggctaaatgctgtcaaatggggatttataaaattaattataaaaaaatagtggtaaaaaatagcactcttttattagagtgctaacagccattgttatcttattgatttaaagattgcttttaaagttgtttgccaatctgacaatcacttaaaattggatgaggccgtgaaaaatgacattttacccagcatcctttgtgacgatcaaaattattaccaggtgaagatgtggaaaaataggcaacttccggccatgtaattgaattatccaagtattcaatcccgcaatatctcgttgaagttttttcttagtagaaaaaacgtggaccagcaagcaggccccggccatataagccccctaatttaatattccaaaatcaggaatattccgttgaacttgttacttggttaaaacgtggaccagcaagcagactccggccatataagctccctaacttaatattccaaaatcaggaatattccgttgaacttgttacttagttaaaacgtggaccagcaagcagactccggccatataagccccctaacttaatattccaaaatcaggaatattaagttagggggcttatattctggagtctaaccgcttgctggtccactctggttcatttaatctcaaaagaaaagtcaactgcgtcctttaatgtattatggacggtacagaggtgaagcgtttcttcgataaaattttggttttcctcaggtggcagattggtttcacaatccagtgtgacgtgaattttactaacacgggatgatttatcagggaaccgttctgtttcgccgtcgacttcaacatcgaattttttaatcttgatatttgaactggggcgatggacaattgaagctgcacttgcccccaaacaagcaccaaccgatccaagtagatattgaaccgggtttggacctgcatcggttccacgaaagatggtcggttcgtcagcgataaattgatgaactccggccgtattaattgtttgtgagccaatgtttcttaaagttgtatgaacgttgtattttgccattgtttttctcctttattcaaaacgtgttacgatacaatattaatgaaggacttaatgagaacccgtggcggcagaacgcccggtttttccaataaacattgaaatgaagtgattagttgaaaacattaattatggtttcacatcccaatcttgaacaatcagccaccgaagcctttttcaaaaccagtgctgattttgttgatgagagtacttggtattctttggatcatctttattctaaagcaaaaattgatcctgatcgagaacaacgatttatccaaaattttgaccgtattatttttcaatttccactctattggtattcttcaccggctagtctcaaacagtatatggatgatgttttcacccgcaagttcatcgttgcaacccagtctctcaaaaacaaggaattgggaattgtggtgacgacaggagatgcattaacagattttcaagcgggtggcagtgagcgatatacaatgtcagagattttgcggccatttgaagcgtttgccaacaaagcggtgatggtttatttgaaaccatttgtggttgatcaatttaactataaagaggttactgataaacaacggttattagtggcctatttgcagtatctaaatgcaccgatgccgttaagcttggaaaatcgggagaagtggctattagcgcaactaaaacaaagtaaacccgatatagcaccccaacagcagaaaatacttgatttagtaattggagcaattgatgatcaacaggatcaaattgatgatttaaaaatgaatatcaagttaattcgagatcaggaagagtgattgaaatgacagataccaatgagtggttgatcaaacgattagggcagttggaaaatgaggagcagtcatttatcaaaaaatcactttatttggcagctcaagatttggtaagggagcaggggaagcgaattgaacaggcacagcaggaaattgatgggcgaatttggagcccggataaatggtgaaagttaatatcagatattgaagatacaaaaaagagactgagacgatcattattttgctcggcctctggtagtgtatacacgcgattgtaatcacgcaaaagacgggataaaaggcaacttccggccaagtaattggattataccaatgtactctctggcagctaaacgtcttttatcccgctcttttcttgaagtttcgatcatcttttattgatgaatgctaacaattatagttcgtcagctggtgcccaatgattgatgggaccaaatttatgaccaacttgaatctcgttttttattgcgatgtcaacaaacttcttagcaattcgagcagcttgttcgatatcggttcctttggctaactcagcggcaatacatgctgaaagactatccccggttccattttttcgatccgttgggaagaaatcaccggttaaccaaaaacttttaccggattcgagcagaacataatcagaaacctttgtttgaccgggattgtggtgactgcccttcaaataaatatttttagcgccgagattttttaatttttcagcggctattttcatatcatcatcagttttaatttccatttcagctaacttctgggcttcaaaaaagttgggcgtaatcacgtaagccaatgggattaactcatcccgcaacgttttataagcgctttgttcaagtaacatgttaccatgtttagttgtgatcacggggtcaacaacaaggggaccaaagtcgtatttttgataatttttaatgacagttcgaattaaatccgagtctgataacatgccggttttacttgcccgaatgtgataatcgtcagctaaatctttgaattcctggttaataaatgattctggtaaattaacggcatcgtgaatcccgtagctgtttccagcaacgcacgccgtcatgaccgatgcaccataaacatgtcgtctgaagaaagtatgcaaatctgcttgcatccctgcgctaccgtcactatctgaacctgcaattgtaagagcttgtggaaattcgtttgccaaaataatcacctcaaaatgtatttttatactattaactactaagaataacacaaaataaggaaattgttagagaaaatctaattttaaaaaaggagattgatttgcgtttgagtggtaatctgtattataataatttagtctattggaatttagaaatgtaataataaataaggagagtcttattatgcgtatttgtcatccacacggcgtacaaggacgtcgtccagttaaccgtaagaacgatcttaagcgaaacaaagaattagcagatttgcaacacttcttgaagcaaaagcctgctaagtaatgcaaaatccaaccggaactaatctggttggatttttttatgcttaaatattagaaattttaattgaatgagcaggggttggcggcttggggtgaggaaaaaggcaactgccatgcagccaaattatctcaatattcaaaccgggaatatctcgttgaacttcttacttagtggaaatgtgggctaacaagcaccccccggccgtatagtttcctaacttaatattccaagatcgggaatatcccgttgaactttttatttagctgaaacgtgggtcaacaagcaggccccggccatataagtcccctaacttaatattccaaaatcgggaatagctcattggactttttacttggtagaaaaacgtgggccagcaagcaggccccggccatataagccccctaacttaatattccaagatcgggaatagctcattggactttttacttggtagaaaaacgtgggccagcaagcaggccccggccatataagccccctaacttaatattccaagatcgggaatagctcattggactttttacttggtagaaaaacgtggcccaacaagcagactccggccatataagcctcctaacttaacattccaaaatcgggaatattaagttaggaggcttatatggccggagtctaaccgcttgctggcccactctggttacttagttgcaacctcctcaaatttttcgacatcttttaatgttccgatgatcgtgatgacatcaccctgttcgatcaaggttgcctggttggggatcgccgcgccctccgtatctgcgtgtgagatggcaataaccgaaattccgtatcggttggtgaagttaagatctttcagtgtccggttgaagaatttggaattggttaattcaaattcaacgattgatagttggccatttaattttaaatcgttaaggatttttggctccatcacgtgtaatgcgattcgctggcccatatcgcgttctggctgaataatctcatcggcacccaacttttctagtacttgggcgtgacgggcattttcggccttacaaacgagatgtttgacgcccaggtccttgcaaattagggttgtcataatgctggcttccaaatcggttccaattgtgacgaagacattgtcaaaattaccaattcccaactgttgtaaggccagttcgttttgggtgtcagcgacgattgcctcggttgcaatatcacgaaaggaatttacccgggcttcatttttatctatgaccaagacttcctgatcgtgttccagtagcgtgttgacaacactgctgccgaaaaggccaaggccgatgactgcatagttgcttttcataaaaattctccttgtcatttatcattgttatattgatgtgttcagtcgatttaaccgatcataatattttcttctggatacctgaatgcgtcttcagggcgtttggatgtcagcaatgagtacatgactgtgaagacaccaacccggcccataaacatcaacacggcaaagatcaatttaccgataatggtgaggtgtggtgttagccccaatgttaatccagtcgttccaaatgccgaaacgacgtcgaagagaatatattcaatcccgaaatgttttggaatcgtttcggtaatcgttaaaatcagcgtcgcaattgatagcactacagcaactaagaaaaccaaggttaatgaccgctgaacattgtcatctgaaaagcggcggccccaaaaagttgcatcccgtttaccacgcaacgttgcccaaactcgaattaacaggatgccaacggttgttgtctttaaaccacctgcagtagatcctggtgttccaccgattaacatgagaatcatggtgaaaaacatcccacccattgataccttggtcatgggatagctgtaaaaaccagcggttctgggcgttactgacataaaataggtgttcattagtcgctgaaaaacagttaagtgtgattcattactgaagttaccctcagtgattaagaagacaataaagctaatgataatcaggcccaagtaagttgtgagtgctaatttggtatgcagactcaggtaatgatccttgcgatatagtaacaggtccttccacactaaaaagcccaaggatccggaaataatcaagcaggtcaagacgaataagaggtaggggtcattttgaaagcggacgagactattattaaacaagtcaaaccccgcattacagaacgcgctgatcgaatgaaaaatgctataccccagtcctttgacaaaaccatagcgtgggtaaaaatcaataaagatgagtccggtgccaagcaattgaatcgacagtgataattcaattaccagcatgacaatacttctggtgttggcgaaggattgtaaattcaatgattgctgtgtaagcagctgggttgttaaatccattttgcggcgcatgaaaacaaacagtaggaccgcaaaggacataaatcccaagccaccaatttcaactaaaattaaaatgacaattttgccaaataggctccagtgtaacgccgtattaacaaccgtcattcccgtgacacaagttgccgaagttgccgtaaagaatgcgttaatgtaactagtggcgtgtccggcggcgcttgagaatggtagtgaaagcaaaatagttccgatcaaaataatgcttaaaaagcccaatgttaaaatttgtggtagggcaagtcttccccttgaacgcatgagatctgccacctttcgataatattctatgtgtattatctcacatttacgggtgatgtgttggatcgagtgaatgcctttttcttaatcagccaggggaatcagtgtaagtgcggtataatattgatgactaattttgcaatggaggattaaaatgctaataaaaaatgttcatattcagaatgcccaaccacagacagacgttcgaattgaagacggcaagtttgttgaaattgcggcggatcttgaacctaaagataatgaacgggtgattgacgcgactgataaattgatgttgccgccgttcgttgatccacacgttcatctggacgcaacccaaactgccggtgatccggaatggaaccagaccgggacgttgtttgacggtattcggatttggagtgaacgcaagaaaaagctcacaatcgatgatgtgaaatcacgggcaaaaaaagcgattaaaattcaagtctcaaatggtattcaatttgtccggagccatgttgatgtcactgatcccaacttaactgccttaaaagcattgattgaagtgcgtgatgagattaaggatcaggttgaattacaactggttgcgttccctcaagaaggtattctatcatttccacacggcaaagaattaatgactgaagcggctaagcttggtgcagatgttatcggtggcatccctcactttgaatttactcgtgagtatgcggttcagtcgttgcaattcttgatgaaattggctgagcaacagaataaattggtggatgttcactgtgatgaaattgatgacccacagtctcgaagcttggaaacattagcgaccctggctttagaaagtggcatgggagataaagtcactgccagtcacacgacagcgatgggatcgtacaatgatgcttacacgtacaagttgtttagactgttaaaaatgtcgcaaattaactttattgccaatccactggtcaataccaatctgggtggccgatttgacacctatcccaagcgacgcggaatgacccgggttaaggaattggccgctgatgggattaacgttgcctttggtgaagacgatattaaggatccatggtatccaatggggaatggtaacatgttggatccggttgaaatggggattcacgttggccatttgatgggctatgatgatattctaaattcttatcaatttattaccacaaatggtgccaaggcgatgcacattactgatcactatggcattaaggttggcatgccggctaattgtattattatgaataatgataatttctataacgcattaaatgaacgttctgaaatcctgtattcaatccatcagggtaagattttggttgaaactaagcctaaagaagttactaatcactttacattctaaaaagatcaaaaaagcacactaagataagttttgaattttaaatcaaaaatcaaaacaaatattagtgtgcttttttgaaccgggcatcccgggaataaatgttttttaagtggcgttgtcctgatcgttaatgatacaagcgatgtctcatcacgtaccgaatctgatattaaaagttaaaggctacaggaccaattatcaactaagcgcccttgtgtgccgggtttttcttaggttgcttctttttagccagtgcggctttgcgctctcgtgaacgttcctttaaaatgttcttgagcgtattaatgtcttcttcgtgtttaactttccactgcttataagatgtattagtatcagtatcagttggtttgagccctgtatccaaccagaatagcgattccgttaagctcggaaaattatgcatccaaagtgtctgcccattttctgaatcaaacgcaacgtacgaacgggcatggcgttgcaaaaatgtatgtttacgaatcttgaatgcttcccgttttcgagttagacggtaatcgggtaaaatgtacttaccttgtctttttaatcgtgggaaacgttcgtttatttgatctgaacggtctttgagtaacgccttggcttcatcgaccgtgatcaatgtggcattagtttgggtcatatgaatttgccccctttattattcattttcgcatagatttatctaattgaaaagtagatagaaagattataatcaattattaacattttttctgaaaaattattcattaggagcgaagttatgaaatactacgcagttaaaaaaggccgaaaaaccggagtatttacatcttggaacgaaactgaaaagttagtgaaaggatatcccggagccaaatataaaagttttaaaaatcgagaggaagctgaagactttattggtaaagcttcagccacgcaattagatttaggaccaattaattctaaatccaagccaaaaactgcttctcgtaagcatgaatcagctgaaaattttgacttttctgatgtgattactgaagaagggacaatcattgtatacacagatggcggttctcgtaatcatggtaaccatttaggcggtcatgttaaggccagtgacaaggcggcgtgggcttatttgatactaactgagacacaacaggtttctaattccggtggtgaatttggcgcgactaataatcgaatggagattatgggattgcttcaggcactgaactatttgataacgaatgatttggaaaaagaaaagattacggtcattactgattcaaagtacgtgttggatgccattacgaaagggtggctagctggttggaaacgcaaaggttggaaacgtggcagttcgtctcagccgactgaaaagcaaacgctcaagaatcgagaactttggcagcaaattgacgctaatttaggtaaatttaggcagcttaattttaagtggacaaaaggccatgccagtaatgagggtaataactttgtcgatgaattgctaaatgaaacgatggatcgaatggggaaagccgattatcaagcatcgctgatacctaaaatagagaaacgaacgatgatgcaacaggccaaatcagccaaaacgcaggatccatcagattccaaaccttcaagtaagaggatcgggcagactcagggtagtccagttcatgaaaaaatgagtgataaaactaaaaaatccgtccaagatgttaaggcagcccttcggcaaatgggattatttgacgacaaataaaccggatgaggtgtgaaatgatttctggtgaatgtgaattaggagaaacggtgaaaatggttatcctgcttaactgaagcacgtaacggctataaaaaaataaaagagtctggaacaatagtcatttatccaggtccttgtttataataatcacgattattaccaaacggaaacgtagaaagaagggcaacttctggccatataattagtttaactgtgaattaccgattaaagtttaccaaaacgtgcaaagaaaccacagcttccggccatataagccccttaacaccatattccaaattcaggaatatggtgttaaggggcttatattctggaagctaaccgtggctctttgcactctcacttatttacatgatgataccgcgtatcaacttccttgctccagaatccgcctgataattggaccggttcctggaccatgataaacgcatccggtgacagctccgtaatttgctccattaagcgccggtcggcctttcttggggccaaaatactgaggaccagccgatcgccatcccgaccataggccttactaactgtgacaccataacccagatttcgtaaattttcggccaattcctcattgtgagcatggatcggattcttaggatccacttgaacggtaacttggaaattgacatatcctaacgcaattttattctcaatcacaatgccaatataaatcccgaccccaaaaccaattgcataagcagcaatgtttaatggactatcaatatgctgcaaagcaatcgccagagccataacataaacaaattcttcaaaaactgcaacgattggtgccaaaaattggtgccctttgacgactagcatcgttcgaaaggtattgatggaaatataaagcgcatttaaaacaaaaattgtaatggcaagttgcatgtcgaatttcctcccaagtttaatttgtaaatagtgtagcacttttatgatctaaaactgtgaaaacatgttcgaaacggttcattttgattaatagctactactaacgtatcgcggtataacagtcgtttaagcactgttaacattgacaacaatcgcaattaacggtattctgaaatttgaaccaaatatcatagtaagggttgctgaccacatgacaaatataaaattaattccatatctaacctttgaaaacacgaaaagtgcccttgaatattacaagcgggtatttggagttacggatgtgaagcgccaagcaccaacacaaaaacaagctgaagaaatgtcacttaatccagatgttaatcttgataatttaacgatgaatgctagttttagaatccttgggaaagatgtttattgtgctgacagtttcttaggaaaaccagttgtttcgtcattgatttcattgatgtttgaggttgatttacatgattccgacgcagcgtcggaactggaaagcttgtacaaacgagttgctgattctgaagaagtgaaggttattatcacgtttgaaaagaaatcaaatggcaataaatatggtcaagttgttgataaatacggcgttacatggatctttaatgcagtgaaataagtgataatactgatttcactgtatcgtgagcttaaaaatctacatagtttgactaattaggccattggaattaattaaaagcggagttgaaagcaaatcagttgttttcaactccgttttgaatacataataataacaagaatatggttggctaagcagttgaatgactaaagttggcaatcatatcaatatcttatcgaaattcaaggacagaaagggatgtgattaccatgcctgaatttgatcacattaaaggattcttgtttgaccttaacggaatcattaccgactcatggcgctatcacagtaaatcatggcgcgagattgcaaccaaattggggatctcgtggtcaactcatttagaggaagccattaagggccgggaccggattgactctttaaatgcgattttaaaagctggtgggttggaaaatcaattttctgatcaggagaaagaagcattggctgacgaaaagaatgcgatttaccagacaatgttagataaaatgaatccaaatgatattttacccggcattctcgactttcttgatgaattaacccgtaaccattatcaaatgatcattgcatcggcctctgcaaatgcgcccaaggaaattcaaaagttggaactgcaaacctattttccattaattgttgatattaaccaaattaagcataataaaccggcaccggatgtttttgccaaagcagctgaaatgctgggcttgcagccagatgagtgtgtcggaattgatgatggtattgttggggttgaatcaattaatgcagcgaaaatcgtttcaattggggttggtgatccacgggtcttacatgaagccgacattcatttcacgacaacgaaagaattgacgttgcaaaatattcgtcaggcttggcctaagtgattttcaagatattgttttaagacaacggcttgattattttctcgatctttagcgccaaacaataaaatgacgttgtcactttttaatttatccgctaccattgaaataaagtcgctggttttgggattatcattaagctcggctatgtatttggccttgaaatcgggaaacttttccggatcatgagaaaaccaggaacgcaactctttgcttggggcaatttccttttcccattcatccaatttggcgttgaccttggaaattccgcgcggccataggcgatctaccaatacccggtatcctgacaagtcttgtggtttatcgtaaatgcgttctagttttaattccatgaaaattcctcctaataattaatttaagtatctctgaaaggggttgagaacaattgagacactatgatccattttatgccagtgcgccaactaatcaaattgcaaaagaaatgttggggatgctgcttacatacgattcacccaaagggctggttggtggctggattgtcgaaaccgaagcttatatggggcaaaaagattcggctgcccacgcgtttggtggtcgacgaactgcatccaacgaaccactatacggtcccccaggtacagtttacatctattcgattcatgggcgttatcttcttgatgtcgccgctcaagaaaaagatgtgccgcagggggttctaattcgtgctgttgagccaaccattggtcaaaaaattatgctggctaatcgtaaaaagcatggatttgacttaacaaatggtccgggaaaattaatggaagcttttgggattgccgataaagagatgaactttgagatttttggtgatcattcaaaactggcgattgatcagcaacgcaaaaaagccccggcacaaatcgaaacatctaatcgaattggggttgcaaaccaaggagattgggcaacgcgcccgcttcgttattttgttaaaggtaatccttatgtttcgggaattaaaaaacgggatgttgatcaggaaaactttggctggacagttcctgtcaagaaagattaagtgaagtggcatatcaagacaaatgaggttaagaagctgggacaaaagtaattttgtcccagtcactatttgtgtaatcacgattattaccgagtcgaaacgtgagataaaaggcaacttccggccgtacaaccggattatcccaatattcaagcccggaatattcggataatccagttgtactctggaagttaaccgccttttgtctcactctgtcttttttgatttccaatgataataaactttaaatggaaatttcatatttgtttatctggctgaaacgaaacggctagttattctggtgagcaatttttgctgaaaccgcactggcaatcgcacccacaatatcgtcaataaacgtgtttgaggtgccgtctttagcttcgtccaactgtttcacaattccggacttgtcgcgatcgatatagccgtaattagtgacaccaattgtgccatagatgttggcaatgtttaatgcaattccttcgtcgacgccgaaaacgccagagtcattcatgataatactttcaaggggttcttttaataatccctgagtagccagtcggtctaattcaagaccaaccatcgcgttattcagaacttctcgcttatgcaggacatctgtggtggccttgcgggcttcgtccattgtgatgtcgggaataaattgttgctgcatcttgaatgctaatttagaaatatcttcgggtgtgacaccacgttcttctaatgcactaatgacaaagttataggcagcagtatctggaaacttaaagtttttattgttcatgactgattttcctttcttaattgataatgattaattaattggttctcctacttcaagtgtagcgatttggaagtagaatggccaagtttaaggcttctttaatctaagattttcttgagagtgatgtgcaattaacttccattttagattgttacttagtaataggtgtcatgataataaaagagaccgaggcaaattcatttatttgtctcggcctcttttattatcatgacattgcgataacgtcctaagtgatttagacacctgatttttaatgtttaaaaattatagtagatattttttgtcgatatcggggtcttgggatgttaggatctttggaccatctttagtgattgccaaagtatgctcgtattgagcggatggggttccatctgctgaaacatagtaggtccaatcatcagctttatcatagcgatctttaatttcccaagtaccagtgttaaccattggctcaatggtgatagtcatgccttctttaagccggagaccgtgaccgggaacaccatatgccggaacgtttggttcttcatgaattgatggttgaataccatgaccaatgagttcacggacatcgcccatgtgattttcgtcttccacataagtttggatggcggcaccaatatcaccaagacgattaccgatgacagcttggtcaatgcctaaatagaggcccttgcgagtgacatccattaacttcttgatttcgggtttgacttcgccaactgcgtaggtccagcaagaatcactttcgaagccatccttgttaacgcacatatcaactttaagcacatcaccgttttgtaaggctagtcctttacgaggaataccatgagcgacttcatcgttgatggaaatacaagtcgcaaacttgtagccgtcaaagcccatttctgaaggataagcgtcatgatccttaataaatttacgagcaaacatttcgatgtcccaagtatctagaccgggtttgatgattttgcggagtgccttatgaacaccagccaaaactgcaccagactcagccattttttcaatttcacgtggtgatttaattgtaatcaattatttttgctcccttaaaaatatttttattaattctaacacttatttatcatactactaatttttagcataaacgaaaaaggcctcgagcaaaacggcagttctgtctcaaccttgataaccaacattggccccaattaggggggcagcgagctggattcagcgcaaaaggctattagacccagcaatttgacacaacaaattcatggatcacttacgcttcatcaataattcccttctggagtgcctccagaattaatttgacctcggtaatttttgaatcgaccaagtattccattgtttcatttttatcctttttagctgaactcatttgatcattaagaaacttaagctgatcgtgcaagtattcggttaatttcatatcaatcacctcacaggtcctctataactatattatatatcattactggcaagttgccattaatatctaccctggcgactagtttacatgctttatagccaaaatagcaattgatttgtttacacattagaattattctaaagtatggaggcgatttgatatggtaaataatatttggttacgttggttctttgttctattttatattgtcatgtttgtgttactttaccttggcagcagcatgattgtcatgtacatgatggtgattggaatgttgggggaagcgctggtcagtttactgcagtattacgaaaagaaatgacaacctcggctgacgaatgaactaaagcgttacataatgagtttcggttgttgcttaagcttgtcgctcggaaataaattaggctaaaagtttaagcaaacatcgaaagtgacatacaattgaactgtaagtaattcttggggaagaagggatgttacatggtaaagaataaaatagatactccggcactttacgtaaatccagaccgtagtgttgccgtgatcgattacagcaaaaaatttgttaaaaatgcttttcaacttgctaatagtgatgagtttcgccaattagcagcgttatatttggacaatgacagttatcacaatacgccttctgaatttagccaagtgtcagttggcgactttatgaatacgatgaaggatattttaatagaccggatggctgatttaaagtatcctgttcgggatattttagatacggtaaaagatttctatgccttttatcgatcattgttacgggtttcaacgattaatatgcatcaaaatgatattgttgccaataactttatgaatattgacaatcattttaatgaattggttcttgagctctatcgtaacgttgaggaaaaattgcagggacatgccaatcatctttatcgacaggtcaacgcggggaccaacgcttgtattttgacgcaaacaattaaatggcctgttccggatatttatgaaaagttggctggcattcagtttattgatacattaatggttcggccaccaatgatggtgcatactaagagcaataagcgtgagggaacctttagtgagacccggcaaaatccaattgataattttactggtcatcgtgacagctggtactgttaccctgcctgggtcggcgaaagcttagcttatatttactttgaccgtgattactttgccaatgggatcgcacttggtaatctgtttcatttagcagatcggcaaacggttcagggacgcaaaccggacattattttattgtttggttccaagggagcggaatctgataacgacgatggctgtcactattattatgatgaccagaatcatatttatgttggtcaagtaccttataatgacaagacaacttattttggctacatgaagaagatggtattaacgttgcataatcttcacatgattaacgtgcataagctgccaattcatggttctatggttaatattgcgttctcaaacggtaaaacaaaatcggttgtcttctttggcgatagtggtgccggtaaatctgaagcaattgaagcacttcaggaggttgccaacgacaaaattatcagtattgaaacgatctttgatgacatgggtagttttacattaaccaaagatggtaatgatatttatgcgcaaggaacggaaacaggtgcctttgtccgtttggatgatctgagttcggaagttgctttcagtaatatggatttgggaatttatatgaatccggagttatccaatgcccgatgcattattccggctaacagttatgaggaaatcatcaagcatcatccagttgacatgtggctttatgccaataattacgattcagatattggggttcaccggtttgaagacgaagatgcggccaaggatgtctttgtttcaggtaagcgaaaagcactgggaacaacggacgaagttggcatgagtacgacgttcttcgctaacccgtttggtccggttcaacggcaaaaggatacgcagccaatcattgataaagtcttccacacaatgtttaagaagggaacatttgtcggtgaaatctatacccacctgggtaatgacaagaagaagtcgagtttaaacaaatcggcggagaagttgttggaactgatgatgaagtaaagagtgctcaagcaaacggttagctcccagaatataagcccccaattccaatatccctgattttgggatgttggaattgggggcttatatggccgggagctgtttgcttgagcacgtttcggcaaaataaccagtccatttagcttggaagcatcaaagaccattggcttatatggccggagactgcttggctcagcacgtttcggcatggcagccagattggttttggggcatggccgttaagccgcttgtgccagtccatttggtttggaaatattactattttaggctcaagtgctactgacatcgaaacattgaacttgggcaaagtttcaagcttataattgcaaaggctagagcagcttcctggccatataaaacaggatccagtcagaaactgacaaaatcagcttctgactggatccttgttttgttacgttgatagttaaacgccttttatcccgcgcatactttagtaaagctactaatgtcgtgcgttttctgcttgatcgatcttttgatattcctcatcttttttcttcaattgctcatctttggcctttaaatcaaatacccgccaacaaaccaacgcaattgtccaagttaatgcaaataagcaaaccaataaaatacctaaaatattgaaattcaaagcctgggcccatttgatgatggttgaatgccaatgtagttctgtcccgagtgcctgtaaaacatcaacaataccaacaaagaaggcggcagttactgataatccggttaaagctaaattatagtagactttccggaacggggatgagaagacccaactataagcagtactcatgaacaaaccatcgctggtatccattaagcacatcccagcagtaaataaaattggaaatgaaaaaacagcaaaccaaggaacccctttactggttgcgacggccgaagtggccagaaccgcaatttgagttgcggtatcaaatcccagcccaaacaggaaaccaacacaaatgacctgccagctgtgattgattaagtttaaactctttttgaatattcgaaaaattcgggtgtttgtcgaagcatttgcctgcttaaaatcgccggaattgatcgccttaaacgatttccaaatgccaactagaatcagtaggttgattgatcccaacaagagcaacatgaatccggcaaacaatgtaccaaaaacaccgccgaggtcctgtagtttaggtaattgattttttgaccattcaacgaagaaaatggtaatcaacgccatgatgaccacgactaaagaatgccccagtgagaaataaaaaccaacgccatgggtgtttttgccgtcattaacaagttttctggtcatgttgtcaattgccgtaatatggtcaacgtcaaaggcgtgctgcagaccaaaagtgaacgataagaaggccatcgccaatagtgatgggtaacgggtcaagtacgataaaaccagcgcccagccggcgataaataatactaaaatataagttccaaatttaagaatatccggccgaagcgcatagtgatgttgaagattagcttccaaaataattacctccacaaattttttagtaacttgtggttaacaataactaagagaaaaaccgactgattgatcttattcagcattgcgttgttgcatcactcttagttttgataattaatattccctttagtacagacgttacgatcacgtttggttgaaaagtttattaattaacaaagtcagccctaagaaactttgttattaagctattgttcatatcctgacttgatttcgactgacagcctacattttcccagttacccagtgattgtcgtagcgtcatccatcatgcagtacaagagactgtaaaggatttgaaccctttttcgaaccaataacctttttacttaacggggagagactaacacaggaatttgtgactattttattgtgataaaaggcgcaatgaatactatcctaatggtctttaaatcctcccgttactgtgagtaagactattttgtctgtttgattgtgaaaatacgctaaatttagcgtattttcgtaaaagttgggtataaaaatagcacaaaacgagaataaagtgggctccgacaattcaaattaactttaaaagatggtgacaaagttggaaaaatcaattgaaacaaaaaaacgggcagttggcattgcagttttatcggcattattgtatgcgttttatccaccggttgcaaaaatgctattacatcattgtccaccaattattttagtggcgctcctttatttaggaaccgggattggcatgctcattatattccctattatttcttggctttctccaaagaagcatcatgagcaatcgattcagaaaagcgatggattaacattggtgggggtcattgttgcaaacattattgcaggaattttaatgaacttgggaattgaatattcgagtgctgccagtgcttcattacttggaaattttgaagttgttgccacaacccttttagcagcagctttatttcatgaaccggttagcaggaagctatggcttgcagtcggcgttgtttttgtggccagctgtttattgagtattcgcaattttgaaaaattcacaatttcatggggcgcaattctggttattttggcaactttttgctgggggatggagaataattttacgaaggtattgtcaaaacgtgatcccctccaggttgtcatagttaaggggttgggagttggtgtcggaagcctgttgatttcggtattgagccatgaaaactggccatcattaaaaacaatactcattgcaggggtattggggtttgtttcgtttggcctcagcatattcttctatattcttgcacaacgctatattggggctgccaagactagtgcttactatgcaattgcaccatttctttcagtaattttagcaattgtctttttgggagaaacaattacctttcaatttatcattgcgttaagtctcatgattattggcagttatttggtcactgtggccaattgatcaagcgaaaattaagtagaacaactatgaattgattcaaaaatggattaagttgtcgcggatagacgacaacgaggcaggtatttttaattcatctgtaaagaagtagacatagtgaaatcttgataattcagcaatgtaatcggtaccattttgacatttgttaattttttgctttcacactcaacattcatgtcatttttaatggtaatactatgaaaatagtcctaagcgaccatgctaaaataaaagcgttaattgtgatttaacaaactaatcaaaggtgggtgacatgtatgcatggttttattggtgagttttttggcacaatgattctaattttattcggtgccggtacaggtgctggattaaatttgaaaaaaacatatgccaaagggtcagattggacgtttgtgtgcctctcatggggtatcgctgttactatgggagtttacgtggcaggttctctagggtctgatggtcatttgaacccagccgttacaattccatttgcaatttttggattcttcccatggtctgatgtgctgccatacttggcaggtcaatttttaggagcgtttgttggggccacaattgttgcgattcaatttgctccacatttcaaacaaacgccagatgcgcaatcgggtaatgttgttggaatctttgcaacaatgccggcaattaaaaatccattatttaatttcctgtcagaaatattcgcaacgtttgcttttatttttgttcttctgaatctcggcaattttactgttggtttaaaaccatttattgttggaactttgatcttcgttgtcggaactggtcttggaacgaccaccgggtttgcgatcaatccagcccgggactggggaccgcggcttgcttatacgctgctgccgattccaaataaaaccagtgcccattgggaatattcatgggtcccaatgtttggtccactaattggtggttcaattgctgcatgtttgcagttctttatcaaataaattttgtttgataatgatgaagtccttacttgaggttaattatccaagaacaatcgcaaggctttttaactagatccttggggtaaagaatttagtttgaccatcgagtttaaacaaatcaaatgaaaaagcacgttgcattgcgcccgtttctcagacgttgtgcgacgtgcttttttggtggggtaattgttaccgggtttacccgtttttgagaagattttcaccagagtgggccggggtctgcttgctggcgcacgttttcactcggtaaatcaacaaattattactgagataaaacgtgaaacagagaggcagctcccgaccgtataattattaccaagataaaacgtggtgtgaaaggcagcttccggccatgtaagggacttatcccaatattcaggatcagaatattaggataagtcccttacattctggaagctaaccgcctttcgcaccactctgctacctgaatattcgccgactatttcgatactgcacatccggttttccctccaagaagttagcgtatcttgccgcagcgaagaaataatccgatagtcggttaataaagactagaacctttgaattgatttcagcctttccctgcaatgtcacgatccgacgctctgttcgtcttgtcactgttcgatcaacgtgcaatgcggctgctgttgctgttcctcctggaaggataaatttatcgacttggggcacaaccttggtgtattcgtctatccggctttccagccattttaaaggatctaagtctctgccaaaaataaagggtcgtttggcattgtcgccaggattggcaagatcgtttccggcatcaaaaagtagttgttggatttcttctaattctggctgcaatttggccgtcttttcagtaagggttgtaatggtgaagccgacctgagagttgagttcatcaaccgatccatatgcctcaacccgatcatcatctttgctcacgatgtgcttgttgatgatccgtgtttggcctttatcaccagttttagtatatattttcacgagtatgcctccgcctttcattttgaaatcattttaaattcattgtacagagattgattagaacaaaactattaaaaaatgacgtgcgatttcttagatgaaaaatcaattgattattgacaaaaatttgacggttaaagcgtctaaaagtcaaaattgtagtattagaggcgcattatcttgtgattacgcattgatattgtcgaatcagcactaattccggacgatcgtagcccgtatgctaagaacacccaagagaacgaatccccgaggtatcataattccgcttgtattcttaccaagcgagttaaaagtcggtcgccacaattttgcacgaattaagtaatgtataaacaaaattgttgaatccttcactaagtattgaaaccggtgtcaataatacgttaatctttttactggagcttggcagtgctgttttagctgacgagtagcacaggacatgttctgaatacatccttttaggcttcttaaatttttgaaatgaaggtgtcacaatgactcaatcacttagattaaagcgactgacactggtcgcagttttactggcgttgtgtgtggtgggggctaatgtcaagatcatgggctcgattgcctttgattccgcgccggctttcctgggggcaattttacttggtccgattgatggtgcgtttttaggcttttttgggcatatggtttcagctgcattatcgggatttccattgacactgccgattcatttagtgattgctgtaatgatggccatctgcatgtttgcctttggttggattcggaaacgatttggccgcagtcgcttggcaacaatcgttatttcagacatcgtcggctatttgattaatgtcccccttgagattgcaccgttgtacttgatgatgaatgctgccatttttgccttttttattccgctgacaattgcgactgtgcttaatttagttgtttgtgaattggtttatgcattcttgccacagtcgattaagactaagccgtatttaaggagtgaaataaaatgaaagtcattcatggtggaaatcgtgaggaaattagccgaaaaacaggcgtcgatgctgatgaattaattgattttagtgccaacattaatccgcttggcctatcttcaaagttggcacgagttatccaacaagccattccggacgtgatttattatcctaatcccaagtatcccgaattgaagcacgccatcgcgagccattatgaggtgaatgatgatgacgtcttcgtcggcaacggggcagttcaaatgatttttgacactgcagttgcccttaaatctaaaacggctttggttttagctccgacatttggcgaatatgaacggtcattgtcccgggctggtgctaaggtcgagcattacatcctaagcccaattaataactttcaagtcaatgttgatcatttactggactacttgatggatcatccccaaatcgacttgatttgtctgtgtaatcctaataatccaactgggcaagttatcgcacccgaaaaagtgcagcggttagcaaaatattgtcgaactcatcaaatttggttgattttggatgaagcatttatggattttgttgctgaagattcattgagttatttacatttattagatccaagtgatccggttatcattattcgttccgcaactaaattctttgcgattccgggcttacggcttggatttgcaatgacaaaaaatgaatcgttaaagcagcaattgagtacgcagtccgaaccgtggtcggtcaatacacttgcccaaaaatttggtgaacatatgtatgaagatcaggcttacattgaccgaacttatgactggttgcaacaggaaaaggactatctatatcaacaactacagatgattccgtatttaagtgtttatccatcaaaagttaattactacctattaaaaagtaaggtgccaaatttacgtgagaaactatggccgctaaaaattatgattcgtgattgttccgactactacgaattaggatccaaatattatcgcgtggctgttcgatcacatcaggaaaacgaacagttaatcgcggcgctgaaaaagctgactgccaatgtgttgtaagttaaagaggtgtttcgatgaagaaaattttaattgcaggagttaccagtggctctggcaaaaccagtgtcacgctgggaattcttaaagcgttaagtgatcgctatcaaattcaggcttacaaagtgggtcccgattacgttgataccaaatttcatacaagaatcaccggtcgacaatcccgaaacattgacagttttcttgtccccgatacgaaagcattggattacctattcagccgcggcaccgaaacccttgatttagggattgttgaaggtgtgatggggctatacgacgggctcgggactgataaggacgctcattcaacagccagtattgccaagaagctgcatattccagtaattttggtcgtaaacggtcgggcagcatcaacatcggtcgccgccattatcaaagggtttacggaatttgatcccaaagtgccgattgtcggtacgattatcaataacgtgatgagtcgcaatcattatcaactcattaagggagccatcgatcgttacgttggcttaccggtgcttgggtatttaccttaccgtaaggaagtggctttgccatcgcgccaattaggattagttcccgataacgaactgccggctgttgatcataaaattgagttgctgggcgaaatggcaaaacaggatattgatctcgcgaagatcgttaaaatggctgctgacaacaccattcccgatcaaccgccatttagtccacagccggttcatttaaaattaggggtggcgatggatgacgcgtttagcttttattatgaggataatttgcacttattaaaggccgctggggttcagctcagttattttagcccaattaaggatcatgaattgcctgatgttgacgcgctttatcttggcggtggttatccggaagaatttgccgatcaattggctgccaataccgaaatgaaagccgcaattcggcggttttcagagaccggcaagcccatttatgccgaatgtggtggcttgatgtatcttggccgaacattgacaactcatgataaccgttatgaaatggttggcatctttaacggtgacagtcaaatgacccctcgtttaaagaagtttggttattgcctggcaattcctaatcaagacgttattcttggcaggcggggagcagaaattgccggccatgaatttcatcattcaatttttgtcccacgggacaaccaattgaagccggttctaactttgaaaaaagttcgggatggtaaagtggctgatcagtggcagggaggatatcaagtgaagcgaaccttcgcaagttatctccatgttcatttttatcaaaatccagccttatttgatcagttgatgaagaatttaggggcgaatgcgtatgcagtggattagtatgattgtctgtggctttgttttagatctactacttggtgatcctccccgctggcctcatccagtcaaagccatcggtcatctgattgcctggctgacaaagtggtttaaccatccagcttattctgctgcgtgccggcgagttttaggtgctgtcatgtggctgataacggttggcatcgcttggggcatcgttgccggtttgatgtggttgaccagtgggattgtttggctgaattttgtcattggaacttacttttgttacacctgtttatcaattaagggattggcgattgcaagcaatggtatcatcaagagtttacgccaccaagatctgtctgaagcccggaaacaagttgggatgattgttggtcgggatactgaacaattatctggtgagtcggtttgtaaagccacgattgaaacagttgcagagaacaccagtgatggtgtgatcgcaccgctgatgtatctgatgattggtggaccggcattgggaatggcctataaggcagtcaatactctggattcaatggtgggatataaaaatgagcaatatggcgacattggattggttcctgcaaaactggacgatctttttaattatattccagctcggttaacatgggcctttctcatgctggcaactgttctactggggtatgacgttcgtgacgcatttgaaattgggacccgtgatcgtgaaaatcatcgaagtcccaacagtggtttttcggaatcggtcgttgccggcgcccttaacttacgactgggtggccctcattactactttggtgagctggtaaccaaaccctttattggtaatcaaaatgcgaatgcagccaccaccgttgatattcaaaagacaatcaaaatgctttatttgacatctgtaattggactcattatttttgcagcgtgccgaggaacaatcatgattataggaggctttggctaatggccgatgaacattacattacaattccaaataagattacagataaaagctttgaaatgattcaggatgaaatcgatcaaattgatccaaattttcaatttaattctccaattgaagaagccattattaaacgggcaattcatacaacggcagactttgattacttaaagaatttaaaatttcatggggatgccattgaaaaaattgcccatgtcatgatgaaccacggcacgattattacggatacaacaatggcgctggcaggtattaataagcgtaaattggatgcgattggctgtcactatcactgttatattcgggatccggaaacctttgccttggccaaggagcaacaaataacccgttcaatggctgccatcgagattgctgccaaagtaccaaccgaaaaggtctttgtaatcggcaatgccccaacggcgttatacaaaattctggaaatggttaaagaaaatcgattggatccggaagcagtgattggagtgccagtgggctttgttgaagcggccgaaagtaaacaggcattgtatgagagtgacattccggccattgtggctttgggccgcaagggcggcagcaatttggccgcggcactgaccaatgccattttatataacttgaacatagcagagtaaggcggtgcagaaacgtgtcagaagatgattatgtttattataacggtcgaaagttgcgcaaaggttatacaaccgggacaacggcaacggccgcatcagttgcggcaactaaggcaattttaaatcaggagcttcaaactgatgtttcggttcatgcggccaatggtcaaaaggttcagtttgaaattcataactgttcgtttgatgaccagaaagccagcgtcgcgattacaaaagatggtggcgatgatcaggatgcaactgatgggatgctgatttattcaaccgtccaattaagaaatgataatcaaatcactttggatggcggtaagggaatcggtcgggtaactgaggaagggttagccaatcaaccagggatggccgcgattaatccaacgccacggaagatgattaagcaaagcgttcgccgggttttagggccggataagggtgctgatattgtgatttcggcacctgagggtgaaaaagtcgctaaattaacttataaccccaagctaggcattgttggcggtatttcaattttaggaactagtggcatcgtgacgccgatgtccgaagagagttggaagcattccatttcaattgagatgaatattcaccggaaacgtggtgacgagtcgatcgtgttaacccccggtgatatgggtgaagattttgctaaaaatgaacttcagattccagttgccaaacaggttcaaatgagtaattttgtcggttatgtgttaaaagaagttcaacgattaggatttcataaagtgttgattgttggcgacatgggcaaactgattaaagtatctggtggtattttctcaactcatagtaaggatgccgatgcgagagctgagattatggttgccaatctggcgttaatgggtgcgccaaccgatctgttgaagaaggtttataactgcttgaccaccatttcaatgattaagttgattaatgaagccggctaccaaaaggtttatcaaataattgccgacaagatcaagttgcgatcggagaagttgcttgctcatcgaaagcccacggttgagatcgatgcggttgtcttttccagtaaggttggtttattagcggctacccagccgattaaagaaattgaggcgcaatggcaatgataactgttttgggaattggaccgggaagtgatgatttaatgctgagcggttatcaacgatatctcgatcaagctgatttggtcatcggctcaaagcgacaacttgggttatttgaaattgacgattcaaagcaaaaactgttacctaaattgagtcgacttcgggaatttctgcaggccaacctgaatcgccggattgtgcttttggcatccggagatccgctgctctatggcattggtaactgggcaatcacaaactttggcagcgaacatgtcaaagtggtccctggtatcagctcgattcaatatttgtttaatcaattgggcctgtcaatgaacgatacctacttaaccagtagtcatggccggcaacccgattttgattttttgctggctcaccaaacagttgggatggtgactgatcaagtgattgggccttatcagattgctcaagaaatcaagaagcgtggtcagcaccgccgaatctatgtcggagaattgttgagctatccagaagaaaagattagtacctacacagaagcaacggtggaaaaccgagactatcaaatgaatgcggtgattattacaaatgcgtgatgaagactttttacgaacaaaagtgccaatgactaagtcagaagttcgggcgattagtttagataaattaaatttgcaggggaaaaattccctgctggacgtcggggcaggaaccggcagcgtgagtttacaagctgcccttgagtttcctgacttacaggtcatatcgattgaacaaaaggatgccgccattgacatcatgactcagaacatggtgcattttcacaccggcaatattaatttattgaaagggacggctccagaagacattccagaccacttatatgacgcaatttttgttggtggtagtggtgccaatctggatgccattattgatttttcactggctcatttaaacgcaagcggttcgctggttttaaattttatcttgaatgagaatgccatgacggcttatcaatatttggcagctaagtcgatcacaaatttagaaatgattcaagtggctgtttccaaatggcacggactgggtaaaggacattattttaagcctcagaacccaacgatgattattagctgtcaaaaaaactaaaggagaaataatatgacaattgtaagttttgtaggtgctggacctggcgataaagacctcattacattaaaggggtaccgccggttagctgatgctgatgtggtaatttatgcgggttcactggttaatccggaattattggactattgcaaagctggcgccaagttatccgatagtaagggaatgactcttggccagatcattgacgagatggttgaatcgactaaagccaataaaaaggtcgttcggcttcaaaccggtgatttttcaatttatggatcgatccgtgaacagattgaagagttaaagaaacggtcaattgactacgaatgcatccccggtgtgagttcgtttttgggtgctgcttcgcaaatgggcgtggagtataccgttcctgaagttgcgcagagtgtcattattacccgaatggctggccggaccccggttcctgacagtgaatccttaagatcattagctgctcacaaaacgtcaatggtgatttttctttcggttcaaggaattcgcaaagtggtccgtgaattaatcgccggtgggtacaccgatgaaacacctgctgccgttatttacaaggcaacctggcctgatgaaaagatggttaaaggaaccttgggcgacattgccgataaagtgaagaaggctggtatttctcggacagcgctcatcatggtgggtgaattcttgggtgatgaatatacctattccaagctgtatgatgccagctttacccacacgtatcgcaagggcgttaaaaatgccaagtagttcagccaatcaggtttcagtaattgcgctcacacaaattggcgcagtgttagctcggaaaatccagggtcaattaccgattagtcaactggtcctgcctgaaaaatatgccgttgatgatgagcaaagtttcggtcgtggccaatttaaagcaatttgtcaaatgttattcaaaacgtcagatgttgtgatttgtattatggcaactgggattgttgttcggacgattgcaccgattatcaaagataaaaccgtcgatccggccgttttagtcattgatgaacgggcaaatcatgtgatcagtttattatctggtcacgttggtggtgctaatgcttggaccaaccgaattgcgaaattggttaaagccgatccggtaattacgactgccaccgataccgaacatgttcaagcgttagatacactcgcccaacggtttgatggctggtatccggattttaaatatgcgaccaaattaattaatggtcggttagctgctggtgatcgggttaatatttatatcgattcggattttcgcggtattgtgactgacctaacgggattcaccgaaatcaacgaggttgcggatgaccaatccgacgtaccactggtgattatttcagataaaaccggatatcccaaacgtcaaaacagcattcaggttatccccagagttaacgtacttggcgttggctgtcgtaaaggcatcccttatgacgccatgcaggcggcgtttgtggcattttgccaacaacacgggctcacttggcggtcattttatcaagtgggttcgattactaaaaagcaacatgaaaatgccatccattatttggctgccactttgaatattccggttaaattttattcagctgataacctgcaaacagtagctgaccattattcgcaatccgcttttgtaaagaaaacggttggtgtcggtaacgttgccaacacggcagctgagcttgcttccggcagtcggacgttcactgatcgatttgcaaccgatgaagtaacgttggcggctagtcgaaaaaaattgaaagtagatgattcttaaatgttatacattgttggattaggtcccggttcaaaagatatgatgacccaggaagctctggatgtgatcaagaaggtaccaatcattgttggctatattacctatattcatttaattccggatttgttggaaggaaaagaaattgtcactaccgggatgcgtggtgaggttgaacggtcacagaaggccattgaaattgcggccagtggcaaggatgtcgcaatcatttccagtggcgatgccggtatctatggtatggctggattagttcttgagatggcttctaagatggatcaacacattgacgtgcgggtggttcccggcgttaccgccagcattggggctgccgctgccttgggggcaccattaatgaatgatttctgccacattagtttgagtgatttgatgacgccgtgggacgtgatcaagcaacgggttgatgccgcagccaaagcagattttgtaatttgtctgtataacccacgtagtaaggggcggccgcataatttgcgcgaagctttagatattattttgaaatataaatccgatcaaacagtggttgggattggcaaaaatgtgggtcgttcccatgaaatcgaaaaaattacgaccatcaaagatttggatgaaacagaaattaacatgacgactatcgtgattgttggtaataaaaatacttacgttgcggacggccgaatgattacgccaagagggtatacattatgatcttgttattgggaggaaccagtgaaagtttagaaattgccgattatctgaacagttacgaccttccatttatcctttcggtcacaacagattacggtgccgatttggcgcatcaacacgcgaaatacgtatcggaagggcctctcttaccagatcaatttcatgctttctttaagaaatatcaaatcgatttgattattgatgccacccatccctttgcccggatgatttcaactcatattatccaagccgctcaggaacaaatgatccgatatattcggtttgagcgaccggatagtttaccgagaagtccatatcttgagttaatgcccgacttggatcatgttgttgattatcttaagaaaagaacggggatcgtttatttatcgactgggagcaagacagcaccggaatatgcggcaaggttgggtgttgaacgacttcatgttcgagtattgcccacaacgcgggtcatgacgttattaaccaaggctggttttgaagctaatcagattgatgccattcaagggccattttcaaccgccctaaatgttgaattgattaagcgaacgaacgctgtggcagttgtgaccaaggaaagtgggcgcgctggtggtgttcaggaaaagattgccgccagtcaacaattaaagattccctgccttgtgattaaacgaccggcaattgcctatcctgaagtagtttcaacgattaaggaattggatcatcagcttgaaataaattggaggtagcaaaatgagtggatttgtatcgttagtcggtgccggacccggcaatccagaattattaacgttgcttggaaagcgtcgtctgcaggaagccgatgttgtggtttatgatcggttggttaatccagcattgttatcgcctttgatggttgaaaaaattgatgttggtaaattaccgcatcatcataaatttagccaatatcaaatcaatgatttattggttaagcttgcccgggaaggtaaacgggtcgtccgtctaaaggccggtgatccttatgttttcggccggggtggcgaggaaagccaatatcttcgagaacgaaatgttgcgtttgaagtggttcccggcattaccagtgcaattgccggattaggggcagcgggaattccgattacccatcgggattttgcttcaagctttcacattattacgggtcatcataaagcggctggcaaggaattagattggcaaaacattgctcaccaggaaggaacgattgtctttttgatggggatggaagagttggaacgaattacccagcatctgattgaaaacgggaagtcgccccaaacaccagtggctgttattcaatgggcgacgcattggaaacagcgggcagttaaatctgatttggccaacattagccaagtggtgattgaaaataaaatgagttcgccggcactgattgtagtgggtgatgtggttagcctaatggatgagctttatccgcatctaccccttcaaggtctgcatttactggttccgtttaaggagccgtcacaactatttgccaaattacaggatcaaggggctgccgtaaatttctttgatcgtcgtttaaagatgccattgaagtttgatttaccagatatttctcatggcggcacacttgtcgtaacggattttgctgcctttcatttcttccaacaaacattattagcaagtggttttgatcatcgggcattgttgtactggcagattctgacaactaatcatatggtggatcgaaaattgcgggatgccggtattatttctgacggtaattttgatatggaaaattcacaatatcgagatcctgtcattgttttgggggaacaacaaacgttatcccatttaccggggcattattccgagaaaattgcaacgtaccaagctaagccagttgctcaacagattgacctgacgaattttcatgctgtcatttttcccagttccgcttctgcaagcgatttagttgaagggtgtgatgctgatcagcgacaacggttggtattgatgccgtgttttgcgatggggacaatggttgccgaggaatgtcatcgattaggattagaaaatgtgattgctgttgaaccaacgtttgatgccgttgttaatgcagttgaaaggaagtttcaaaatgaatcgagtcgcagtactagtcgtcagtttcgggacaacatatccccaaacccggcaaaagacaattgaagcaactgagaatgcttttagaacggcatttccaaacactaaagtattccgggccttcacgtctaacgttgtcatttcacggattaaggcccacgaaggccttcaaattgatacaccggaagaagccctggatcgaattaaagatgaaggctttgatacggtttatgttcagtcgctccacatgattccgggaatcgaatatcatcgtttgctgcagcaagttgcgaaagttagggatcgatttagcaaagtagttgttggtaagccaatgttggtttcatataccgattacgtaaaagttattaattttctaagaggggttggcggtacgttggccgataacgaagctgttctatttatgggacatggtacttccgatcgggcatttaccgcgtacgcttgtttggatcacatgctaatggggagtcaacactatttaggagcagttgagagttatccggatattcaattcgaaattaaccgtttaaaaaaagatgggattactcgagttcgcctgcaaccgtttatgctggttgccggcaatcacgcacatcaagatatggcatctgacaaaccgacttcttggaaacgtttattggaagccagtggcattcaagttgatgcccagcttaaggggatgggtgagtacccatttatccagcaacaatttattgaacatcttaagaagcaattgaaggaagtgaagtaaccttatggcaacattttttgggattggtgttggtcccggtgatagtgagctgatgaccgtcaaggcagtccacacgattgaacatctggatattctttatacacctaaggcacacaaatctggaaccagcgttgccgagcagattgcggcaccttattttccggagagcttgatgattaaacggcgtcatttcccaatgaccaatgattgggaagaaaagcggaaaagttggcaagtgattacagacgaaattgtagcagatgttaaagcgggcaagaatgttggctttgtgacactgggtgatccatcggtttacagcacatatagttatttacttgatttgattgatgatcaagttgcggttgaaactattgccggaatttcatcgttctcacaaattgccgctgaagtttccattccactaacgttggatgatgaattattagaaattattcctgcaacagcagatgagcagcagattgccaaggcaattgacgttaacgataatattgtgattatgaagatttcgaccaatttgcccaagatctaccagctactaaaggaacgaaacttgttaaccaaagcgttggtcatttcaaatgcgtcgatggaaaagcaaaaaacgttccggctgtcggaaattagcccggaggataagctaccgtatttttcgacggtgttggtaaaaaggagtgcggacggaagcgtttagatcccagaatataagtgattaattcaaatattcctggtcttggaatgtctgaattaatcacttatatggccgggatctgcttccgggagcacgtttcggcaaagtagccggtaaaatattcctagtcttggaatatttgaattaatcacttatatggccgggatctgctcgctggcgcacgtttcggcaaagtagccggtaaaatattcctagtcttggaatatttgaattaatcacttatatggccgggatctgcttccgggagcacgtttcggcaaagtaaccggtaaaatattcctggttctggaatgtttaaatgatttgcttatatggccgggatctgcttccgggagcacgtttcggcaaagtaaccagtcatattccggttctgaatattaggcttaggtagcttagttcggagatctattttcgaaaacacgcgtttcaatagggaaagcattagggttacaaaagaacatcagtcaaaaaaactgatgtctcaaactaaaggaggaacttctttatgaaggattacatcaaaagacatattcccatgactagcctggttttagggacaattgggttattagatggggcactatacccaacgaccgcccatgcgatgcatatcatggaagggatgttgccgccagtttggtgtattttctggtttgctgtcagcgcaccattcttcatttacggtttgtaccggatgcggaaaatcgttgattcaactcagcaaaatgccaaaattatgttggcactttgtggtgcgtttgtgtttgttctttcatcacttaaaatgccatcagttaccgggtcttgttcacatccaaccggggttggtcttggaacggtgatgtttggtcccggtgtgatgtcggttcttggcgtgattgtgttattatttcaagctttgttacttgctcatggtggtttaacgacccttggggcaaattgtttttcaatgaccattgttgggccatttgttggatttggcgtttggaaattgtgtcgggcatttaaggttaaccggtccgtctcattgttcttatgtgccatgttggctgactggtcaacctatgtcacgacgtcattccaattagcaattgttttcccagatccaagttcaggagttgttggggctgcaattaagttcttggggatttatgccattacgcaaattccattggcgattgctgaaggattcctaaccgtaattgtttataacttagtcattagcaacaacttgtggaaggagaccgctttacaatgaaaaagtcgaaaaccaagcaaaacatcattttattagtattagttattattttggtcatttcaccatttttcattgttaaaaatgggactttttctgggagtgatgatcaaggaaccgaacaaatcaaaaagaatgatccttcctataaagtctgggcccatccgctttggacgccgccctcgggtgaggttgagagtctattatttacagttcaaggaagtcttggaactggcattattgcctacgtaattggcaatgctcgtggtaagaagaaggaacgcgaacgacagcttcgtgaacacgctgaagatgtttcaacaactcagggtcactgaaatcaggtggaaagatgttatcaattgataagtatgcctattcaaatcgaattttaacatggcggccgcaaattaaagggctgatttggttactgggaattgttttggcgtttcaacccattctttggattaaaggggctttgattgttgttgccgttggtcataccttgtatgctgcgcacctttccgtccaccagtatttaaggtggttttatgcaattctaccttttatcctattaagtattattgggattgtttttacaatgtcgactaataagcagatcatttattatcccatccgattatttggttattactttggtgtttcaaaaacgatgttgccagtgggcttacatttaggtgttcaggtttttgcggcggttgtttgtacgtattggtttgccttgacgacaccgtttcaacagatcattattacattgaaatcgtgtcacctgccaaacctgatgattgaagaaattatgctgatgtaccggttcatatttatctttattgaagcatttgaacaaatctatcgtgcacaaaaattacggtttgggtacaaaaatttcagattatcactgcactcatccgcaattttagcgaaaatgctttttgaacaggtgatggttaactatgagcatatggttcatgcgttagacgctaaattgtatgacggcgagtttaaggtataaggaaacgggtgtgccgatgattgaattaaagcatttaaatttttcatacgagaaaaacaaaccaattttaaaggatgtttcgttaaatctgggtgaaccaggggaagacgttgttgggattattggcccaaatggttcgggtaaatcaacgctctttttaaacctcgttggcatgttaaagccgacttccggtaaaattgtcgtggatggtcagcccttgaaatatcataaaaaggctttgaatcaattacggcaaaaaatcgggattgttttccaaaattccgaccaacaaatcttctattcaatcgttaaagatgatattgcgtttgcattgcataatttgggactacccgaagatgaaattaaaaatcgggttgatcgtgtgctcgaagaattagatatcgttagtctcaagaataaacccattcaatatttgagtggtggtcaaaagaaacgggttgccattgccggcattttggttttgcgctcggaatggctgctgcttgatgaaccaaccgccggcttggatcctgatgggactaagcgaatgatttcattaattaagcagctgattggtcgcggacaaaagattattatttccagtcatgatatggattttatgtatgaggtttgtgaccatttttatatcttgcgggatggtcagattgtaaaatccggccgtaaacaggatgtttttttggatgatcaattgttagaatcaagtaaactaacgcaaccctggttagtccggctgcatgataagttacatttaccgttgtacaatacggcggctgaactatttgccgatcaacacttagcggccgaaattgccaatctgaaaaaggataaggagtagcgttatgaaaacgaagtcgatcatgtttcaaggaactgcatccgatgcgggaaaaagttgggtggcagccgggctctgccgaattttgaaaaatcgtgggcttcgagttgctcctttcaagtcgcaaaacatggccctgaactcattcattactaaaaagggtgacgagatggggcgagcacaggtctttcaagctgaagccgcgggggttgatccggatgttcggatgaacccattactactcaaaccgtctacagatcaagattcacaggtagtctttatgggtaaggtattagcgaatatgagtgcagctgaatattatgattacaaaccgcaattgagaagcaaggttcttcaagcctatcgttccctggcagctgaaaatgatgtcatggtcttggaaggggcgggttccccagctgaaataaatttgaatgaccgcgatatcgtcaatatgggaatggctgaaatggcggatgcaccggttattctggtggctgatatcgataaaggtggggtctttgcgtcaatttacggcacaatcaagcttatgccgccagctgatcaaaaacgaatcaagggcattattattaataagtttcgtggagatcagtcactgttggcgtctggtaatcaaatgattgaaaaattgaccggtattccggttattggggtcttaccaatgaccagtattgatttggatgatgaagatagcgtcgtgctttcaagtaagtcgcaagttaagaatcaaaccaaagcacttgatattgcggttatcgcgttacccaagatttctaattttactgattttcacagtttggagattcaatcagatgtttccgtccgttatgttgttaaaccagaagaaattggacggccagatgtgctgattcttccgggaagtaaaaataccaacgaagatatggcttatttaaagaatcggggatttgtcaaacccattcgggcacttcatgaacagggaactcaggtgattggtatctgcggcggctaccagctgcttggaaatcacatggtggacccttatcacgtggagtctgatttgaaatcacagaccgggcttggattattagatgctcaaactgtatttagtaaagaaaaagtaactacccaagcgaccgccaggcatggtaattatgagcttcatggatatgagatccatatgggagaaacaacgttgggacccaatgttgagccgttttcgacgattacatctaataacggtcaggccactgtcaggtctgatggtgcagttagtgctgacgggagtgtttgggggacttatttgcatggactttttgataatgagaattggacccgagatttcttaaatcagcttcgtgaacgaaagggactcaaagcattggcagattcagataacaccattgccaagtataaggaacgtcaatatgaaaaattggcaaacgtatttgagaataatgtggatatgaagaaaattgatgccattcttaagggaagcgtgacgattcatggataatccgtatccggttaatttggacctaactaaaaaagcagttgcggttattggtggcggcaaagtggcggccagaaagattaaggctctggttaatgccaaggcccatgtcaccgtaattagtcccgtacttgacccgaaaattgatcagacaacgattacttggataagaaaagcatacgctgctggagatattcgggatatggatgtcattattgcctgcacaaataatccggcggttaatcaacaggttaccgacgatgccagtcattttcagtgggtcaataataccagtgataaaacgcaatcagatttttataatgtggctcaaattgaaaccgatcaactgttattaaccatttcaaccaaggggcattcaccagcgaccgctaaacatattaagaaggaattattaacgtggttgaaaagccaaaaatggtttggggagggccgataattatgtttatcatatatgtaagtttgaattatcagaaactaccaattgatattcgggaaaagtttgtcttgtcaaaagatgaactggttcaggcaaatcgcttgttgaacgaagaaaagagtatcttggaaaacgtgattttatcaacctgtaaccggactgatgtttatgccgtcgttgatcaaattcataccggccggtattatatcaaacgatttttagcaaactggtttcatatggacttggaccaaattaaccgttgggtcgaaattggcactaaagaagctgctgttacccatttgatgcgtgtttcgacaggcctcgaatcattaattgtcggtgagcctcaaatcttaggccaggttaaagatgcgttctttcttgcccgtgacaaccaaacaacgggggccattttagaccatttgtttaaacaggcgattacattttctaagaagatgcataccgattatcgagttagtgaacttgcccaaacttccggtcaagttggattacatcagattaaacagaccttggaaagtgttgacgggaagcgattggccatcgttggactcggagaagtcggtgatcatgtcttaaaaaatgccagtacgatgggatttggtcaaattttgattcttaatcatcatgattcgaaggctatcgaacaagccggccagtatcctgaaatgattgatgcccgaccttggcggcagttattggcgaccctcaagcaatctgacgcagtggtcatggcaacttcttcaaagcaggcgttgttaagtggtgacgcaattgccaacacatctgctttaaagattatcattgatctaggtgttcctagaaatgttaccaaggctggattgcctgatcatgtcagttattacgatattgatcatattaccgggattattacagaaaacaagattgagaagcaacagatgcttaataagattgcggatcaggttccagctgccgtccaagactttttcgtttggcaaaagcagcttcatgttgtcccggttattcgtcaattgcgagaatcttcactaaatgttgaaaaagtggtttatgatagtttattgaggaaacttcctgatttggatgcccatcagcgaaaagtgattagcaagcatatgaagagtattattaaccagatgatcaagggtcctatcaaggagattaaggagttatcagttcaagatggggccaatgctgatctcagatttttctgtgatatttttggactatcgttcgatgagattatcagccaacaaagatcatcaaaaaaagagaaatctaagcaatcgcaagatgccactagagaggtgcaaaaagtttatgaaaagtgaatttacggttggaacccgaaagagtcaactggcaatggtgcagaccaaattagttgtcgaggctttgcagcaacattttccagatgttaaatttgtgatcaagaagattacgacccaaggtgatcgaaacctgaaggatagtttgcaaaagatcggtggcaagggtgtttttgtgaaagaaattgagcatcaactggaagatcaatcaattgatttcgcggttcatagtctcaaagatgtgatgcctaatttgccggatgatttaacaattggctgtattccaaaacgtaattcaccttttgattgcctaatcacgccgaagccgattaaagcaattacggatttgcctcaaggtgccagaatcggcacaaatagtcttcgtcgccagggacaattattacatcaacgaccagatctggaaatcattccaattcggggtaacgttgaaaccaggattaagaagattgccagcgaacatttagatggtgtcgtacttgccgaggctggattgaatcggctgggagttgacctcgccggactttatcgattaacccttaaaggggtcattttaccggcgaccgggcaaggggcaattgccattgaatgtcgtaaaaatgatccagatactctgcagctattaagcatgattgcagatgagccaacgcggcaaagtgtgttggttgaacgatcgtttttacgacgattaggtggtagttgtaattatccaattggtgcttatgcctaccatgatggtaaccggattcagtttaaaggcttagttgcgtcagctgatggtaaacacttatttgccaagcaccaagcgggtcagccggatgaaactttgggcaccaaagtggctgatttgcttatcagcgaaggtgcgttagacttaattcaataattttagatactaaaaataggaaagaagatattttataatggtaacttttgatcgtcatcgtcgtttacgttccagtgttgcaatgagagatttggttagagaaaatcatctggataaagatgatttgattatgccggtttttgttgacgcaactatcaaagatcgtgaagaaattaaatcaatgccgggtgtctttcggtactcgttagactcaattcttgacgaaattaaaacaattgtggatcttggggtgaaatcaattattatttttggcatcccggatcataaagatgatgttggttccggtgcttgggaggatgacggaattgtccaacaggcaattcgcaagattaaaaaggcttatcccgacttaatcgtgattgcagatacctgcatgtgtgaatatacgtcaactggccactgcgggattgttaaggatcataaagtcttaaatgacgaatctttagtttatcttacggatacggcggtcagccaggtaaaggccggcgccgacattattgcaccatccaatgcaatggacggatttgttgctgcaattcgtgaaggcttggacaagaatggatttaaagaaacaccgatcatgtcatattccgtcaaatatgcctcaagtttctacggtccatttcgggatgcagctgacggtgcgcctaaatttggtgatcggaagggttaccaaatggatccggctaatcgtcttgaagcccttcgtgaagttgccagtgatgaaaaggaaggtgccgattttgtaatggttaaacctgcaatggccttcctggatgtgatgcgtgatgtccgcgaccggactaatttaccattagtggcctacaatgtttccggtgaatatgcaatgattaaagcagctgcccaaaacggttggattaatgaagatcagatcgttaaagaaactttggttggtatgaagcgcgctggtgctgatctcatcattacttattttgccaaggatgcagctaaacgaatgaacgaacaaaggtggtaatcaaatcgtgttaaatttcgaaaagtctaagcaagcgtttaaagaatcaagccaatatatgccgggtggtgttaatagtcccgttcgagcatttaagaatgttggtggcgacccactttttattgaaaaaggggctggctcacatatttttgacattgacggtaatgagtatattgactacgtgttatcatggggtccgttaattttaggccacgctgatccgaaagttgttaaagatttacaggatgctaccacccgtggaaccagttatggtgcaccaactttattggagacagaacttgctaagaaaatccatgaaatcgtgccatcagttgaaatgatgcgaatggtttcatctggtaccgaagcaactatgagtgctattcgtcttgctcgtggttatacacaccgagataaaattgttaagtttgttggtaactatcatggccatagtgattctctgcttgttgatgccggttcaggtgttgcaacgtttaatgttcatgatgctccgggtgttccaaaggacttggcttacgatacattaacggttgcctacaatgatgttgccggcattaagaacgtcttcaaagctcatggggatgaaattgcttgtgtcattgttgaaccaattgccggtaacatgggagttattccgggaacaaaggaatttctgcaaacgctgcgtgacttaaccactgaatcgcattcactattgatttttgatgaagtcatgtcgggctttcgggctgcttatcatggcgcgcaggatctttatcagattaagccggatttaaccacgctcggtaaagttgttggtggcggtttaccggttggtgtctttggtggtcgtcgcgatattatggaatacattacgccggacggcccggtttaccatgccggaactttatctggaaatccattagcgatgactggtgggttgagtacccttgaacaattgaatgatgatttgtacaagcaaatgtttgctcggactgatgaattgacccgggggattaagcaggcagctgatgatcaccacgttcctgttacggttcaccatgtcggaacaatgtggagttacttctttaacaaaggccctgtcaataattttgctgatgttcaaaagagtgatgttgattacttcgcaaaattctttaaagcgctattgcaacacggcgtttatacggcaccgtctcaatttgaaaccaactttatgtccagtaagcatacaaaagaagatattcaaaagacaattgcggcttttaacgcagcttttgatgatgtttctgagggataatagatgaaaaatacacaatttcgcgatctttcgctcatcccgttaagtaatgatgacttattggtgattgcctgcgactgcagcgccggaattggggagaaacaagcggacatggtggcggttgatacggctattatggccgcttattctttgcgggtcccattgatggagttgattagttttggtgctcaaccaattgctgtggttgatacgattggaaatgaaatggtcccaactggaaaacgagcaatcaaaggtattaaaagtgaactggctaaagcctcactttctgggcttccccttaacggtagtactgaggataacatggtcacaaaaacaacttctgttggggtaacggtgattggccggattgctaaaaagaatttgcccagcatcaatagtgacgatttgaccatctttcagttaggaatcccatatgttggtgaaacagttaagcaacatttaaacgatattttttcgtatgacattgttcggcagattaaacgtgatccagctgttattgatatgctgccggtggggtcaaagggcattcaatacgaggcagatcagatggcggctactcacgggttggcccttaagaaaccgactcaatgggatgatgtcaaaatgaaacagtcggctggtccagcgacggttttattagccggcgtcgaaacatcacaggctgataacttccagaagcgatttcaaggacttaagccaattgcacttttagtaaaggaggatgaaaaatgactgccgaaatcatgttagttactggtggggcaaagagtggtaaatcagtctttgcggaacagcagttagcgaatgatcaacgaatttgctacattgccacgggagtcatgactgctccggatcaggaaatgcaattgcggattaaacatcatcaggcacgacgaccggccacatggacaaccgaagaacggtatgaaaatttggcacaattcgtggtcgaccaccgattcgatggctacctattggatgatgccacaatggttgtgacaaatttattttatgaaatgatgagaacgttggcggtaaacgatgcgggatcaattgatgaagccgtggaaaagttggataagaatgcaattgaccaagttcaaaatgaaatttttagtgagtggcaggcgttattaacagctgttaaagaaacggatcagcgaatggttatcgtcacgaacgaaacgggtctgggaattgtcccggcaaataagcaaaccagaattctaagagatatctatgggcaggtaaaccagttaatagccaaggcggctaataaggtctatctggtggtgagtggtattccggtgaaaattaaatagagtgttcaaagaagcggttagattccagaatgtaaggcccctagacctaatattctggttctgaatattaggtctaggggccttacatggccggaatctgcttctttgaacacgtttcggaacgaaaaaaaggcaataaacagcagcccggttctgaatattaggtctaggggccttacatggccgggatctgctccattgagcacgtttcggaaggaagcatcatttgcttttcgcacaaaaatacaagtataggaaagaagaagtgatatgggacaagcgatgatcttgtttgcacagttctttaccagaatttcaattccagttgaaattcctgacgttacaaataaatttaagggtaatattcagtattttacattatttggttttctaattggtgccttggaggcaggctttttttggttgatgagtctcgtctttccagtttggtttgcctgggtggcattctggatttttgatggcattttaactggtggcttccatttagatgcattagcggatacggctgatggccttttttcatcccggaaaccagagcgaatgcatgaaattatgaaagacagccgactggggaccatgggcagtttggcattactttatttctatatgatcgtaattggcgtgggattagtggttgccaatcgactgccgttatggcagatggccggattggttgctgtttcgacaatgatggctaaaaccggtattgcactattattttataagatgctttatgccggcactgggttggcaagcatctggactggggtttcaacttggcgaatcattgttgctcaactcttctcaatcattgtgattggtggtttgttacggattccgggcttaattagttatgttgtggtgttaattttcgtttatttttatcgacgacatattattcatattctgggtggcctgagcggtgatccaattggtgcttgtggcgttttatcacaggcggtctttttattggtttacgcgggtttaactaaggtgatcttatgaaattgttagtgatgcgacatggtgaaacaacttttaatcatcaaaggaagttttatggtaaaaccgacgtctcactagatgaaacgggtgtgaaacaagctgaaattgtttcaaaaaagttgaaaaatgagtcattggacgcaattattcgcagtaatatgcgtcgaacggccgaaacagccaagccaattatcgctgatcatccgaatgctgatttatacgttgattcgggttttgatgagatgtcgtttggtgattgggaagggatggacgcaaatcaaattgaggcggctgatcccaaaaattggcagcggtggcttgatcaaccgtttaaagtagccccgggaaatggtgaatcctatgaaactttcaaagttcgggtgacgcaggcaatgacaaaatattaccagaaattatcacctgccagcacaacgctattgattgcccatttgggaacattaaggacgttgtatcattcatggtttccgagtgaagattattggcaaacaaaatttgaagccggttgttattcggtctttgatttgtcggcagacggtgttgaactgttggcgttaaatgtttaactagggggattggaaaatggctttcttaattacgtatcctgagcaaaaagtaaattcaaaattgcaggatcgtctgcaatcagtcggagcgacaatatactgtccgatgaggctgcttagacccgtttcggtatccaatgccgataaaaagttgattgctgatagtgagtatttagtgattacaagtccattttcattaagcgtttatttgaccaaatttagtcaaattagtccatcagcaactgttattgcgctgagccaaaagatgaaatcacgacttaatgaggccggtattgctaaggttcgtttgcctgaacaggagaatcaacgcagccttgttaagctgttaagagacttatcagataaaaaagtcatttggctgaatggcaatttaatgctagcccactcattgatacctgattcagtgaaaacagttcaaatctatgaaaatacttggaacaaacatttagaacaagtcgcaattaccaagataaggtcgcaccaaatcaaccggattttggtgacgagtccttcaagttatcaacggatcaaggccattcagcaacaaatcccccaatgcttttcaaatgtcagctactatgttttaggaccaagtactggtgaaacaattcagcgggatggtcagcgagttgtcgcaccgataaatgccattgatgttttaaatcaaatgttgaatcgaatggttaacgatgagctaagtgctcgggttaactaattaaataaagcgtccgtgctgattgacattatttaatcacagaatttctttaaagataaaataagactattttgtttttgcttgggggtgggtgccatatttaattggccaatggctgttgaatcgatatgttcagccgagaagtcatttggtgttgcaccaaaacaggcagctcttgaccatataaagtaaattagcccaacttccaaatcgggttgaatttactaccgcgtctaaacgtgctaaagagatagctcccggccatatgaagcaaatcattgtaactttctaaatcgggttggatttgttaccgcgtctaaacgtgctaaaagagacagctcccggccatataagcaaaacacttcaacttttcgaatcaggttggacttattaccgagtctaaacgtgctaaaaaagacagcgcccggccatataaacaaaacaaccgtaacttcctaaaccctggaagttacggttgttttgtttatattctgggagctaagcgtcttttttagcactctacaaattatcatacgaagtaaacacccactgcactaccgacaaaccgttggtactgattgaacttgccggagctgttggttgcttgcaatccaccgtgtagatccagccacgattcccggctgaatcagccaaaccaccgatattattgatataaggataaccgttgactggttgagagaaatagttaatatgattcttcttgaagtatcgggtcgaaacatcaaagattgtatcgttctcatgccatgaaagatctcgacgaatggtataaactttttgaatatcagaattgtggtgtcgatattcggatggggttaaacccgttcgatgtttaaaaattttagtgaagtagctggtctgtgaaaacccgatttgattggaaacatgacaaattggtaactgggttaacgccagtttttcacacgcaatagcaattttttgattattaatatagtcgatgaaattaacgtcgaggacttttttgaaaattcgactcagataagatggcgataagaaaacttcttgtgcaacttcatccagtgaaattgtttgacgaatatttttgccaatatattgaatggcagctgaaagactcttatgcatatcgtcttcactagttgtgaggttctcatcggctgcctttgagtcactgattgaatcgtgatgatttaaactaatctttttttctaacggatcatgccctgacgatgaagccttcaatagggtaccgagatatctgatttgagaaagttggtcggaagccaaagcatcccaaaccgcaactttcatgtttaaatcagggtcaataacctcgttaacaatattttcaagataacttcgtgataaataaatccgttgctgtgacacgtttaccgagttacaaatcacgcacccccaaaatccgtgattaattgtaactgggaaaattgaataaatctctaaagaactaagatcaagattttgttgaatttcagcaggatctgaataaatatggccatcttttaataagttgccatcaagtgtgtaaaacacagtttggatttgagtaattcgtgaaaaggaatcgattgcttctgcaagcgcaccgtaatccttttgttctagtggataagtgagcattaatagtacctccccgtacgattcaaaaaaatcggcatcatcaactatatctgaaaacgctcccaccaacaccaccaattttatgataaaaaagtcacgaattcaagctaaacttgcctattttttggtattattttgtgtttttgtcatattttgtgaaagcgttctcagatattgtgattgcctatcttaacttcatcaagataggataatgaaattcgcttatactgaaagtgttttcaaagacgattaaaacagacttgtgacttccatcacttggctggggattaagtggctttgaaagcaactagacttcaaaacacttaggaggaaacacacatggataacgaacaagaagctttaggtttgattgaaacagaaggtcttgtcgcaaacattgaagcagccgatgcaatggttaaagctgctaatgttcatttaattggacaagaaaaaattggccacggcttagttacggttatggttcgtggtgatgttggtgctgttaaggccgctgttgacgcaggtgtatctgctgctgaaaacattggtgacgttgtttctaactacgtaattcctcgtccacatactgatgttgagggaattcttccaaatccaaaagatttaggtcaagacgctaacaactaatcatttcttcttgtgaaagtaggaaactatgacagttgataaaaacgtattagtgcaaagagtggttaatgagttactaaagagaggcatcaccattaacccagagaatcaaccaaagtcttcgggaggatttcatatgaatgattttttaaattcaactagtgtcgttcctgagttcgttgggactcgaaagatcggagacacgattggaatgtgtattcctagtgtcgatgggatgttacttgataaattacatttaacaaaacgctactccgtacttggcgtcttaagtgctcgttccggtgccggtccacatatcatggcaatggatgaagccgttaagacaacgaatactgaagtcgttgatatcgagcttccacgtgacacaaagggcggcgctggccacggttccttaattataattggtggttatgacccatcagatgttcgccaggcgattcaagttgctttagataatttaagccggacttttggcgatgtttacaatacacctgccggccatttggaattacagtttacggctcgagctgccggtgcttgtcatttagcatttggcgctccggtcggtaaagcttatggcctaatttgtggtgcaccagccggaattggtgttgtaatggctgataccgcaattaaaactgctggtgttaatgtattatcgttcgcatctccaggccatggaaccagcttttcaaacgaagggatggttcatattagtggtgattcaggagctgtccgtcaagccgttatggctggccgagaagtcggtcttaagttgcttagtcaattaggtggaacacctaaaaatgattttccatcatatattaagtaaccgggaggaggaacataattgaaacgtcaaaagagatttgaaaaactagagaaacgtccagttcatttggatggattcgttaaagaatgggatgacgaaggattagttgccatggaaggcaaaaacgatcccaagccaagcgttaaggttgaaaacggagttgttaccgaattagatggtaagaagaaagccgacttcgatttaatcgataaatatattgctgaatatggtttcaacattgataaagctgaagaagttatggcaatggattcaactaagattgctaagatgttagttgatccaaacgtttcccgttcggaaattgttaaattaacaactgcaatgaccccagctaaggcagaagaggttattagtaaattaaactttggtgaaatgattatggctgttcaaaagatgcggccacgtcgaacaccagccacccaatgtcatattaccaacactcgggataatccggttgaaattgccgctgatgctgctgaagcttcactacgtggatttcctgaacaagaaaccacgactgcgattgctcggtacgcacctttaaatgcgatttcaattatggttggttcacaaactggccgtccaggtgttatcacccagtgttcagttgaggaatcagaagaattatcattagggatgcgtggctttacggcctatgctgaaaccatttcagtttatgggaccgatcgagtatttactgatggtgatgatacaccatggtccaaaggattcttagcttcctgttatgcatctcgaggattaaagatgcgatttacttcaggtgccggttcagaagttatgatgggctacacggaaggtaaatcaatgctttatcttgaagcacgatgcattttcattaccaaaggttcaggtgttcaaggccttcaaaatggtggtgttagttgtatcggtatcccaggtgccgtaccaagtggtttgcgtgaagttcttggcgaaaacctcttgtgcatgatgatcgatgtagaatgtgcatccggttgtgaccaagccttctcacattccgatattcgtcggactgaacgaatgattggtcaattcattgctggtactgattacatctcatcaggatacgctgccgaagagaaccgtgataacacatttgccggttcgaatatggatgttcttgactacgatgattattgctcaatggaacgagacctttcaattaacggtgggattgtgccaatccacgaagaagacgccattaagattcgtaacaaaggtgctaaagcaatccaagcagtatttgatggcttaggcttacctaagattacggatgaagaagttgaagctgcaacttatggcagtaactcagatgacatgccaaaacgtgacatggttcaagatatgaaggctgctcaagatttgatggatcgtgggaccacgatttcagacgttatcaaagccttatatgaccatgactttaaggatgttgctgaagctgttcttaagttggcccaacaaaaagtttgtggggattatctacaaacatcagcaatctttgacggcgattggaattgcatctcagcagttaatgatactaatgattacatgggtccaggaacaggttaccgtttgtgggaagacaagccgcaatgggataagatcaaagatattccatgggcaatggatccacaacatatggacttctaatagactgaaaggaggtaagttctgtgagccaagaaattgatgaaacactattaagaaatatcattaaaaacgttattggggaaatgaaggatactgatacgccaatttcatttggtaagaaggattcttctgcaagccacgaatctaatcaacttgcattgcatggagacagctggtttaagtcgggtgatgatccggtttcaaattcatcatctgcgaccgcaacagcaagtgcacccagccagtccacatcaggaaatggtgatattaagagccttgattggttcaagcatgttggggttgcaaaaccaggattatcaaaagatgaagttgttattggggttgcacctgcatttgctgaagtgctaactaagacaatgactaaaatccctcataaagatgtcttacgtcaaattattgccggaattgaagaggaaggtctaaaagcccgggttgttaaagtttaccggacatcagatgtttcatttattgctgatgaggttgataaactttcaggttccggaatcgcagttgctgttcaatcaaagggaactgctattattcaccaaaaggatcaggaacctctaaataacttggaattgttcccacaggcaccagtgattgatttgccaacttatcgggcaatcggtaagaacgcagctcaatatgccaagggattatctccagacccggttccaacagttaatgatcaaatggctcgtgttcaatacactgccttatcatcattgatgcatattgctgaaacaaaacgggtggttgttggtaagcctgccgaagaaattcaagtaacctttaattgaggaggatatgatttatgagcgaagttgatgaattagtttctaaaattctgagtcaactaaataatggtgatagctcacagtcaaccggaacaaccactgcttcatcggtaacaccgacaagtagtcctgcaaattccggtaagacgtttgataagggcgattatccactattcagaaagcacccagatgatgttaaaacgccaacgggcaaagcagtaagtgatattacacttgataacgttgttagcggcaaggttgattctaaagatttacgaattaccgcaaatactttgagacgccaaggcgaaattgctgccagtgccggccgtccagctattcaacgaaactttcaacgagccgctgaactaactaagattccggatgacaaagtgctatctttctataatgcattgcgaccattccgatcaagtaaacaggacttactggatattgctaagcaactccgtgacacctatcacgcaccagtttgtgcaaattggtttgaagaagctgccggtaattacgaaatcagcaagaagttgaagggtgataactagttaggagtttttaatatgaaacgtgtaattggcgttgatattggtaattcctcaactgaagttgcattagctgatgtctcggatactggcgaagtcaatttcattggttctggaattgcggaaacaacgggaatcaaaggaaccaagcaaaatttgattggagtcagaaatgctatcaattcagttttgcggaaaacaaacaccgaaatttctgatgttgacttgatcagaattaacgaagcaacgccggtaattggtgatgttgcaatggaaacaattaccgaaaccgtcattaccgagtcaacgatgattggtcacaatccaggaacccctggtggcattggaacaggttctggttacacaattgaattattaaaactacttcagcaaactgacaagcagcggccatacattgtgattattccaaaggaagttgattttgcggatgcagcacatctgatcaatgcttacgttgctgcaggatatcaaattactgcggcaattctgcaaagtgatgatggggtcctgattgataatcgactcaaacaccgaattccaattgtggatgaagtcagcagaattgacaaagtaccgttaaacatgttggcagccgttgaagttgctgatcaaggcaaagtcatttctcaattgtcaaacccttatggaatcgcaacgttattccatctgacgtctgaagaaacaaagaacattgtgccggttgcccgggcgttaattgggaaccgttcagcggttgttatcaaaacgcctaaaggtgatgtgaaggcacgggttatcccggctggatcaattacgattcagggtgacaagggccggtccaacgtgaatgttgcggctggcgccaatgcgatcatgaaaaaggttaatgaattcaataatattgatgacattaccggggaatccggtacaaacgttggcgggatgcttgaaaaagttcgtcagacaatggccgacctcactgataagcagaataaagatattgccattcaagatttgttagctgttaatacttcggttcctgtcaaagttaaaggtggtctggccggcgagttctcaatggaacaagcggttggaattgcggcgatggtcaaatcagatcatctgcaaatgcaattgattgctaatttaattcaagatcagatgcatgtaccggttgaaattggtggtgctgaagctgaatcggctattcttggcgcgcttacgacacctggaacaactaagccattagcaattcttgatcttggagctggttcaactgatgcttcgatcatcaataaaaaggatgaacgagttgccattcatttggccggtgctggtgatatggtcacgatgatcattaattcagaacttggtttggatgatatttatctggcagaggatattaaacgatatccactggctaaagttgagaatttgttccaacttcgtcatgaagatggttctgttcaattctttgaaaaaccattgccggctaaattatttgctcgggtagttgtcatcaagccagacggttatgagccaattccaggcaaccttggtattgagaaggttaagattgttcgccaaactgctaagaagcgggtctttgtgactaacgctaccagggcgctgcaacatgtcagcccaactggcaacattcgtgacattccatttgttgtcattgttggtggttcggctttggacttcgaaattccacaactggtaactgatgagttgtcacattacaacttggttgctggtcgaggaaatattcgagctatcgaaggaccacggaatgcggttgcaactggattaattctttcatacgcgaatgaggtaagggggtagctcatggcaattcaaaatgatcggcctgcaatttttattgcaattccgaaaaatttaaatggtcagcttcccacaaacttatcgccaatgttaaacggcattgaagaagaacaaattccagttgaattaattacattggattttgatacagccgttcaaagagcttatcaggcttcggttgcatcacgactatcagttggaatctcgtttgatgatcagcacattattgtgcattacaaaaatttaccagctgatcagccgctcttccaagttgcaattgacaacccaaccaacattcgcaaaattggtgcgaatgcagcacggttagttaaaggagtgccatttaagagttaaagataggtgatgtttatggaacaatcaattggatatcttgaaatatccggcctcgcgggtgccatcgttgctgccgataagatgttgaagacagctgccgttcggcttcatggaattgaagaagcaaaaggtagcggttggatgactgtttcgattgttggcgatgttgctgctgttgaagccgctgttgaagaaggtaaggcggctcttggcgatcgggtcattagctccgatgtcattgcccgccctgcagaaggaattagtggtttaggcaagactgatgtgatgaagggcaaacacccaaaagatgatggcccggatgatccgcaaagcccaacggacggtggtaagggcccagatactccgagcgcgccatctgctgggaacggcggcacatcagctaaacatgaactgtcaatttcccagaaaaaagaactggcggtcaaaaaggataatcgaccggctgttcagaaggacactgttactgaaaagccagaggatcaggttgtcacttgtaatctctgtggtgatccaaagtgtccgcgtaaaatcggtgaaccgcataagaaatgtattcattatgaagaactagagaagaaaaaagccaaaaaaggtaaagacgctaaataataggaggaattctcatgaataacgcattaggtatgatcgaaaccaaaggacttgtagcatcaattgaagcagcagatgcaatggtaaaagcagctaacgttgtcttggttggccaagaaaagatcggtagtggattggtaacagttatggtccgtggtgatgttggtgccgttaaggcttcagtagacgccggtgtttcagcagcagaaaatgttggtgaagtgatgacatcgtatgtaatccctcgtccacattcagaagttgaaggaattttaccggacaagaaatagagtgtgatagaaggcgcccagctcccagaatataagtgaatcattcaaacattcccgattctggaatgtttgaatgattcgcttatatggcagggagctgccttctagcacacgtttcggccaggtaaaaagcgagatcatcaaacttccaatcatggcgcatttgaatgattcgcttatatggcagggagctgccttctagcacacgtttcggtcaggtaaaaagcgagatcatcaaacttccaatcatggcgcatttgaatgattcgcttatatggcagggagctgccttctagcacacgtttcggccaggtaaaaagcgaaatcaccaaacattcccgagttgtgtggatgtttaaataattaacctaatctctagctgaacaaagataatagtcgtgatcaggaaagtatttgaggttagagctatctcaaagtgcttaaatgatatttcgcctcacagataaactaagtaaaaggcggttattgatttatggaaattaacgaagaaaaattgcgtctgatcattcggcaagtgattcatgaaatggctgatccgtaccgagtaccgattggtgtttcaaatcaccatattcatttgactaaacatgattttcagacattatttcccggccagacaatgaaagttcgggctcagttaaaacaaccgggcgagtttgcaagtgaacaaacagcaaccgtcattgggccgttgggaacggttcaacatgttcgaatcttagggccttaccggtcccattcacaagttgaaattgcccgttccgaggcgattgcaattggggtggacgcaccgatccgtctctcaggacatttggataataccccgtctgttcagttacaaactaaagatggtactgtgaccgttcaaggagtgattgttgccaaacggcatattcacatgagtttagacgatgctaagcgatttggtgttgccgctggtgatgaagtatcggttgacgttctttcaaatgatcgtcggacgactttccacaacgttgtttgccggccaagaaaagattttgttttggaaatgcatattgataccgatgaggctaatgcagccaacgttaacaatgatacggttggtcatattatcgttgaaaaagacaagtgatgattttttgaataaaggttggtgggcaacgtggatcagattattgaacaagttatggcaaaaatcaggcaacgcgaacaccaatcttacgaagttgattatcgattaaagggtttgccacctgatgaagaagtttatacggatcacgccaacgttgtcataaacgacgttgcgatcggattagtagcggacttgtatcgggctgacacatcgaatccatgggttcagtggatccttcagggaattagctttcaggttaattttacttttcagattagcaaacaaatgattaattttattcccaggaagatgctactgaactggcccattgaatttgtagtcgatgctcgtcatccagtgtttggattttttgggaaatcagtcagccgctccgatctggccgctttgccggatcaatcagttgttgttttaacaccaacacagcggctcacagcagaagctgaggaaatatgccaatataagcagataattaaaaagattaggactgatgaagattgtatatggcaaaagtaatcggaagtgtcgtttccacccagaaggacccttcactgattggccgaaagctgatgattgtgcagcccattgactctgacggtaaaccggttcgtagcgaagaggtcgccgctgatacagtgggtgccggaattggtgagtttgtcctactggtccgtggtgcaggtgcacgaaaggccacttcgaaatacgacgtaaagaatgatgttaacgactgttcaattgtcggaatcatcgattcatttgacaagtaaggagaagggatagtttatggctatttacactaaaggtggcgataaagggtcgacaagcttatttgacggtaagcgagttcgtaaggattctttacaagttgagacatacggaacctttgatgaactaaatgcaaatattagtttagctgataaattctgtattagtaaacgcaataagcaaattttgcagcaggttgaataccggatgttttatcttcaaggagaaattgctacccatgatccagaaaagttccgcgctcaaagtaatatcatttcggacgaggatgttcattttctagagtcggtcattgatgattacacagcgaaactacctaaagtaacaagttttattttgccggggtccagcttggcaggtgcacagttgcatgtttgccggactgtttgccgacgggctgagcgattgttggttgcattcatggcagacaatgaggttcgacccgagttagagagatatgttaaccggctatcggactttatgtacattatggcccgctccgaagatcatgaagactatctgaataaggttgtcagtgaagttgtgcgtcgctataaaaaagcaatggaaggtaagcaataatggacatggataaagaacaaattaatcaagttattcgcgaagttttagcaaataattcagacgatcaattgtttgaacgacacaagatggaaagagtcattgatgcagcagtagcaaaggctgatgaattaaatgttggcgttaccatttgcattatggatattaccaataccgttcagatgttgtatcacatgcgcaatgcaaatttggtaagttcaactctggcccctaaaaaggcttggtcagcgattgctatgaaagaacccacaaaagatatcagtaaagatattcaacctggtgggccattgtatcaaatggaaacgatgctggacggaaagttggtatcgttccctggtggaattccactgaaacacgatgatggcaaaatctttggtgccattggttgtagcggtggtttgattgaacaggatcaagctatttgcgaagcagctgttcgcgaatttatgaaggagcgaaactagaatatgcaagaacaaaacattgaagaagccatcagaagaattttacaagaagaacttactaacgacgctcatagtgactccgatgtttcacattctgccggagcattaggtaacggcatctttgaaaccgttgacgaagcaattgctgcggctaagcaggctgaagaaatttatgttgataaaccaatggcctttcgaaaaaaggttattaaagccatcaaagacggttttggtcctcacattgacgaaattgccaaggccatttatgacgagactggtatgggaaccgttgacgccaaggttgttaaattgaagaatgccttgtacaacacaccgggaccggaagtcttggaaccggatgttgaaacaggcgatggcggcatggtgatgtacgagtacacaccattcggcgttatcggtgcggttggcccaagtaccaatcctgccgaaacggtgatcaacaatgccatcatgatgttgtcgggcggcaatacgatgtattttggtgctcatccgggtgccaagaacattactcgctggatgattgagcatttaaatgaatacgtttataaagcaaccggcattcgtaacctggttgtttcaattgcaacgccttcaattgaatctgttcagcaaatgatgcaccatccagatattgatatgttatcaattaccggtggcccagcagttgttcatcaagccatgatcagtggtaaaaaggcagtagctgccggagctggaaatccacctgcgatggtcgatgcaacagctaatttggatttggcagctcacgatattatcaaatcttgtgggtttgacaataatatcttatgtactgctgaaaaagaagtcattgttgatcaaagtgttaaggatgcattgattgccaagatgcaggaaaagggtgcgtttctcattaaggatccggcagtcgttgacaagattgctaaaatgacgattggcgataatggtgcgccaagtcggaaatttgttgggaaaaccgctacttacattttggatgaagctggtgttaagtataccggcaagccaacagttgttatttttgaagctaaaaaggatcatccattagtcacgacagaaatgcttatgccattattaccaattgtttcctgcccagactttgagagtatcctcaaaacggccgttgaagtagaaggtggtaatcaccatactgcttcaattcattctgaaagtatccgcaatattaatcgggcgggtcaccgaatgaacacatcaatctttgttgtaaacggaccaacgttcgttgcaacaggggtcggtgataacggttattggagcggtgctgcagccctaacgattgcaacaccaaccggtgaaggaacaacgactaccaaaacatttacgcgtcgtcgccgtttcaattcaccagaaggattttcattacgttcatgggaggtttaatttatggaagaaattcgaattccaaccaaagtcttttcaggaaatgatagcttggactggctggaaaaattgtcaaacaagaaaattctgttggtatgtgattcgtttctacctaatacaccaacatttgacacaattaaaagcaaggttgaaggaaataatgaggttacgattttctccgatgtcaaaccagatccaccgctgcataacattatgctgggggttgaacaatttagtaaggttaaacccaatgtcatgattggtattggtggtggttcggcaattgataccggtaaagcgattcggttctttggcgagaaaattgaaaagtatgatattgaacaatttattgctattccgacaacgagcgggacaggttctgaagttaccaacaccagtgttgtttccgatcctgaaaagcatcggaaattcccaatcattgaagactatttgacaccggatattgccttattggatcctcaattggttatgacggcgcctaagagtgtcactgcattctcaggcttggacgttttaacccattcactggaatcattggttgccaaagatgccaacacgatcactgaagcattgtcagaaaaaggcattgatgtcatgacccatctgttggttgaatgttataagcatggtgacaatgaagatgcaagaaaggtcgttcacgaagcgtcatgtgcagccggaattgccttcaataacgctggtttaggaatttgtcattcgctggctcaccaattaggtgccaactttcatgttcctcatggtttagcttgtgccatgttattgccacacgttgttttatacaacgctgaacatgacaagacagccatgcataaatatgcccaggctttcaaaaagacgggctttgttgctcagggaatgggagatcaaattgccgttcgtcgtttagctggtaagatcaagcaaatgatgattgcaatggattgtccattaaccctgaaagcatttggaattgatccggcaactgctgaatcaaagacggaaacagttattgcagatgcaaagaaggatgggacattcccaggaaatcctgttgtgccgtcagatgatgacttgcgcaacatttacaagaaagtaatccgttaacgacaggagtttttctatggctgaaaaaatacttgctatcaatgccggcagttcctctttgaagtttaagctctatctaatgcctgccgaacaggtcttagttagtggcttggtggatcgaatcggccatgatgatgcaatctttacttatcatctcaacggcgacaaacatgaaaccgttcaggcaattgctgatcatttacaagccgttaaattggtcattgaggctttgttgaatagtggtttaattcaagacaaggctgaaattgtcggtgttggtcaccgagtatctcatggtggcagcacctacaccaaatctgtggaaattaacgcagatgtgatgaaacaaattgatagattatcggttctttcaccattgcataatcccgttaatctcgtggggatcaaggcctttgaaacactattgcctgatgctcgcgaagttgcggtatttgatacctcgtttcatagtacaatgcccgcaagtgcttatacgtacgccttacctcatgaattggttgaaaaatatggtattcggcgctatggattccatggccaatcgcatgagtatgtatatagtgaagctttgcgccgatttggtgaaacgcagactagtcagatgatttcctgtcatttgggaaatggtgccagtgtgtgtgccattaaaaatggtgaatcggtaaatacgtcgatggggttcacacccttggctgggttagtgatgggaacacgttccggtgatattgatccgggaattgtgcctttcattgaaaaggaagaacacttaagtgccgaagatgtccgaaaattactgaatagtgattcaggactccaggggatttctggtctttcaaatgatgttcgggatattttggaagctgaaaagcagggcaaccagcgggcaaaattagcgttggcggtctatgttcatcagattctggaatatattggggcttacacaacggatcttggtggtttaaagacgttggtcttcaccgccggagttggtgagcattctgctccaattcgtgaacggatttgcagccggttaggttatttgggtgttaagattgacagtgagaagaatcatcgaaatgactttgaaattcaagcggatgatagccaagtaaaggttttggtgattccgactgatgaagaattagttatttcaagggaaacagtaaaagtgcttgattcttaaaaaatcatagatggaggcttgtaacatggcaagaaatattgaacgttccattcaagagtatgttcctggtaagcaggtgacccttgctcatattgttgccaatccaacggccgatatttacgaaaagttaggaatccaggcgcacaagaacgcgttaggcatcttaacaattacgccgagtgaagcgtcgattatcgccggtgatatttgtacgaaatcaagtaatgtcacgttgggattcatcgacagatttagtggctcggtggtcattgtgggggaagtgtcggaggtggaatcggccttaaagcaggtagtggaaaagttgcatgatctgctggggtttgatattccgaagattacaagaacctgagtggtccaaaaagcggttagctcccagaatataagcaccctaagcccaatattctggttctgaatattgggcttagggtgcttatatggccgggagctgctttttggaccacgttatggctcggtagccagaacggagtagaatattctggttttgaatatttggttaagaggcttatatggccgggagctgctttttggaccatgttacggctcgggagccacaaggacaaacaactgtaattgtttaacgcgttttgattcattggattttagtcgcgtggatataaatgggagctgttcacatgcaattagatcgaattctaaattcatatcagcttacccggaattttaaattaaagaatcgcatcgtattggcgcccctgaacattcagtcggcgctatttgatggtaaagttagtttaaatgatctggattttcacagtaagcgttctaaagatgttggcatggacgttgtggggtcggcctatgtctctgaatcaggcaatacagcatttgggtcaattagtgctgctaaagatgaggatattcctggtttaagaagactttctgaaacgattcatcaaaatggctgtaaagcaattttacaattagttcatgcgggtcgaatgaccaatcagtttgtgacaaaaggccacccggtagtcggccccagtccgattaaggccgaacatggggtagtggacacaccaactgaattaacaaatgatatcattaagcaagttattgacgattttgttagtgcaaccaatcgtgctattcaggccggttttgatggggtggagctacatggggctaatacatttttgcttcagcaatttatgtcgccatgttcaaatcaacgtcatgatcaatttggcggttcaatcatgaatcgggttaagtttccgttgctggtggcgcatgaagttgctcgagctgctcacaatccatttgttgttggttatcgattgtcacctgaagaagttgaaacgggtgggttgacgtttaccgataatttggttttaatgtcgttgttaaaacaagttggcattgattatctagggttatcgttgcgtcggtataatcagcactcggtaaccaatcaacaacttggccgtttttcggttacagaagttgttcgccaggttgttggtgagctacccatgattgtgagcggtcagttaaatgatcctgctcatttacgggaagctggaggcgacttgtttgcagttggtaagcaattgtttgtcaagcctgactgggctaagacattaaataaaggttattcagaagctgagttgtttaagttgatgaaattaccgtattcgggctaaataaacactcactggtagccaattaatcgaatgggggttacaccaatggattctgacaagcgaattttagacatcgatcaaggcgtcaacttccgggaccttggtggctatcaagctgctggtgggcgaacgacttgttggaaaaaattgattagggcgggggcactttcaaatctaacctcgccagatcagcaactgttgactgattatgggatttcaacggtgattgatttgcgttctccttatgaactaaagcagtatccagataaggtgccattcagttgtaaatatattcacttgccaatttttaatgatgatgagacagaaagtcaaagcaataaccaggaacttcaaaaggcatactctgcggatccgcgaagtggttatcttcggatgttgtacgtttatcggcgaatgattgtcgatccacagcctcaagctgcctatcgacacttctttgactatttgctggctcatgggactgatgagacaatcttatttcactgttctgctggtaaagaccgaacgggtatcctggcggtactgttgcttgatgccctgggagttgatagtcaaacagttcgaagagattatttaatgactaatccagcctcgattcgtcggattgatttgagaattcaaaatgctaaacaatcacgaaaagggccggcttttgtcagttcagttcatgatctatcgaccgtcagtgacgattactttgatcaggcaatgattattgtcaatgaggtgtacggtggtgttcgagcctatttaagggatgtcgttggcattgataaagacatgatggctgaattgagacgaatttatactgaatagcgtgatagtgcgggacaaaaggcgattacactttggaagttgccttttgtcccgcgttttcgcttggtaacaatcgtgtatccactagcagagactgaccaaaccgactattactccagcccattacgataagtgaggaaaaagtgcttttacgctctcgccccttataagttgcctcatagcaagctgtagtacaatgaaaagttgtcataattgtagcccctgtcggttgcaaatggttaacttttgtgtcaatctggctcatatgatttctaaaatctaacgattgcggaaataacaccgtcataaaaatcagattctccaacaccgtaagcagtctgcacaaccagtttcaaaagaggtttgttatgaaatttgctaactcttttaagcgaaatatcagtgcgcttgaattcggatgtcttatctggatcacttgctggccaaaaagcggcctctgccgccacaccaacttgaaatacgataccagttcaattgcaatggccactgctgagtctgcaacccatttcggtttcttatcgttaatcacatctttgctgctatcgtatttaatgggtaaagacttgatttcaacgaggactgtttctgcaacaaattgatcatatgctttggctgcaactaaatttacttgcttgcttagagtgcgcaaagacaagcggtacatcatacaaattactaagatcttcacttaccggcttttatgtgctaatctcttttgcaagaatagttagttttgtcttcttttcaaccgttacatcactgatactctgaggaacaccataaagtcgatcattactcattcgaaaagtttccttttaaaattctaaattcaaatcgtcggtacatcacggggagtcttcagctatgaaaaaacaatctccaaaaagaaataaaagatcaacgaacatctggaatcctctatttgtaccaaaaaaatggggaagtggccttgggttcaataatgataaccccatcggaagggcaataaatattttggctttgattgctttaatagcgcttttttgttacgtaatatttgaatctttcttctaattttttcaagactcacttgcagtagaaatttgtctgttttttcatctattaccaccccttaaatggaaaccgaatgcttactggatgtaaataattttttatttctattttttatgtgaaattagaatcaatgtatgtttgcgaacccatgttgataagaattgtaaaatattcaattggctttctgcatcaacattattaataagctcgtctcgtatcaataaatctggatttgacagtaaagctctaataagctttattttttgagtttgaccagtgctcattttactttggctattatcaacaacacttttaagagacaagtcactttctcttaaatctttatcaaattgagtcatattaattattatctgggtttaaagcactttttgtgtttaattggctttattcatttgctgataaaagtgttcgagtgatactaatcaccgctctcaacatccccgaggtagaagaaacggtgtccaccaacattataattagtccatctggctgagaagaagtcctcgccggaatgccaagtcttaccaatcgttgtcagctgacggattgtcagccgataattagtcttggaaacctttttttcagctaagccctttaccggtgttcggtaatagagatagtaatgttttcccttaactaaaaaccgattgacctttattgaccgggtcggcttgattttgaacaatggattatcaaccgccggtccaccattgccctgcttgccatagctcatgttattttgaatgcgataatgctttagccgtgattggctgtaatactgcaggtagccgtccatggttacgacaaagatcggtttgtagtgttcggagccattattggcatattgtccaagttgtaagaattggctacgcatgggcaatttgagcgaatacggcttgaagtatgttgtattgtagttgcgaatgtaaaccccattctttggttgataaattcgctgttgtttagcgtaactgatctggcctagagaaaagacggcctggctgcgctgactgcccgctgttgagccagtagtccccagaacttttaagatggttcccttaggcgttataatccggtgccctttcttgtcgttaactttggtgtattgaccagtgaaagtcggcttcttaactttaacatattgaatattctcattattacctaaatcggtactggcattagctgcaattgtactgctggtgaaaagtgcaatcccaatagcaaatgataacgttattttctttagcattggttaaatccctcctggcgattgtttaacacttagtattatagtcgtttacccgtggtgattctattggtttaaatatcggcaatcgtgttggttcatttgaattcatgagatttgcaaagcagctgaataataacatttgactgaaaatagataaaacaaaatgtgattgttaaaaaaacagtcggatgccttctataacagatcatcatacggtgtgaacagccattgaataacagagatgccatcaagctcaatttggcttactggcaaggctggctgtcgacaattaacggtgtagacccatccttggtgattgaccgcggagttgcgcaacccgccgatttcatcgatatacggataaccattaatggtctgggcggaaaacgggatgcggttgtccttgaaaaattgggatgaaacgtcgagaatcgtttgtttattaccccaatccaaattgcgttttattgtataacttttcttgatattggcgttttgccgtttatattgagttggcgtgacgctggtccgagccttgaagagttttgagaaatagctggtttggttgaaaccaacctgatgggcaatttgacgaatcggattggtggtaaaaatcagttgatcgcaggcaagtgccattttttgattattaatataatcaacaaaattgattttaaatgttttcttgaagagtctactgagataggcgggtgacaggaaaacgtgttgggcaacctcggttaaggtgagtgatttttgaatgtttttgtcgatgtatcggatggccgcctttaagctgtgagttgcttcgtaatcaccaaaatttggtttcgtcggggaagtcactgttttatcagtggttagcgatgtcgaaatgggatctgttgtcccgtctgatgtcctaaccaggttattgatgaagttgatctgggacagttggtggttgtcgagtggatttaaaacagtaatgtggccgtgccgtttagtgataatagcgtcgtttagtgttttttcaagataactttgagccaaaaatactcgccgctgtgaagtatgagttgtgtcacaaattaggtatccccaaaacttgtgatcaatgattacgggaaaaagcgactgccacccttgtgaatcaatctgaagtgcgtgcttgattgctacaggatcggtctgaatttcttcagattttaacagatgattatcgaaagtataaaagtaggtttgaatttgagtcatttctgaaaacaaatgaagtgcctcagctaactgagaataatcttggggttccaatggatatgtgggcattatcattcctccattgtccgaattcggttttgttacataaaggttattttaggcggaatgaaagaattcggcaaggatgaaaaactgcagaataatagattagtttcaggttgtaatctttgaatattaccctaaattattcggctcttcgtctgcagagcgggacaaaaggcgtttaacttccagagataatatgaagtgacctcctaattgtcaattcgcggatttaaactcataatgatgttgtataaacactgagttgttaccgcatgacaataggaggtcacccttatgcaaagtatagtttacgtgggcatggatgtccataaagaaagtcttagtttatgtgcccttaattcaactactggtgagatcttaggagaaacgaaatgtgccttaagtacgcagatgctttg

SEQ ID NO: 653 - DNA, 18903 bp, Unknown
  Metagenome-assembled genome
atccacgaataacagaatggttaactgtcgattggacttatgttccttggtttatccatgcccctgatggaggatgagcaggatttaaatttgtgacttgacaatggtcacttcataacagtgtaatcggactatccgaatattctgaacttgaacatttggataattcggttacacggccggaagttgccttttgtcccgcgtttttacttggtaataatcgtgtttacactaacagagactgggcaaacgactattgtcccactcacattgttgacataattcttgttgttacgtttgagactttagcaatactactttcctgatccttttctgattggttgaatttatcaacgtcaatcgtcacttgatcgggttcaagactattggtcattgcttgacacgcattagcataatcctgatagtcccgaaccaacaatttatgccgaccaagtagtttaacagggacgggtgcctgttgaagctgattaacgttttcctgatacttatcagttccagattgaaaatgggctttaatctctgctaatctctcagatgttaaatcggcaatggtgtcagtatcaattgcctttcttaacgtttcataatcgccatttaaatcttcaccattctttgacgttgaatcaatgacatcagaaacaatcttggcatatcttctcatatcttgtggtttcaaattaattccctctatccaaattattgtttatcaaaaaagtgccgctgaacatattttactacttctgagacaacaacgatcataaagccgccaagaacaacgaccaaccattgcgatggcaccaacttagtcacatggaacatctgattaaacccaggaatgacaatcgtcaaaatcaacaatagggttgacccaagcaatgcccaattgaaaaatttgtttttgaagaggccgactctaaagattgactgatgaattgtcttggagttaaaggcgtgaaagagttgaattaagcccaacgttgcataggccattgttaaggcatcggcgtgaatcaaggcatctgtcccatgaaccgggttcaagattgcaaacgcatagacacttaaggtgatggcaccttcaaagaatccctgataaagaatgttgctcataatcccaccagaaagaaagtttgaagaacggcctcgaggttgacgtttcatgatccccggttcagctggctcaacgcctaaagcaatcgctggaaatgtatcggtaactaaattaatccagagaatttgaactggtgccaggatttcccaacccatcatcgtcatcacaaacagggttaatacttcacccaaattagctgaaagcaaatattgaagtgacttttgaatattagcaaagacttttctaccggctcgaacagcggttacgattgttgcaaaattatcatctgctaaaaccatatcgctggcttccttggaaacctcagttccggtgattcccattccaacaccaatgtcggcagtcttcaatgctggggcatcattaaccccatcgccagtcatcgcaaccactttaccctttttctgccaggcttttacaattcgaaccttatgttcgggagcaactcgggcataaacagaaatgtcaccaacctgcttctcgaattgagagtcagacatctcatccaattgagcgccgttcattacctttccggcagtatcctttgatgtgtcaccgcggtcaagaatacccaatcgttttgcgatagcctgagcggtgtcttgatgatcaccggtaatcataattgatttaatcccggcagatttggcttctgcaaccgcttgggcaacttctgggcgctcaggatcaatcattccgattaagcccacaaaggtcatatcatgttcctgggcatcacttgtcaactcagtaggcactttgtcaacaaatcgataagcaaatgccaatacccgtaatgcttgagttgctaactgatgattggtttcactgattaattgacgatcagcatcggtaaactggcggacttgatcaccatcttgtatttgggtcactcgttccaataattgatccggtgcccctttcatcgtcatcatgatttgatcatctgcaaattgattatacgttgacatcaattttcgttccgaatcaaacggaatttcagccagccgttcatgtttagaaataaattgttgaaccggctgatcctgattcaaataaaacgaaattaacgcagtttcagttggatcaccacccaattgaccttcttgaaacttggtgtcattattcaataccatgatttgagcaagtctgttttctaacgttaatttagtctcactggaatcagttaattgctcgtttaggaaaaccttttcaacggtcatcttattttgcgttaaggtcccggttttatctgaagcaataatgtcagtactgccaagggtttcaaccgcgggtaatttcctgattaacgcccgatgcttagccatttgctgcgttccaattgccaaggttacggttacaattgccggcaggccttctggaatcgctgccaccgccaacgaaatagcagttaataacatatcaaggacattttcctgcccccgccacatcccaacaccaaagacaattaccgaaataatcaaaatcaaaatggtcagcattttggctaattgtttcaagttttcttgtaatggggttaccgattcttcggtggtattaagcatatgggcgattttaccaacctcggtgttcattccggttccaattacaacgccaacaccacgaccagatgttacgttactgttcataaagcccaaatttttccggtcacccaggggcaaatcatcatcagcaatggtggccacctgtttattcaccggaaccgattcaccagttaaagccgcttcttcaatttttaatgaattagcctctgttaatcggatatctgccggaacaatatcgccagcttccaataggacaatgtcaccaggaacaatttgatcactcttaacagaaagtgattcgccgtttctcaaaacagttgccattggcgctgacatttgttttaaagaatcaatagcactctcagccttagattcttgaaaaacaccaaaaatcgcatttaaaataaccaccgcaatgatgataatggcatcgatatgttcaccggcaattccggcaataatcgccgcgacaatcaaaatgatgatcattaaatctttaaactgaccaataaacttttcaagtagagttgtccgtcgcttcccttgcagtttatttaaaccaaactgattttggcgatcaagaacttcttgagccgttaatccgtttgcctgtgatttcatttgagtcatcacatcttcaactgaacgttggtaaaaaagtttgtttttttctgccatttacttcctccttagaaaagaaaaagacccatgaatcctcgcaaaaagattcataagtctcaccatttaagatttatcccggaaatacgagtatttcacgttgacgagataatcgcaaaaagatattgctggttactccctttatttacaaataattatacctaatcaatcatgaaaagtcactgataaactacttccaaaatgtatcgtagacgttaattggcgtatgccgtttatgctcagtcttgatataccagccttcaattgtttcagcggcctgctgagaaacgactttaccttccagataatcgtcaatatcttgataagtaacgcctagggcaacttcatcgggcaaagctggtcggttatcttccaaatctgcagttggcacttttttgtaaagatgctccggtgcacccaactcattcaatagttgcttgccctgacgtttatccaagcgccaaagcggtgtaatatcggcggcaccatcgccaaacttagtgtaaaagccagtgacggcctccgcggcgtgatcggtcccaacaacggcgcccttttctccgccagcaatggcatactgcgcaatcatccgctgacgggccttaatatttcccttattaaaatcactaatttgaatcccgttagtttcaaccgagtcaacggcagcatcaacggctggtttaatgtcaacccgaactactttgtcagctttcatgtagtcaattgctgccaaagcatccgactcatctgcttggacgccataaggaagccgaacagcaataaattgataatcagtgtcgccagtttcatcgcgtaattcagaaatcgccagttgcgaaagttttccggcaagggttgaatcctgaccaccagagattcccaaaacaagtgtttttaaaaaaggatacttttttaaataagctttcaaaaagtcaatacttcttctgatttcagcctttggatcaatcaccggctgtacttttaatgcattaataatttcctgttgctttgcccgcatctgcaatcatcccttgattaataatttatttgttggacatagttccgaactttttcaataatatcacgtttattgtcccagcacttttgtgaaaggtcaaccggatatttttgtggatttaattcacgtttgtactctggccatagcgatgcgagctcacttgcggcataattagcaatttttttgaggtttggtcggtcatagatcagttgaccacttttataaataggtcgaagtaatggcttagcatcaaagttttcaactgtcttgttaatgtaagtatagtttggatgaaacatgtaaatagatttttctttacgaggatcttcgtctgacaaagtaacgtaatcaccctccgacttaccatcccgtgcgtcagtgatgcgccaaacctgctttttaccaggagtcgacactttttcggcatttccagaaatcttaatcgtatctgtcatcttgccgttactgtcttcaaccgaaaccattttataaacagcccctaatgcgggttgatcaaaagccgtgattacttttgttccaactccccaaacatcaattttagcgtgctgcatttttaaactggcaatcgttgtttcatctaaatcatttgaagcataaatttttgtgtttggataacccgcagcgtccaacacttcccgaacccgtttagaaagataagccatgtcgccagaatcaagccgcacaccggcaaagttgatcttatcgcccatttcattggcaaccttgatcgcgcttggcacaccacttttcagtgtattatacgtatcaaccaagaagacacagtcatgatgcgtttgcgcgtacgctttaaaagcatcatagtcatcgccgaacgattcaaccagcgaatgagcgtgagtaccactaattggaattccaaattttttaccggccaacacatttgaggtcgcattaaaaccaccaataattgttgctcgagacccccacaatgccgcagaaacttcttgcgcacggcgggttccaaattccattaatggatcatctccaaccgcaattctaattcgtgatgccttcgtcgcaatcaacgtttggtagttaacgatatttagaatcgcagtttcaaccaactggcattcacaaagtgtcccctccacttgtaaaatgggctcattaggaaagactaaatcgccttcataagccgagcgaatggttcctttaaatttaaaagttctcaaatattccaaaaactcagaaggatagtcggtcaccttttgtaagtatgcaatatcatcgtcggaaaagttcagttcttggatgtattgaatcacatgttcgaggccggcaaaaaccgcatacccgtttccaaacggcagcttcctaaagaacacttcaaagaccgcatgccggttctccatgtgtttctcaaagtatgtcgccatcatattaatctcatagaaatcagtatgaagtgtcaaattatcgttttctgacataataaatttaaaatcctcccaagtaagttgttataatctagttagttcaattttaacatttataaaattattaaccagaattatgtaaattttttccaatctgactggttacctaaggagttatgaccatgaaccaaccatcacaaaatcttgttaccattcttggaatccctttcattaacacaacaaagcatcagtttgaaaaaattattcatgagcgaatcagcaatcataaaaatacgtttgtcgtcactgccaaccctgaaattgtgatgtatgccaatgatcatcaagactacgccgcattaattaaatcagcagattatattatcgcagacggcatcggcatcgttattggcgccaaaatactgaaacaccccattgaagaacgaattaccggctatgacctatttactcatttattaaattggggaaaccaacatcacaaatctgcttattttgtcggggcaaagcctgaggtcattaaaaagttgcaaaaagcagttgccgaaaagtaccctcaattaacgattgccgggactcatgatggttactttcaagacgatcaggaaatcgttgctgacatccaagcccagcaacccgatatggtcttcgttgcaacggggtatccgaaacaagaacaatttatccagaagaatcgacacacagccaagggactttggatggggattggtggttcctttgatgtgttaactggcactgtcaagcgcgcccccgaaacatggcaggaactacacttggagtggctataccgcgtcatcaaagagcctagtcgaatttccaggttaatggttctacccaagtatttactaagagttctcaagcagcgacggtcgaaaaactagggggcgatcaccaatgattccgaaaaggcgcaaacagctaattattgcctttatcagctttattatcgttgcgacaattatctccgttatctttggcttgacacaccacgcttcatttacagaaagttttccgtttggcctggtcgggatttttgttttggcctatctttccagcttgacttcaactaagccaatttatatggacatcttctacttcattttgtatatgatcacctcaaggatctggggcggttatgtcaactggacatcgtgggtcatttttgccgtcacttcgggtgtcatgacgttctttaccgcatttttgcgagcaacatttacaaagccagaaaataatcagcatcaaaagtagccggatttatcagcatttaagatgattattgattggttaactaaaaatggccaaaagtacttttccataatcaaacaggctcattaaccatctccgaagttgaaaatgtttagtgagcctgtttgatattccggcctttcttagtaaatactatcgataactcccagccagttttgcaaaattaatcgtgcctaacccgctagcttggttataaacggtattggattggccagtataatacaaatttgaattattatccgaatcatttaatggcgtgaatggcgaatcagattggtccgccagctgataaatctgcggattccaaaatcccatccgcgtactattttcttggctattaatcaacgcggtaacggctgcaaactgtggtgcaacaatgctggttccaccactgctaatccaagaatcaccggcttttgcgtgttggtaaaccatgtaaccagtatttggatcagcatttgcggcaacatctggataatttcgaccgccatcagtacctgaaagtaacggttgattataaattggttgatttaattgtgaaaaatactgacgggcgcgaaacgtattaataccaggaacacccttttgataatcaggtgtggcataaaggtgactaaaaccaccgccaccaccaatcccaattgatggtaaaagttcaggcatttttgcaaataatgacggatgggcctgaagcaccggccaatcgtaatcagttccccaacttctttctttattgaccgttacagtacccaaatttgtaccggcaggcttaaactgactcgaaaagggaagggttgttccgcccactgaagtcacccatgggctggtagcaaatggatcagcatcgtccgttgagcgatcaaggagaacccgtgaaccagaaactcccaccactgtgtaatttaaggccccattatcaccagaagcaacaaagtttgatacaccttggagggcagcctgtgccaatattaggttcaggacttgaagatacttcggtgaaatgacccttctttgattaagaatttggtagtaccgattggtccccaatccccaactgcaggaaagcgcgctggcttgattatcatctaatgccgttgcgtaggcattaaccaagttcatgatagttgggacaccacttttaacccgatacatcttaactcgggcttccggcgcaaccgaaccagcatattcaatatccatggtggcttcttgattttgattatcaaccgctgatgaatcaaacaagcttcctttaacatttcgaaccagataacgactattatctgtcccagcaccctcatgtttccagaaatgatttatatcacttctcttggcaccaccaaaagtaatcacaccaattgtttgccccttaccagttagtccacgttgataaagctggttaacttgataccgcttagaaaatcgactcgtatcgcccattttgctggcattattatcggtttgcgcatcgagtccgacatcagtacttgcaaagaaatgagcctgattatgatctgccattcctaaaattgtccacaccattttcgcaagtcgattgggaatcacaggtcttcgtttgccaaactgcaaggggttaggatgataagttgcctgattcaaattaattcgaaatagtctattaatatacttaactttcccactcacattcatcagcaggccgttatcatatacatgggtcgctaaatgcttttgcctaagaaacttacgccactcgttggtgaccgattcaggttgaccataattttggcgaacgccagcagccgtcaaataatttttaaaggccgatttagttggatcattaacatctgcagcttgatggtacaattcagattcatttttaggccgaagaacaatgtcaaaactggttgttgtattctcctttaagcgatctggccgcattgcatcagtagaaattattgatccataaacgccactataaacatcagctgatccactgacagacattattcctaatgtcaagacggttgccaaactggctaaaatccaacgaaagcgccacatttcattttccccctcaaattgttcaatcctcacctcattttagcacgggagcgattaaaataacctgctgccgaattcaaaacaatcgcttattcgaataggttgcgcaaaaaaggtcgccgggacaataatcgttttgctcagtctctgttagtgtaaacacgattgttaccgaacaaaacacaggacaaaaggcaacttccgtccacgtcaacgattatctagctgttcaaatccggaatgtctcattgaacttttcatttagtaaaaaaacttggatcaacaagcagacttcaaaatataagccccctaacttaacattccaaaatcggaaatatcaagttagggggcttatattctgaagtctaaccacttgctgacccatttttgctttatcgaggatgtctttgcattaattattaacgtcaaattaatttttaatcattctttttccaagtaaaactcaaatcgatcaccaacgtactgcgttcttacgtattcgaaaggcctgccatcttggagataagtaatctgccgtaaccgcagaattgcatcgccacgtttgatatccaaatattcagcaatccgttcagaagccagcattgccgaaaccgtttgctgagcttttccaaggcttaaatcctttttctgctccaatgttcgataaagcgaactggttacttcagatttctccaacccctcaataatgttttctgggacagtggcaacctcaaaacagattgggacatcgtctccataccgaatccgttccattcgtaagactgattggtcttgcgtaatctgtaatttttccatttcacttaaagaaggttccatggtgtgatatgaaattgttttactggagggctgtttgccttgagccagcatcaggtctgtaaaaccagtgacgcctgacattttttcttgaactttttgatttgcaacgaaggtccctgaaccaacgcgccgttcaagaatcccttcgtcaactaaagtctgaattgcttgacgcaatgtcattcgactaacaccaaactctgtggataattcccgttccgaagggattcgatcaccaattttccacttatcagcctcgatatttcgtttgatatcattatgaatttgaatatagattggcaaccccaccgaaaccagctccttagtcttaatctaataattttccatacctatacgttgccataaggtctaggcctttgtcaaacaaatttaaatccgcatcgttcccaacctcaagcgactccttacctttcaggtgaaattcattagcttgattggtcgagctcattctgacagcatcttcaattgtgcaaccagtaaactggatgatatttttaaaagcatctttatatttaagaattgaaccggccaaccggccatttttaagaactgcccgaccgttgtggaccaataccggctgttcaccaagctgatattgaccatcaggcatcccctttgcttccattgcgtccgtaatcaattcgagtcgcgtagccccgattattttgtaagcgatcttaacagcttcgggtttcacgtgataaccatcgcagattaactcaacgtgggtttggttagctaacatggcataaccaaccaccccaacctcgcggtgctgaaagccgcgttgggcgttaaacaaatgggtcacatgagttgggcgcgccttttttagttggccaaaggttgcatcactatggccaactgacatcacaatatgatgctgttggcaataagcttgaaaatcagggttaactatattttcaggcgcatatgtcaacagtcggattcgatttccggaaagctgttgccatttagcaagttcgattttattaggttgctgaatctcattaatcggttgggcaccgttaaacttagtagaaataaacggtccttcaagatgaatacctaaaatgccttgattcttttgagctgcaagattgattgttttcatcgctgaagcaattttctgcgggctctgagtcattgttgttacaaagatccccgtaacaccctcagcacccattttatccaccatttgaccaatacgctgtggatcattatccatcgaatccgttccatagccgccatgaacgtgaacatcaatgaaccctggaacgactaatcgattttcaccattaattaactgatcatctgcttgtggttgatagtcggtcatcggtccaatggcaataactgtcgaatcaaatctcagatagccgtgtaagattatccgaacaccggtataaattttactgttgatgattacttttgccattatttaacactcgtcgctagtcgtcatgatttccagttgacttggcgatggtagcatcaatgcccttgacaaccgcatttaagaacccggcctgttccattgccagaatcccggcaatcgtatcaccaccaggtgaacaaactttatcaatcatctcggccggcgttgcttttgagtccatgagtgatttcgcagatcccaaagttgtttgggcagcaatttgggtcgcaacatctttgctgaacccatatttaaccccggtacggctgagacaatcaataaagaaatctacataggccactgcactaccagaaatcgcactaaaagcggcaaactgcttttcgggtaattcactaacttctccagttgctttaaagacagaaattacttgatcttttcgatcaccggttaaattctcattagctgcgattgcagtcatcccctgcccatattcagaattaatgttcggtaaacttcgtagaatcggtaattgatagtcagtcagttcttccaatcgattaagagttatccccgatgcaatcgaaataagcgttttatgcgcatttaattcactccggatctcttccaacacatccgtagcaattcctggaatcacagccaaaacaatcagatcactatttttagttaattctaaattacttgattgagcagttaaaccatactgattcgcatatgtttcgtaatgaatttgacgagcactatggaccaaaatattttttgaagggacaaagtcagcccgcaacagcccttgaataattgcttgagccattgcaccaacaccaataaagccaattttcatttctattctcctcacgtttatatcggactattccaattattaattcgacaatagctgaaatttttaaagattgcaaccattatattttggagataccaattttttaatttattggtcatcgtgagaataacgagataacaaatggtagaatgatacgtttgaccggtgtatgcgctaaaccgactatgattaaccaaccaagggccacaccaaatgcattcgttaaaacgtcattaatatcgacccagcgagaaagaccaacccattcatcaagaatgaactgcaacatttcgataccggtactgataacaactcccgttaagatcacctttttaaatttcaagtttggcaataaaagtcgaatataaatccccattggcatcatcattaaaacattttgataaaagtcagccgtcgtactccaaaatgggatcaaattaaccggtgcgctaccaatgatcatcggggcgacctgctgatttccaacaaaagcatacgatgttggtgccaatgtcaggtaacttacaatcatcatataagcaactgccgacaaaattgtaatgagctgccaacgcgaggcttttgccgtctgataagaatgcgattttaaccaaataaacaaactagtaatatcaatcatgtatggtagccatttaatcattagaattcaccttccttttcatttttcaaaacagttaacaaccctttatcctgttaagtgtatggaaattgcgttaagtgaaccttaagttgtccgataaaaagaaatattttacataatgacaactttttcttaatatctctaagacacataataaaaatgatttaatgactacaataatcgtcttcttagttaacaagcgccaatcctagcggtaaaagctgtctttgttttacctatctggcattgataacaccgagtaccctgtcacgcgacatcctagacgatcgattagattgaataaaaaacgttttgtaccgaatcaattatatatttgattttgctattaatttattatcaacattctggtatactgggacaaatctttctaaggcggtgatatataatgcccagaaacaattttgacattcacgaagcatttgctgaaaaaacagttgctgtggttttagaccatttaaaagagattcgacaaaaaagacccaaaagtgacttcatcctcctagatgataaaaattttatggtcgatgatttaagtgttgttggatccctgatctctttaaatcttattaataataaaggaatgagatgcgaacgcttaatagctcctgagtccttttcagttacgatcgaagaactcagaaagcaatagtcatctattttctttaatgcttacgaacaattgcttattcacgtattttaagatccgctcttacttttgactatccttatttgttggatagtcattttttatttctcatttattctggcggcttggggtggcatgcaactgatccggttcctttgttgccagtagaaacttccattcgagaattgtaaaacgattgaccgattcctttatagaacgccagtggatatatatctacccaacaactacgaagcaagaacaaaatgaagctacggagaaactagcggagtagcttcatttttaaagcataccaatttgacacccagcattcagatataccaatcattggttaaccacgaaaaaatggttaacttttggtaccatttgaccgacaatcagtgacaatcaaagaaaaatgaatgcacaaaaaactggtacataaactggtgcatcttgtttgtagcctattgcatgctattgaaaattagaagtaacaaaaaagccgtcaacaaagtgttttacaccttattgacgactattatatctataatattgggctagctgggttcgaaccagcgcatcacgggatcaaaacccgttgccttacctcttggctatagcccaaaaataaaatggaggggagtggattcgaaccaccgaacccgaaggagcggatttacagtccgccgcgtttagccagacttcgctacccctccgaaacgtttgtcagtaccaaaccaacgaatataataatacaaaattctggcgttcacgtcaagcaaattattcaaaaaagttggataatctttaactggttttgccattcttcaataaagtcgttgcttgaccactcgttatgccggtgattatggtaaccgacggccgcattataataccatgtttgtttgatttgaattgggacaatccgctgatgaatatggccaaagatgactcgctcaacttgatagtgattaatcaaatcctcgatacgtttgcttcccatcattgcattagccatattccaaaaacggaaatcggtagtatagcgaataaaatgtctatttggaacaaagtgagtcattaagataaccttctttgcctcattcttagccatctgaagctgtttatcgagctgggcaataactataccctcccgctcaacatcgctcataggttgagaaattaggctgtcaatccagtaagccattttccattgataaaactgatctattgttttgttcacattatccgcaaatgaataatcataccaaccatttaatccaatgattcgatagttagaattcggaatatcgacgaatcggttgttaagataccctggccaacttcctgtttcaagttgttcatatgtcacattcttaatcatatcgtgattaccggcaataaaaaggacctttgtgggcgagactagtttagtcaatttttggacatattcaacagttttttcgaaatcattaaacatatcaccggcaattaaataataacctatctgctgttgctttaaaaaatgtgcctgttgtttaatggcttgatcaactggaatcttgttaatatcaagatgattatcacttgtcgccgctattttaatcataaccattctcccaaataaaaaatgtgctatccagactaggataacacaaattatactactaaattattttatcatttctgttttaactcattaacaattttattaattaacgccttccattaacttcttaatcggtttaatcaagaaagctaataaaattccggccacaatcgctaccaacccaacaatcataaagtaattaacctcattatcgggagtatagaatttaacaatttgagaattgacagcttgtcccgctgaatctgccaagaaccacatactcatcatttgagattcgaatgccttcggggctaacttagtcgttacagaaagtccaattggtgaaatcaataattcagcaacttcaatgattgcccaactacctaataaccataaaggactaaccaatgctgaagaaccaaacaaagaaactggaattaccatgaataagtatgaaagcccagcaattaccattcctgtcgaaaacttacctggagaactaggttgccgtttacccaacttcatccataaccatgcaaagagtggtgtatagatcataatgaacaatggattcaatgattggtaccaaccagctttaattgtgaagccaagcacgttattgtcagtttggttttgagcaaataaagctaatacaactgatccttgttcttcgattgcccaaaaaacggcagctgcgataaataatggaatataagcaatcacacgggatcgatctgtactcgaaatctttttacttgagagaataataacgaagtaaatgaccggtgttgcaatagcgataatactcaataatgtgatgaatgtatcgatatttagtgatcccatcacatgaagcaataagagaatcagtccaaatacaacaacgcctaatccgactcgaatcgacaatttttttgcgtcatctggttcaagtggatcggatggataaagacttgtacttggtaaatgctttttcccaccaagaatgtactgaagtaatccaaagaacatcccgatcgcagccaacgagaatcccagatggaaattaacactcattcctaaccaactcactaacaatggtgagataaaagatccaaagttaattccgaaaacaaagattgtgaaacccgagtcacgtcgattatcatactcagtatacaagccaccaaccatttcagaaatgtttggttttaataacccggtacccaatgtaattaaaacaattgaagcaaataatgcaatctttccaagtggcatcgaaagggcaatatgcccaaacataattaaaacaccaccatagaaaaccgttttacgactaccccaaattcggtcacttacaaacccaccaataaccgatgtcagataaaccattgaaccataaattgccataatcgaagcggcagtcgattgtgaaaatcctaaaccacctttagttacgctaaagtacatgtagaaaataagaattgcccgcatgccgtagtaactaaaccgttcccacatttctgtaaagaacagagtcgacaaccctcgaggttgaccaaagaacgatttatctgcacgtctttcctggtcactttgaccttgttgttgcatgtgataccctccaaaaaataaatctaatcccctttaaccaaagccagtcggattagatcattaaatttataattaccttactttaggcttaaaccatacgaactattatatgctagatgagaaagtaattcaacaaactaccgataacgattagaaccaaaaaccagtcatgacatcataatcatgactggtttctgagaaaaataattttatagcttctcattatcaagtgtcaattcctaatgtttattaaaataaattggaataaaccgtcgaactaagaattgaactgtttcagtattcatcaatgtgtcttgagcatgcgtaaacaagactgagtattgaagtgtttcaacattcgcaatcactttattctgctcttggtgagcttttttgagccaatgatctgctgacaacaattgatcatgtatactttctttatctggatgattagtgcttaatttatccaacacacctgttaagacttttttggctttcccagaatacgtcaaaatcttcattgaactttcgttaagttcatcgagattcattagatcaccttagcaagactgaattgattcatgatgaacttaaccaatttttccccgtttgcccaaccataaacatcatctgggattgttttgactggtgcttttccaccaatcatttctaattctttttcatgatatgaagcttggggtgcaatcaaaactaagtcaatagctttatcaaggtatgtatcggtattgtcaaagttcgttgacattaatttgattgatgcatgataagtttctaaaaaccttgatgcagacttaacaagaaaatcacttgaaattccactttcacaaattaataatacatttttcataatttaacgtcccctttacatattttgtatctaaatacatcttatcagataatttcatataccacaagatagaattttttgaacatgtcccggataacacttattttaaacgttttatatcataagatctcttatataccaataccatcagagttacctataccaatttaaaatttgctttatttttctttttattatgaaaataagtaacaagtatatcctttttatttacatgttgatggcttttattaaaaaattattgatttgaataatgaggtaagttagccctttatgcctgaatttcaaattaagtatccacaaaagtgttgtaatcattgatggtagtatcttttgcctattacttccggaatactttttggaatcgattatttacaaaagcggcaaatgttttctatcgttttacttttaaaacgtgcatactacagttttgatacacataaaaaggatggtaacaaaaaataattttcttcgttagaaggcttcgtcaataatacaagttagcctcaagcaatttaatttcaaaaaacaggaagtctactagatatcatctaatagacttcctgttttttatttttcaattatgtagaataatgccggctgcaggagttgaacctgtgaccctcggtttacgataccgatgctctaccagctgagctaagccggcattggtgagatacacaaaagtgccaacaattgagttagcacttttaaccaatctccggcaggcgggctcgaaccgtcgacaacctgattaacagtcaggtgctctaccaactgagctatgccggaatattgcgtggcaacgtcctaccctcgcagggggcgatcccccaactactcttgcggctcttcgaagcttggacttctgtgttcggcatgggaacggtataccttttctagccatcatcaaccacacccatcgaactacttgtatgtgagaaacttggctccaaactaaatacatatctactcttttctacagccttcaccgctgcttggttaagtcctcgaccgattagtatggtggccgcctccatgcattcacttgcactttcactatgcctccacatctacccgatcctctcggaggggtcttactcttcccgaaggaagatgtgaaatctcatctcgaggcgagtttcacatttagatgctttcagcgttttaatctcctccataacgtaa

SEQ ID NO: 654 - DNA, 14576 bp, Unknown
  Metagenome-assembled genome
cgaattgttgccgagaaatatcgctttggtaatgatgactaaaatgttgcatatgatcaccaacttttttgacagtagtttatcaaattattgggtcaaaatcaaagatactaaacagcttcttacgatccaagcaggatcgttcggcgttaacttccttcattatcgttgacgctcagagtgttaaaaataccgaaacggccgagaataaaggctatgatgccggtaagaaaatttccggaattaagcggcatctagcagtggatatgaatggctttccgcaagccattcatttaacgcgggccaatgtctctgaccgtgacggcgccagtgccatgttagccttaaacgccgaaaacttacgccgggttcgaagcgtattggttgatggtggttacagtggccgcaatttcgccatggatgtccagcttaatttaaaagcgaccacccaagtcgccaaacgaaatgagttacataaatttgaagtgttgccacaacgctggataattgaacgctcctttagctggttggaaaaatatcgtcggctctggaaaaactgtgaacgacagctgcacaccagtacaacgatggtaactttagcatttgtctcagttttcctacgccgcttttagagatctcaaacagtttctaaagctggtcgaattaattcaaattgttgccgagtaatattgctgggataatttttcatagcttaaactcgctttttacatagaagtatatcaaaaatcatagatcttggacagcttctgacaccacccgttaacctaatctaaaaaaaattaagtttaaccggttaattatttaattaattaaatctccaacttcacaactgccccaaaaccaaaacaccgatcctagatatatcttatatggcattcgagaacattaattattctgccaaattctcggccatcaagatcctggatcaaccccaaattgcccccggtagaactgattcaacaagtgtgccaaatgttccactgtcgctttaaacgttttattggtcaatagcagatggtcagtaaaatctgccaggtaattctgccaacttaatcgttgcgcctgttgagccgtcaataaggctctgagggctagttcatagctacgggcaattgtggttggtgttgcccaacgggtgattgcatatctgccgcgaccgattgtagtgacggccaactcacctttggtttgtaagtcttttttgagtttgtttagcgattgcgcgctaatgtttagggccgtttctaactgtcgaaaagacatctctaaatagcccccctcgcggtaggcattttgattgatatattgtttcaggtcgttagcccattcacttaagtgactgttctgccggtcaattcgggctttggcatacttatgccaaaccttaggttggggtacttgggccaataaacgggggcttaaataattagcttgaatattttttatgtaaggttgcgtggccccatgataatgaccggaatacgcgtcttttaaaatgcgttcaaattctttgactgccaacggcgcaacattgttagtgttccaaacatctaactcgttataggcatccataaaaggaattttgctgccgaaattggctagggccaaagtcattaagaagttatggcgaccaactcctttacccagaccactttccaccacgttgtttacctgtaaagctgctaagtaccaaggccgtttagcctgggtttgccgggcagtccgcaactgagctgcttcgccttgcttaatccgtgaccgaacctgttgtttggcatttgtttgttgacgtttttgggcaacctgttgtttactccattcaatccaatcagcgaaacgactggtggtttgtgggtcataaaacaggatattgttttcgtggggtacgcgaaagaagccaaagttattacagccacaatccaactctgggaatttatggttcatataggcttttaattcgtcagcgattaattgggcaactttaaccactggtaaactgccgtctttttggcggcgaacataggctggttggtccaaaacatagtagacctggtacccgtggggggaatttaggactgcggtaggtttgagttgattattcaacgtcaacaatctttgtttagcttgggtccattcagccttcttctgattgtgataatccaggtccaagacaatgacattaacttgttgcaaattatccaacgtgttgccggcaaaataatgccggtggacatccacatagcgcccatagcgtgatggattaggcgtccagtgggaacaatatggtgcattgtccagaatgccctcttgtgacgttaccaatagaccgcgggcgctggttaaatcgtccttggtacgggtcatggtcacagtgccaacgtgttggggatcgtctttggtatcgacaattttttggtgactattcttgacgcgttgtttggtaactgagttatgtaggatctgttcgatcagggcttgacttttcattatgctttctcctttctatcgttcttatttgcttgcaatcagctgaaagattggtatatcatggcggtataggtttgttaaaagtgaagacctggatatacgatcacaaacgtttagtactagctatttggtatcagaaacttgttaccagatactggttacatgacacttgttggtaaaaacatttgataaaaggcagttgatgcaagacatttaacgtaaaggcattgtttgaaaactcagttggatacttgaattagtacttggttgggcatttagagcatttagttaaacatttagcactcagttaggcttttaacatttggatttagtatcttcttggaccttcacttgactagttattacagaaaataaagatctcctattgaccgccaaatcaaatttcggtaggtctttattttttccaaaatttaccttaaacttttggaacttcaaaggtccaacttttagggcctaaaaaaggggggacgcatttttcttgcgtccccttttttacagaatccaccaatttattgaaaccagtagattggaatcctccccgtgagcctgctataattaacttagtgtaaaggtggaccaacacttttaccggttagttaaaaaagtttattacgagaaagatcgttaaaaagttttcgcaagtggtcttgcacttgtgtcgactgagtaagaatcattgcgactgattcttattcaacgatctttttttgttcttttagaaatctgttaatttgttttaacaacccaagattatcatttagcactctttttgtaaatataaaatgtgtaaaagtacactccttcacgatagcgttatgtcaataaatacactaggagaaaaagagattagtgtattagtagaaaaaaggattaggagattagtgtattagtgtattaagagattaggagaaaaatacactaggagaaaaagagattagtgtatctttcataaaggccgatattacaggcttaacaatttctatccttgtttaaaaagtgtactattacacttttctcctaataccctaagagaaaaagagattagtgtattaggagaaaaagggattaggagattagtgtattaggagaaaagggaattaggaacctaataataatttttttgcttgagattaacctgtataaagtgtactattagcatataaatagaataacgttagtgtacttttacaggattgaggcgaatagattgggatatgtaattataaatgcacaacaaaagggcggtgttggtaaaactactgatactgttatggaagccgtcgttgcttcttcattatttaataaaaaagtcctagttattgatactgatcttcagggtaatgctacccagtttcttgcaaaaacctataaggatttaaatatcaacaaatcttttatgagttgtatggaagatggtgacttagaatctggattggttcacctaggcccgaatattgatatgattgcatctgattacgacacacgaaaatttggcgacttcttagctgacaagtttaaaaatacaattgatcgaacgttctatctaaagaagcttgttgataaattaaaagatcggtacgattttgtattcatagacgttccaccttcgacagatattaaagtcgataatgcgatggtttgtgctaattatgtagtcgttatacaagaaacacagcaatttgcctttgatggttcaaaaaagttagttttaacttatctccaaacgctcgcagatgactttggcgataaaattaatttacaagttgctggtatcttaccggtcttacttcaggctcgcagacctttacaaactaaaattgttcgcgaaacaattgagtattttggtaaagacaacgtatttaataatattattaacaaccatgctcgtttggaatggtatactgcccaaggtgtacaatttcaagactttcatgataaacgcatatggggattgtttgctgacattttttgtgaattacaagcacggattgaatcctttgaaaaaaccaacgatgtaatcaattttcactataaacatcaatatattaatcaaaacaagttgacgcctttgggaaaggaaatgactgtcgatggctttaattaaaaaagataacaatcaacaagttaaaattaagcatactgccaatgttgatcgcaacttaacccctagtaaaaagtttaagtccagtgaccggtgtactttaaaagttgatccacctgtttatcaacttattaaatcgttagcttacattactgataaaaagatgtatgaccttgttcgggaaatggcaaatgcttatttagaaaataacgttaatgatcgacaaagagagaatgttttacgaaatattgacgatattgagcattaaaaaaggagactaatacactaagaaaaaagtgtattagtctccttttgctttgtaatgattgcttcacactataatctcattaaattagcatgtcaataacaaaatatgcttagttccaaaaatagtagcttcaatacaaactaactataaggggtcaatggaacatccatacgaaaagtagcggtaggatcccgaacaaaaaatcagaaacgttgatttaacagcgtttctgattttttatattggctttatttaaaaagagctctggaacattcgtacgaaaagtagcggtagactttaaaaaccgaacaatcttatttttcgtctgcttcatccaatggtcttaaatgaccattttctaacgcttcattatattggaacgtgtacttaccgacaaagttaatgtgttcaaacatcagtggcgataatttgccgatcatgtcgtcagaacaatcaaacccttctgattgcatctgcgtcacaatcttttccaggtaaacggtattccaataaataatggcattcgtgactaaactgagagcgtttagttgttcttccataccatcaaaatacgtttgataaagcttccctttccgaccataaaagatgtttcgacaaagcgcgtgccgagcttcacctttatttagctgttccaaaatttgacgcgcataaatctcatctgaaagatagcgtaattgatgtttcgttttatagactttgccgtattcagtaatcgctttacccaaagcggttgggtggccttcacgttgcaaggcctgagttaattctgtcgcattgaccttaccagactttaacgaaccggccacgcgtaaaatatcctcccaatgttcttcaatcaaccttaaattaatgcggttttgagacaccccatttaagacttgataatcagcggtcgaatcaatccgccatagcttggttccctgactattagcaattcggggactgaactgaaaacctaataggccaaataagccaaagactaaatcgctataaccggcggtgtcggtcataatctgagtgggttccaaactgctgccttgatttaaaaagccttctaataggtagagagaatctcgtaaggtccctgcaaccaccatgccatgaaagccgatatattgatcagaaacaaaattgtaaaaagtaatcccgcgaccgcggccaaagtattttggattgctacgagaatataaagacctttggggggtaacgtaacgaatgccatcggccgaagccatttgaccgtcgccccagatgagcgcactttttaattttttatgcgcgttaataatgcggcgattggcggcggcaagggtatcaattcgcaagtattgatggtccacgtacattaaccgatcgtattttagactatttgaactgtttttagccactggcgaaaggccaatgttacaagcctcagctaataaaaccgctaaaatactaatatcaacgtgtttcatcttcgtcccactttcactaacgtgactaaaacattgtgttaactgtaactgttggttaacctccaagagaatatccgataaatcaattttgggaattaaatgccgaacccgacttttaaaggccgcttcgtccttttgttcacggactttgcgtaatttggccacaataattttttcttggccgtcaacctctttgacctgggccatttctgaatcagcccaattttttagggcctcggcataggataaagctaaatcctgtttcaccgcttcaacggctgcttgaccagtctgcggtaaatcaagttgttgaatcaaaacggccttttgttgacgccaagtagacttatcaattaagcaggccatgggatcaagatagcgattactttgccggacgtaaatatcatgacgcttaagaccatgaaccagaagctcgatgccggcaatcaacacacactgattggttacttgggggttctcacgaatataataacgccattttttcggtagtttttcgacgatctgttcaaacatccgataggtaaccgggcgcggaaaccgttggcgaataaactcccaaaccatcagacaatcttggccattggtagtcccttcaaaaacaatagtggctaaaatatccggaatgaatttccggaattttcgataagcatttaacagttcttcaatggcaattggttctcgctcattacgcactaactgattaacctgggtaacggctgactcaattatttcaggtggataagttgctaaaactttgtttctgagatcttgactgctgatcgtttcgtccatcaataacctgacaatctgggagagcgttaaagctgcatgatcaaaatctttaatggttcgcagccgttccttggcttctttatttttggcccgtttaaaaagcgtctcgtagaagcgtgaaagagctagtaattgttcatccatcgctcgtttgcgatactcggaaacaaaagcgaccaataacgccgtttgtcttttgacggacatccgtttaatcagactggccttggctttaaaagcatagttggccagattctttaactttcctgctggaattgcgcctaattgccaatcctcagttttaaattgttgaaactgttttaatcgagtaaagccacggttaatttctttgcggctttcatccatcaaaggatttcttaagagatccattttaatggtggccccatagatgggttccccaacggcagttaacagatttaaaagtcggtccgtttcttccgctgaagggacggccactaattgactatccaaaaggtcggcggcaacctccgtgacccaattaacaaagcgttcaaaggtggtcacccctggtaagagaattttttcatccaaacatttttttagcagcatatcaaaaagtagtttttcggtttcgtttgtaaaacgcgctcgctcaagcagccagtcgttcaggctcgctttgaccgcgggatcagtaaaggcttgataatgatattttcgcttaatcagcgccatatgttggctaatggtcatttttcgcgtgtagcctgctaatgcccgaccatcaatagttaactgtttagctaaataatcaattacctcagctgggacttgttgtagattagttggaaaagttcctaaaaatctaactgagctcaattgaacggcaaagcctaatttagtcgttgcggaacgcatttcatcaattaacgcgcgatcaaaatcagttaattgaaaatacagccgcagttgatcggcagaagagatgccctcaaaagttccgaagctttgttggtgatgcgggttagtcggcatattattctccaatgtttttaaaaaactatagtttttggaaaggtttcgctatactttgattaggttgatttaaccgggttttgagttttcaaaaactcattatcaaaaagtttataataaaccattgccaaaagatagctaaatttaccctggctatcaaaaaactaaggagtcactcatgattattggatatgcacgggtttcaaaagatgatcagaatctcaatcgccaaattgatcaattaatggcttatggtgccgaaaaaatcattcaagaaaagtttaccgggacccggcaaagaagacggaattacccagctttccaaaccattcgggctcatgatgtcgtggtcgttggaaagtatttcccgcttgggccgcaatacgttggacattttaaatcggattaaatactgccaccaaaaacaaattaagttggtttcttaaaggagcagatgtgacaccgagaccccaactggtcgaaagccatgtgcaaatgtatgagtgtgattgcggaactggagcggaatttattagatgatgggttaaagaagggattgcggccagtcgtcggcgtggcgttcgttggcgtgaagttggccgaccaagaatcgccaagaaaaagttgatattgccatttcggttgtatcaaagtggtgactattcagttaaagaaattttggccaccaaccaaatttcctcaggaactttttaccgcgaagtggaagctgttttttaaaactaaaaaagcttaaaagaaaagatgacccatctgcttattcacaaatgacttctaaaatttatggattccaaaaaagatttacgaccctttagttttaacaaagtttgacagccatcattgagtagctcttatactaactagatgatcgtctagtaatggaaggagaaaaaatggattatcaaaataagtttcaaaggctaaagcaatggctgacccgaaccgcctaaaaatcattgatctgctttcatgtggatcactttgcgatgtatggcttgtatatcctccagcattttgatttttctcaatccacttttgtctcatatatgaagtttttgcaaaaatgcaggtattgtgtttgcgggaaagatgggaatggcaaacctatccctaaaaaaggttttccaagagtttaaacagaaatgaccgaccaactgttagcgatgagataactgcctttgccacggtctgtctgttgtgaaaagatgttgccaattaagtttttaagcaataaatagacgccgtttctggtcctatgtaagagtgaaaaatgatgggaaaagtattagcaacaagaattaatttaacaacaagtacctatttttaggcaagggtggtggggttggcaaaaaacaacggttgccagttgccactgacacttagcttagcgatgctggtcaccgagttagatcgtttcttccctgatccagctagtaaatgccgacttttttaaagttagtttaaccaatcagccaaagccttccaaacatttccggttttttgctgccaaatttgatcggtcagtgctgcgaacgagtatcgcgagcaggttatgcaaccttatcgaggcgatggccgtgtgcccaagaagcagtcagaatatggctgaacaattatcaggctcgtgtacggttgattgaaattgctgcatttaatgaatttgccaacttctaactagttccaagataatcagcaatttgactatatgatttttgatacagcgccgaccggccataccttaaggcatgctgcaattgccttctgcttggagagtacatggatagaatgatcgtggtgatcctgtcttcggccaactagtggcttaaatgatagaaagtatgtatcaaaaagcaggttgatgaaacttaggcaatcctcaagcgaacgactttgttttagttaccgaccacaaaaaggcgcccttctggaggcacaacgcgcttcacatgagttggcgccttaaacatttaagaaccagcaactaatcattaaacggtatttaaaatcagccaaccgaagcagttatcagactatttttttaaacaacagcaagtgaatttgcagaatatgccagtcactttagcccagctaacccaagttagcaattcccatttgcgaggctaccaacgtattggattactaatgtacgatactattgaaagaccagcagccgaaataacgaggatacggtactgctagtaactttcctgatctggctgttgtcgtgaagaattagtgcagtcaaatcaaataaatatcttcacaagggaaaaggtggcgttggtaaaacaaaccgtgccgttcaaaattgcccaaaaagatagctgcctcaacacaaaaacgtgcactggctaccacgacccagcgatcatttgaaatacttcaaaatcacaagtccgctgatcaagtgagcccattattgatgagaaagtctttaaaagaatatcaacacgaattctcactactgataaaagacatgaaagtataatgatgttgagtatgtcgctgaagattgcgttcacctgtactcaagaaattgctttgtattccgagcttgctgagttagtcgcccaaaatgatagtgacgtcgttgtggttgatcggtccggactggtcattacactcttaatgtgaaactcgacccaaagctagtgatcaagaagttgccctaactccgcaggagtcccacaagcagtcgttaattctgttaccaagactacaaggatccttaagcaaatgaaaatggtttatggtaacgctacagaaccacgccggtttatgaagcaatgcggtttagatgcgatttgaagcgagccagtctaagctaatacttggggggtggtcaaaccaaagtatgttggcaactcaaaccactgatccagtttgctggctcgagtgccaaagcgagtaaatggaattgatcaggtcaaagagcttgcgaataatcattttgctgttattgccatggcaaccaaatacgaaaaagcttttaaacggtttaattaataaaggaaaaaaaaaataaattccctttgccaatctaagtgcaacagtttctaggtccaaatcctataagtggtacacagcttagcgttccggcatcagttccgccgcactccggtagcccagatacgacgaggccggcttgttgaagtgcgtctggagatctggatatcaatgaggtcgttaatggtgaggtgagcgacccttcggaataaactctcgtagaaggccgttctggttctcatttgttcagcgcgccatggtggaggtgagtacgatggcaaagtagacattcagttccttctaatgaatctagtcgtgcgaaccactgcctataaaggtgatggggtgaagttatcagcaccgtatcacaatgatgggactgaagttcccaccttacagtgttacttgctttgtagtgagcgagctgatgatgatttcgaagcgactcatcgctctgtcaaaacagaaagcaggttcgcttcacgcgcttacctttcactaaatctacgtcccaatgcccttgcgaacggtcttgaaattcaatgggtctttcatcaatccgacgccggtcaccccccacaccgatttaccaagcttcgtcttattggtgcacggagtaggggaatggcttagttaattcgcaaagctgggtttgcgcagtaagtaagtcgtggtccgttagttagaatctatcaggcatcaatatcccggtaaaccgttggtgttgaaggaaacaacccgtctgcgtgttcccgtttgaaggtgtgtacgaagctgtcaacaatggtgtagctgtggacgttgccttgatgcagcggcacaggcggcgtagaatcggggttttctcaagcatcgtcttggggcgacaccgctaccgcagctgagcgtgcagataagatgccgtataagaaagtaaatcaacgctaccttatgccgggggggggattcgctgtagaacggagccacgagtgatctcacgcgaaatagtactacgagagcggttgagttcgggcaatccgtgttgggaggaatccctgatggaagcagagttcaatgagaacgcgatcaaaatgtgatagtgttggtcagcattttagagatggtacgccttgatgtggtcatgagtgcccttctatgggcttggtgcttataagaatagtcatcatggcctttttggtcatttaattatgtgttgcacttagatgtaaatcggcgggaaaaaaatattaattcagtttaggaggtatcatgcaaggtctttttgccgtttggaatgttctttactcacattattattcggtatctggcaacctagagatatcaaattggaggacagccgtggtggtgcaattttagcattatgtttggcgtggtgaagatttagatgttggaacagttaccggaattgtctggaatgccaccttatcttcgtggctattattctgatttaaatcatttagacaaaatcggattttgtgttgaatgcggacgccttacacatggctagtggcaaacggtcacggatattcgcagtttatttggttgcccaccttagcgcgtcgttgcgccctttttgctaatgatggggcatgtggctgcttcgtattctacccccaggttttagcaatggttagggccttacactttgatgaaaagccaccaaagtttcccttttattagtgccagggctttatgccgataccacttctttaaccaatgatgttattttacttggtaaatatggtctctgcgaactttttggaatttccttttcagcgtagctttaagaatgtgatttctgatctatttttcgctgttaggtagtatggatcatgtatctttacttcgaaaagcattgccacgagaaatttttttttttggtgccactcaggagttgccggaggaaacccagtcttcactaaaagatcagcggactttcaagtttaagggtcgtctactcatccattgatggttacttagtagcggttttcttaggaatccccggtacctttatcgcatgagtatgcggctattttctgatggtggtaagaagttccccatgttaatgcgatggcagcgattttatttgttaaaggagtccttggaacatgtctttttctcaatcggtatgtatgtcgtagtctccggccttcagaacgttggtctaacactattatccggttgtcatgacgaaatcgcaaaaaggttgtggttcggtttgctgccacaatgggcagatggggctacttaggcagcacttttatctcattatacgaagaaatgccgaccgtcatgattaatttttgttgccaacatcaatcaaaggcgcgacgttcagtgctcatccatcataagttagtgtacgcaaacataatcggctcagatttgggacctaagataccattggctctttggctacattagtctggcacatgttagctcaaaagggagttaaattaaatggggggaacgtattttaaaattggaattttaacccacggaatccattgtgttattaccctatgggccgtctggttatcattatcgatttttggttagaaagataaatcacaattactttggagattgaatagaatgaaaaaaatagcgttttgaaaccagcaatgtgtggcaaccggtgtttgtggtccagagttgataaggaattgattcaaaccaacggccagtcagcggtagggaagtgtgaatgcacaggggcaggcccatgttcattcgtgtaatttggcccagagaaacacgatttgttttttgcctttggtcgaaatccgatgttgcccaagaatttaaaaaagcagggtataatgctttaccaattacggtagtggatggtcagtggtaaaaacggtgaataccaacccattagagtttagcagttacttagacatggattagtactgctttggattcactaatagtttagaatggaggattaatgatgacaccaaatttattttctatgtactggaattgattgtcgaagtcaaaatggctgaaggattcgctttaaaaaaattttagcaagcttgggcgcgtgccagtgcggggatgggagtcgaggtgcatggcttgaatccatgggtgttaaagtttggatgaaaaaagaatgatttcacagcaaacatcaaagttgtaattgatcccgattattgcttaacgtggacctagttgtcaaatttatgtggatagagatcgtgatcgctgtccagtcacccaccaacggtcaagaaaacgcattggccacttccagacccgctttagcagtggaccgaacggattagaattagtagttttaggaaaggtcagagatcaaattgagcagcagatt

SEQ ID NO: 655 - DNA, 42623 bp, Unknown
  Metagenome-assembled genome
agaccaacgagcgaaagcgctcgttggtcaataaaatactttacctaactaaattatactaattttttcggtatttgactaccgttaggttagtatgtccttttttaggttactttcttataaaaaaataggactgggacaaaagtaattttgtcccagtcccgttttgtgtaatcacgattattaccgaatggaaacgtgcgccaaatgcaactttctgccgcgtaaccgccttttgtcccactctcatttttggacttgaattataatagctggattattttccctgactttttactggttcaccattatcgtatcgtcgtagtgcgttcagcgcattggtgacgtttccccggacaatatcggtatgactaacatcaataatttttaaatcggcgattagttcgtctggtaagctgttaagaatgcgatcatccatcagaataatgtcatttgtcggaacacttggatcgaagaaatgttcggcgactacgttaattgatcttctaattgagtgaataccattttttaattgatcacaaaaattttgaatgagtgcatcatccacgattgcatttcccgtcaatgaaggttgaattttaccaacccgaatgtcgccaacgactcttatgttcaatgaatctcaccgccccgtttttattgctccaagtcatggtatcacgttaatagaaggtgatacggaaaaatgaaatcatcttttatcaaaattaactttattaaccaaaatataagatttagtgaggatgagttttcaagcaaaagtaatcaacgcaaataataattgacaaaatagggaaatattttgatgcttatcttcattttgtgcatgagcccgcaactcaaaaaataaatagaatgctaaaataatggatatccctaaaattcgggtaaaggagatgcttaaggagaagcaaatgatcaaaatgactaccagaattgcccacaatgaagattggttgttttttttcatgaatgcaggaaatgagaaaaaaatattggcaaaaattaagagcgtaatatacattaacgatactaatgaaaaataatggtggtaggaaatgttgaacaaaaaaacgataccactgccattaataacgccgtaaataatccactggcagtggggctcgtccaccaggtgggttaacgcaagtaagttagctgctccaaaatcaattaggagaagcagcccatcagccaagtgattgtcgacataaaagaaaagtcccaaaatgcaaataagggtatcacacaaaaacagtgacaggcgactaaacttcgaggtaacgattaagcagaataaggcggcaagtggtaaccccaataatcctaattttagtaattcatgattgagaaagaattgtgagaatgcaatatttgaaaataacacccagatagctaataacatcaacgttcgaatgccaaattgaatttgactggcataccttgcgatcacaatgaagcccccttaaacagttctgaataacagtttactataacttggaggggattaagtcaagctgtgtcaaaagtaactgatgtttaatattttaaatcaaatgttcaaattatcaattcgggttgaatctgattgaaatctgatggcagacacggttttaacttaaattttaggttccaaaacaaaaagatctgtgataatatggaaaagttatgagttcccgataggattcgcgctggacgtgaagaagccttgtaacctaaaaaataagtagggggaaaataaaatgcgtgaaagacatttatttacttcggaatcagtttcagaaggacatccggataagattgccgatcagatcagtgatgcaattttagacgcgttgttagcaaaagatccagatgcacgagttgcatgtgagacatccgttacgaccggattggttctcgtatttggtgaaatttccacaagtgcctatgtcgatattcaaaaagtcgttcgtgatacaatcaaacgaattggttacgttgatggtcgttatgggtttgatggcgattcatgtgccgtcattgttgcacttgatgaacaatcacctgatattgcccaaggagttgacgatgccttagaagaacgtcatggacaaaccgatccattagataagattggtgccggtgatcaggggttgatgtttggttatgccattaatgaaacaccagaattaatgccactaccaatttcattggctcatcacttaatgcaaaaacaggctgagttacgtaagaacggcaccatcccttatcttggtcctgatgccaaggctgaagtgaccgttgaatatgatgacgatgataagccatttcgtgtcgatactgttgttctaagtacgcaacatgatgaaggtgttacgctggaacaagttcgttcagatgtgattgagcaaattattaaaaaggtcattcctagtcgttatttggatgacaaaacgcgttatttagttaatccaactggtcgttttgtcattggcggccctcagggtgatgctggtttaaccggccgaaagattattgttgatacttacggtggttatgcacatcatggtggtggtgccttttccggaaaggacgcaactaaggttgatcgctcagctagttatgccgctcgttatattgctaaaaacattgtcgcagccggtttagctgatcaagttgagattcaattagcttatgcaattggagttgccaaaccagtttccattgatattaatacctttgggacggggaaggtttcttcagaacaattgattgaagcaactcgaaagatttttgatcttcgacccgctggaattattaaaatgcttgacctgaaacgaccgatttatgaacaaacggctgcttatggtcattttggcagaactgatattgatttaccttgggaacatactgataaagtagatgcgttaaaagactatttcaagttaaaaacggctaaaaactagttagcgaaacgcccttgaaaaaattcaagggtgtttttttgaccaaaattttaaatgaaggagatatttcatgacaaagacagcttctaaaagtaacgttgcattagtcaccattgcattatttgttgcaacgtttatgagcgccatcgaggggacaattgtctcgactgctatgccaacaattgtcggtgacttgcgcggggttgccctaatgaattgggtattttcgatctttttactaacaaatgcgattgcgacaccgatatacggaaaattggctgatagtgttgggcgtaaaccaatgtttattttgggaattttaatttttatcgttggatcagtcatgtctggcttatcccactcaatgctggttctgattatttggcgagctatccaaggcattggagctggttcgattatgccaatttcaaatacaattattgccgatatttatcccttggaaaagcgggctcagatcctaggtctaaacagctctgcctggggaattgcatctgtagttgcgccgttattaggtggttttattgttgatcacttaagttggcactggattttctttattaatttgccgattggtttgattgttttgatcatggttcaatggttttttcatgaagaaaaacggcacgttaaaagtaagatggatatagctgggacctcttggctaaccttaactttattggccgtgatgtacgcttttcaactcattggccagaatcctattaattggaaagttgttgcggtgtgtttcttggtcacaatcatttcagccatcatgtttattcgagttgagcgagtcgctaaagatccattaattccgatggccctttttgacaatcggaccttcgttgttcaaaacattgtcgtatttttagtaagcggctttttgattggatacgaagtctatttgccggattggacacagggaattttggggttacgagcttcaatggccggatttgccgttactccaagttcattgatgtggatatttggatcgttctttgctggaaaattattagcaagaatttctccatatcggattatcaatttgagcctttttttcattttagttggggcaattgttatggtcttgctaccggcatataccccatttgccggttttctgctgatttccgttatttgtggaattggctttggattgacaattaccacatcgattattagtgttcaaaatactgttaaaccgactgaaatcggggtcgctacttcatttaatacgttgtgtcggacattaggccaaacattgatgatttcagtgtttggaatcgtcatgaatatgacgatgttgcgtggggtgcgtcagactcagggaacgtcgttgaaaatgatggacaaattaattaacccgcaaacagctaatgaattatcaaccaatgtcttgccaaaactaagaaatattctgtaccaatcgcttcataatgtttttgttgtggccttaattttgattttgatcgcctacgcggctaattttatcgatcgaaaaaatcggaatgggcacttataaaaagagtggtctaaagagcggttagatcccagagtataagaccccccaaccctaatattccgtttctgaatattagggttgggggtcttatatggccgggatcttgctctttagaccacgttttctacggattgggagtcgaaaaaatttaatttcaaaaattaggttaaagtgtcttatatggccgggagctgctctttaatggcttgggataggtgaggtaaagatttaagtgacctggtctttgacgttaatcacctaaaatcggctttcaactatactgacttacggatgagtttggaaatctaatcaaacaaacaccatactttaattaactgtttttaactgctggagcaatgttttgaattaccagaacgaacggtggctcgtgtttttgattaatgaattgataagtaagggcagcaaactttttttggtccaatgatttgccaaaatcgagaatggcattcttttccgtctgtcccccaggatgaccatagtagatgacgattaccactagcccattttgttttaaatggtttaagcagcccttaattgcttcgatagttgattctggatgggtgataatcgatttgtctcctccggggagataaccaagattgaagattgccgctgaaattaagctctttttaggtaaaaaatgatcgagttgagaatgactggctgtaaacaagtgaatattttcttcgttcaagccatttgctttcagtcgatcatgtgtgtggtcaatcgccgtttgttgaatatcgaaaccgtagacacttccggttttacccactaaatttgcaagtagcagcgtatcattaccgttgccaacggtgcaatcaacgacagtgttccctttgctgataatgtgtttcaaaagttgatgactatacgccaatgcatttggcaatttttctgacattacagaactcctatcttttcaaaaataatttggctgatccgcagtaggaaaaatcccagtgtccagccacctaaaacatcacttgcaaaatggacgccaacgtaaattctgctcaatccaattagaatgataaacaatccaatcaggcagttaataataagtcgttgggatttcttggccattatatggttaataataatgattaagctgccgccaaccatcatagcactcattgaatggccacttggaaaactgcttgaatgaacttgaaccagatgggccaaggttggtcgttgacgatcaatgagcaacttgatgagtgagttaaccggtcccgctaagacaatgccattaacgaacaagaaaagggcactgcggccattatcaattaataaaagaatcagacacgcaccgacaataaagccaattgcggggccaacattcgccatttgagtaaactgaattgtcaaacgggttaacgtcggattggcaaatcctcggaccaattgactagcagtactgtcaaaagacgatatccaggattgtttaaaaataacgccgtaagtgatgataagaaaaacggctaacgataaaatggtaatcagatagtggttgtgacgaaatgataatttcaatgttttcaactccagtgttaatatcataattatagcacggtgatctattgttttttattggtggttttgttatgataataggcaataatttcaatctagtgaaaaatgaagagacgaattagtaactaatcatttgttgtccagaaactgagtgggggctgtgaactcagagcaagtggtggtgaactcatcgtcgaatgcctggtcgaatttgagtaagccaggtcggttttatcgccgttatcggttttgagtgctcattttattgtaaatgagaatataggtggtaccgcgataaatcgtcctataagaaacccagtgtggtttcttatagggcttttttcattattttgaaaaaatttgaaaggtggcagttgcataatggcatacaatcatgaggtaattgaacgaaaatggcaacattattggaaagaacataaaacatttaaaacatcagatgacaccagtaaagataaatactacgtgttggatatgttcccgtatccatctggtcaaggactgcatgttggtcatccagagggatatacggcaactgatatcatggcgcgagtggcacgaatgcaaggaaaaaatgttcttcacccaatgggatgggatgcctttggattacctgccgaacagtatgctttaaaaacaggacataacccacgtgactttacagctcaaaacattaaaacatttaagcgtcaaatccgctcattaggtttttcgtacgactgggaccgcgaaattaatacgactgaccctaagtactataagtggacgcagtggatttttgaacagttatataaaaagggcctcgcttacgaagacaatattgaagttaactgggcgcctgatttcatgggcgggaccgttgttgcgaatgaagaggttgttgacggcaagaccgaacgtggcggctacccggtttaccgggttccaatgcgtcaatgggttctcagaattacggcttatgctgaccggttaattgatgacttggacacggttgattggcctgaaagtattaaagaacaacaacgaaattggattggccgctctcgtggtgcaagtgtttattttgatgttaaaggacacgcggatgctaaagttgaagtctttacaactcggccagacacgttgtttggtgcaacatacatggtgttggcaccagagcacgagctggttgaccagattacgacacctgaacaaaaagctgaagttgatgcttataaagaaaaggtttcccgtaagtccgatcttgagcgaacggacttaaataaagataagagtggtgtctttacaggtgcatatggcattaacccaattaatggcaaagaagtgccaatctggattggtgattatgttctggaatcttatggaacaggtgccatcatggctgttccagcgcatgatgaccgagattatgaattcgccaaaaaatttaatttgccaattgttccggtaatcgaaggtggcgacattgatgacgctgcgttcactggtgatggccctcatttcaattctggattcatggatgggatgaataaaggcgatgccatcaaggcggctattgactggttgaaggaccataaggccggtaaagagaaggttaattataagcttcgcgattggattttcagtcgtcaacggtattggggcgagccaattccggttattcactgggaagatggcgaaacaaccctggttcctgaggatgaattaccacttcggctgcctaaagctaaagatattcaaacttccggtggcaaggaaagtccattggccaacttaaccgactgggttaatgtggttgataaaaatggtcgtaaagggaaacgtgagaccaacacaatgccacaatgggcaggaagttcatggtactggcttcgttatattgatccccataatgacaagatgattgccagccctgaaaaattaaagtattggtcaccagttgacttatacgttggtggtgctgaacatgctgtcctacatttactttacgcaagattctggcataaattcttgtatgatcttggggttgttccaacaccagaaccattccagaaattagttaaccaaggaatgatcctgggaaccaatcatgaaaaaatgtctaaatccaaaggaaatgtgattaatccagacgatattgtccgtgactatggtgctgataccttgcgggtttatgaaatgttcatgggaccaattgacgccgccaaaccatggagcactgaaggaatcagtggtgctcatcattggttggatcgggtatggcggatgatcattgatgacaataatcatctgcgtgatcgggtaacaaccattgataatggggaacttgacaaagtttacaatcaaacagttaagattgtcacggatgattttaaacacatgcgttttaatgttggcatttcccaaatgatggtttttgttaacgatgcttataaagctgaagcgttgccgattaaatacatggaaggctttgttaaattactttcaccagttgccccacacattgctgaagaactctggagtttgttaggtcatgatgggacgatcacttacgagccatggccaacctatgatccaaagcaattagttgaaaacacggttcaaatggtggttcaagtcaatggcaaggttcgctcacatcttaaaattgctcgtgatgaagcaaaggataaggttgaagcagctgctaaaaatgatgagaatgttcaacgatatactaagggaaagacgattcgcaaagtaattgtcgttcctaacaagattgtaaatatcgttgtttcaaatggttaaatttgtttgaactaaaggaaactgggtcaaaaatcattttgttcaacggcttcccccaaattgttacctggtagaacttcagttggtaccttttggctgaaaaaacaaatatcagataagcattctgacggtattttagttcaattctgattacaaaaataaagggatctttaaaatcaaaatttgattttaaagatccctttattttgcagcaaaagcgttatgacctattttgttgccggccatctttttgaactcttaattttacttttaatgtaagcataaccaattgataagatgaatgaaattagaacagcaaaaattgtttcaacgatcgcaccatcgtaaccggcctcatcaaggatatcaatgactgctttgtgcagaaacatgatcccaagtgtctgctggccgaccaactggattggtttaataacaaattgtggcattagtttgcagaaataataactaaaactaaagacaactaaacagatgataataggaataaacataatgtaagaaactctggaaatcgggatatggtgataggatgcatgaatgatcttggattttaagaagaagccaaaattaaaccggtccatgtgttgttcccagaaaatccagagggtaataagtgcacaaggaacgataatccacaaatcactgacaatttgctgaattttgtgaaaatataaatagccaaacagcatgaaaaacaatgcaatgaatgcaacgtcaacatcccaagggacatatttccactggaaaaagtaaatatgtttatagctggttgaaacaatcagcgaaataaacgcgacgataatctgagcttcccggtttttaacgtatgtaataatgatagatgtgaacagcaatgctaatagataaacgttaatgtaccaaaagacactcaaatagttatttaatgttcggccaccataagccaatcggacaaagtaaaagagtgtgtatgaccaactttcaccacgaataaaatgtgaaagcaggattagaaagccaccacagataaagtatgaaaccaataacggaataattcgtttctttaaaaacccccaccaattattattaataattggctttaagaaaaatccgcccataatgaagaagatcggcatgtgccaccaataaaggaagtgaaacatggtgccgtgccgagtcatggcatgaccaaagacaacggcaacgatcccaattgctttggcaacgtcaatccattcaattcttttcttactcacaagtttttcacctctaaaattattaagaacactaataaaagtattttagtgcatattgcatgggattgacaatacattttggtcacttgttatcaaaatgacttatgcttaagacatttttaatatgtcagggattaattgttattgatagcttctttgattacaatgagtcaagaatcatcgaaagcaaacgaaagtaggaaacatcatggttagaaaacaaagcgattctgatgaatccagggatcaaatgttgtctggatccgcttggatgacagctggcagcattctcagtcgatttttaggagccatttatattattccgtggggaatttggtttggcaattacttttttcgagcaaacgcgttatatggactcggatacaatatctacagctttttcttgattgcagctattgcagggattccttcagcaattgccaaacaggtggctcattataatgcactcaatgagtatggtgtcggtgttcggttatataagcgcggcctcgtcttggcagctgtcatgggaattatctgcgcaaccattctgtactttggcgctccgttaattgatgatggcaatccgaatgtgattccaattcttcgctccttggcgtgggcggtcttaattatccccacaatgagtttaaccaggggttattttcaggggtaccaacaaatggcaccttctgcaatttcacaatttgttgaacagttggcccgggtactgtatatgctgctgaccgcgtttgttatgatgcaaattttacatgttgattgggttaaagcggtatcgcaatcaacgtttgccgcatttgttggtgccgcggccggaatgatttctttgatggtttactacttaaaacaccgtgatgttttcagatcattagttcgaaatagtaataatcaactgcgggtatcccccaaagaactttaccgggaaatcgtcgctcaagctgtaccatttattatattaggtgcgggaattacaatttttatgttgattgatcagtttacattttttaaaattatgcgagtcgcgacgacttattcggaagcgacgttggctgacttgtatgccatgtttgctgtaaatgccaataaattaattatgattacgatttcgttggcatcagctttagccattacagccgttccgctgctgtccattgcactgactaatagcgagaaaaaagaaatttctcgccaaatttccaacgtgattgtccttttcctgttcgtaatgattccggcgtcgttgggaatggcagccattgcagggccgttaaaccgggtattctatggcaccactcagcaagcattaggtgccaatattttaacattttcatcaattgtttcaattccgatggggttatttgtcgtgatttcggcggtcatgcagggattgtccgaaaacaaacgggccgttaggtttttcttggtcgggactcttgttaaattattgattcagtggccctgtatatattttttaggtgcgtttggaccattgctgtcaactggaattggcctgtcggtggcaaattggttaatcttacggtcattagatcggcaatttgggtttgaaaaacggatgctgtcaattgccatggaaaagatttcaaaatattcattatttatgtatctcattacaattttggtggttcatggtgccaatattgttctagggtatgtttatcacccatttggtaggagtggcagtttgctggtgtcattagtgggtgtgggaattggtggcttgatttacatttatttaacattaaaaagccgaattgcagatatggtgttgggcccgagaagtaatcggttgaggagaatgttgaggataaggtaaaagagtggtctaaagagcggttagatcccagaatataagccccctaaccctaatattccggttttgaatattagggttagggagcttatatggcggggatctgctctttagaccacgttttcagcaaggaagcccaaaacaggaggtttttaaatattagattaggggcttatatggccgggacttgctctttagaccacgtttctagcaagaaagcccaaacaggaggctattgagtattagattggggagccttggcggtgagctcttcttttcactatcttctgcgaaaaaacgattaagtttaacccgggtcccgattgactgatatcatgtgaattgattcagcaaatcatctttgagttaattcagactcaaagcaatttgaaatttatctaaaaaaagaaaaacagatttcgaaagattaatcgataagcaatcgttgcagatagatgaggattgagtttccaattaatcatttcgaatccgtttttgtttaggggactatttttagacactctgatttttcttcataaattttggtaatgcttcactgatttgatgaggtaagaccacgtattgtttgtgggccaatttatcggcaattgcactatgggcaaagacagctgctaacacagctttgggctgatcagcaaattgggcggtaaagccaccgaccattcctgccaatgtgtcacccataccaccggttgcctgagctggcgttccacctgtgttttcataaacactgtcttgatagtaaacttgggttcgatgtgacttcaccacaaccaatgcgttcagtttattggcagcggcttgattggcttcaggtgtttgatcagcgattttaataccggaaacgcgttgccattccatctgatggggtgtcaagacattcagcgaatcttgaggtagcgttaagtggttttgtgcaaccaacgttagcgcagaaccatcgataaccaatgtttgatttttatgcgcaagttcgaacgtctttgtcaaaattgttaatgcctgattatctgttcccaaaccaggaccgatgacgacaacgtcagcagctgaaataattggtgaagctgcctgtgaatcatggtaatcaacaaacatcgcttctggtaaccaatcgtgtaggctagtttgattagtcgggtcagtcatggtagtgaccaagccggctccggaataaacggcagcaagcgatgccataatgatggccccaccaaagttttgactgccaccaattaaggcaattttaccataagttcccttgtaactatttgcaggtcgtttacggataactttttcgagaattgactgcgtgatttttttcaaattaaaaacctcccaacaacattcactttcttttagtataacattatgagtccgacggcaagtccaacaatcgttactgattgtgataaaattgaatcataagatgacaggagtgagaaaataatgacaattaattggcaagaagaagcaaaaaaatatcgggatgactatttgaaagacttaaaagaattgattagcatccccagtgttcgcgatgatgaacatgcaactgatgaatatccacttggtgaggggccaaccaaagcgttattaaaatttctttcatttggtaaacgtgatggatttgttactaaaaacttggataacattgttggttatatcgaatacggtagtggtgaccaaacaatggccatgcagtctcacgctgacgtgatgcctgccggtgacggctggcaaaccgatccgttcaccatgactgaaaaggatggcaatgtttatggtcggggaacttctgatgataaggggccaggattagcagcatactatggtctaagaatcttaaaggaccatggtgtaacacctaaaatgaagattcgtttgattattggaactgatgaggaaagtcaatggacgggcatgaaacattactttgatgttgagccggaacccacttttggtttctcaccagatgcagaatttccactgattaatggcgaaaaggggaattcaacctatgaaacaacttttggccataccaacggtgatgcgtatacgttaaagaattttaattcaggcctacgtttgaacatggtgccgggtaacgccacagcaatggttgagaccgatgataatgaagggtttgtggatgcctttactgattttttggataagaatgcggtatccggagatattaaagcaacgcctaatggaattgctgttcatgtgattggaaaacaggcccatgcgatggagcctaaaaatggtgtcaatgctggaacctatatggctaaattcctgagtcagtttaattttgaaggggcagccaagaactttattcgatttattgccgacaagctgcacgatgattcccgggcaaccaagattggtgccgctcatgttgatgacgtgatgggtgacttgacgatgaacgttggtattatgacgtttaatgaaaaagacggtggtctagttaataccaatttccgctatcccaagggaaccagtgatcaagaaatcttagatcgactacaaaccgttgctgaaaagtttggtggaaccgttaaggaaactgaaaacatgggaccacattatgtggatcctgatgacccaatcgttaagacattgctgcgtgtttatgaagcgcagacaggcaccaaagatgttcaaccggaagttgtcggtggcggcacctatgctcggctaatgaagcgtggagttgcatttggggcattattcccaggaactgaggatacgatgcaccaggccaatgaatttcaaccgattaacgatttgatcaaagcaatggcaatttatggtcaatccatttatgaattgacaactaagtaaacacatttgaggtgttagaatgcttgagtttaattatacaaacattttggtgggggttgacggttctaagacgtctattaaggcggttactaaagcaattgccgttgccaaacgaaatcaggcaaaattgatcattgcagcggtcatcaacgatcgtgagttcatgggggtttcaaaggctgcttcgattggttttggtaatattgatccatcgacaattgacgctttaaaattgcgttatgaaaaaatggtcgcaaggtatgctgatcaagcgcgggctgttcatgttaacgtgaaaacgattgtgacgtttggtgatccgaaaacagttttgtcaaaacggcttgttgatgaagaaaatgttgatgcaattgtaattggagcaactggggttaattttgtctcacgcttaatgctgggatcgacagcttcctttgtgattgctcatgcaccgtgtgatgtctttgtcgttcatcgagattagtgacgccatttttcttagtgattgtcgtgatggcaaataaaaggaggctgaggcaaaatttgtttttgtccagtctctttagtgttattccaattattgcagagtaaaaagggtggcagaaagttagttccattctccggttttctttcagcagtaagaaataaaatcatttatttttggcttccttttgccgattattattgataatcaacgcccaaatgcccggaatgatatatagcagactgccaagtatgccaatgatcatcattacaattggccaaacataaccgttgttttggtgtaggcgtttaagtccaaaaaatacgatgatctgttgtgccaggtacagtccgccaaggattaccaacacaatgttgacaatccatgatgtgggcttaaaaatcatgacggcaattaatgtcaaaactaaaataacagtgacaaaccaccagataatccagccaacgatctgggcaccagtgagattttctttatttttcaagtagcatcaccttctttacgactaacgtttggttcaactttacgttaatcaaaagattttctaaactgactgacaggagatggttgaatgattgttgatattactttcgggacaacttttgggcatacattagcgcattattatcggcttaaacatcaacaaagtgaagtcattgcgttaccattggcacttgactttggggaaattaatcaggatgatattttggcatcacgacagaaaacgtttgagatgatggcatctgggtttcatgaacagccgctcaaagatgcgttggtaacccttagacaagcattacaacagttaaaaacggcgattaaacgaggagatacgttacgaatctggtgggatgagtcgtccgctaattactgtggctttctttggttgtgtcagcaactatcaactattgataatccggtttatcagatcaaatcgccgcttgtatttccaaccccggaggttcttattgccatttccagtatcgatgaattagcggatcaggatattgataaatttaatttattctcttatcagcaatcgctccccaaactgattcgtcggagttggagttacgcgtggagatctttaagagatgacaatcgaccggttcggattgttttaaatggccatgtgttaagtcagccgatcacgttttatgatcaatttattttgtcaacaatggatactgttcattttattaaggttgagcaattactggcaaagattcttggaacctatggcagcgggtttggcagccaattttcagaggtctggtatcgttatcggcttcacactttggccagtcaagggatgtttgaaattaaaacagataaaaagtccgccaaaacaacgatttgcttaaagttgcccaaatgatcatttgattagaaaaaatcacacaggagttgcatgtgacccataaaaacgtttatacttttccaagcgcacaaattcgaaattattaagtgagggaatcgttatgattgatgttttatttaatgaaagcttttcatcgacgttaaaatactactatcagcagcatcatatcgatcaagaagtattatcaatgccgatgtatttggggttaggtgacatcaatcaatggagctttactgaggcccgtaagaccttatataaaatcatgagtactcattctaagacaattgatccccacgagtatggtgagcatttgaatgcaatgacgagtcgattaaagcaagcaattagtaatcgggagacaattcgggtttggtggagcgacttggccgatgattactgtggtttcctgtggttatgcgattatttatcggagcatcagttgcaaatgtttagcattcacgtgcctctaagctatgcaattcaaggaaaccgattgataacattggatagtattggtgaaattacggaggatcagttggcgaccctaaatttatttaagacggaaaaagtaatttctgcagaaaagcaactggcctatagctatgaatggcgggaacttagaagtgacaacacaccggttcgggcaatgataaatggccacatgcttagtcaggaaattgatttttatgatcaattcttgttgggaaacgttaaaaagcatcgattccggaatattatcagagtaatcggtgatacaatcgggtcttcaccaattggggttgctgattggtggtattggcatcggattgattatttaatatccaaaggtgtcttggattacaaaatgccaactaatatggcggttggtagtatcaagctaaataaagtcaatcaaaccacgttttgatcgttgaagataaaacagagcgggacaaaaggcgtttaacttccagagataataattgaattatccgaatattctgaacttgaatatttgggtaattcgattacacggccggaagttgccttttgtcccgcgttttcgctcggtaacaatcgtgtttacacgaacagaggctgggataaatgactattgtcccagcctcttgtctgttaaaacttaaatggtctaattgtccatgccttgtgatctcaatttgaggagctctaaatgacattttctttcggttgcctaattttcgccaaagcctgatcgatttggcccagcacaatttcaatatttttcggattggatagatcatatttttgtaaatcaatccgaattttaggactaacatcatattcttgataccattttttataagcggtccacattttaaaatagtattcttggaggcctggattgtcatcaaactgctcgtaatcgcggcctcgttttttgattcggtacttgattgtatcaaagtcactgtctgcataaaccaatagatcaggggcttttttgggcaactggtttaactcagtcatcatgttatcaagtagcttgagatagacagataactcagtatcagtaatgttaccctcggcgttgttttctttagtaaataaggcatcttcatagattgagcgatccaacacgttattgtcattattaagcgcctgtttgatcattgcaaatcgtttattcaaaaagtaaatttgaagtagaaatccatattgttttggatttgagtaatacagtggcagaaccggattttcgccgactggttcaaaaaaagcctttgtgcctaaatgttctgcaatttttcctgtaagtgttgttttgccaacaccgatcattcctgctgtgattatcaccatggtagcccctcttttaataaaattaacaatatatagtgtaccatagaatatggtcacacaatatctataaatcttgaaaaatccaatcactatctaaaggcttattctcattaagtagtacaatgaaagtattgaataactgatggagggaattatttatgtataaagcggttgtttttttcgatttggatggaacgttatttgataatgaaaagaatgtctccaaagaaaatattgcagcaatcaacgaactacgtgccaatcacattttgccaatcatttcgactggccgaaatatttttgagattcagtatgtcattgatgcaactggtattgactcattagtaagtgctaatggcagttatgtccaatatcagggtaaaaaattaaaagcagaagccattcctgatgatgttattgaaaacttactgacattcgctcagaagcagggggatgtgatttcattttataataaccgagaatttgctttaacagctgaaaatgagttaacgaaggtcaactatcggcttttgcggttgaccccacatgttgatcccgacttttataaaaataatgaagttaatttcttgaatgtctttaattatgataaggatcaattatatcaagatgagtttaaaggaaaactgtcattggttcggaacaatccgcggtgtttggatacgatgaactggggtgtctccaaacaaaccggcattcaagccatgcttaaacaagctaagttaggtgatattccgtcttatgcatttggcgatcagttaaatgatttacaaatgtttgaagaagtgaagtatccaattgcgatgggaaatggtcggcctgacgtcaaagccaaagctgcttatgtcacgaaatcaaacattaacggcgggattgttaatggattacgtcattatggattgattaaatagtgtcaattgaaataataaagtgaattgcggccgttttacacgtgcaaaaccggtaaaaataatgtcgtttaattataaatagtaaaagcgcgttagccaataaatcccaatgatttactggctaacgcgcttttactattagtaaggtaacaattacttggtcatttgtttctcaatattagctaatgtcatttcagcagttgactcaaaattaacatctgcggctttgagaattgttttatcgccaattccaattgaagtttcaccagcagcattgattgattcaacgccggcagcagcatcttcaaccccaatgcattgggcaggtgcgaggttaattaattcagcacccttaacataaatttccggatcaggttttcctttgcttaaagtcttggggtcaacaatcttagggaaataatctgttagttgtaattttttcaaaacagttggggcgttcttggaggcagatgccaatgaaagcagatacccgccatttttgatttcatcaagaaatgctttgatacctggcaaaatatttgccggcgtcattttatcaactaatttaagataattggtatttttttcggtagctaaagtaactttttgatcctcagtatatttattttgaagatttcctgcttttaaaatcatttccaaagagtccattcggctgattcctttcaagccatcttcaagttctttggaccaaggggcgcctaccttatcagccacttggtgccatgcttgactgtgaaaaaccgaagtatctgtaataacaccatctaaatcgaatacgaagcccttaatatcagaaaaacgtgccattcttcatcactccttaattatttatatgagatttctgttggtttatttttggaaattgaatatgccttatcagccactttaacgtgagtatctttatcggccgtaacgattaaccggtgatgtgcaatttcaaatttatagttaattccttggtatgtttgcttgaatgaaagtttttgccacaagcttggaagatgcggattaatactgagttcgtcagtatcaaatcggacaccaccataacatttggtttcaatttccaaggtagctcccatgacgcctaagtgaattccctcagcggttgtgccaccttgaatatcatagtaatcggaaaatagagcggtagaaaacagctgccatgattgatccatattgccatccatttcgtcaagaactgaatagacaatccgtgataatgttgaaccgtgggttgttcgatcaagatagaatcttaagttggttgtaaagaaattggcaggtaactcatagccaagtcgggtgatgacgttttgcacttcattaaatggcaaaacgtagtatgccatcagcgtatctgcttgcttggcaacttgatatgagtctggcgattttccttcaccctttagtagtcggtcaattctagatatatcgccgtatttctttcggtaggaatcaaaattaagtttggaaagattaaagtatccggagaattgaccaatgataccctcttcgttgatatccaagcgaagcttatgggcaatgtcactcattttatcaagcagttcgttatcagttccggcctttttatttgcactatccacaacagctgctttttgattagcgactaatccggcaactttgtcaaatagccaggaaaccataatgtttgtataagcgttattagtcagaccatgatcatcggcgtttggatactcttcgtggaattcatcaggacccatgacgtgccgaatatcgtagcgatccgccgatttgtcgtaatcagccatgctgacccagaatttgcaaatcgaaagaagcatttccaatccgtatttttgcataaagtcatgatcaccagtgatatgaacgtaattaatgacatcataagcaacggaaagcgagacgtgtcgttgtagtcggctattatcagggtcccactcaccgctaactggattcagatgaacaaattgtgattgctcgtcgccatacattccagattgccaaggatacatagcgcctcgcttatcctctgaggtcgcgtattttcgagcttcgccaatcctgttatagcggtaaagtaagcattgttttgcaattgcagggtagtgaatggcataaaacggcagatcaaaagtaacgtcccagaaaatatggccacgataagcttcaccatgaaggccacgagcgccaaccgatgaatcgagtttaccggatgccagtgcagcacttgtaaccaacatatgataaatattgacccgagtgagtttttggctggtaatatcgttttgaatttgaatatctgacttattccatacgttaccccagaatttcttgctatctgctaaagtatcttcaagcgaagaatcgttaagctcattttgggcagccgtttccaaattatcatccgatttttgactggtaaagatcgtgacgcatttttcgaactcgtagctttgaccgggttcaacattaatgctaagtgattgacggatcatctgattttcagttgttgtatcaattagtttttgaacatcaacagtttgactcgttaacttggaattaatgacaaaatcgactttagatgttttggtttggccgcttaaagaaatctgattatcgtgagcagacatgccaacaatgtcaatatgtttttgattaaagtctttatatcgatcaacatttccgttaatgacgctgccgtcaatttcggaataaagttgcaaactaccggaaaagttaatgggttttagttcatacttaattgaatagcggtgccaattagtcatattagcgacctttgtggcccggacctccaagatatgaccagttgacaactgaatatgcaaggtcgtcgttagaacaccggtttttagatttagactacgataaatgtcttgaatatcttcttttttaatggtgaatggttgttgatgatccacaccaaagctgatgtattgtgcgtttggcaagttgaccaagtcttcattaaccacatcacggccgttaatattggttgtaagttggttgtagacaccggcaacatacatgccagggtagttatccttgttggcggttgattcgacgtaggccccacgtaacccgaagtagccgttaccgattgtcagcatggcttcttgaccatagttacgcttgccactatattcaccataatagtctaagtgccatttaagatactcggccttttgctcaacggctttttctaaaccgatttctttaacagtttgtaagttaacaaccgggacgttcatcatattggcaatagccaatccgatatcaatcttttgatggttgattccgataatcgtatcggaaaattcataattaagtgaattttcaatgatggctgcatcgataggtaatcctgtcagggcagccttaatattttccaggttatcgccaattgaaaatttggggttgtatgtaatcatgaacttccgaaaggggggtctgttggaattttcggaataatttaattccataaccccatcgcgagccctaatagcaaacgttctcataacaaaacctcttctcaaaatttaggaatcataaaataattcttataacttaattttagaccagccggtagtaaagagcaattaattgggtgtgaaatcggttgtccactaccattgttgaaaaggttgggtgatggtcacagaaattcttggcttgccaaatagtaaacgcgtgatacttctaaaacgtaatgagccaactgtcgtcaggctaaacagtaaattacgcaaatgatcttctttgattaatcaaccagtttgataattacttaagcgggttatcattttgcctttctgatttttgtaataagtctcgaatctcagtcaagagaacctccttattatcaggagctggttcagatttagcgggttctttggttacaaacttgttgatcattttaattaaaatgaaaacgacaaaggcaataatgaggaagttgatgactgaattcaagaatgcaccgtatttgaaagtggcatcgccgaccttaagtgcgagatttgataggtcaatccttcccaaaaagattccgataaacggattaattaagttagttgttagtgacgttacaattgctgtaaaggcaccaccaataatgacaccgacggctaaatcgatgacgtttcctctcgaaataaatgctttaaattcttttaacataagttcgttctcctctctgagattgtgttatggtattaacatcaatttattatacagattagatttttaaaacgccaaaaatgggtttaccaattctcacgtttcgtctgatttgtgagtatgataatatagaacaagaaattccaaaggtgaatagaaattgaaaaagaaaaatattattctaatcggcgccattatcatccttgttttatcagcaacattttacattacacaaacttttagctggtcttccatcgcatttattgcaatctggattggcgcaatgattttgttacggttgatgattacacccttgctggtattcttattaaaatcggataatcccaagcgtgattggaaagactgggatgaagatgatgattacgggattactcaacaaacaagtcaatctaaggatcagaaaaaatagtttgaacgaaggagaagtttatgaaaaaagacatgcttagaaaaatattgatttcggctgcagtccttttgtcacttgttattggtgggtcaagcctattaacttcaagcgttgatgctaaggctagggcaacgaaagcaaaaacaactcaggttgcaaattctaagcagcagttggtcgatattgttatgaaacccaagagtcagcaaaacctggatgattttgtttatgacagcgttgaccctggaaatattaattaccggaaatttgtaagtgccaagcagtttgcctctcaatttggtcaaaatgcgacaaatattaaaaaactccgggtttatttaaataagaatcacttaaagacaaccgtctatcgaggaaacctgataatgtcggtgacgggaacaactaaaaatattgaaaaggcttttaaagtcaacttggtcaacgtgactaagggaagtctcaagtatcaaaaggcgatagggacagctcgggttccgaaaacactgaatagggcagtttacgcaattatgggactctcaaattattcgcccttttcaaataccaaacgtacattttcaccagcatcatttcataagttagcagaaacgtcgggtagttctggcatctcacctcgttactccccacaaaagtttgttaatcgctatagtttgtcatcactctatgccaatggttcaacaggtcggaacaagacaatcggtattatcacttttgctaactatcaccccagtgatgcttataaatattgggcaggtcaaggaattactgttaagcaaaaccggttaagtgtttatcggacaaatgaatatgccgggacatgggatggttatgatgaaacaacaatggatgttgaacaagcaggtgcaatcgcgccggatgcgaatattcggacatacatcggtaggtcaaatatcactggtatggtgaactcgttggctgcagcagttggtcaaaatagtgctgatgcattatcaatttcttgggggcaaagtgaagctcaggttgcgtatgaaatcaaacagggcattacgccagctaaatataatcagattctaaatttgctgtttgagcaagcggctgcgcagggaatgagtgtctttacggcagccggtgataacggcgcctacgatggtatctcaacgggattgacgaagggattatcagttgataccccttctaattctccgtatgtcacgtctgtcggtgggacaacgttgcctaaaacttacacagttaacggaaacaaagtgacagtttcaaaagagcgtgcctggggatcagaatttctttaccccaactatgatcatcaaaagttttttaacacaatggacatgattgacagttacttcactggtggcggtggtggatttagtaagtataatgacacgccaaagtaccagaagggcttcagcggagttggaacctacgaagcaacaaaactctggtcatttaataaaaatggtcagcctaagcagctaagcacaccggttgaaattagtggtaaacagcaaggacgtaatgtccctgatatttctgccaatgctgatcccgcaactggttatacgatgtttgttaccccgaaacataatgctgcagacaagggggaatgggaaatttcgggtggaactagtattgttgctccccaaattgcggcaaccagtgtcttaatgtcggataattcggctggtcgacttggcttttggaatccacaaatttaccgatttgctgccagccatgatacgccctttacagtgttggatagccgaaccaacaatacgaatttgtattatacgggtcaacccggcaaactatataatcaggcaactggtttaggaacggtagactttacgaaattgaataatgcttttaatggataactgatacgttgttcttaagataatcgcatatttagttgcgttcgctttgaggtattttttcaattatcaatttaacaacttggaaaattcagattgaggagaataaaatcatgaataataattcccaaaaactgacagcgggtgactattttgaaagaattttaatttttgttggattagttgtcatggtgtcaattgtccaattacctctttttttcattgcaaaaggtggtttttcgacaaaggcaaattatatatttggggcgctttacttaatcatttttgcaatatttatttggattgcattaataatttataataaatacgttcatcctgcgaaaagggcattgacttggcaaaatgttaaatggatcgttttgtcatggatctcatttttagtgattgaagttattttaggccttcttaatcaagtgatctatcatgtttcatcgacttcgaacaatgaaattatcagtcaacttatgacaactaatcaccttacaatgatcttaatggggattacagctgtattcttctctccaattttggaggaactggtttttcgtggatttctgattggtgcatttttcaacaagtcaagtcgaatactgcctgttattgtaagtggcgtattattttcaactatgcatatggaagatttaaacgtcattagttttgtaacatacgcgttactgggaatgattttggcatatttatatgttcgaactgataatataaaagtctcaattgggcttcatttcctaaataatttgtttgcgatggggatgatggcgatctctatttttacaattggccagtaatcaaagattaaattcacttaattttgaaaaaaataattgttaaacaattcaaataattttttgaggtgaacaactatgggactatcagtaaagctaatcaatgatctttcagacggtacaaaaggacctaataacctaattacagatgttgctggcgttaaggtaggtcaaatcacaattgatgagggtgatgtacacactggtgtgacagcaatcttgccacaccaaggtaatatttttcgagaaaaggttccagctgcatcctatgtgattaatggtttcggcaaaagtgttggcttagtgcagattgatgagttggggacgattgaaaccccaattattttaactaatacttttggtgtgggcacagctattaatgcgctgaccaaacatatgttggatcaaaatccggaaattggggacacaaccagcacagttaatccaattgtggctgagtgtaatgatggcgatgtttcaaatattcgggcgatgagaattaccgaagcagatgttatggcagccttaaaaaccacggaaaccacttttgaagagggtgccgtgggcagtggtcgaggtatgatgtgctatgacttgaagggtggaattggttcttcatcccggcttgttaaagttgacgatacccacacctacactgttggctcattagtgatgacaaactatggttttcttgacgattttattgtaaatggtatcccaattggtaaaccgttggctaaaatgttggctgctgataagaaaaaagaagaaaaaggatccattattacagttttggcaaccgacgcgccgcttaattcccgtcagctcaaacgattggctaaacgggcaactgtcggtattaatcgaagtggcggatatatcggcaatggaagcggtgaaattgtttacgcgttttcaacagctaatttagttaatcattttgctgatgatgattttgacacaattgatcgattcaatgataatcatattgatttattttttagagccgttgccgccagtgttgacgaagcaatcttaagctcgatggttcatgccaaatcggttgttgatcgtaagggacggttgcgattgggattagttgatgcggcaaataaattagttcaagaacaacctgattatactgaaatggttgagcgggttttgacacaacttggggtggtgcaatgaagggcttgattttacttggtgctgagaatattaatcaaaatgcttggggtgcaatcaatggctgcgaggctgccagtttattagagggccttcatttccaaaaacgggcagaaatgattaattatggtcaatttctacttgatatgccaattagcgcggatggtaatccttatcgtggatttggtgggtcaccgtttaaaaatcagatcggaaaatttgaagcaatttttgtgacgccattaatgcaatggggatctcgatatggttcattaataaatttaagtggcgcggctccttggtggttataccagtctgtcaaagagggcaatccggtaatagtttatgtcacggttcattttgaggaccctaaatgggaacaatatccgtttgggaaagtaccaacgaataatcacgctgttttattagatggcattgattctgaccgcgttcatgttagtgacccaattgatggaaaatattggttggataggaataaattcgaaacgatctataattcccgacggatggcggttacaatccaaaaataatcactttttcttaccaggtctgctaaaaattattagtaaaggcctgttttttttataattttatgctaaattagaaactaagtttggtttgttaaaaatcttacatacaaattgaggagtgatttatgatgcatttatcacgtagatttacggtattggcgggggttgcaagcatttcattgattcttgttggctgtgggcagaagtccagtcagcaaaagaaaacgattacgacatcaactgatactgaattgacgacggttgatccttctaaaaccacagctgttgggacatttaatgttttgaacaatgttgatgaaggtcttttccgattgggcaaggatagtaaggttgagcctgggattgctacttcatctcaagtttcaaaggatgggaaaacttacacctttaatttgaggaaaaatgcaaaatggagcaatggtgatccggtaacagctcaagattttgtttattcttggcgacggactttgaatcctaagacagcttctcagtatggttacttattctccggaattaagaatgctgataaaattcaaaacaaaaaagctgcagtttcatcgctgggaattaaggctgatggcaagtataaattgacagtgactttggaacagcgaattccttactttaaacttttgatgggattcccagtattcttcccacaagactctaagacagttaaaaagtacggtagtgactacggaacttcctcaaagactcaagtttacaatggtccgtttgtgcttaagaaatggacggggacaaatttgacttggacacttgccaaaaattcttcatattgggataaaaagaacgttaagcttgatgatattaaatttcaagttgtgaaagatcctgcaactgggttgaacctatataatcaaaagaaacttgatatggcacaactctcagcaacacaagccaaacaaatgggcaagaaaaaagatttagtttcaagacgacaatcttcaaattattacatcgcgtttaacttaaagaacaaagctttccaaaatttaaaaattcgccaagcaatgtcaatgatcatcaatcgaaagatgatggctagcaaggttgttggcggtggcgctattgataacgatagttttgtttcgaaaggattagctgtttcaccaaaggacgggactgactttaccaaagatgttactgcaccggcctcaatgagctataacccaacgaaagccaagcagttgttccgtcaaggattacaagaaattggtcgatcatccttacatttcactttgctgaattctgatacttatgaccagaagcaattgagtgaatatttgcaaagtgcattacaaaaattacctgggttgacggtttcgttgaataacattcctggaagagttatcctttcacgacaggctgatcatcagttccaagcaaccgtggccaactggtttgccgacttctctgatccaattacgttccttaacattttaacgtcgaccaacccaagtaatatttctcgttggaagaatgcgacttacgataaattaatcaaggctagcaacgatgatgatggtagcaacgcagacgcccgatgggacgacatggtgaaggcacaaaatgtcgccttgaataatcaggcaattattccattgtatcaatcaggtgaacaatggttgattagttccaaagttaagggtgtcgtttataatactgcaggcgctaactataactttaagaacgcctacgttaaataggaggctgtgttttggaagaaccaacaattactcgaattgaagttcaaacggcctcagttccgcttaaacgaccgttcaagactgcgttaagaactgtgacgacagctcaaaccctgattgttcaaattagtgacagcatgggctacgttggttttggtgaagcggcgccgacccctgtaattaccggtgacactttagctagtatttctgaagcaattaatcatgtgattggtcccaaactgattggtaaagcgttaagtcgttcagaagacatcaaagcaatcattgatcaatcaatggtgcataattcaagtcctaaagctgctttaaatattgcagttaatgatttaatttcccaacactacggcattccactctatcaactgttgggcgggaatgctgatcagatcttgactgattatacggttagcgtgggctcaattgatgatatgattggccaagccaatgatttagtggctcaagggtttaccacgttgaaattaaaagttggtgatgattctgaagccaacgatgttgctaaggtttctgcaatcagaaaggctgttggacctcaaattaagcttcgtttagatgcaaatcaaggatggcatcctaaacaagctgttgcagctattaatcgaatgaaaacccttggattagatatccagtttgtggaacaaccagttagggcagcagattttgatggtctggcatttgtgactgctaatacgacaacaatgattatggctgacgagagtattttttcagttacggatgcgcaacggttaatcaatatgcgtggatgtgatttaattaatcttaagttaatgaaagccggcggaattgataacgcgttgaagatcaataccttagctgaagcggctggaatcccgtgtatggttggtagtatgattgaatcttcggtttcagtcactgcagctgctaatcttgcagctgcaaaacaaaatgtccgatacgtggatttggatgcctcaatgatgttttcgagcaatccaattagcggtgggttggttaataaacgaaatcaaattagtctacctcatcgtgcaggtttaggttttcaatcttaaagtaatgttattctaatgagtgattcgttgtgacttgtcacagtgaaccactttttattatttcgtcacttactaaaaagtagtaatcgtttatgaaatgttggaatcgtggtattataataaaaaacgaatggaggtgcccagatggaaacaagacgtgtaaaggtacctgtagcaactatctggaaatcaaaaaattcaccaagacctgttgatcaatcggcagttgatggtgatgtaaaaaaatgggttgcccaaatgacggatcagcaatcggtggatttaagcgaaaatgatttactcgaaactcaagcacttttcaatgacgaattaattatcgatcactttgatggtgactgggcaaaggtgtatgttgcaagtcagaaagatgattctgactctagggggtatccaggatgggtaccaaccaaattattgagcgatcagcaagtggcctatccgccaattacggcaacggtgaggattgctgttaaaaacgccatattgtatgatacaaccaaaaatccgattcttgaattgagcttaggaacagtgttgcctcagatcggcagtgatgataaattcatcgaagtggtgacacccttgggaaagggatacattgatgaagctgccgctgttttgccgtttgccggtgggaatgcaggtgaaacaatggttgagatggggcgccaatttctagggatgcgctatctctgggctgggattagttcatatgggttcgattgttcaggatttgcttatacgttgcatcgcgttttagggtttgatattccgcgtgatgctgatgaccagcgtgatggtggattgcctctctcgccggaagaaattctgccaggagacttagtattcttcgcatatgatcacggaaccgggtatgtgcatcatgtgggaatgtacattggtgatggtaaaatgatcgaatcgcggactcctggtgcaaaaattgatattgcaagtttgacggaacctaagtttgcgtcagaatttgcaggatttaggagatattggcgttgatgcagaaccttgatcaaaaaatgactgaattattgagtcaaacgacgacacacactggcatcttgattcagttaaatggtgaaactatttttgaaaagaatgcgaatcaaatatttccgtctgcatcgttaattaaattggctattttgaatgcagtcatagaactgcgtcccgatttaaaacagaatattcggattgatccgaaccgtctcgctggcggcgccggtattctccagttaatgacaagatcaacttggacgttgcaagatttattagcattaatgattagtgtgtctgataatgcggcaagtaatgtgatcattgatcattttggaatggacacaatcaacgaatatctagttaatcatcagtttgagggaacccgacttaatcgatatttgatggatacaaatgctttacgaactggccgtgataatctgacatctgctgttgaagctgttcgattactccagattgcattagaacattccactatggtttccagttggtttgcgaaccaacagtcccggtacaagttacctgggaattttgatgaacttactgaccaagtgacagtctttaacaaaaccggtgaaggggttcaaatcgatcatgacgttgcaagatttgtatataacaacaacgtggtagatgttgctttgctaacttcaaaatcccagaggcgaatggatgcactgaggttgtttaaccaaattggacaattaatttttgactttatcatttcgaaaccataaaaaataaaagagtggaccagcaagcggttaggctccaaaatataggcccctaacttgatattcctgattttggaatgttaagttaggggcctatattttggggtctgcttgctggcccgcgtttttcttctaagtaaaaagcttaacgagatattctgaacttgaatatttggataattcagtgacatggtaggaagttgcctcttgtcccgcgtttttttgctcggtaataatcgtgactacacaaaacggggcgggacaaaattacttttgtctccgccgcgttgttgttaatatattgataatataatggataaggaaaactatttaaattagaattaaatagatcaaagttggttaatttgcattgtgttgttcattatagtgatcaaggtgggcttcaattgttgcaattgtttccgaacaagcagctttctcttgcggagttaaatttaaaattttgaagcaattgctaactcgtttaaatacactgtcacgattcgtaacagccatgtgggttagctgaataatgaccgttctttcatctttgtgacttcgctctcgcttgatccaattgtgactttctaatcgttttaacagtggggttaatgtaccgctatcaaggtgaagatggtttccaagttctttgactgataatggtgcatattgccacaatgtcaacatcgcaatatactgtggatatgtcaaactgaaaggacttagggcatcttgataaaatttattaaattttttattggctgtgtaaagttgaaaacacagttgagaatttaattggattggtggttgtgtattgggcataatttcaactcctgcaagtagtgtataatgttattgtaaagtatttggaaacaaaatcaagaaaaataatatggagcaatttaattgcgaacaatacgttattttgttccagcaaaaggggatttaaattgattaaacttagtaaattaagaattagtacatggttatttattgttaccttaatttcgatgcttggctaccttggctattttggttattggtatttgcaaggatctcccaaattccatggtcagttgatgctattaattgaggttgcagtaggaattggtattgcagtgttaccgtttctaattgaaaaacttggtcgtttttattttccacaagttgaactgatttttttctatatttttctttatatgtcggttttccttggttccggtcttcaattctatagcattcttttttgggacaagtatgaacatgttctttcagcaatgatgttggctggattgggcttttcaatttttcagggattattagattctcgtcaaaactctagaacccagccatttttggtgagtctgtttgcatttacctttggcgcaacttgtggcgtcttctgggaaatgtatgaattcacggcggatggtttgggcggtcttaatttgcaacgatacgagcaagctggccggatgttagttggtcgtgccgccctgatggatacgatgactgacttaattgccgatttgattggtgctttcttaatggcattgattggctatttgatgatgaaaaataatcctaatagtggtcgttatctggtatttaagtcaaaacgtcaaaatatcttttcaagtctctacttttagtgtaaaatataatatgttgttgccccaatggcggaactggcagacgcgcagcgttcaggtcgctgtttgagagatcaagtacaggttcgaatcctgcttggggcataaaaaagaacatattaaaagaaagggcccccgtaattactgcgattacaggagccctttttgatagctactaagaattatcaagttaatggacaatgttaattaacttgtgatttattatgctagtttttaatcgataagaatgtggttgggatcaaggtgatttattccggccaaatttttatataatcgtaattattaaggaaaagaaacaggggagtcctgctgcttctcagaaatccattattttcactggaaccaattgtttgaagggagtgagagctaaaaatgaattttgaccatattgatcattttgtcttgacggttaaaaatgcggacgtaagtgctaagttttaccatgatgttttaggaatggatatccttgagttcgaaaatggtcgtaaggcagccagctttggtaatcaaaaaattaattttcaggaagtaggacatgaaatcgatcccaaagcggccgttccaacttgcggcgcaggtgatttttgtatcatcacgaaaacaccgcttaaacaggtagttatatctcttgatcacgctaacattccagtagaattaggcccagtatcaagaagtggggcagttggaaaagtccaatcggtataccttcgtgaccctgattacaatttaattgaaatttcgaattatgagtcatctggtcaaggattagaaataaagaagtggaattaataaaagtaagagaggaggaaatcagcctaactttatgacagcatcattggattcagagagggacagaaaatgttccccattcagtgatggattatgctaaaaaatggggtgagtcaataattgctttgactggcctctgttagtgtgaacacaattattatcgagaaaactgcgggtcagcaggcagccccctcaaaaaatataagccctcctaacttaacattccaaaatcgggaatatcaggttaaaagggcttatattttttgagtgagctaaccgcttcttagctcactttggttaattaataattagttgttaattgattgttgcagttgtttttgcatttaatttattctggttaaatgaaaatgtcacagcattaccatttttatcagtggcatatgttaattgttgtagggagtttttccccgcccccataattgattcgccgtttggtgttccaagcgtctttagcgtggcattataggagtcaccttttttgatcccggcaagtctgcttttggaagtgatcttcatgccgctagtttttttagcatcatacgcttttccaacaactttgccatcaatggcatggatagtgacatcagcaactttaaatgaagggtcaacctttgaccatgagtattggacaatctctgtttttgacgctttagacttgctgctaggagtaccaaattttgctttgactgagctttctgttgcgccaccttggccagtcataatgccaaccttaatttttttataattggctaatgtaatgttcttgctaagatcttgtgtttgactacttgaagttttgttactgctgctcttcgatttactcgaattcccacaagcagcaagtgacaaacttgctaagactgttaccgctaatacaactgactttttcataaacatgttatatctctcccaataaaatattaatcacacaaaatacattataagttaaatgccccgtaattactaccggaagtccagcagcccttagtgattaattacgcttgtgatttaaaatatatccttgggcatattttttgcattttaatcataaacgttgcattatgatattagtagtaacaatgttggcgctttcaagaaaggatgatcacaatgtataaaaacattcttgttccactcgatggtagtaataattcacgacaggcgttacaggaagctgtcactctggctaagcaatttgactcgacattaagtttagtgacggttatcaataatacgaatttttattatgggactggtgctgccggaatgccaccacggatgtatgatgatcaaaaggcaatggccaataagattattgatgaagctaggaaatatgttgaggctcaaggtgtcaaatacgaaacgtcagtagatattgggaaccccaaaaatattattgcccatatttatccagaccaacacgacattgatctgatcgtcattggtaaatccggtgttgatgcactgaaccgattactcattggttcgacaacggcttatgttgttcgtaatgcaactcgtaaggtattagttgttaacgcaaaagattcagattaggaaagattaaaatttgaagcagaattaaaaacttgagagtggatcaggacataaaacttgccctggtcctttttatcattttagctcagggattggaaccaggttataagcgtaaaatgatttttggattaagtgctatgttaaaaaatgataaaaaaataattgacaagcctcataaatcgggttattatcatttctaatcaatatatcatttgtttttaatattatttgtgttgatgggaagagtaaccggattagtaacattacagaaagtcttggatgatgagatcaagatgtttgaaagtccgatgaagatgagcccagagcatattcaaggtacgttgctattgaatcgcaaggatgcgttatcatcccaagcttgaacacgagctgttgaggtttagtaagtgtgtggattaataaattactagacgaacaaaggtggtaacacgataataatcgtccctttacctgcattttaatgtgggtaaagggactttttttattcttaaaaattggtttagatgacaattttttgaaaaaatcgtgattactttacataacaaaaaaggaggttacaaaatgatcgaaattacaaatgtccataaacaattcaataatcggacagttttgaatggtattaatttacacgcagagactggaaatgttgtcacattaatcggtcccagtggtacgggaaagaccacgttactcaggtgcattaatctacttgaggaacctgatcagggtacgattgaaattgatggtgtccgggttcaaattccaatcaagaataaaaatgatatattgacacttcgacgtaaaaccgcgatggtttttcagcaatacaatctttttcgaaatcaaactgtccttcaaaatgtggttcaaccacaggtacttgttaaacggactaataagcaagtggctaagcaacgtgctgaaacatttttacaagaggttggtatgcaggattatcaaaagtattatccatcacagttatctggtggtcagcagcaacgggtaagtattgcaagagcactggcacttgatcccaaggtaattttattcgatgaaccaaccagtgccctggatccggagctttcgcgcgaagtgttgaatgctattcacaaggtagcagatctggggattacgattgtactggcaactcatgaaatgcagtttgctgaagaaatttcaaatcaggttatctttatggaaaacggcaatgttgttgaagacggtacaccggctgaaatctttcatcatccggcgaatgagcggaccgcaagatttcttgaaaactatcgtgttcgtcaagcaccaatttattctgcacaaataaaaaagtttaaggtggtttaacaattatgaagaagacacatcgaattttagcaattctcccaatcttattaatcgcactctttttgacagcttgtggtaaatcatcaggtcaaagtaagaaaacatatgatgttgccgtttcaacggccagtaaaccgttaagctatcaagaaaatggcaagttaaaaggttatgaagttgatgttttaaaggcagtggaaaagaaacttggtaatgttaaattcaattacagtgcagtttcccagacggctgaactaatcggccttgattccaagaaatatgattttgccgccaatggtttttatagcaaccctgagcgtcagaaaaaatatttggtacctaagcaaaatgacggccttagtttagtgaagatctactacaacaagaataaggtcaaaaaatcaatcaaaaacttgaatgacttatccggtctccgcgttgctccagtcaatcccaatggtggtatgtataacttgttaaccacatggaacaaaaccaactctaagaaagtaaaagttttgaccagcgatcaattcccattacaacaacttctaaaagatgttaatagtggtaagtatgatgcgttaattgatccttccaatttaggcgaaaacgaaatcatttctggtttgaaacttaataatattaggagttcagaacctgttcgtgcatttccaacttatttcttattcaccaaagacaatacagcaatctctaagcgggttgataaagcattaaaggaattaaaaaaggatggcacgttgagcaaactttcaaagaagtatttcggcgaggatgtctttcagtacaaagttaaggaaaattaagcttcaaaatcaaatttattaagtcgtcaataaaaaagcaatgaattaaaagtcaggtgagcatatgcataattttagtgacgtaattggcctttttaaacagttgttaacagggttgccaattaccctcggcttcattatttcttcgtggattattggatttagtttatcggtattggtgactgccggtcgattaagtccgcggagatggttgagatatcctctagacattttggtttccttcactagaagcattccaattgttttgcagctgtttttggtctattacggattgccagcgcttgttcaaacgctgattggcgttgacctaaatgatgtcaataaaatgatcttctgtattatcacgttttcaatttactatggttcctatttatctgagatcctcaggccagcatatttatctgttcgaaaagagcagcatgatgcggcctatgggttgggatataccaaatttcagacgaattttcatgttattgtgccgcagatgttctcaattgcgctaccatcactgggaaatgaagtcattaatttagttcatcagtcatccattctgtttgttttaggaactgtcgatttaatggggcaggcggatatgattatcacaacagattacacctcatcaccgctgctgacttatttctgtgctgggatgatttattggggattaacgattgttatcacggccgttgttcatagcattgaaaggtatgttgatcgatacaagcaaagtgatttagagggggggacaatatgagctcacatatttttgttggcgatttctggacgatttggaaagtggtccctcagacacttggattgtcatttttgattttaattttagcaacgctgcttggaagtctcttttggcagattcaagagtctaggcacactgcgattaagtttctatatcatgccttttcttcttatttcagaggtgttccgttgctaattcatttattgattttttattacggtctaccgatagtgattaaggctcttagtaatcaatttaattggggggttaacaccgatcaattgaatcccatttatgcggtcattgttagttacacgttatattcggcaagtttcttagctgaaattattcgtggatcctttaagtcagttggtacggatcaactggaagcggcatctgcattggggtatacgaggactcagcgcttttttgcagtttggctgccacaagcgttaagtgaagctcttcccaaaatcttgaattattatacgcttctgattcgtcagttatcattagcttttctggtgtccgtagttgatatttttgcaaaagccaagttggagacggcagctaatgaccgttatattgaagcgttttgtgcggccgccattgtttattggatcttatgtgttgttttaacgttaatcttttcaaaagttgaacactatttacgtcgatatgataggagtgtgttggcatgaatcattatgaacgaattaaagcagctttaaattttcaaccagttgatcgggtcccagttaatttatgggctcatttaccggaatatgatcaaaatccaaaatccttagccagaaagcaagtcgaatttgcgcaacagtatgactttgattttatcaaattaatgccatttggcctctatgcggtcgaagattatggtgccgagattaaatattatgcgcaacgagatcatccggctgttttgagtaaacctgggattaatcattatagtgattggcagaaggttgaacctttacctggcaattatgggacctatgggaaacaggtcgaactggcaaagtatgttcgtgaattctcacaagggcaattaccatttattcagacaattttcaatccacttacgaatgctttaaaattagctggtaatcggttagtgttggatattaaagaacatccagatgaagttaaacaggccttggaagccttaactgaaacaacaattaattttattaatgaaaatattaatgcgggtgttgatggtttcttttatgcaactcaaacagcaactgccaatttatttaccagagaggaatatttggaatttggtcggccttatgatttaaaagtccttaatgcatttaaggataagacatggtttaatgttgctcatattcatggtgatcatacttattttgacttgattgctgattatccggttcaagcattgaattggcatgatcgttcagtagttccttcattaaaggaggcacggcaacagacaaataaagcactgattggtggccttcatgaattaccttacgaggatgttgaaaccggcagccgaccaagtattctagtgactggatccgttaatgaagttgaaaaacacgttcaagaagcgattgatgaagtgaatgggaaagggctgatcattggtccgggatgcgttgccagtcaagaagtacccgatgcaaatatttatgcattacgatctgcagtgggattctcaacggccagagagagtgtttgattaatttaaagtattttagatagctgaatgatacgattttgatgcaattgaaaatattcgagtgggtcatttgaccaaaagaagtcctgtaagatcagccttgagactggttttacaggacttctttagcaatgtgattccccacacgcgttaaatgatgatgtgtaagttgttcgtcaaagtttccgggacaacttacacgatactaaattcgatccgaaatgcgatatggtttttcgttcttttgttgagcagcctgttgttcgtttgtatgactaatgacatcgtctgcgaagaaaatatcaaaattcttgttatcaacgccgtgaacaactagcacccgtttgttttcgtcttgcttttccttataaatctgagcagtttttactgcttcgttatgatcgtgaaaattaccaattgaatcccccgggttaaaaaaaacgacttcatccataaatctcgctcccttcaattctatttcatgctcttattttaattataacttaaaagggtggtaaaatgaaattcgataacgccggatttaaaattgaactgcaacactgagccaagtatacaagtaggccatggagacctatgcttaatagtgaccaaactaattaagaaaggacttctccatgacccaaaccaagcatacta

SEQ ID NO: 656 - DNA, 53143 bp, Unknown
  Metagenome-assembled genome
ccagcgttcgtcctgagccaggatcaaactctcatcttatagttaaaatgataagctcgaaataagctcatgattatttttgttgttacttttattcaaagcgaattgacttcgcaaatgtttggcttcgattaaaaatcgaagcgccctacacattcgtttgtcgaaaattttgttcagttttcaaaggtctaccatcgtcatcggagcgcttgttcatcgcttttgacaactatttaatattatcatgacgagcaacttgtgtcaatgacttttttaaatttcttgacttcggaaaactgtgttctcctgaaagccgcaataaataatataccgacttttcgactcaatgtcaacaaaaaaagacaaatcaatttgatttgtctctaagaccagcttaattcctataagaaccctagacgaaattcgctttgcttatttaattcgtgccaagaagtaatgctttttgccgcggcgaacaataacaaacttaccatcaaatttctttgacggatcaatttcaaaatcaacatcctggactttttcaccattaattcgaatcgcaccattattgatatcttcccgtgcctgacgtcgggatggctcaaacttagttacatcgaccaaccactgaacgatatcgagtggttctgacgacacttcaacagaaggcatcttcttaaaaccttgttcaatttcagctgttgttagttgcgagacatcgccagaaaatagggccttggagatatgctcggcttgatccactgcatcttggccatgaacaaatttagtaacttcttcagccaatcgccgttgcgcttcacgcttctcaggctgtgtctcaacttttttagccaagtcatcaatttcttcgcgacttaaaaacgtaaagtacttcaaataacgaacaacatccttatcgtcctgattaatccaaaattgataaaattcatatggtgacgtcttttcaggatcaagccaaactgccccaccagcagttttcccaaatttggtaccatccgcttttagcatcaacggaattgtcatgccatatgccttggcatcctgtccttcaactttatgaatcaaatcaattcctgaagtaatattcccccattgatcagcaccacctagttgaacttggacatcattatgccgatacaggtggagaaaatcaacaccttgaaggatctgatacgtgaattcagtgaacgaaataccaacttccaaccgactagcgacaatttccttattcaacattgtattaacattgaacaacttgccatagtcacgaagaaaatctaatagggacagttgggacagccagtcatagttattaacgatttcaaacttgccatcttgaccaaacaacttttctgcttgccgagtcagccctttcacgttatgacgaacttgatccattgtttgaagaacccgttcagatttcttgccacttgggtcaccaattgaacctgttccaccaccgataagaataacgggatgatgacccgccaactgaaatcgttttaagatcataaacggaatcaaatgaccaatatgcatgctatccccagtaggatcaattcccacatatagccccaccgactttttgccaacgagttcatacatcccatcgtgatcggtttcctgattaatcgcgccgcgccactttaaatcatctaaaatgttcattaatgcatcctcctaaattatctgttgaatcaccaatcctaattaagcgccatgtctgttacgaatttcgctgttcaatgaatacatgggtgatgatagtatgaccgagaaataaaaaatccctgacaaactaaattgccagggacgaattttccgcgttaccacccaagttattgccggacaagatccaacaatctctcatatcattgataacgaaatgactcgttaagcaaaagctccacagatgtaagttcatttattacccgcttggctcgcatcagccgccaagtttctgaattcacggatcaataaattacttttctgcctcaacgctcataaatcgataagttaataatagttggtccacatcacgatgtcaatggcgcctgccaccaccatctcaaagttttccacgaagcatccgttgaaaatataaattgtccatcactcgatagtgatagaattcagcagaacccatcacacgtgtatgagccaaactccaatctgccaaccggcggtcaaactcaccaatcgtcgttgaatagtttccgcccataatggttgcttgtctaaactgacgttgcaaagcgagattaggatactgatacaaatctttagtcccaaacgtatgacccaactcatgaataattaacgcccggcgtttcgatcgatcatatcgagtcatccagttatcgtttagagcaatcacaccactgttgatttctgccattccagcaaactgattactcatctgcccactcacggtaaccgtcaatcgcgacttgttgatcagactcgttggtttaaatagtcttcttccaagtgcgtgattccatgtgtgcgctgcgaatcgaatatcggcttggtattttttcgcactgtcattaacgaaataactgattttccccctatcagtcaaattcttgttggcaaccattgtattatcaaatttaaccgcggcacctaaagcccgatcgctttgagttgcaaacatccccgttatgccaagaccgatagccaccaacacgctaacaagtacttgtttagcccccactcaaatccccctatcaaaaaagcattgagccggtttgttaatgaaacttatcccgactcatcccctgaaaacaatataacaagtcggccgatgcaatgacaaatctaacgcctatgttttttcattctttcttcacaaaaaattcaaagactgagatagttgttttttaagggctttcattttaaaattaatttgttactaaaataatctgatcactattatttatagaaagaaagtgacatctcgtgttaaaaattgagtatgaaaatggtggcgaacaagaaagtattgattacaaatcagctgctgactttatggcaaatcaacgtttggaagttcccgacctcgaagattattacaagatcaagcgtgttacccttgatggaaccccgattacactctcggataaaacgattattggcctttataaacattttgacagcgaaggaaagtaagcctttcagcaagtcagagttaataaaaataggtcaaagaacgatttgatctcagtacatcagccgcctgttccaatgtttccaagttagaaatattggggggcagctaatgcggttaagaccagttctttaacctattttttctttcttgcgatgatcatgctgcaaagtgaaatcgtttcaagtctagatttaattttactctaaaaagggttctatacatataaacattctttttagtgcgaaaccggatcaattttgaaggacgttttgccatccttaatcacaccatatattcgttgttgatgtgaggcatccaagtagccgaagtccagcagcttttgatcatctttcacaataattccctttaattgattactcaagaactctcgaagaacgggaatctgttcatcaaactttcgagctttatcgacagctgtttggagtgtaaacccttggttaagaaaacgttgaatgtgaaaaatcataaatagtgtgtgcaaattatactgacgtgacgccccttttttctgctcaaggggctgaatgtaaccctgcttttcccaatatcgcaattgacgacctgaaacctcagtaattttttcaacctggccaattccaaatattaactttgtactatcaataaatgttggattttgttcttccaaaagttttcacctagattcgtattttaacgcttacaacattatatcaaacatcaatgctttattaaaaccgatcacaaaaatcaaaggccttcaaattagcaccacgacgattgtcaaaagattcttggttggcacacttgtttttgatataatgctttcgaaaggactgaatcaaatgggattttcgccaaagctaattgtcgcagatgtatccttgattatttcaattgccctcgcattttttattaaatatacgtcgttacaggatgatgtcaaaattgggttgattattctagccggcatttttttaatgatttcagtggtcattaacctggtttcagctagagaacgacgtcgaaagaaaaaatagggtgcggcttgcgtgtcaaaaataaagtaaggatcagttaaaacgaccttaacttcaaaacaccgaatcattttccaacttttcaataatcatcatcaaaaacggacagcgcgggacaaaaaggcaacttccggccgtgtaatcggattacacggccggaagttgcctttttgtcccgcatttttgcttggtaataatcgtgtttatactaacagaaaccgggtcaaacgactattgtcccacccctccgtttttagaccctttaagactcatatctttcaataacttaaatgggcacctgcagccgaatcctgtaaccaatctcacttctcatacaatttaattaagccttgcgtccctaagtctccccaatgatcctgatcgaccatcttttcgtataactcacgggcttgtcgggtaccaggtaaacttaacttcatttgatcagcaaccgccaatgcaatccggagatctttgagaaaatgcttggcagcaaatccaggctttaaatcaccgtgtaaaattcttggcccatagtttgccatgctccaattttcagccgcaccaccattaatcgtttggatcatttgatcaggatccaggccggctttagtcgcatacatcaatgactcgatcatacccgtcatcgttccggcaatcataatctggttggccatcttggcgttttgcccctgaccggcgtcaccaaatcgcgttatcgctgttcccattgccttaaggattggccgaatctgatcaaatgttttggcatcaccgccaaccataatggtcagcgtcccatttttagcaccaatatcgccaccagaaacgggggcatccagcacatggatgcctctttgataaccatagtcagcaatctttttagctaagataggggaactggtcgtcatatcaattaacgtttcatcagacgtggcaccctcaaaaatcccgttacttccaaaataaaccttttcaacatcttttggaaaaccaacaattgtaatcacaacatcactaacctcagctacctttgccggtgtatcctgccactgggcaccatttgctaatactgtttgcgcgtgttgtttggttcgattataaacagtcacctcaaagttcgctttcaataaattattgatcatccctgtacccataacgccggtaccaataaaaccaattttcatattatcacctcatcgattcttgacttgtttcaaaagtggccgccaccaagcagcatgattaacataccacttaatcgttgcccgcaatccctgtgaaaagctcacttgaggataccaccccaattcactgcgaattttcgaatcatcaatcatatattgtaaatcattggcaggccgatcggaaacaaattcaatctgcgatttagaaagccccagctcctgaacaatttggttaaccacttcaagatttgtccgataataatggccggcaatattataaatctgacctgatttaccactacgaaggaccgcatcaattgcggcacaattatctaccacattaagccaatcgcgactattttcacccttgccgtaaatcggtaattttttcccaagcaatccgttaaccaccataaggggaatcaacttctctgggaattgaaatctaccatagttattggccgaacgggtaatacaaatatcagttccataggttttaaaatacgccaaagctaataaatcggcggatgcctttgtggctgaataaggggaactgggctttaatgccccattttcatcaaatgcctggtgaaacttagcggttccataaacttcatcagtcgaaatttggaccaaacgaatattgaattttctcgctgcatttaacaaaacactcaggccaacaaaattgctgctgacaaaagcatttggatttaaaattgaacgatcaacatgtgattccgctgcaaaattcacgatgccatcaattcggtaatctttaatgatcgcattaacatgagcttcatcggtaatatcgccttgaacaaaggtataccgagagtcatcattaatatcggccaaattcgccaaatttcccgcataggttaacagatcgtaatttacgagcgaatcatgcgattgacttgccattaggtaatgaataaaattcgagccaataaatccagcgccacctgtcactaaaaggttcaactccttaccccccttcgttaacctaatcatgtccaatatcaatttacccgaagcctaaaaaacaaagaaataagcacaatattaatctagtcttaatttaccatattcgcgccatcaattaagattaaatcacaaaaaggccaaaacaaatttacatttgcctcagccttcaaaattttgggaaagataaccgctgcggttagtcttcaattgcatcttcgtttacccagtatttttgagctttgctgctgttagaaacgcgaatccggtaaaagtcttccgattcgcgttcgccatcatcatcccgataataggctttagctttcatgtcaacaaacacccgtttgccagttcgggctttaatgcggctccaagaatactcccgattattctttttagcgcctggaacatatcgatataatttttcttcacggtaatcttcgtcaagagttgccttaaaattagtttttgcgtaacggacacggtaaacccgtgatggccgaaaatccaagggttgaatctcggcattggtgcccttgagttggtactcagtatcagttgtttcggcaatgttgttaactctggcagtttcagtcgttggtttcgagatggaatcatgggtcgtacttagtgagaaaccaacaatactaattggaattaacattagcattgctgcgtcagctaaacgtcgctttttcataatcatctgcctccaattatttaaatgatatttatacattattcttatttatgccataatcataacctaataggagaaaaaagtcatgtctaaaatatgactttttatcgacctttttaagacattcagaatgaacaatgtcgaaaatcgatttgagcaccaatatcaatctttcgcaaacctaatatcaaacccaaacaatcactctacataaaataaaaataaaccatcacaatatcctatgatttaggcgtactgagatggtttatttacatttaatgattgacgttccaagctaaacaattggtaatttcacttgaattcaaaaaatacggtatctcactattagtctatttctgatcatatgcttcctggaacaatcggacaatttcttctttagttcccttgcgtgggtttgaaaaggcgttaccatccttcaatgcattttcagccatcatttcaaaatcagctggtttagcgccaatggatttgatactacgtggaatattaacatcatcgcacatttggcgcattgctttaattgacaaatcggcagcatcccgtgttgaaagaccctcggtgttttctcccatgatcttagccaattcggcaaatcgctcaggagcagcaacaatattatatttctcaacgattggcaatagcatggcacagcaaacaccgtgtggcgcatcatattgtccgccaagctgatgagccattgcgtgaacatagcccaggtccgcattgttgaacgccatgccgcccaacatttcagcttcaaccattttcgttcgggcttcaatattatgcccgttggcaactgcttcccgtaaactttcttccactagtttgatggcttggatacactggccatcagtaatttcattccggttggttgaaacataaggctcaatcgcttgaacaaaggtatccatccccgtagcggcggtcattgaagctggaatatccagcattaacattgggtcgttaaatgatactaatggaatatttcgccaagagacaaccacaaacttcaattttgtttcttcattggtaatgacacaatgccgagttaattctgaggctgttccagcggttgtattaacagccattaatggaggtaatggattgtctaaggtttcaatgccggctaacttggtaatatcatcaccatttgtcaaaatgatgccaacacctttcccacaatcatgagctgaaccaccaccaactgtaataatgctgtcacagtgattatctaaataaacagctttagcttccttaatattatgaatcttgggattggcctcaactgaatcataaatcgcgtaactaatcccaaccttatctaaagatgccaaagtttgagttaccggaccattttccaatccccttaagatcttaccggtcacaatgagtggcttcttcatgtttaacattttagctcggtcaccaatttttttaataacccccttaccaaaaaaattgacgcttggcattaagaaatcaaaattctctttcatcaataatcttcctcctaaaacaggtcgctagattaggttggaaccaatgattggcccatgtcatccacaagccgatctctctggtgatctgaccctattatcatttttaagcagtttcatgctatcataaacccaaactattgtaaacattttcacaatcatttgccagaatgtttcaaaaatatgaaaatgattgatgtgccactaaaacagtattttcatgtctgcatcaggttggacgatcacttaccataaggacagagttttgtcttatctttactaattgtgaacaaatcacgaaaggatttctaaatgaacgttgaccactcatccaaattagtctacaatataggaaattttaatttacttaagctttgatgagatgagtagcattattttcactgtgatagagagtttcagttgctgaaaagaaaccagtgagaagatgtgaagatgagctcggagctacgtgtcggtccttgggcctgcacatcgttagcaaccgttaccttgcaaaagtataaccattcttaaaaatggcgtacttattgagactgagattgtgagatttcagtaaactcaggtggtaacgtgactaagccttcaccctgaacaacgaatatttgttgttcagggtgaaggcttttttggtaaattaaatgattaaaatttttggaggaattcacacatgactcaagaaccttttgacatcgatactttattggcacaggcagggaatcgcgataataacgatcaataccattcagtttcaaccccgatttatttaacgtctaattttcgtcaccgcgatttggaagacgttgaaaactttgatccaactaaacagtattcatactctcgactttcaacacccactcgcagtgtcctggaaaaaacactggctcaattagaagatggcgcccgtggatttgcactaagttctggaatggctgcgattcaattggttttttcattatttaaatccggtgaccacattattacatcagacgatttatacggtggctcattccggtattttgattatttagcagatcactatggagttaaattcagtaaatggaacggcaaagattacgaaaaattagcatcccttgtgacgccaaagacaaaagcggtttggctggaaacgccttctaatccaaccatgaaaattattagcattaaaaaggtcgctgatattatccataaagccaacccacaaattttggtttgtgttgacaatacctttctcactccggtttaccaacaacccattcgtcaaggggctgacattgtggttcacagtgcaacaaaatatttatcaggccataatgatatgctggctggtgcggtcattgccaaatccgaagaaattggtgaagaactcgaatttaacttcaataccaccggtgtaacacttgatccatttgattcatggttactgttgcgaagccttaaaacgttatctgtccggatgcaacgacacactcaaaacgcaaaatatgtcgcggcgtgtttggctaagttgccccaggtagaaaaggttctctatcctggcgaaggtggcatgattagcttttatgttcaaaatcgcgaccaggttgatcgcttattcaaacgacttaaaattatttcattcgcggaaagtttgggtggtgtggaaagcctactgaccattccttccctgcagacacacagtgatatgacgaaggaagcccggttaagattgggaattactgatgaactattacgattatccaccggacttgaaagtgccaaagatttggcaaacgatttaaagcaggcgttggcggattaaaagagagtgcaaagagccgcggttagcttccagaatataaactcaatcaaccaatattcctgaatttggaatattggttgattgagtttatatggccggaggctgcagctcctttgcatatttagtctggttaaaattatgatcacaatcaccgtatcaattaatttgtcatagtactgcccctcgctacatttgttaattcaacaatactcataagtacaacaaaggagcccaggcggtaaaactgtctggacttctttgttattaatatagttcagatgaattatttcttgtttcgccatctcaagtgaacattaaaagaacggcgacctttcagaagggaaaagcacaccccactgatctacatcaattttattggcattaacccttggataatttatccacagcataacaatcgtagacaaactttatggcagcaaagtctcattgagtgagctcttatttagattaatggtctaactcttcagcggttctttatccgctttgtcggcaaattcttgaatttctttcttttgatgctcattaaagttccccagcttaggcattaacccatgaagatacaaatgctcatttgattctgaaatgccgtttttcttcaatatcttaccaagttgtttccccactgtgaagacactgccggaagtcccaaacaaaacgacttccttaactttcgttgggtcgagattagtcgtaaactcccttaaatttttatcaacattcgtattgtaaataccgccaccaatgaaaagtttatcaaccaccccttccaatggcttgtcaatcgtttccggcgtcaggttcaattgttcacccaacagcttagccatcttttcagtatttccggttcttgaataatatctaattgcattcacaaagaacatcccctttttcatatagattgatacacattgagtataatactgtattcgctttctttcaaaaatatcttttctttgtaaagcgtttatatttcacaagcaggctactatactaaattaagtgaaggggatttcacatctttcatttaattgatatttttaggaggcttgtgctatggttcaaaagattagtggttcagatgctgtattaaaggtgcttgaggattggggaattaagcatctttatggcttaccaggtggctcgtttgattcaagtatgaatgcaattcataatcaaaaaagcaaaatcaaatatatccaagttcgtcatgaagaagcaggtgcgattgcggcttctgccgacgcaaaattaactggcaaaattggtgtttgctttggttctgctggccctggtgctgttcacctactcaacggactgtatgatgccaaaactgatggcgttccagttcttgcaattgtggcccaagtcccaaccagtcgcatgaacatggactttttccaagccatggatgaagaacctatttttgatgacgtagcggtttggaatcgaactgcaatgactgctgacagcttgcctcgaatgaccgatgaagccattcgtcaggcatatgctaaaaaaggcgttgccgttttaaccattccaaaggatctcggctgggctgagattgacgatacctacatttcaaatgccaatacccatcaaactcctgtttatccagaacctaatccagaatccgtaaaacaggcagttgctttaatcaaggatgctaaatcaccaatgatttactttggtctgggcgctaaagatgctgccgaagtgttaaagaaagtttctgaaaaattcaagatgccgttagtatcttccgtcctcgcaaaaggaatccttgaagacgcctacccggcttacttgggctcaactggccgggttgcatctaaacctggcgtggaagttggttttagtactgatttgatcctctgggttggtaacgatgtgccattcagtatcttcctatttaacaagaatgccaaggtgattcaaattgatattgccagcgaaaaattaggcaaacgacgccacaacgatgtttcaatggttgccgattccaagaaggctttacaagccattttggatgccggcaaggaaaagaaaccatctgcattttatgacgctgctttagctgataaaaagaactgggaagcttggcaagacagtttcaaagattccaaagaaatgccggttcgtccggaaccaatctttgacgtcttaaatcatgctgccagcgataaggccgtctttggtattgatgttggtaacgtcaacattaactttgaacgattgcttgatatgcatggtgatcaaaagtgggcaacttctggtaaatacgccacaatgggctttggcctccctgccgctatctcagcaaaggttaattacccggatcgcgatgtttacagtttgagtggtgatggtgcctttgccatgttaaatgaagaaattatgacccaagtcaagtatggtctacacatcatcaatgtcgtcttcagtaatgaaacccttggctttattgaggcagagcaaactgatgatacccatcaaccattatccggtgttgatttaccggatactgattgggcaatggttgctaaaggaatgggtgccctcggttacacggttcacaccaaagaagaatttcaaaaggcagtcgatgacgccaaaaagactgacagaccagctgtgatcgatgttaaatttactcaaaagatgccatttacaactgagcatatgacgatcgatccagcatggcaggatcagaagaaagtcgatgaattcgttaaaaagtatcaggcacaagatctgaaaccatttagctatttcttgaaagaagctgaaaaatagtccgctcgtttatttaaattaccagctctcggaatcgcaataaacagagtgggccagcaagcggttagaccccagaatataagccccctaacttaatattcccgattttggaatattaagttaggggacttatatggccgggggctgcttgctggcgcacgtttcggctaagtacaaagttcaacgagatatttccggggttgaatgtttggacaattcggttacgcggcaggaagttgccttttggcgcatgtctttccactcggtaataatcgtgattacgcaaagcggggctgggacaaaattacttttgtcccagtcccgcttttattgctttaatcgaccctattttttattttgattttctgctatttgtgattaatcattctgatcatgctgttttttgaaaatagttgagagatcatcttggtctggtcggtcagccaatttaatgtagaaattcgagaatgataaggtaatataaggttcgacccacagggaagcaattccaaacgtcaatccttcaacaatttcccaaccaataaagctcaagtccatcacaaagtattcccatttatgaccattcatcatttgccggctttgtgtgatggcttctaggtacccaatcggtttacccgcatcaagagcatcacgataaatattgatggactgcacatacgaaaaagacttaatgattccaggaattaagaataagatactccacagaattgctagaatcgaggttaaaattccgataattacggcacctttaaaatattgccagttattgaaaattgtgaacgatttattcaccggttggtcaaatttagctttgttccttaacaaatcaattgatcgaaacatcattcctgcggttaataaactaactaaaattgtcaaaacagttgaaaagataaggtacttaacaagcatgtcctgattaattgaaaccaccgtgccggactgtgtcagttgatttcgaaacgcaccgttctgactagctaaataataggcagccgcactggcaaaatctaaaagtaacacgggtaagaataataccaggaaaaatggaaaatgactcgaaagcatccgttgtgcttcaagttttagtgctggacgatccataaaatcctcctttaaaattcaatattggataaagcagttacaagcagtatattacactgacaagttgtgtcaacattgtcgccatcaggataaacaccacattcccaattgaataaagcaactattctgtcactatcccatttctttgccaatttcgattgatctgatttagccagattaccagcccaaaagtgacaatcgtgtagaccgcaccaccaggaccaaccgcatgcatcccaaggcttctgacaatcaccccgccggttgcagaacccagtgcaatgccaaaattagaaaagatcgaattcagagaggatgccaaaacaatcgattgtggatagttttgttccgctacttgcaaaaaatgaatctgaatgggtgaatttaataatggcatcccaaaaattaagatcattaatacgccgacccccagccaacgactattaaagagaatcggcatcatgatcaatagtataaattgaatgatgtacaccgtgggcattgcgtgcagtccccacccttcagttagtttcccactcgcccgattaccaaagatactggcaattccgaaaacaaataacaggactgtcaataattgagttgaaaaatgcaattggtgcgttacaattggccgcaaatacgtataaaagacataaatggctgctaaattgaacatgggtaacagcattccaatttgaattcgccgatccttaaataaagctagttggccgagaatgctactgcctttttgtttgaaatcacggggaagactcaagaacaccaagcctaatgtgataaggctaatcacaataatcgttaggaaagccatccgccacccaaaatttgtcgatatccaagttcccagtggtactccaaacaccgaagcaatactgaagccggcgaaaacccatgaaagcagccaggctcgctttgacattggcgcaatatggccagcaaatgttaatgcaattgaaatggcggcaccagaaaccaaagccgttacaattcgtgaaattgccagaaaaataaagttgggcgcgaccaagcttaatccatttccaaacgtaaagacgctcatcatgaccatcaggctccaaaacaaattgtacttcccaatcaaaaccgtaataaatggtgtgctgattgcatagacaattgcaaaaatagtaaccaaataaccaactgttgccacgggaacattgaactgattagacaaatcatccaagatcccaacgattaagaattcactgaatcctaaaataaatgcaaccaacaccaacacaaagctctgaaccttaaactgtttcatgtgtttctcatctccctttattaattggttttcccaaaccttccatatcttacaaggtttactaaaagtaatctagccatttgcgaagaaaaaacagttaacataattaatttaatcagtctgtaacaaaaacggttttcaaatatttacgataacgcttatcttgtctcggtttcatcaaaaaggacaacctatttaggggatcaaatcgttaaaaacggttgcagttttatttattatttcgtatactattcacaagcgagttgccatctcgatggtactcaaatcattttagccattattcgaacgtcctcgagcgcataggaccttaaatatgtcgcgcgccaaagtagtcaaccgatatcggttgactactttttatgtttaaaacgacaactttttggatgcttaagccgggctaagtgtgtttcgatccaggcaatcaaatgaccgtcttcagttaacagctaccatctttaatgatcatcactcaaattaatttaaaaaatgagcacaaaaaaaccggcgattgatatttcgccggttctttcttagagccatcaactattttaattcgttctccacagctgatgctttaagagatattccacttgtcaaaaagcatcacctccttttttgattgtccataatatacatccatttaaattaaattgcaagagatttgaacgaatccaaaattaatcgtcatgtgcttcgttgcgttcattttcaatcacgtcatcatttacccaatacttctgagctgtattcgaacgtgaaaatctaattcgataaaaatcttcatgttcaagttcgttatcatcgcgatctttaaaggtggcaactgccttttcactaacataaactttttgctgatcagatacatggagtgtattccaatcatatgttttattattgcgaactgatcccggaacatacttgtaaatttgttcttctcgatattcattatctaaccgggtcgtatagcggacattttgatacctaatcttttctgctttttgactaccttgatttcggttggttgctgtcgttgacgatgactgactcgttgacgagctcgctgcctgactactttgtgacgatgatgaactacttgaacttcccttatcaccagcgtttgaagaacatccaaataaccctaatggtaacaagaccagtaagcaagcggtcgttaatccttttttcatggttagccctcctcggataaacattcagtaatgtatgcttacctatattataaaggattatcataccgattacgaataagacagctaaattcagtagaaaaaaccagagtggaccagcaagcggttagcccccagaatataagccccctgacttaatattcctgattttggaatattaagtcagggggcttatattctgggggctgcttgctggtccacgttttagctaagtaacaagtttcagcgagatattctgaatttgaatatttgaatagttcggttacacggccggaagttgcctttatcctgcattttcgctcaatagcaatcgtgtttacacgaatagggactgggacgaatgactattgtcccagtccttatttgtttgatttgtcatcagtatgactgggaaaaaagcgatggctacggagtcgatcaccgctttgacgcagcatcctaatctaaaattttaaaagaataatccttcccatacttaccatgagcatagacattgtaagtgcctaaaccatgatatcttaccaaggactttttgtatgaatctttaatcaaccgtttctcagtcttgaactgaccaaggttagctccggatgatcccttattaaacgaataccaagaaccccacttagaaacttttaacttatgagcacctgatttgtaaggtgtgtatttcgtaccattaaatgaaaaactgtggggggttatccgaacataatcataatgccccttgcttcgataccgataccatgttccacggagggctttgggagttgtggtggatgaactagcatgtgcttgaacggcattagtcgttactgtcattgcaattgcaaacacacctaacatcgcgagaatgataattcgtaatttcttcaattgaacgcctcctatgcatttaattatatcatgacatgggagaaaccaattttaaggtctgactacgatttctttacaaaatcgcgaaattagccaatatgggcgcctaatcaaatcaattcttccatcaccgtggacatcggtaaagcttgaaatgccatggctcacataggatcacaaatcaaaaagcaggctcataaaaagtgattgaaacataagctgatttgtcatcttaatcatgagttaaaacgatttgaatttgactggtctgagccgccaggttgcaggaagattaccatttgactacaaagactgacgatccgaagaagttgttggaaatagttgacgtcgtttctcgtaaagtcggaataggtaatatcccaccaagccaaaaaataacggcccaatcaactctagcaataaatcccagtactcattcgccgaaattgctgaaataatggttgataacacgccaatgatgagtaaaccatctaccaccgtgacaatggttagatacacccatcgacgtttaaaaatcacaaacggcttttctaatgcaacatttcgtttaaagaacggaaacgcggttaccaagaataaataaggcagtgtcgaggataaattatccatcaacgttaatacattataaaaatcaacggcggatttccctccaaacgacgtcattgcgattaaagcacttacgaccccggcttgcagccacatagcattggcaggcatcgcattccgatttaattttggcagcgcttttggccacaattgtttgggagttcctaaaataaacgatttaatcggcatataaacaatcacgaaaaatgatcccagataactcagtaacatggtaaatgaaccaaacctggcaaataaaaagctgagattttgcgctccagcggttcccaacgagaattgctgaccaagttggtatcccaaattgctcattaacacgtacgtcgtatttcctaaattgacacctgatcgtgtgaagacatttgaccagttagccgaaacaccccatagaaaaatgaagaaaccataaatcacggtaatcagaactgcacctaatgccattgctaacggaaatgtccgtttagcatttttcatcttatcagaaaccccgcccattgcttcaatcccggcataagcataaattgcaaagatcaaaaacgaaacgatttgactcattgattgataactgtgtcgtggcgacttgagaaaactggttggtaatttaaccggttcagctaattgaaaaccatttttcgtcaataatatcagactggcgatacagaaaaagatggtcaaaataactgccgcaattccacccacagctgctaatttagcaactttggttaatcccttcgttgcaatgtaggtcactaaacagaagaaaataatactcatgatgccgattgtttcggttgagtttaaattaccaatttgccaccgacccgtttgatctgaaccgctcaaggttgtcgatagcataatccaaattttagacacagtagaaacaatcaaaataatccaggaagcaagccatacaaaaccaccgataaacgcccacttggttcccaacgaatttgacaaccatgagaaaacaccaccagcttcatttcgcaatgacgcgccatattctgaaaacatcagtgaagagggcacaaagaatagtaatgcggctaaaacgtaccaaataatccccccataccccatggtgtaataagcaattgaagtattatcaaaagcgaacgttgacgtaaagatcatcaacatgacactaagtaacgttaattttttactagataatttagccatatgcaggcttcctttcgtccatcattaatctttaaatcgactctcgattgctctggcgtgggcttccaatccttcaacccgggctaaagtcgtaatggcatctttttcctttgccaaggcttctctagtataggaaacaaattgcgttcgtttaacaaagtcggcaacgcccaacggtgagaagaatcgagcggttccaccagtcggcaaaatatgatttggaccggcaacataatcgccaagcggctcggatgctgaaaatcctaagaaaactgacccggcatttttaatttgattcaagtaagaaattgcgtttggcagttgaacctctaaatgctccggcgcaactgcgttcattagcgtgaaggcatcgtcaatatcatcaaccaccgcaataaagccttcattatccatcgctgcttgggcaatttcttgacgcggcagcaacgcaacttgacgggccaactcttgattaactgcgtcagctaatttccggtcatcagtcactaatattggtcgtgccagtttgtcatgctcagcttgggaaagcaaatccgcggcaacttgacttggcacagattgtgaactggcaatcacaccaatttctgagggaccggcaatcatgtcaatgtcaacctgaccaaacacctgctttttagcggttgccacaaagacattcccgggacccgttattttatcaactctggggatggtggctgtgccataggccaaactggcaattgcctgggccccaccgaccgtatagatttcatcaacgccggcaatcttggctgccgctaaaaccgccttgtttaaaccatctttttgcggaggtgttgccatgacgattcgtgaaacgccggcaattttagcaggaatcacgttcattaaaattgaagaagggtaagccgctgtcccaccaggaacatacaagccgaccgccgcgagtggcgcaactttttcaccgcgaatcatgcccttctttttcgcatcgataaagctttcctcaacttccatttgttggaatgatgtgatatttcttttagccaattcaagtgcatcaatcactttttggtccgtttgtccataagcttcatcaatctcttcttgagaaacccgtaaatcatccaagtcaacattgtcaaactgcttctcataatccttaacggcctggtcaccgtttttaatcacatttaaaataatttcgcgaactgatttttcaaccgcctctcgattagcaacttgatttgtccgaattgcgacctgttttaatagttgatctaatgaatcttcgataatttgcataactgccacgctccatttctttaacgcctataaaattcagattaaagtccgttaacatctatcaagtcacacactaccggtaataaaaaagactcgcccccggacattgctaatgcaatatccgaggacgagtctgtcgcggtgccacctctactttgccgctacctcacgataacgaccttacgctgctcacaactagtcgtccattgaaaatggagaacagttgtagtagccgtggtaacgctcgctagcggaacaacctacccaatcaaagattgattcaatcattcagttcatagatgtgttttcgtgattcgccacaactccttctcaccagcggagctctctttatgtgaaacaaaccattacttttctaatcataacttcatatttgttattgttttttaatttgttgatgtttcaaaattaccacgtttttaaaatatgtcaagcctttttattaacttatggtagtgaacaatcatggaggagagtgggacgaaaggcggttagaccccggccatataagccccctgacttaatattccaaaatcgggaatatcttgttgaactttgtacttagccgaaatgtggaccagcaagcagaccccggccatataagccccctgacttaatattccaaaatcgggaatatcttgttgaactttgtacttagccgaaacgtggaccagcaagcagaccccggccatataagccccctaacttaatattccaaaatcgggaatatcttgttgaattttgtacttagccgaaacgtggaccagcaagcagaccccggccatataagccccctaacttaatattccaaaatcgggaatatcttgttgaactttgtacttagccgaaacgtggaccagcaagcagaccccggccatataagccccctaacttaatattccaaaatcgggaatatcttgttgaactttgtacttagccgaaacgtgggccagcaagcagaccccggccatataagccccctaacttaatattccaaaatcgggaatatcaagttagggggcttatattctggggtctaaccgcttgctggtccactctgattttaaatattaaaatatattgataaaaacatcgttaacgttcccgccatgacgaagaaatgccagatcaaatggagacccggaattttcggaaaactgtaaataaccgctccaagagtaaaaattatcccaccggcaaccaataaccaaaagccgctgatgcttaaattatcatacaaggctttccccaagaatacgcacagccagcccatcaatacatagatcgttgtttcggttttttgatatttgccatgaaaaacaacatgactaataatcccaccaatggccaatgcccagacagctgccaataatgcatacccagcccaatcatgaacaaaaatgatgcaatacggtgtgtaggtccccgcgatcagcaaaaaaatattactatgatccaaaatctgaaagacccgtttcgctcgagtaaaaacaaagcagtgtaagagtgttgacgccaaataaagtgacagcaccgtaatcgaataaaccaccaagctggtaatcgcgactccggagagatgatcatgacttgcccgtaaaataagcatcaccgataaaataacgccggcaaaaaatgaaacgccatgggtaacagcatttaacacctcgtaaacgacctgttgacgtcttaatttaatagtctgatttctcatcatgatccctcctcgaaaccatcataagataaaatagtttataaatcaagaacatgtagacatcaattctatgtttctttatttttaccgttgaatatgcgataatacgggtattcaaatcaaaggagtccacattaatggccgttgaaaaatccgaagaaaaattgcaacagaaattatcaaaaatttcattgcccaaataccaagacttacccaatttagatttatacatggatcaggtaattgatgagataaatcaatatctcattccaatcaccaaaacggcaatcacgaaatcaatgattaacagctacgttaagaagggaattgtcgatcgaccaaccaaaaaacgctactcacgggttcaattggcaaaactattggtcgtcagtatcttgaagccaattttatctttagatgccatcacacaggcattaagaattgcgatgaaattggattctgtggacaacgcctatgatcaattcgtcaccctctttaacacggaacttaaacagattgacatccctaatctgtctgctaaacaatatcaatcaatggcaattaagtcgctactgtataaattattggttgaagatctgatcacccgtaacatttaatcaaggatagcgaggtgcctactcatgaaactcacaattgtgcaacacgtcccatttgaaattcctggtctaatcagcgaatgggctgctaagaatcatcatcaaattgacctggttcagcttttcaacgatgaccagcatttaccagatcccagtgctgtcgcgtttttaattgttcttggcggcccaatgagtgctaacgatgacttaccctggctttctcaagaacgccaattaatcaaaaccgtggttaacgctaataaaccaatgttgggtatttgccttggtgcccaacaactcgctaaagtatttggccaaccaatcatcccaacgcccaaagaagttggttttggttcggtcacttcatccccactagctcaattgctcttcaatgcccaggatcactatcaagtccttcattggcacggagaaggctttgaaactccccaaggcggccgaccacttttttcaagccaatattggcccaatcagggatttagttacaaatcggctatcggtcttcagttccatttggaatcaacgccggcctcgctgaaagaattagtcacaaccgacgctacgtttattgcaggttctaaattcgctggcaacgaaaatgatattctcagcaagcactttgaccctaattgtcggacccttttgttcaatattttgaatcacctgactgaacaaattgaatgagcatcgttacgaaacactcactttggcgaaagcaatcattaactaatttatcaaaaaatgatgttttgacatgcattttggctatattgtatactcttgttaaattaattaatggaggcaccataattttgaaaaaaattgctattttaattgcaactctcgccctaacacttccctttacagccacattaccaacacctgctgtagccgcgaaaacaaagacttataagttttcaatcatcaacgctaactttcttaacgcaaaacaaacttttcatacagccaaatcctctgtgactgtttataaggccgcctttggtgcggataatccaagtatgaacttaactgccaacggtaaattaaaacccgctagtacttattacgtcacaaaaatcattaaagcaaagagtgatgccactaagcagaatcgaacgttctcatatgtccaaggccacgggtgggttcaacaaaccaaactagtccgcggtgtatttaattaaaaagctgttgaaagccttaacgtaagttccttttcaacgttctttttctttggctaattcccaccgtaactctataattatgttgaaggggggaattattatgaacagagcagctatcaaggaagacgcaaagagcattttaaacgcgcacttctcatttttctttttgctatttttaccaattttcattattgaaattctaattggatggtttggttatggtatcttggagcgcccattggttttaaccgtttgggcaaaccttaacagtttgctgtcactcctgatattgttgattgccgctggaatcgcctttgtctgcattgatgccatgcgccagaagcttgaatatgaacagccacttcaaaaatcatttaccattttcacaaatggtgattattttctcggcacattactaattgatattttaatgtggatctttatttttctttggtcattactattatttattcctggaatgatcaaatcactcgcctattcacaagccatttatatttaccgggacgcaattgaccgaggcgaacgaattggatttctggaagccatcacgcaaagtcgtgaacttatggacggtcacaagtgggaattgtttgtgatgcaactcagttttcttggttgggcactcctggttgtcgtcactgccggaattgctgggatatgggtgttaccttattcgaccctaagttttgcaaattactacaacgagttagtaattcagcaaaacgccgaaattgctgccaaagcgaaaaatatttcgggcaattcaacctctccagataatgattcaaccgattagtctaagtatcgcttaattcattcaatgtttagtgcaaaaaagctgactgcaactctttaacgatttaaaagaatcggtaaaggagtgactgtcagcttttttctttcatcgaagaatgattgatcaacgatgccttttaggatggttcttattctgatgctttttgttttcctttttccactgagccattgaaataacccgaccttcatgacttggctgaggtgtcggcttttcaaattgttttggatgtcgatcaaaatatgcctgaacggcatccgaatcatccagatcaacgcccgcgcgtttcatcgttaacctgatgacttttaatttgctatattgactttcatcatttgccagtacaaccatcacaggttcagcctgaatgattgcccgtttagtccgtttgatgagatcggtccgtaagaaatgatgcttttcgaggaagtccatgaatctcaataacgtttcagcaatgtcagaatattcactgcgttcaacaacgagatcagtcacaaaataacccgttaggacattagataccgcatactttgtccaagcttttggtgtttttcgatactcatcataaattcgaccaaccaaattggcaacgtaaaactcagcatcatcctcagaaacgttgggcggcaccgattcccagtctggggactgataaaattgccaaacccaatcacccatataatcctgaatattttcagcaattctgggagaatactttggcagttcaggattaatttcaagttgacgatcgttaatttcagtctcttcaattcctggaacgttagatgttacttcaaattcttggctaatcaatgaccttaacaagtcttcatcaagtaaaagaatgtgagcctttattaaccatctgacaaaattgtctgagattcccagcatattcatgacatctgtcggtgtaactgattcaggcgccccattcactatagccggaaaagcggcagcaacatcactaatcgtccagtgagaaacctgctttgggctgtgaactgaaattattgacaagaatagtgtcatcgcttgctgaatcatctgatccggaaaatcggccacttcttgatatgttgcactttgctgatattgcggccaatataacttcacttgttttttaacaaaccgactgtgctcttcatctgaaaccatcattttcttctcccaactattttactaaagtataccagacaatcaaagcttggtataactttcaaaaatgaataaggctgggattttttcatcataatccgggtacaattcaaattactaatcaaaacaaatcacgtctcaataatcaatcgtaaaagtaccaattaatcaacctttttcctttttgacaacaggccacttaagccaagtaccagcccaagtaacaagccaccagcaatgcttatccccacattattcttctcatccgtttgaggaagcatccttgcctgcttcttgcttcttattgtttgtggcttcggctcatttactggcgaagcaccactcttatcatttaaacgattaactgtttggtcggtcttagagctaacattaactcgctcattttggcttggcatctgtgggttagacactttgacatcaacatcatttggatgacttaacgcttcaatagttggtgcggtcagctttgcagaatcattcggcaggtttaaggccgttggttgatttggtttgatccctttttgtgcgtccggaaccggaacgggcactaccctggttgattcacctgggaccactggctgtcctgggcctgctggttcatttggtgttacagaaaccaatggtgtcgtcggttcatcaggacgaagcggttctatcggtcgacttggcgtcactggatcaaccggcacaattggcgtaacaggtattatgggtttttctggtgtcaccggttggcctggttcaatcggttttaccggatctggcgttcgttcataagtcacattaacgattgtatctctttgaagaaccccttgaacatcatttaatgagctggtaaacccataaaaaaccggcgaaatgatttcataagttcccgcaccgtcagcttgatatggcaccgccatcgctactcctgtttctttatttaaatagttaatctggagtttgtaggatgcgatcggctcataggtgaaaatgagtggattcccaaccggcattggcatgctggccgttacccaagcccggttaaagccaaaaccgaagaagccgtatggatccgctttcatttcaactgtctgcgatgtttcagtgccaccaccatatgcaggtggatattttacgaccacataaactaactgggtattttgagtatccaagactttgaaatatttatccacataggtattgacctgttccagcttgaattcagtcgtcggtgtcgtggccgtcacgttattaattaaaaattggtgatcattattttgaaacggaactcgaattaagcgatatccgggaatttgaggatatggcgcgtcaatgtacgttccaacataaccagaaacttttgcctgcggggcaatctcattgcccatcggatccacatattttactgggatattctgaatatactgaagtggtcgaatattttgtgccccagtctttgtcacaatttgaagtgagccatacttccaaaataaatctgtcccgttcttggtatatttccaattagcatcaaactggttcgaatcaggagtcggaatttcttgagtttgaacaattttccccgtcttatcaacttcatacaggtacatcaattgattatcaattcggaatcccgcttgccaagcagtttgcccatcataataaccgccactcataatttctttttcatgttgtggttgaataagatcggcagcctgtaattgaccgatcttattactaacacccgtcccattaataatcgcatccttgccaggtgggtttgccaattgaccacctatatataccgggacctgatggaaaacggttcccggatacgtgttggtttgtgggacatctgaacgcttctcaggttctacggttggcttactggtcgtatccacgggatctggcgctttttttacctcagtgggtgtgacgacatcccctactcgctgctgatctggttttgcctggttgacttctgacacaacttgttttgtctcacccgatttggcagctggctgtttcgcgactgttgattgctggggtgttgtttgctgatccgaggtctggttagctgtcgagttgacgacaaccggctttggatcagccacccggtttgccgaaacttcctgtgcctgcccttggctatccacattggccacggtggcagagttcgccacggtttgatcaactgcagcactttgagtcgtttgatcagctgatggaacagatttgtttgcagtagtctgattagtcgcttgttcaccagttgttgccctaactggttgacgagttgcttgggaagtggactgactgacatcagttgaactgctggctgcggttgtcgcatttacagccgctgagcttgttgttgccggcttatcagcatcgctctgatttggggtggcctctgtcacttgctcagtctgaacgttcccctcagcaacgtctgccatcacttgacgattgtcaattcccattcccattgttgccgcaataaagacgactgctgaatataaccaaatttttccagctttgtacattttaaagcgaatcttgggatctcccatttgtggtgccatgatcaattcccccgtttttataattgtcccttacttacaataatacttggaatcagtcccccaactaactccctacctctattaaacgggaatcacaataattaatccactatttgagcgatatatcaatgttgtgaacaagtccacaattggtagatcatggtagaatactaatcagacagtatgttatttaaataatcagggaaatggggttttaaaccatgcgggtaacaacttttggtgaaatcatgctacgactgacaacgccgacaaatcaaacatttattcaggccaattcatttgaggccaactacggtggtgctgaagccaacgtcgctgtctcgctcagtcaactaggggatcaaacctccttgatcaccaagcttccagcaaatgaacttggtgacggtgtcatcaggcagctaactggattcggggttgatacccaccaaatcagccgcggcggtgaacgactcggcctctattttctacaacgcggggctggtattcgcccaagcaacgtcatttatgaccgatccaacagcgcatttgccttgtcagatgaccaagattatccatggccagaattgcttggtcaaacggattatttctatatttcaggcattaccccggcactttcacccaatctgcaagacacattactgaacgcggtcaaattttgtcggcaagctgatatcccagttgtttacgatgccaactatcggggtaaactctggtcacccggcgcggctcagcaattcactaaaagaattatgcctttcgttaccatctgtcttgttcatgatgaggatcttttaccgtcatttaatataaaaacgaccaacagcaatcatggcttggctatcgatcaaaaagacacttttaagcgggcaatgacggctatcctggcccaatatcccaattgccaagcgattgccagcattcttcgcaaccaatattcgccgcaaaaaagcagttggacatcgcttcttctgcacgaccgtcaattttatcaaagtccggtttaccagatgacaacagttcctgaagttgcggccggggatgcctttggtgcgggaatcattcatggtttcttaaatcattttaacgattcgcaaaagcttaattatgccatggcggctgccgcttggaagttaaccattccaggcgatttcaatttagcaactaacaatgatatcatgcgagtcttaaaaaacagtgaccaatcaattcgccgataaaaaacgcgatcctcatttttaaggattccttaagagcgccaattacaagccttttttataaataaaagctgaccgctatgataagataatttcgaagaaaaggaatcgaacgatcacagatagggaataatcattatggaaagtttacaagacaaagcctacaaccaaatctattcacaaattatgaatttgaaactgtacccggggcaacgtgtttctgataaggaatttgagaaatcaatcggtgtcagccgaaccccaattagagaagccatgctgcgcttacgccgagataacatgctttattcgatgccccaaagcggcacttacgttactcgaatcaatttaaaaaaagcacttgatgcccggtttgttcgtcaaacactcgaaaaagccgtcgtcagtgctgacggcgaaacgattacccagcaacaaattgcagaattgtcaatcaacttaaatttacaaaaacatgctgttcaagctcatgatattccgaaattgttcgcattagacaatgattttcaccaaaagctttatcagtttgctgattcggaaaatgtctggcaatggttgcaaacatttagcactgacctgaaccgctaccggttactgcgagtttatgacagtaatctgccacgaacaaccctaattcaagaacaccagggaattttagacgcgttaacgggtcacaaacctttacaagccgaaagtctgatccacaatcatttaaatttaatgataagtgagcaaaaatcagttatcgataaatttcccgactattttaccaatattgatcatttagacgatcaacaagcttagttgtatcgaataggtcaatcatttttcgatagttacgcacatccaccaattcagttacaatttggttaaaaccttggggggctctctcagacatgttacaattttaactaacaactaaagaggaggaatgtgaattatcatgaaaattaatcgttggctgcgcacggctttaattacgtgtgcggctgtatttagttttggaattggggttagtgctcaaaccgcatctgctgccacaacgcctaaatatacaactgtttcaactacaaccataaaaaaggctccctatcataagaagtcggccgccggagcgatttataatctatctcataccaaaaaaattgccaacttaaaaacatacccttacacgacttggtatgccacaaagaaggtcactttaaagaatggggcttccaaggcattgtattataaagtatctaatggaagcggttcagtttccggatacgtttggcataactaccttacccctggcaagtcaccatttggcttaaagtatgcgcaatcagctgttgcgctggatatgaacactggcggcacagtttggtcaaaagctgctgataccccccgcccaattgcgtcaatcactaaattaatgaccctgtacctggttcgccaaaagattagcaatggtgatggcacttgggattcaaaagttaataccagtaatgccggattaaaaaagttgggcaaggataaggactttggcggtttcaaattcaccaagaattcttacaccgttcgtgacctatatttagctggactaattgaatcttcaaacaatgccgcaatcgctcttggtcaatgggttgctggcggttcaacaccaacttacaataagaaattcattaatatgatgaatgcccaggctaaactttggaacttaactgatgcttcatttgtttccgcatcgggaatggaacaaaatagtttaaagccgtttggttacagtatcggtggcgcaaatgccaacttagtgtcagccaatgatgttgcccaaattgcaaaacacttcattgccgattataacgatgtcttaaccgatgcttcagttaaatcaatgaccttggatggtcaaaagctttacaactataacaatatgttacctggccgaaagtattaccaaaaatccttaaacgttgacgggttaaagactggctatactgttccagctggttactgcttcgttggaactggccgaaaggctggccatgaccgaattattacggttgtgcttcatgacgaaaacgaatttacagaaacccgttcgttaatgaattatgtttataataataaattagcttaagctaacttttcgttgtttcataaacgtcgaagtagacttgaagttatgtatgaagaggttgtgcctattactggtcaacctcttttttgatacattattgatctaaaacgtgtgataaatagcagatccccgccgtctaaataaccgcagccgtacatccgctaccgtgccgaaacgtgtgactgcaagcagattccggccgtctaaaccccagcacgcaatattcccaaaagcctggaatattgcgtgctggggcttagactctggaatctatgcgcttgcagtcacactcttatcatatttccccaccaacgccaccaatctttcaatatcagcttcatacacctcaccaatattgccgattcggaagctgtcgatttttgacaccttccccggatagatgacgaagccacgatcctttaaaaattcgtataattgatggaaatcaaaattttcggatggatacttaaacgtcgtaatgattggcgactgaacctgctcgtcaatcactggttcgtaatccagcaaaatcattttatttcttagcaattgctcatttgctttataacgttgggtccgggcttccacacctccctcatcctttaactctccaatggcttcctgaaatgcataaacaacatgagtcggtgatgtaaaccgccatttgccatcatgatcttcgaagcatcgatattgttcatatagatcaagtgataatgaacgtgcatttccttgcgtcttatcaataactgatttctttgcaataacaaaaccgaacccaggaacaccctgaatacatttatttgcgctggaaattaaataatcaacgccaagccgattaatatcaattgaaacaccaccaaaactagacattgcatcaacaattgtcacgattcccattttatttaaaatcggaataattcgctcaatcggattcaagataccagttgtcgtttcacaatggacaaccgcaaaatgagtaacctccggatgtttcgcaatctcatccaatactcgtgccgggtcaaccggctggtcctcattaaactgtaaatcaatatgggtaatcccataataatcagcaatctgggccatccgttcgccataggcaccattaattgcgatcattaagacactagcctgattttgggggatcgcagttcccaacgttgcctcaacacagaatgtcccactaccttgcattaacacgctggtatacgcttttggtgaagcttttccaatcgctaataattcaccacggatttcttgagtcacgcccttatagtcatcatcccaagtcccgtgatcaattaacattgcctttttaacattggcggaagttgtcagcggcccgggagttaacagaatttcctgccgattctcatgatcaaaactacttaattcatccatgtccttaatcactccaatcaattggtcaattgagtcaatcacatcattggctcctgctttaataaactgatcatgcgcatgtcgttttacagccatcttttcgtcataattgagttttaaataatcttcctttgaaagaccgatcaagttactcccctcgatgactcccactgaagtgaccccagcattgcgaccttccaaaatatcattaaccgtatcaccaactttgatgacttgactcgggtcctcgattccaagctttttcatagccaacagcaacatatccggattaggacgacccacgtaattggtttgctccgatgtaatattaaacttgggaacgtaaccttgagccgctgctaacggtgagacctcattcaacatttcctggttatatccggttgtcgtggcaaccgcaattcggttatgatctaaataccgaagtaactcagtcatccccggcttcagcttcgccgtatcctgaaggacagcgcgaatttcaatttgaaattcctggtaaatcttttgaatggcttcctcaattgaaacatcgggatatcgagccagccattgatcctgtaacggttttaatttcatcatctttttaacatgcgataatttatccaacccaatatcggcgcgaatcgttggctcactaatctcaattccaaaattatgaaaggcccgttgaaatgcaactaacggtgcgcgactcccataatcaatcgtggtacctgcccaatcaaaaacaactgcttttatcatttagtgtcctcctaatgttgtttaataactttattccgaagcatatacgagataatttccaaaatgactgcaaacaatagcagcatgtaaacaattaaaccaacttcatgaaaatcaaagtaaaaaccactggccatatataattgatagccaatcccaccggcaccggcggctgcaccaactgccaccgcattagtgaaattgatttcaaaacggataaacgtccaactcagcaaattaggcattgtctccgggattactgcctgagtcacgattggccagaaaccaaccccgatggctgatagagacgataagctgtcaccggataaatcatcgatgctgtcagcatatactttggtcagataagccacactgtgaaatgttaatccaatcaccgcagcgttagcacctagtcccaatgccacactgtaaatcagaacccagagaatcgtgggaatggcgcggataaacgccatcacactttgaacagtgtagaccaaccagcttggcgataatttatgagatcccattaaggcgaagaaaaaggcaacaattgaaccaattaccgttgttaaaaacgccaatgagatgctttgtgccaatgcaacccacagtacttgccaggtatcgttgccggttctgggagtcacgaacataatttttaaattttcagcaaagttgccaaaagccgcccacaagtttagcccatggggaattaatgatggcattgttagtgcagtcacaccaacaaggactagtaaaatcgcccgcattaaggttcgccttgaatcatgaattcggtgaactgatggttttggaagctcggacgctaccactggatttattgttaattgtcgttccggtttgttaatcattgaatgcacctctcaatgtaatttgaaacaagctcaatggcgacaactaaaataatgattgccgtaacgactaagcccgctgccccataccttagacttttaaagtacagatcaaataagaaaccaatgccggtccctgttaataacccaaccagcgtcgcatcccgaatactattttcaatcatatacagaatccacgaaatcaatgccgttgcaacttcaggtaaaacggcttgaaaaacaacttgcaaataattggcgccggttgcttgcaacgcttgaattttttctgaaccaaagtcctcaatagtttccataaatgcgcgggtcaaaaatccaagtgataagaagaacaatgctagaaatccggtaaaatcattttgcttgaaggaaaacaataagatcatcgcccagccaacacatggaatgtttcttagtaatgacgcaaacccacgaataatccaactcgcgtttctattcaaggcagtattttttgcccctaaaatcgccagaaataaggcgccacccgcagcaaccgtggtggatgaaacagctaccaaaaaagttcgaaacagttgataggcgatatcttgccaatactgaattgactgtgaattaggaataaaattcttagccagccaaatgagcccggtttggactgataaaaaggaactggtttgaaaattcagtatcagcgaacagaccagataaatgagcgctagtaaaacaatgattcccgttatctttaaccgttttgctgcaaaagttttattactgaccttcatttccatagctaagcctcctgaactgcaactgaccgatatatctcattaactgtcattgcatccagctgatcaggcttaccgtcaaaaaccaatcgaccagaattaatgcccaccacatgatcagcatacgttttggcaatatcgacctgatgtaaattaatcaacacgattaaatgcttctttttcgctaaacgctgaaggatgtccattaccattgtcgttgatctcggatccagcgaagcaattggttcatcacaaagaatcatcttaggatgctgcatcaacgctctggcgatcccaacccgctgcttttggccgccgctaagatcccggcaccgtttataagcgaattcagctaacccaacttcgtttaacaggtcaaatgcttcctgcttttccgccttcgtgtataaagaaaacatcccggcaatggttgatttagcagccaaacggccatgaaggacattttcaagtgctgttagaggttcgatcaaattgtaattttgaaagatcatgccaatttgggtacgcaataatttcaactcatatttattaagggcgcgcacattatcatcctcaaaccagatttcaccatcattatcacgaattaactgattaatgctccgcaagagcgtcgtctttccagcacccgatggtccaataacgactgtcacttcacccggtttggcactgaacgaaacatcatgcagcgattgtttttggccgtcatagcttttcgataaatccttaatcgttaacatgcaatcttcctttctgatagattattcacctaaaatttgatgagttggttgataccaactatcgctgactgctttaaattgggtgttgccatccttaggtaataagccacgtttcttagcattagccggcgcaaagaatgtccggtcattggtaacccgcttagatgtcaaatccttcacaatttctttaatttcttttttgctaacatacttattgttaaccgcgattggttcgttttgaactttataggctgcgattgccaaactttctttcccacgaacctgattaaatggtgctggcgcattcttattaatctggaaaatggcgccagctttgtttgaatcatttagaaatttcccatattgagttaaatccatatcatcaaacgctgcaacgtcagcatcgccctttagcaagttaacagcggacccttgatgagaccccccaaacaaaactttagagaaaaatttaccactttgagccaagtcatctttatttttaatgttgaaagttttagcgattgcccccgcaggaatcgcataccctgaagttgacgtattgctgacaaacgacatcttcttacccttaatattttttaaactatatttgccgttaactttgtattggctggccttatcctttggcaccataatgtaactatgataataggcatcctttaacgtgccggatttgcccgtgtaagtcacaatcggttgcacattcttactttgttgatgtgcctgaatataactgtcagggcccatcaaagcaatttgggcttttccagatgaaattgcctgaatcgcgacgttataatccgtcgttgtttgaacttgaaccttcttgcccgtcgccttggcaacttctttactcaatgctgcccgagcggccccctcttctttaacagaatcgccaggtaaaaagacaaccgttaatttgccagattggccggacttgccagtcgcccctgcacttgaacaagcaccaagagaaaccgttattccgagtaaagtggtgaataaagccgctttcttaagtaaattcatgtcattaactcccatattcccattatttttgaacaactcaattgtatgaaacgggtgtaaatatcctgtaaatctaaggtaaatatgatgtactaaaactgtaaaagtaatgctaatgataaccaatttagcagatgattgtccacctcaaaataacaatcagttccataaaggccttgactggcaggacaaatgataataatcttaggtatgattatttacgaataacaatttgcgtatcaaacataacgggggaattaacattattatgcaaaacgaaactaattactatttatatcaacggctcacaccgactaactgggccagcgctttattcgccaaaaacgctcgtactgaactggaacgacgagcaaacaacggtgatggcgaagcaaaaatgctgctgacccttcacgattgtgaggaagaaaaaagaagtcgccaacccattaaaccggttcgacgggttagaaacttcaaggaacgggcagccaagattaagatcttttatcatttgaccttaggatagtctgtgaagtccaatcaattaatctcaaaaataaaaaccacttaatcagaatccctatttgtaggaattttgattaagtggtttttgacaaatttgatggttaggagaaaaaaacttacaaacacataagaaacctgtccaaatattaaggatcagaaatatctcgtggcatttgttacatggttaaaacgactcgttctttcacaacattcttttccaattgacgatgtgcccatgcggcatcatcaatctttttagtcagcactggatcttcaagtagaaagccatccgccatccgttgatttaataatttagcggcatttaacagttgctctgttgtcgcatggctgataacaaagccttcaattcgcttggcctgcgtataaaattgccgaaccgaaagcgtaaatttattatctttgggagccgtgataactccaacaatgcctccctgcttcaaggcatccaaattgtcttcaagttccacttttcctgatgtatcaacggcataatcaacaccgctgatattatgtttttctaactgtttatgcagcgattttttgtagtccaactgataatcgctccccaatgcatcaagagttccgaaatctctttcgtttgacgttgtgatcaccctcaaattcatcgtgtgagcgatttgaaccaatttctttccgacatgacccgcagcaccttcaattaaaatggttttttcaggctgagcttcaaaaatatcattaattaaaattgccgccgttgccgaagagtgaaccgaagcaactgcttgaatgggatcaatcccggcaggtaaatgataaagtcgatcagcagggataacagcgtattcactggtaaccccttgccgaccatcatagcccatactattagtccagactgaaacacctttggaaaaattagtcaccgccgccccaacttcgacaaccgttccaaccgcatcccgaccaatcacaaacggaaagtttttcttagtcttatacgaaccagcgcgaacaaaagtatccacgtgattaaccgagactgcttcaactttgactaatacctcatcacgattcatgcttggagtcggtaaatcacctacgataatttctttgctgtcaccggttttattaatatatgcagctttcataaccttacctccaattctaatcaatctataagttcccttcgaccttattataagccaaaatctattcgtgcttggtaataaggtctcgaaatcaagaaatcaaaatgttggttaaattattttttgtgaataaatatgtccaataactgacagtattctaaattaaaaacacaatgaagcccatttaaatgtcctttccataaaatcctgcccagcaaaattctatttttgattcttaaatacatgtcaaccaaaagccaattaaaagcagggaagctttaattagtcctcccggatcacgaaacataaaataattaaaatcgtcaacaaaaaaggctgaagcgctctgaccgcctcagccttccctgtagaaatgaattaacctactaactgcccttcctgctcacaagcttatatacgcttagatcaatcacatgatccaaaaatatataaaatcatcaacgaagggcaatcttaaacgactgcttaccatcaattgtatcaacgttttcaacatcgccatcaaccggtacatgagtaattaagaaactgggatgcaaatgcgcggtaaatttgaactcgtatgcggtgccacccttttgcttcttggcatacatcaagccctggctaccatccgacaactgaacaacttgttccttctttttggaaggatccacataaattgttgtcatgcttttcacctccacattcattatagcagggcaatggttcactggctaaaatgaatgggcttttatccctacccttttctaatttcccactcgcaaaccgcaaaagttggtttaccatggataatataagattaatcagattgattctcgattattcttaatcttagaagacaagcattaaaatcagaaaggcgaaatatatgaaaaaataccaagatcaatactttgaaggcgaacggccccttttcgccgaagctgacgcaaaaattacgggtaccacttttggcaagggtgaatcaccattaaaggaaagccgaaatatcgatctcgagcattcgatctttaaatggaaatatccgctttggtatagtaaacacgtgactgtcagtcacaccatttttgaaaagattgcccatgccggtatctggtacaccgacgatcttcaaatgacagattgttccgtccaggctagtaaaacctttcgtcgcagctcccacttaacgctaaccaatgatcatttttcaaatgccggtgaaacactttggaactgtgaccacattaaaattgatcacgttcaggcaaatggcagctactttggtatgaacagtcatgatatttatattgaccatttggacttgatcggcaactatgcatttgatggtgccaaaaatgttgaggtgcatcattcaacatttgtcaccaaggatgccttttggaattgtgaaaatgtgacgatttacgattcggtcattaatggtgaatatcttgcttggaacacgaaaaatctcactttaattaactgtactatcgaaagtgatcagggcttgtgttacatcgatcatttgaccatgcgtcattgccggctgttggaaaccgacttggcatttgaatattgccaaaacattgacgcggaaatcgattcaaagatcaccagcgtcaaaaatccaatcagcggtaagatccacgctaaatcaatcggtcaactgatcatggattcaaccaaagttgatccagccaaaacgacgattatcactgacactaaaacaaccaaggaaaagagtgcttaacatgtatgatttcaaatcgattatccctcgtcgggataccgattcggttaaatgggacgtcaaaccaaatgaactgccaatgtgggtagcggatatggattttaaggcggctccggaaattatcgacgcaatgcagaaaaaggttcaattcggaattttcggttatgaggaacctcacacggactatttcaacgcggtcgctaattggtacgaatccgaacatcaaacccgacctgatccagactggatgattttctgcaccggcgttgtcccatcaatttcttcaacggttcgccgcgtcagcaacgtgggtgataacgttgtggttcaagcaccagtctacaacatcttttacaattcaattttaaacaatggccgtcatgtcttgtccagtgacttggtatacgatcaacaagctcactcctattctgtcgattgggatgacttggagaaaaaattagctgacccattgagcacgatgatgatcctgtgcaatccccataatccggttggcaaggtctggtccaaagctgaactgatccgaatcagtcaactttgtctgaaacatcacgtaacgttattcagcgatgaaattcatggggacctggtttgtggtaaaccggcttacacaccaattttttctctacccaaggatctcattcaacaaacaatcgctgcggtatcacccagcaaaacgtttaacgtcgcggcccttcacgctgcaacagtgattgtcccaaatgaagggttaagaaacattgtatctcgcggtcttaataccgatgaattggctgagccaaatctattagccctgccaggatcaatcgctgcttataccaagggtcacaagtggttagccgaattaaaacaacaactgattaaaaatcggcaaatcttaaccgaattctgtaatcaaaatatccctcaaattcatgtcgtcacatctaatgcaacttacctggtttggattgactgcagcgaactcacaacccattctgatcaattagaaaggtttattcgcgaccggactggtttgtatgtttccgccggatctgtttacggtggtaatggtaatcaatttcttagaattaatatcgcatgcccggaaaccatgcttatagacgggttgaatcgattaaaacagggcattgaagcatttaccagtgcaaaacaaaacagataaacagagtgggtctgcttgctggcacacgttttgtgtaatcacgattattaccgagtcgaaacgtgagataaaaggcaacttcctgccgtacaaccgaattatcccaatattcaaacccggaatattcggataatccagttgtactctggaagttaaccgccttttgtctcactctgcccaattatctattagctacttaacttgattaaccggccacttaggctgctcaccgtccagaacccgcaccacttcattcgccgcatcagttgccattctggagaagctttcggttgtacttgaaccaatatgtggcgtcaacaaaacattgtcaagtttgaacaactcactatcctgaggtaacggctcagtctcaaagacatcaagagccgctccggcaatggtttgatttttcaatgcgtcaatcaaagcctgctcatcaatcaagctgccccgacctaaattaacgatgacactggatgacttcatctttgacaatgccgttcgatcaataatatgttttgttgctggtgttgccgctaaatgtaacgttaagacatccgactgggctaataatgtatccaagtcaacaaatgttccgtaaggcgattctttcggcgtccggttatgaataaggatgcgcatatccaaagcactggcttttttagccacccaatgaccaattcggccataacccaaaatccctaatgttttgccggccaaatcaaaacctaaatgagtcaaaggataaccgtaatttccctttcgcatttcagtagtgaccgtagttaaatgcttcgataagtcaaaaatatctgctaacgttgtttcagcaaccgttgacgcgttggcattcggcgtaattgtgacccaaacgccgtgctgctggctagcctgtaaatccacattttcatagccaacaccatgccgggcgataatttttaaatttggcatttgcgaaataacggcttcaccaatttgatcgacgaacagaatcatcccgtcagcatccttaccgtatttcaaaatgttttccggcgttgtgccaggtacttcaattaattgaaagccatgatcggttaatacttttttcccatcttctgataatttatctggaacaattactttttttgtcatttgaagtcccccgtgagctatctattgttagcagcataagttaacatatcttcggtctgttgattcatcagtggcggtaactgatcaaagtcaaaataatccagtcgaaccgtttcatcggtctcatcggttaatagttgcccaccgatctgacgaaccaaaaacaactgggtaattgtttgaacctgatccccattgggatacgaaaaagaaccttcgtcaaaaatcttaagcggccggataatttccacttcgacaccgctatcctctttgtattcacgcacacaagcctgcgaataggtttcaccaaattctaaatagccacccggtaagctccaatcatgggtatcggttcttaaattgagaagaacctgctgccgatcattcaataaaataccagccgccgtatttagaattaatggcatgtggccaactcgtgagcgaatctctttaatgtatcccttgggcattttctgacctcctaatgaattttgctttattgatgttaattttatcacttgttggccactgttaggaaattgtgtttaatagagattaaaagggcagcggtcgtttaaaacaaatgtgatcttatgcttcatcccaaaagtcgtcatagtgggtatatcctatgctgtacaagcaattcagccgatattccagtaacagaagcattcgtttgtgggctaccgtgccgaaacgggcaataacaagcaggctccggccatataaggcacttcaaccgatatcccaaattccgggatatcctccgatgtaggctaccgtgctgaaacgggcaataacaagcaggctccggccatataaggcacttcaaccgatatctcaaattccgggatatcggttgaagtgccttatattctggagcctaatcgcttgttattgccctctggttattcacatactcccgatacaacggcagctggtcaatcaactctttatgcgtgccatggccacttacccggccctcttcgatgaaatagatttggttcgcattcacaattgtgctcaatctatgagcaatgactagcgttgttcggtttttcatcaacttttccaacgccttttggaccatcatttccgattcagaatccaaactggccgttgcctcatccagcatcaaaatctttggatcacgaaggaaagccctggcaattgccaaacgttgtcgctgaccaccggaaactttcaccccacgctcaccgacttgagtatctaaaccatccggcatagcttcaacaaattctttcgcatacgccatttccaacacgtgccatagttgatcatccgaataagatttgtttaagccataagtcaaattatagcgaatcgtccccgccataattgatgcgtcttggccaaccaaaccaatttgttcacgccaattcgccatgtttaccttgtcaatatctgtcttaccgattttgattgaaccaccatttggctgatagaaacgttccaacaaactaaatattgttgatttgccaccacccgaaggaccggcaaacgccacaattgaattgggcttagcttcaaatgaaacgccatgtaacactggtttgccatcctcgtaagcaaagctgacattggtcatcgataacgtttgaccagcagcactcaccgacttaccagtcatctgatcttcttcatgagtttgtagtaactcctgaattcggtcagttgaaccacttgctttagccgtatccgagaaaaattgaccgagaacaacgaacggcccaatcatttgaaccagatacatcaagaatgagaataacgttcccatatccatcgttccctgagcaactcggctggcaccgtatgccaacatagccacgaccattcccatcatcaccattgtcattaatggtccggcaattgaatcgtaaattgcttcttttaaaccaatttgatacaagtcaaaaattcgttgatgaccggattttctctcggcggtttccgcgtttgaagatttgaccaaccggacttcacccaaaacctcgctggccgatccgttaaaatcagccaaggcgtcctgtctggcatgggcaattttccgggattgatttgccaccggtaaaatcgctaaaacaaccagtgggaccgcaataaacatgatcgcggtcatcttccaatccataatgagcatcaatacaaacgccccaacaagttggagaagtgaggttaccattttaggcagtgaatttgccaacagatctttaacttgagtcgagtcatttaccagtcgagatgtcatttccccagacttggtttcgtcaaagtaggtaaccggcaagaccagtaacttctgccataactgtccacgtaatttgtacacaacatcttcgccaaagaagcctaagattgcgccggatacggcactaatcagtgcgctggcaacaaacagaccgatcaccccgatgactaaagttgtatcaaggtggtggccaagctgattaatcaaattttttgcaaaattgggaaccgccaactgcatcccggttgcaaccattcctaacaataaaccaatccccagctgccaataatgcggtttgatttgggcaatcaactgaagaaaatcctttaatttaaaggttgatctcggcctttgtctagttggttgtaatgtttgctccatttataccacttcctcttaatcctagtcacgattccgtttaaaaccaccaaatggaaagtcatgattaaagccttccatattgtgatgccaatcgtgagccaatcgcataaaatccgcaaaatttttcggctccgaccaatcatcaggcatcttttcatctaaatcattcagcaacttccccagtagctggcgcaattgctgttgttcatcatttgtcaatgacgcaaacagtgattctgaaagctggtctttaaatcgctgtgtctcgttgatgaaagtttgacctttatcagttaatgaaattaaacttactcgtttatcgtctggcgattcatgacgctcaatcaaaccagatgcctccaacttattaaccatagcactcacggaactgggccggatatccaatgcttcaacaatatcgctattggtaagttctttcttcgatgctaattcatgaagcattcgcaactgattggagttcttctgcggatcttgagaacgcccaaactggacacttttaatggcagccgacataaacgcccgctgctgaaacaactttccaaacagatttaataattcttgagaatcataggtcataaatatcactttcctaattaatttatttagttagtctcaaccaattcgaactaacaaaaagaattataattagttagttagccgttgtcaatagaaactaacaagttttcgctcatttcctcattaccgcttgttaattctgaataaacccctaacacccccgcaattatttgttaaacctaatgctgaccagcgactaatgtcgggttacactattaaatgctgttaatttaacactggttaaaataaatacggggaataaagtttcacttttttctaatctgtttaataggttatttaaattgtcaaaataatgccaaaccggaaaatgcttatgaaacggagtagccacctttcgaccgtaataagtgatatatcaaggcttgataactcatgcagaactgaataaattcgtttttattttaatttgttgagtttatttcactagaagttttaaaagtttgccataaaaattgaaagacctcaaatttatcatgaagttcaataaatttgaggtctctcaaaataatgttttatttttggatgaatcatgattggagccaccagttatgccagttcatctttggaaaacttctgactaataaacacgtttgaatgcttagacttcattagcgaccattttgttggccaatgatgttcaaaatactaatcagcggatgcaagcggttgtttaaattttttattttctcaacgaaccccgctggagtaatgatatcggcaggacataccgatctaacaattggtcatcgttctgttcgagacgattgaataaaattctgactaataaatcgacaatgtcatcaatcggctgaacaatcgtacttaattcgggatggtactgttgaacatattgcgacccgtcaaacccaatcacctggagatcatcaggtaccttcatccccaaacttttagcttcctgcaggcacaataatgccgtctgatcatcggtacaaaaaacaccgtcgggttgatatgccgacaactgctggcgaatcatggcccgcttaatcccaggcgtatcattaaatcggagcctgacagtggctgacttctgtccgactgcttcaactgcctgattaaatccggtcacccgatcggcgttccgtggaatcttttccaaacttccagaaatcagcattaatttttcggatcccttatccattaatgtattggcggctagtttgccccccgccgcattatcacagctaacggttggaataggtgatggaaaatagcgatcataggaaacaattggtaatccggacattttatattccttcaaaccttcattatgtgaccctgtgataataccatccacttggttggccatcaacatctttaaatactgctgttctttggccgggttatccaaactattacaaataattgccttatagccaccctcgaacaactgattttcaattttttgaacggcttcggcaattaacggattttcgacgcttgcaaaaatcagcccaattaacttaaatgtttttccccggagtgctcgggcggcagaatttggtgaataatttaattgccgcattgcttggtagaccttttctttggttcctgacgacaggtaaccacgatcattaataacgcgtgaaacggttgctactgaaacacccgccaacttggcaacatcttttaatttaggttgcattggtacaccttctaatttattttattttgctgtatataccaatttggttcatttactttttagtatagcataaccattatttttctctaaaaaaattctcttcaacgattgacacatcaaaatatccggttacaatgaaaattgtaagggttttcaaatgaaaaagaaagaccttcgaaaataactaaagttcattcctgaccatcaaactaagatggttgatgttcaagtcaattatgttttactgatatccagctgacaatcaagatagcgtgggaattacttcttgtggaagtaacctaatccgtctgtcaaaacgaaagattaataaatcaatttttcaaacatgaaaatacgtcgccattctcaggattctgttttcagaaaattcttctaaatgtcggctggatttagcacttactactggttggcttagtcatggtagcaacggaaatatgctaattataaaactgactatctaacgttggacataaaaacctgaaaaattgatcgaaatttttccgtatttcatctgtgattggttttatttgtgccattatttttcggaaaaacattgtaagggcttacgtggttctggactttatctatattcccaagggttctgaaatttgtagaaatccgatctgatttatttttcgtcaattaaacgtagaggtgattcaatttatgttattaggtagtgtagaagctggcggaacaaaatttgtttgtgccgttggtaatgaggattatcgcatcatcgataaaacccaatttcccacaacaactcctgaagaaacccttcaaaagactgttgattatttcaaaaaatttccagaactaaaggctatttcagttgcctcgtttggcccaattgagcttcgtcaaaattcgccaaagtatggctatatcacgaatacacccaagccaggctgggccaacactgatttcgttggtcgattgaagaaggattttgatgttccgatctactggaccactgatgtcaatggctcagcttatggcgagtacgtcatggcaaccctatttaatgaaaagattaattcattagtttactacaccattggaaccggcgttggtgccggtgctatcgtcaatggccatttcatcggtgacttgggccatcccgaaatgggtcacgtccgtttgaaacgtcatccagatgatcttgattttaagggaatttgtccgtttcatggtgactgtcttgagggattagtcgccggaccgacgtttgaagcccgaaccggtaagaagggccaagatattccccttactgatcacgtttgggacattatggcattctatgttgctcaggccgccattcaagtcactttaattcttcggcctgccaaaatcgtctttggcggtggcgttgtcagcgagacattcttgaagaaggttcgtgcacagtttaaagaattgctgaacaactatgtggatgttggcgatgttgataagtacattgtgatgccactagtaaaagaaaatggttcggcaaccgtcggagattttgcattggcattaaaggaatataacaagtaggcatgtgctaacaacattatttgccaccattatttgccaccattatttcttacccaccacaataaaattgtttacaaagatgtgacgcaaccaaccttacgtcacagatcataataaattatcaaagggagattatatttatgaaagcacttgtattaaccgcaacaaaacacatggaaattgaagatattgaccaaccaactgttaagccaaatgaagttcgaatcgacaccaagtatgccggaatttgtggcactgatcacgcactttataacggccttccaggttcagctgatgccgttcccccaatcgttttaggtcatgaaaactcaggtgttgttgccgaagttggctcagaagtgaccaatgttaaagttggcgatcgcgtaacagttgaccctaacatttactgtggccaatgtttctactgccacacaggccgtcctgaactttgcgataatctatcagcggttggtgttacccgtaacggtggtttggaacaatcatttacagcacccgcttccgttgtttacccgattcctgaaagcgtttcctttaaagatgctgcgacaatcgaaccaatctcctgcgccgttcatggaatgaagttacttaaaattaccccatatcaaaaggccttagtcattggtgatggtttcatgggtcaattatttgttcaattgttgagtgcctatggtgttcaccaagtcgactttgccggcatcattgatgaaaagcttcaacttaataaagagaaatttggtgtcactaacatttacaacaccacccgtgataagatcccttcagactatgatgttgtcatcgaagccgttggattaccacaaactcaggaacaagccgttgaagccacccgtaaaggtgctcaagttttaatgtttggtgttggtaaaccagatgctcatttccaaatgaacacttacgaagtttatcaaaagcaattaacgatccaaggttcattcattaatccaaacgcctttgaagattcaattgccttgcttgccagcggtaaattaaacgttgaccctattatcagccatgtcttaactttggaccaggttgaaggcgttcttcaaggaaaggttaagggagtttccaaagccgttgttaaagttggtgattagttgtgaagaagaatcaggagtcaaaggctagtccaagccaagtattaaatggccgaaccctttcgatgtcaatgtcaattttttactttgtcgtttcgttagtcattaactccgccggcaacgttttaacgttagttaccagtgccaagattcacccttcctacttaggctctgcctactggacggccgctgaagctaatttaagtgttgcttttggctggaacctcttctggacattcctaatcttaggggttgtcattacaattctgaatgcgattttagttggtcactgggattggcgacgcgcattgggaaacctgattttcatggtgcctttctcagcactgattcaaatttttgaagacttcttcattggtaagtacccaatttatggtggcttaccagctgccaatacgcctatgatgattggtttctacattcttttaaacttttttggggttgctttaatcgggactgccatttcaatctatcaacgagttaatttagtcttacatcccgctgatgatttaatgcagattcttcgctttaaatattttaaaggaaatgccaacattgcgatgtgggcgtcctacattccaccaaccttaatggcaattctcgcatttatcattaccaaagacttcactaacctcggtatcggcaccatcttcgctttcttattccaaggtgggattactggtatcgcggatactaaagtaattccaagcttaaaacatcaagcattagatgttggtcaaaaataatcattaaaaataaattttcagaaagaagcacaaattatggcaattaaagatgatattacaggaattcaacatgttgggatcccttcaaaagatttagacaaaaccatcgaattttacaaatcacttggtttcgatgaagctggcttgtttcataatggcgccaaccgttgtgcatttatgaaatttaataatctcatgattgaaacctgggaaggcgatccagtcgctatgaaggccggcgctatcaaccatatttccttgaatacacccgatgtagaaaaagcctttgccgacgctaaagcacaaggattaaatctcgttgatcacgagattcaatcaattccttcattctgggataacgggattaagtattttaatattcttggacccaaccaagaaaccatcgagttctgccaaattttataatttttcgattcgaattaattaaaaaattcaaatacaatcaagtcatcatcttaacttggttgtatttgtcattattaggaggaaaaaatagtggcacatatttcttttgatcattctaaattatccaaatttgttcacgataacgaattaggcgaaatgcaggccatggttaccgctgccaacgacgaattacgccaaggcaccggtgccggcagtgatttccgtgactggttgaatttacccaaagattacgacaaagctgaatttgagcggattaaacaagccgccaagaaaattcaaagtgactccaaagtcttggttgtgatcggcattggcggctcttacctaggtgctaagatggccgttgatttcttaaacgatactttctttaactacctgcccgacgaccgtcgtcaattcccccaagtcatgtttgccggcaattcattga

SEQ ID NO: 657 - DNA, 7816 bp, Unknown
  Metagenome-assembled genome
ggtgagttttatccgacaccgtaggtgccgacaacaaaacgttttgattctcttgggtgaatcttagtgatcccaagtcttcaattatcccttggttaattcccggttgataactaaatcaaagtcagctaacgttttttcatatggaaagcgggctagtttaattctcaaattaatctttttttgttcccggtatttaagctcagccgtttcaattcgaataaggcatcactcaaggacttgggtgcttcatcttgtgatccaataggtagccaaatgttcggcgaaacgatctaactttaattgtctaaggttggtgtataaagcttggtaattggccattttctcactccatttcacaaaatcttcaggttttcggtcgacgtaatcatcaatgactcggtcatcacgattcttataagtctgatcggacaatccttccatgtcatcgcgaaggtagtaaatttttcagtgaaaagggtgtagaacgaattaattctccgtttatataaatgtatagagtatgtcatcgtgtttaatttgtacggtttcgtcaatatatctttggggacggagtatttccgattttgaaagacaatcattgattcctgctaacttccttgcgatgttgttgctggcataggcacgagtaagtcttgatcaaaatctgagatactctttttctttatcaagcaataataaggcggaatttgagtcgcctgagacttctcatgattcagctgatcacccgtcaatggacgatctcggctaagtctagcggctcttcaaactctggttgtaaactttgattcgctgagtagttctggccagcgcctcaacctttcctttggtttgtggccgaacggtcgacaagcaattggcttgaaacccgcgtccttagcgtattcaacgaaggtttcattaaataccggcttaccaaaattcttttatgatgacgacgacaacaaccttttggtgtcaaaccgattttctttcggcacaccccccttgcccaaaaggcattagttaagcaatcaaaaaaggtaatttggctgcgactgaaggtaaattgcatgtatttcatttcgcgagtaccctaaaacatataagaagatgttgcctggacaatctctccatgccgagaaaccaacgttaaatcttctttccaatcaacctgggctgaagccctggcgaggtgtcaatccggatagtggcttttttcgttgcggcttttctgatggttcgacaatagtctctgatactcttggctttccattttggaattaaagcccccccaaaacttcgttctttgataaagtaataaattgccgttgccgaacagccttctagaaccttttcttcaatcgtttttcgataatcgtcaagtttactcggccgccgtaagggttgtggctgctcatctgggggcgtgagccctaaattgtagtatctttttaccgttcgtggatcaacaccatatcgtcgaccaatttcagcgaagttgggctttattttgttcataatatattgctggacacactgttcaacatctaaacgcatttcagttcctccaaatttgagatgcgtttagtttaccgtaaaaaaatgttggaaaaccgacattttctaatcggtattttccaacattttacaaccgttactgacaaaaactattattttctgaataattatatggaattagtcatctattaataccgtatgttacttttattttaaatatatttatatcatccttaccaagaccaataagcgtcttcaatatgatacacttatagtattatttcagtcacttttatacctgaatatactctgtagttatgataaggagagttataaatgtattttttctacgatgacaatatcagtttcaaaaagtctggtattgaacatgctgaaattaaacgactaaggttgtttaatgaaaaacatgttcctgccaagattattacccggatattctcaatgaacattcatgatgttattgctgatgcgggaatttctgaagatcaatttgtaaacttatttgactttttccaaggaacgatgagctttaagccacgtaagttaaccattgaagatttaccaatgcctaagggctatacattaaaaccagaaaaagataaaaccaaaaccgatgtctatcaaggcgagcagctggttatgatcgttgggactcgttccgagaaagacaaacgtctcgactgggttcaatattcaggatttaatggccgacctgttcgcatggttcgctatgacacccgtggtttcgctgctttggaacaattttattcatatggaactaagttggtttccgaacagatccttaaccctgaaggtcaaccagttattcaaagattcacgcatccacgaggtgacggtgaaacagaaacttcccttcatcagttaattaactataaaggccatgattatgacttcgcgacatttgaggacttaacaaccttctggctagatcaactaaatctttcaacgggtgaagccaataccattatttgtgatcgagcttatgaattggcttactctgtccaaaaaatggaaaccccaatttattctgttatgtacctacataataatcacgttaactctgggactgaccacatgcattcatcatttaactataattatgagtacatgttggaaaaccggaaacgttggaatgggattgcaaccctgacaccatggcaatacgatgattttaccgagcgttttggcaaagagaagcctaatgtttatatgatccctggcgccgttaccgaccagaagcttttggaaaagccacacgttaaatggacgactcgaaaatcgaaatcagtcattatggttgctcggctatctgacgaaaagcaacaggatattttaattcaagcatggcctaaagtaatcaaagcagttccggatgcaacccttgatttctggggctatagtaatggtgattacgataaaacactggctaatttagttaaccagttgggcttgaataacgacattactttccatgactacacaaaggatattggcgctgtttatgattcagctcaattacttatcttaccaagtcgggcagaaggactgccattgacattagttgaagctcaagctcatggcttgccaattgtcgcaactgatatcaagtatggtcctcgtgatgttgtcaatgatggcaaagacggctacttagttgaaaaccgaaatgttgatcaattagctgatcggattattgagctactttctgatccgaagaaattggaaacctttagtgaaaatgcctataaagatagttggaattattcatccgatgcaatttggcaaaaatggcaaccactgatcaaagacgctaagaagaatgccaaaattccagaaagtctcgaggtgtaaccatgtattactttttaaatcagtatattaaagcattaaattccagtgttgaacatattgaatttaaacgccaagcgttgtttaaacacgagcgagttcattcaaagattgtgactcgtgattacgacagtatgcttcatttaaatgcagccaactttggtttgaaccaaaacgatgttcttaatatgtatgattatttccaaggaaccacagatgttaaggaaaaatcatccagtgtttcagacttaaacattccgatcagttatcaaatgcactataacagcaatgtttccgaagcgcttcaaggtggccgattggccgaaacaattcatcatacaccgactcgagtgggtgaaattgcctccgttgaacattatgatgcttttagtaatattgccaatcgcgttatttgggattcacgaggcttcaagtcatgtacccaatttttagacttcgatggcgatccactggcagaaatcttttatcatttagacggtacccgtgccttggagcgatattgggaaatcactgaagatggtaagggtaaagtgatcttcaatattcacttgatcaactacaaaggttcagattattacttcaatacagaagaagatctatttaccttcttcctagatgaaattaatggccaaaatcatgaagaaaatacctttattgctgatcgaccgggcgttgcggatattccattgattcgcatgaaaagcaaggcgaagaaatacgtcttcttcccgattctccacgcagctaatccagatgatctgattcattctgaactcgaacctagctatcaagaagtgtttaatcacttggataaattagatggtttgattgtcatgacggataatcaagcccgtcagttacgaattcgcttgaagcggttaaagggtaagggccgaaatattccaatcagtgtgattcctggtgccgccattgataataaagaattgaaagctgaacatgtatcatcattaaataagcagggcaatcaagttatctacgctggtcggttaggtgtcgacaagggtgtggacaatctgatccgggcatttgcattagttgtcccacaagttcctgatgcagtgcttgatattcgtggcttcggtgatggtgactttgttaactcacttaaagatttgattaatcagttaggtatgcagaataacatccaaatttctggttattcgaatccaattgatccactttacgatcaatctaagatttttgccggtgcagctcaccaagatgctttcccactagcaatggttgaagcattaggtcatggattaccgttggtcgcatttgacacaaactttggtccggctgaaattattgatgataaagttaatggtttcttggttcaaccgggtgatctgtatggctttgcgcaacatattattacactgttaaccaatgacgccatgcttcagagaatgagcgaaaatgcttatgaatctgctaaggattatagttatccgaaagtttggaagaagtggcgcaacgcgattggtgtgaaataataaatacttattactaaaaatgagttgatatttttcgagggttaccgaaatatcaactcattttttcgaattccaaagattaattgcaaatttcttacgaacgttttttgattttggcgctttagccaaatcatttttcacgcaatgcggtaatgaaatccagatggtgttaccctcttaaggagaccaaaagaatatgacgcaaaaattaaaagatgaagttaaagagatacttaaaaacgcaagcaaatcagatctgaatgaatttgttgccaaactggcgcttgaagataattcagtttaccagcaactccggcgtcggttcggacgtttttcaaatggtcaacgattatcacagttaaaagcagatatttcagatattatagctgaaaatacttggggtggctttattaactatcatgcttgcatggcaatttgcgatgaattagataaggtgactcaagaagctcttgacatgattctaaatggtgatatcaacgttgccattcaggaagtgttattagtcattaaatcagtcatgggattcttagataaagctgatgatagttcaggagccgttactggatcattagattttgcatttgatacgttaaaacaactatctcaggcaagtgcaaataaattaaccaatccagagaaaagggttttggttaacgcggcgatccaagtttttaatcttaaacggtttgacgagtgggatatgtatcgttatgaggtcttagaaaacgttttgccattgataacgataaatacgttcaagttggtcgaatcagcaacgatgaagattcctgagcggtacaacaaactggatcatttttctgatagactttatggaactggttttgattccgagaagttccatatgacacaactcgaagaatataatgctaagttgaaaagtaaggcgttaattgcctttggagagtttaaagccgccaaacaggtcatggcaaaaaatattgcttttaattcaatccgtcaaattgcaattgacttctactcatctcaagctgattttagaacagccgaaaaactagcagtgaatggcacgttatcgagcaaagggcgtcaagattcaaatacatggttaaacgatttggaaaagatctatttgaaaacaaatgagtatcaaaagttggccgatgtttacaagaaaaaattgttactagcggattggatgattaatcttgatgattataaaaaattaaaggcagtcatcaaaaagcacggtaattgggaaaagtcatatccatctttgcttcaagagtttactacgaagcttcagtcgaacagttatgctgaaatccttaattttgagcatgaaacaggtaaactaatggcaatcgttgaaacggatccgtcgttaatttttgattatggaaaatctttatatgctaagtatcctgaaagagtgacagatctgtattatcaagatcaagttaatgttgatattggcaatacccgaaagcagtatcatcagctaggagaagtcattctcaagtatgctcattacggaaataaagaaaccgctcgcaagtggtgtcaacaattgattgaacagtatcctagaagatcggctttggtggatgaaataacgaaaataaatgataaaatattgtaataactaaaaaagatccagctaaaagttaaaaatacgcttctagccggatctttttaattactcaaaaattaatcattttaattctgattatttagaattcttaattcccaagttgtagaatgcattaaagtttgaaccagaagcagtttgtgcaaagttagcaaactgtgtcttagtattgtcatacttgaatgttgcttggttagcatcaccaaacttagcagaattcaatgcagctgtcgcagttgcacttgttgcataaacggcgctatcgtttgagacagtaacgttagcttggattgcttggaaagtaggagttgtattaccaacaccgccatatacgttgctcttgatagtagcattgttggcatcaccagtaagtgaatcaaatgtcaaatatccactagtcttatcgtttgcgtttactgggttaactaaagtcttttgacctgatgggtcactaacctgttgtgcaaagacaaaggtgatagtgtcaagcccagctgcctttaaatcagcctgaatttgtgcgtttgtagcacttgtaccgcgagcacccttcaaagcattagcagctaatgaactcaatgacccagcagttgtataagtaccattgcttaattgaacaactgcgcttgctggtaattcttttgtagccttagttgtgtcagtagtaactccaacaccatttgcaccattgccaatgttatcgaggttgaaggttgctgatgttactaatgaagtagaagcaacaggagcaacaacaacagttacatattgaccatatttagctccgttaagtactgattggtttgcttgtagttgagaaagacttagtgcagatgagccataaccagttactttagcatcagctaacagtgcggcatatgcagtatttacatcgcctgattgggcactcggtgtaaccaaggcattaccataatgattacctaaagtttgagcagcagtagtatctgaaccattcttagttacaactgcgtatccaagaactttgccggttgtatcagtaatcttaacaccagcttgatcagcatttaatgctggagctggatttggagtagctgaacttgaagcggaagtagcttgcaaagccgaagccttaacccacttaccgttcaattgagcagcagctgattgggcagcagcagaagctgatgctgatgaagcagctgatgagttagcacttgaagcgctagctgaagat

SEQ ID NO: 658 - DNA, 28565 bp, Unknown
  Metagenome-assembled genome
aagacgcatcttggactacgccacgcccgccaagatctttagttcctatgatactttatatgattagacacctagaccactactaaacctgaggtcaaaagtgttgcacttgatttgacaattcggggaaattcgataacatttagttttccggtggctgctgttttttaagaaagctttatagtactggtaggtctagtcgttatctgataaaataaaagccgttatgttcgatgttaaaggctaacaaagatagatttaataaaaggggaataaattatgtgcggatttgttggttatgttaaccaaaaagatgttcctgaaaatacaattagtgacatggcagatagaattaagcatcgtggccccgatgacgaagcttacttttctgatgacaatgttaaaatgggatttcgacgactttctatcattgatttagcccatggtggtcagccaatgtataatgctgaccagacaaaagtcctaacatttaatggtgaaatttacaattataaagaaattcgtgaggagcttcgtgatcttggctataaattcaagactgatgttgattctgaagttttgatctatggttatgaagaatggggtcccgatcttcttcaaaaattacgagggatgtttgccttcgtaatttacgataaaaagaacaatgaggtttttggtgcccgtgatcactttggaatcaagccactctactattatgatgatggtgatacattcctttggggatctgaaattaaagctttcttggagcatccaaatttcaaaaagcaattaaacctgaagctgttgccgattcatctgagtttcgaatttattccttcacgggaaacgatgttcaagaatgtttataagctgttaccgggccagtatttccttcataagaatggtcagactgaaacccatcgttactttaagtttaactacgaccatattgacaatagccaaacggttcagggtgatgctgagaagattcggaaaattgttgatgattcagttaaagcccatatgattgccgatgttgaagttggtagctttctatcaagcgggattgattccagctacgttctaaacgaagccgcaaaattaaaaccaattcagtcgttttcaattggttttcatcattccaagtatagtgagttggcttggtcaactgaattcgccaaagaaatcaagcaaaagaataccccaatttatatggatggggatgattactttaatttcttgccaactatgatgtattacatggatgaaccgctttcaaatccagcagcaattcaactttatttcctatctaaagagacctcgaaacatgtgaaggttgctttgtcgggtgagggggctgatgaattctttggcggttataatacttacttggaatccattccgtttgatcggtaccaaaagtatgtgccaaagccagttcgtaagggactagcaggaattgcccgtcatctaccacgattccatggtaagcgtttcttggtcaggggtgctgagccgttgagtgaacgctattatcgggtcaattacgtctttaattatgatgaccgaaataaagtattgaaagatccttcactcaacgttgattccggtacttacacaaagcacatttttgatgatgttgctgataaagatgaaatgacccaaatgcaatatttcgatattaacacttggctgccatatgatattttgcataaggctgatcgaatgagcatgtgtaattctcttgaagtgcgaacaccactagttgacaagaatgtggctgcctttgcggcgacaatgcctgttaagacccgaattactaaagatgagactaaaatttcgttacgaaccgctgctgaaagtgaattaccaaagaaaacggctttgaaagaaaagctaggcttcccatcaccaattgctagttggattaatgaccccaagtatcacgaacgaatcgtaaaagcttttcattcagatactggtaagaaattctttaataccagcgaattggactatttattaaagcaacatgctgaaggcaagtctaatatgcaaaaaatctttacgatttatacatttattctttggtatcaagtttacttcccagaggacacgactgaggatacggttagtttggtacatcggactcaaatttagaattttcgaggaaatggaaggtgcttagattggcagaaattacagttgatgaagtcctattacttctcaatgaacatcatttattgattgaaagtcaatttaacgaccctcgtttaagttttgaacaaattgcttataattcccaagttgtttctgatcggtgcttattcttttgcaagggaaattttcgaccagaatatttaatggatgctcaaaaacacggcgcgacgggatacatgtcagaaacccgttacgacaatgttcagattccaggcatcattgttaagaatatccaaaaatcaatgtcgctcattagtgcggcattttttgggtttccacaaaataatttgccaaccattgcatacactggaactaagggaaagacgacatcagcatacttcactaaggcaattttagacagaacttataataaacgggtcgggttgttttcaacgattaatacggttgtgggaccggcgaagtctgacgtggttaaatcaagtttaacgacaccagagtcactggacctatttaccaacatggctgccgttgttaaaaacggcatgtcacatttagtcatggaagtttcgtctcaggcgtataagaaaaaccgagtttataatctccattatgatgttggagtctttttgaatatctcaccggatcatattggtcgcaatgaacatccaacgtttgctgactatttacactgcaaggaacagctactggtaaactccgatcgttgcattctgaatgctgatgggactcatttgaaagatatttactatgcagctaaggcaacgacacaaccggaaaatatttatatttatggtcgtcaaaaagcacaaactgctactgaatttccgcttgattttcagtatcgctcacttgctgattctttaaccaataataaaattgagttaaaggcggtcagtgagaaggcaaagcagttggatattgacggagtttacgaaattggaattcctggggattataatgaaggtaatggtgttgcggcagcaattaccagtgggctcatgcacgccggtaaagatgatataaaatatggccttgcccatacaactgttcctggccgaatggagatttatcgaactagaacgcatggcaccatttatgttgactatgctcataattatggcagtctgcatgctgtgctcgacttcttgaagaagcaatcaccaagcggtaaggtagttgttttaactggtagtacgggtgacaagggaattgaccggcgctccggtttaggtaaagcaatcaatgagtcagccaatgtcgcttatttaactactgatgatccggccactgaggatcctaaagtcattgctaaggaaattgcgactcacattgaccgggacaaagtttctgtaagttatattgctgatcggaaaacggcgattactaaagccgtgaatgaaagccaaaagggcgatgtcattgtgatcgccggtaaaggccatgatgcttttcaaaagattaatggcaagaatattccttttgaaggggatgcgtcaattgtggcaaatctagtgaagggactttgaatctatgaaaaatgaacaagctaatttcactcctgttttattaggtagtgattttaacgtatacggaatggcacgctctttgtacgatgtttatgggaaaccggttaaagcatttgctcaagttagtttggcaccaacccgatatacaaaaattgttgatcttgaattaattccgggatttagtgaagatccgacttggattaacgaaatgatgaagatcaaacaacggtatgcaggccataaagaaccggtgattttgattggctgtggggatggttatgcggaattgatttcaaaacacaaggcggaactatccgacgtctttgtttgtccatacgttgattacgacttaatcaaacgtttgaatgataaagagaatttttacaagatgtgtgatcagtatgatttgccttaccccaaaacgaaaattatcagcaaggcaatgtatgaatctggtgatccaattgagcagccatttggttacccagttgctttgaagccggctaatagtgtcgaatggctggatattcatttcgatggtcggaaaaaggcgttcatcattaaaagtgaagccgaattcaaggacattgttgctaaaagttatggcaatggctatacgtccgactttattcttcaagactttattcctggtgacgacagcaatatgcgaaccctcaatgtttacgttgatcgatcccataaggtaaagttaatgtgtcttggtcatccgttacttgaggacccggcaccttcagcgatcggaaattatgttgcaattattcctgagttcaaccaggatatttataatcgagttcaaaaattcctagaagaaatcaactttaccgggtatgctaattttgatattaaatttgatactcgtgatgattcctataaactctttgaaatcaatttgcggactggacggagcagtttctttgtaactttaaatggatataaactagctgactgggttgtccaagattatgtcttcgattctctgaaagatcaaccgacgctttatgcgaataaagatcaaagcaactatttcttatggcttggtgtcacaccccgaatttttgaaaaatatgccaagacgaatgatgttaaacaacatgccatgcaactcattaaagaggggcggtttggcgatactttttggtatggtaaagataaaaatctgaagcggtttgccttatataaatggatgatgcataattatgccaagaactttaaacgctattttgtcacaaaataaggactgatttagaatgaaagactttttcactatcattggtggcatgggtaccgaagcaactgaaacgtttattcatatcctgaatgaacggacacatgccaataaggatcaagattacttgaattatatattggttaatcatgcaacggttccagaccgaaccgattatattttggatcataccaagcctaatccattcgaaccactggctgaagacattaagcagcaaagcaaattggcgcccgacttctttgcaattccttgtaatacggctcattattttttagctcagttgcaggcgttaaccacaattcccattttgaatatgccccgggaaacgattaaagctatcaaggactacgcaccaaatgcacgcaaggttggtttaattgcaactaagggaacacttgaagatggcatttatgatcaagagattattgatgctggttatgaattgtttaagccgacccgtgaagttgctgatgagacaatgtcattaatttatgatgatattaaagaaaagaacgttgttgatggtgagctctatcatcacatcttatctgaaatggttgatgggtttcactgcgatattgttgttctgggatgcactgaattgtcggttgcccaacaacgagctggtgatcattcttatccagtcattgatgcccaaacagttttggctgatcgatcaatcgagttggcgatgaagaatcgtcagaaaagtaaacatgtctaagcaggtctgattttgaatagccagaattgtttgctgagacagaaaaaagctgagatcaaatatctcagcttttttcgtgtagctatttagttaagcaaggaaaatccagataaccagtcttcttaattagtttattggcactttgtcatgtacgctttaaaaattaactaatgtttgaaccattgcagctattggcacgcctactacaaggaaccataacaactttggtgtgtagttggtatcttgcttccggccataagcggtctctgctaaagcaataatgcttagagtgattaagccgccaatgataaccaatagtggatgacggtgaaatgaacgaaggtcgatgacgacttggctgatgacaattacccaataaaataatcgtgaaatcatcattgaatcaataacatgctttttgatggatcgggttaacccccaaatgaaattaataaataaaatgccccaacaagcgtaatttaatgcgacccacattcagatcacccctttacctttagtattatgaatttaggcaaaaaaagcaattgtttggcgaattctttagatatttcaaaacattatgacaagaacagattctcgtgatataattatttctgttgtgcgggtatagtttagtggtaaaattcaagcttcccaagcttgcgtcgcgggtccgattcccgttacccgcttaaatacttggtcatccaattagtaaatattggtggatcatccgcgtttgttataagatctaagacagataataaaatttgttttagatccttttatatatttttaacaaaatgaggtgaatttgattgccggaaaaacaatctgttttgacactaattactggtgccgataagggaattggttttgaaactgcaatggaattagggcggctgggtcagcatattttagtgggctcacgagataagtcgcgcgggtctcgggccgtgaagagacttcatcagcaaagaattaagtctgacttgatgattcttgatgtgacatcagcagcctcaataagagcggttgccgaccgcatccgtaaccagtttggttatcttaatattctaattaacaatgccggagtggcgtttgaccaccatgagtcggcgctgacaatgagtattgaaacgattagaagggacttcgatgtcaatttctttggcttgatccaagtcacccaagcaatggtgccactattgctgaaagctgatcacgcaaagattattaatgtctcaagcaacatgggttccctaggtcttgccagtgatccgacatctcaattttataatgttagttcactaggttatcaagcttcaaaagcggctgttaactcagcaacgattacgtttagtaaaacattagcacatgcaggaattacggttaatgcggttaatcctggatatacggccactgattttggcggtcgttttggcggaactcaaacggttcagcaaggtgctgctagaattgtttcactagcgcgtgatctggatagtgaagtaacagggactttttctgaaaatgcgggtaagttgccttggtaattgataagatttagacgataagtgttgacatatcgcaggctagcaaggtatcatacatttgttacgttatgattattcaataataaaagagaagtagttggtcactaattattcagcgagttcggaggggtggaagccggactaattagtcaacgaagcgtgctttttagaatgctaatttaatagttgagcggatatttatatcaaatagagtggtaccgcgggggttactcgtctcttacaatttttttgtaagagtttttttgtgcatttttatagatggaggaaataataatggattataaggcgcaggtaacaaattcaattttaactgttttaaacgatgaattatcttcggcagaggtatatcaaaaattagaaaaaccaaagacacttgcaatgggtgacttggcatttccggtattttcattagcaaaggtatttcataaagctccaaatatgattgctggagatttggtttcgaagattgatcagagttcctatgacaaggttgaagcaaagggtgcttatattaacttctttcttgacaagggtcagtttagccgccaaatcttaactgatgttcttgaagagggatcggcatatggtcaaaacgatcgcggaaagggtggcaatgtaccaattgatatgtcatcacctaacattgccaaacccatttcaatgggacatttgcgttcaaccgtgattggaaattcaatcgctaatattttaacgaaaaatggctatcatccaattaaggataaccatttaggtgattggggaactcaatttggtaagctgattgttgcttataaaaagtggggtaacgaggaagacgttaaaaaagatcccattaataatttagttaaatattacgtgaaattccatgtggaagataaagaacatccggaattagatgatgaagctcgagagactttcaagaaacttgaggatggtaacgaagaagaaattcatctttggaaatggttccgtaaagtttcgttggaagcttttaacaaaatttatcaaaaattaggtatcgattttgacacgtataatggtgaagccttttataacgataagatggatgaaggcattcaaattctgaaagacaagggtcttctcgtagagtcccaaggtgctcaggtcgttaagctggataagtataatttaaatcctgccttgattttgaagagtgacggggcaactctttacatcacccgggatattgcaaccgcgatttaccgtgatcgaacgtacaaaccagccatgaatctttacgttgttggctcggaacagacttattacttcaagcaactaaaagcggttttattggaaatggggctaaagtctgctgaagacctgcatcacattccatttggcctcattactgttaatggtaaaaaattatcgacgcgttccggtcggattattttgttggacaaagtgctggatgatgcgattgaccttgcgcagaagcaaattgaagaaaagaatcctgatttgcctcacaaagatgaagttgctaaagaagttggtgttggtgctattatttttggcgatttaaagaatgaacgaatgaataatattgactttgttttagaggaccaacttcgatttgaaggcgagacgggtccatatgttcaatattcacatgcccgtgctgaaagtatcttacgtaaagctggcgacattgatttacacgcggctaataaatcattagctgatcctgaagcttgggagacaatcactgctttaaaagactttccgaatgttgtcataaatgcttgccgagacttcgaaccatcagaaattgccaagtattcactaagattggcaaagtcgtttaataaatactatgctcattcaaaggttttagtggaagacgatcagctgggagcacgtttatcgcttgttaaagccgtttcaattgtgttaaaagaatcattaagtttattaggtgttaaggcacctgatgaaatgtaatccggatttggattaatctgaataaatttttaaacagggtgggccggcaagcggttagaccccagaatataagcccctaacttgatattcccgattttggaatgtcaggttaggggcttatattctggggtctgcttgctggtccacgttttagctaagtaacaagttcagcgagatattctgaacttgaatagttggataattcggttacacagccggaagttgccctttgtcggttctttccatactttagtgaaattttgatgatgatttttaaacttcaaactaaaaacgggataacttggcgagttcgaacaattttcatctgatttaattttgaattatcacttcaacatggagagaacccttttgtcccgcgttttcgcttggtaacaattgtgttgacactaactgggactgggcaaaacgactattgtttccgcctttttctttttgatgacattcgaactgatctatattcgaacaggtattagttgtttttccaactatcagatttgaaaattttttcctatctgactggtaatgtccaagcaagaattttaatttgtggtagcatttgcgatgacttgcaattgtcagatcattaaattgcagcatatcgtaaggagctatttttaatcaagtgacctacattttgagtgttaagtatttctttagcaattctagttaaaatataaatcctttttaagtttcggcaccgctccttaatggatatatcagttgtgatacaatgtttgagtatccataaaaggagtattttttatgaacaacaaatcgaagagatcatccaagaaatgggttgggccgatgttcaggcggttcaatcgtttttgtcgaaagtttcatttagtaaaatggttagcagttctttttctaacagtcatgttggcgatgagtacttatctcgttttcctggctaagactgctcatgtgcagaatctggaatcttcacttgccaaaacaaccgaaatatttgatgttagtaatcataaggctggcgaattgtatgcccaaaaggggacttatgttcatcttaatcgggtctcaaaaaatattcctaaagcggttttatcaaccgaggatcgtgatttctatcatgaacacggattttcgatcaaaggaattggtcgggcggtgttcttattagttaagaataagttacttcatcgagattatattagcggtgggggtagtactttaacgcaacaactcgttaaaaatgcgtatctttctcaagaacagacaatgacccgtaaactaaaagaattatttttagcgattcaagttgaaaatgtttattcgaagaaagagattttgacaatgtatttaaacaatgcctattttggaaacggcgtttggggggttcaagatgcttctcaaaagtattttggtcaaaacgcagttgatctatcagttcctgatgcggctgtattggcggggatgttgacgtcacctagtgcctataatccaattgatcatcccaaggcggcgaaatggcggcgaaatgttgttttgcagctcatggtggaaaacaatcagttaacgcaagctcaggctaattactataagaaaacaccgattgttgtcagagatacctatgtccgcaaagatggctataagtacccttactattttgatgctgttattgatgaggcaattagtaaatacggtttaactgaatctgagattatgaatcgtggttatcggatttacaccaacttgaatcaagcgcaacaacaagcaatgcagaccacttataataacaatgctctatttccatcgaatgcggctgatggaacagaagttcaatctgcttcaattggcgtttcaccgacaacgggtggtgtgacagcggttgttggtggtcgtggtaaacatgttttccgtggctttgatcgtgcttcacaaatcaaacgtcagcccggatcgacaatgaagccattggcggtttatacgcccgcactagaggctgggtataaatttgattccgaactggttgacaagaaaaaatcatatgggtctaatcattacacacctaagaattacaataatgtttatcagggtaaggtgccaatgtatcaggcggttgctcagagtatgaatgcaccggcggtttggctgcttaatcaaatcggcgttaatcgtggttatcaatcggtaaaggactttaatttaccagtaaccaagaaagataaaaatttggctttggcactgggcggtttgtctggtggcgtttcaccgcagcagatggcaggcgcctacacagcttttgcaaatggtggtaagatcgttaaaccgttctatattagaaaaatcgtggattcaactgggaaagtgattgttgacaatacagcaaagcaacagggacgacagatcatgtccgcatcagttgccaagcaaatgaccagtatgatgctgggcgtcttcaataatgggaccggtgttgatgccaagccatatggctattcggttgccggtaagactggaagtaccgaggctgataataccggttcctccgatgcaacaaaagataaatggattattgggtatactcctgatttggtcgttgcaacctgggagggctttgacagcaccagtcaagcgcatcatttggaaaatttgagtggtaccggggtcggtccattattccgaaatgaaatgcagacaatgttgccttacactaaaaattcaagctttaacacaaaggatgctcaaacaattgttcaagatgagaataaggacaatggtaatttgtgggacacgattcaaaagaaaacggatgaatactctaataagtttgaacaaaaggcaaaagattttattaatgatgccaagagctggttcaaacactagattcacttggaagtcccagttggttttatgttagaatgaatcgaatacaataaaaaggtggatatacaatggctgacaaaattatggatactgcaaatcaactgcaggcggagttaaaggcttctagcgaatttgcagatctaaaagcatcatacgaaaatctgaagagtgatcctgaaacgtttaagctgtttaaggattttcaagaacttcagttaaagttacaacaaatgcagatgcagggacaacaaccatcggaagatgaaattaaaaacgcccaggcaatggctggcaaaatgggtaagaatgacattatcgctgacttgatgaagaaggaaaagggcgttaataatttgttgaatgatgttaacaaagttgttactcagccgttaatggaattgtatcgagactaggattaacgtccgagttattcgatgtcagttaagcaacagctaatttttgagtttgttcaatcaagagtatctgattcaataattcaatagaaattcttaaattggggcggcaacgaactttctagttttgttccggccttttttacgtacatagttagtaggaggttctaatgaaatttattcatacagcagatttacatttagatagtccgttccaagggctacaaaatgactcacttccggagcaactttggcagcgaattcggcaatcaactttccaatcgtttgaaagaatagttaacgaggcaattaaccagcaagtagattttgttctgttggtcggggatctatttgatcgtaacgaacaaagtgtcgctgctacggcatttcttactgagcagttaaaccgattaagggatcatcaaattgacgcgtttattagttttggcaatcatgattacgcaacaattgattctcctcatttaggttatcctgacaatactcatattttttccaatcaagtcgaaacaaaaagaatcactttgaccgatggaacggttgtggcaattagtggttttagtttcccaaaccaatgggtaaagcaaccgatgattcaggattatccggaagcggttgctaatgctgattggcatattggaatgttgcatggtagtttagattcactgaaatcttcggaggccaattacgcaccatttacgcttcaagccttaaaatctaagcgttatgactattgggctttgggtcatatccataaacgtcaatcattagatgatcaggggattatcaattattcagggaacatacagggccgccagattaatgaatccggtgaaaaagggtatttgctgatccaaagtaatggtcatcaattgagaacaacatttgaaccaacagcgcccatcatatggcagcgtttgaaaatgtctataaatcaggttctgcttaatgatttgacaggaaaaattctagaatatctatcaaagcagcatttttctcaattgcattttgtcagagttcagattgatgcgaagcaaccacttaatcaagaagtgattgctgcaatttctaatggtgacttattggaatcggtccagcagcaaaatgcaatgagttggcagcaactcaattgttgggtaacgtcgattcaactattaccgtcaaaacacattgtggctcaccaatttgatcaagaactgtttgatcaagccaagggtcaaactttgacgattcctcaactaagtaatttagctaaagtatttaaccaatatccatttattaaagaagatctggcaagtaaggcaagtcagaaggatgtttttgaccaaacgactttaatcatggcagaaaatattcaaaacgtgaatgaggatggtgttgatcagtgattattgaaagattagtcatttatggatatggcaagtgggttgatcaatccattcaagttaagcagcctctacagattgtttatggcccaaacgaggctgggaaaagcacactggttgacttcattaaatcaatcttgtttgggtttcaaacaaagcgccaagctgttcatggtcaatatattccaaaaaatcactcaacatatggcggtgaaatatggttttctgaatctggacgtcattataaaattgttcgaacgcagggaacccatggcggtgacattaaattttatgatttggaacatggtcgcgaattaacagcagccgactttcaacaattaatatctcccattgatcgacagacgtataatcaactgttttattttggggatgttaaccaaagcgaggtttataaacttggtgaaatggatctacgccgtcggattcaacagattggcgtagccggagctaatcagtggatagatcttcaaaatgagctggaaaaacaaagccaggagttatatgcaccgcgtggcagaaaaaaggctttaaatgcgcagttaagagactacgataaattagtcggtcaagttgaagatgccaaacatgcatttccgaaatatcaacggatccaagctgagattgatcaactttccaaaaagttacaggaacttcaagataagctattagccggccagaaaaaggcccaacaacaacgagagttattaacaagcctgccgttggcaactgaattacaaaaattatcaagagtttctcaaagtgatattaaagatgggtttcaggatcatgaccggatcgtccttagtcgattgacaattgctttggataatcatcaaaaagagttaaagcaagtgaaagccaagttaaaacagttatcagataaccagtttgaaacgccggttcagaaattttatcaagcaaataaacgtcaaattgatgaattgattaatcaattggccacacaaagggatcttgcgactcggattgagtttttgactaatcagcaacacgaaaacgatacaacgctgacacggttggttcattctatttcttccaatcctttgatacgggtgccacgtttatttgacgatcaaacgtatcatcgggtaagcgatttactgaggcagaggcaaggtgcttcaggtcaaacaactcgccaatccacacgccagcgtgtgcaacgttctgttaatcgaccaaacatgccatttttcgtcattggtgcgcttattttcgtggggtcgcttgctatccaccaaacaatggccagctggttgggttacttcattgggattatggtcctggggtgggggtggcttcatcctaagcgtgaggtatcaaccattcagcaatcatctcagtcaccaaagcatgattggacgttcgatgaaattgatcagcagcttaaccaaattcgttctaaatttgacttatcggatattaatgaggatcgttggctttctattcaaccaacgattcgccaaattaaaggaatccaagctgatcaggccaaagttatgacacagttaaataatgatcagggcaagctgcagatgtatttggattcttggcaatttacacaagattggctaacgatttctgccgatcagccgaccgaacagctcaatcagattgaacaagcggtgtttcactggcgacggttgcttgatgattatcagaatgaaaagaaaaaagtagaaatatatcaagaaatgattactaatttaattgataaaatcaaacaggtgacactgagtaaacagacgtttttccaacagcggggtgtcactaatgatgccgaattcaaccaacttatggcagaccagcaaaaaattaagcggaatcttacccgtaaaaccgaagttgagcagcagcttcgtgtcagtaaggtgatggtaccggctggcatgaccgagattgacgttcatcatcaaattgacaacttgaataaccaaaataatcgttaccaacaattgattaatgaaaaaagtcagcgtcgaagtgaattaaacattcaattgaacgacttagttcagaacgggcgatattatgattttcgacaaacacttgcaaatcaacagaccgagattattaacagcgttcatcgatatttagctttgaagctaagttcggattggattcaaacggttttaaatattgctaccaaaggtcgattacccaaaatgctggggttggcaaaaaaatattttcagattctgactaatcaacattatcgggatattatctttgaggacaggattagtgttgttagatctgatgatgttcattttgtcattgaagagttatcaaagggtactttggaacaactatatttatcattgattttttcaatggcagttggttttagcagtcagtatccaatgccaattatcattgatgatggattcgccaattttgatcagcagcggcggcaggctgcttacgaaatgttgaagcaggtaagccagcagacacaggtaatttatttctctgctaatttgaatttagaagttgacaaatcacttgttttaaatttgaataaattgtaaggaagtgttctcatggcaaaacgattaatggatttgaaacttgatgaagattttgaatcctatgttttaattaaagaagcaacaaagcgcgtggctaagaatggcaagaagttcatctcacttgtttttcaagatcaatccggtcagatttccggaaaatattgggatgcttctgatcaagacatccaacagtttgtaaacggccgggttgttttactaaccggtaaacgggaaagttatatgaacatgccacagatgaaaattgtttcaatgcgattagccaaagaaaatgagcctcacaatccgttactgtttgtcaaacgggcaccactgactcgaccacaaatggaggattttattaaccagacgatttttgaaattaccaacgcaacgtacaatcgagtggtgcgatacttaattcaaaagcatgctgatgcattctttagtttcccagccgcgaaaacaaaccatcatgattttgcaggtggattagcctttcacacaatttcgattcttcggttggctcacagtgtagttggtcagtatgaggggattgatgcgccgctattatactcaggagtcattcttcatgatcttggaaagacgactgaattatcagggccaatttcaacagaatatacacttgcggggaatttgctgggtcatttaagtattatggatgcagaaattgcggaagcagctgatcaccttggaattgatcaacaaaatcaagatatcattttgttacggcatatggttttggctcatcatggtttgttggagtatggctcacccgaacggccgaaaattttagaagctgaaattttgcatcatctggacgagctggatgcgacaatcatgatgattcagggcgccttaaaaaacgtccaaccgggggactttaccgatcggatttttggattagataatcgacgtttttataagcctactgattagttatttacaataactcaagttaaacaaaaagcgttcagattgctaacaaatgtcggcaatctgaacgctttttacaagttataaattaactactttataagcttaattaattacttttttgatgaacttgatgatgataagtaatcggatagtacattctgaagatccttatcttgaatggtaactttacccttcttaagaacctttgaaacaacggaatgcaatgtattactatcggacatcttcttggaaacaatctgatcctttaaagtggattcatggtctttgtaagttcccttggcaggatggttaaccatttggataacttggtaaccatattgcgtcttaacaggggtcttagtgtactcaccattcttaagcttgaaagcagctgtcttgaagtttgtatcaagtgatgtgttggtgttgtcaaacggtgaaattcgaccacctttgttcttagtagcagaatcagttgagtacttcttagctaaacttgagaagctcttaccagctttaaggtctttaatcactgtttcagctgttgacttctttgaaactaagatttggttaacagtaacttttggttggtaagacttaaattgatccttaagttgagcatcagtaatcttgatgttatctttaacagcttcttgaagtaaaagatttgaacgaattgaatcttttaattgagaagcggtcataccattttgctgaagaacagcgttaaatgatgaaccatattgtttcttatacttattgaaatcgctgttaacctttgagtctttaactttgctaccgtattgcttttgaaggaccttgtttaagatcattgtttgcaatacttgtttaccacttgaggtactcttcaagctgctataataagcactttcagtaatttttccgccattagttgtggcaactgatttactaccacaagctgcaagcgtgaaactcatgagtacaccggctaaaacgattagccattttttcatacaaaaacacatccatttctacagtattattcgtttgtcaagcaaacgttccagacaataataacatattatctgaatgatatataacctctcagggaatttaaacaaatattcatatttccattagtggttttgattcattttgttggtcgctttattaatctcatcgacccgtggttcaatttgaaacattgcctcatcaacgtcacgttgaattgcattgattgcttgagtcatttccggtaattgttgtttaaatttttctaaagcagctttaaaatctcgatatgattgtcgccaatctgaatatgcttgtctttttttcaaaaattcgattttaacgcgattgatgaattcggtcggggtttccttacgtgcatataggtgcgcgccaaataaaacggcagaagcaccgattactttaataattgttttcattgattaatcacccatgtggtcgacgattgattgttgcactttcttcagatcatcagcagtgtacttgtttgaattatctttgaagatcattgcaaaatcatcatgagttgtgtaacgtggcactaggtgaaaatgagaatgaaaaactgattgataagcaatttgaccgttgttgttgacaatattcattcccttaatgtcagggttagacgctttgattgcccgagcaactttaggaattcgagcaaatacttcacttgccagttcttcgtcatattcaaaaatattggcgatgtgctttttgggaattagcagcgtatgaccaggggttccttgagaaatatcaagaaatgccttaacaacatcatcttcgtagacggtgtaactcggaatctcaccgcgaacaattttacaaaaaatacaatctttcaaaataacgaccttctttctgttaatactatgtaacattataacatgacttacgtagcgcaatcacaaacactaattttctatgttataatttgttctgtgtatttttaaagaacaatatggaggaaaaagatgactttagaagtttccaacctagttggtggctattcacaagttcctgttcttaatgatgttagttttgatgttaaaaatggcgagcttgttggcttaattggcctgaatggtgctggtaagtcaaccacaatcaatcatattatcggtttgttaaccccgtttaaggggaccattaaaattaatgggacaacactgaatgaagatgttaaagcatataaacaacagattgcttatatcccagaagcaccaattgtttataaagaattgacgttaaaagaacatttggaaatgacgatgctggcttacaacttgaatcaagaagatgcgtgggctcgagctcatcggttgctcaagaaatttcgtttagacaataagcttgattggtttccagataatttttcaaaagggatgcggcaaaaagtgatgattgtctgcgcttttttgactaatgcaaaattattcattattgatgaaccctttctagggctagatcccttggcagttaatgatttattgaacttaatttcagatcgaaaaaagcaaggggccagtattttaatgtcgacacatgttttggatactgcacaacgttattgtgaccggtttgttctgctacataatggtaaagttcgaaccgagggaacgcttgaacaattaagaacccttttccccaatgccggcgattccttaaatgatatttatctttcactagcaagggaaggcgaatctgaatgaaacaacttttcaaaaagcggctggccaatcatttgactgagatgatgaaatatcttcgattagtcttcaatgattatttcgtccttgcactggtctttttgattggtggcctcggatactattattcaaatgcgttgaagcaattgcattccggaatttggtgggcgccactgctcaccattggtgttttactaattgggatccaacttggccggtttgcaacgttagtgcaggatccggattacgtctttttactcccgcaggaatcagagatggtttattacttgcgttccgcttatcggtatagccttgttctagcctgtgtcactcaagtgattatttggattgttttgatgccgttcgttcaggtgacacttttggcgacaacttcagatttgttttatcttctagcaagtatcttgttgctgaaggccatttggcttaacgccgattttgctagaaagtatcgtgtaaaaagcagatgggttgctaatagattcctgttcagatttttattaccactagcagtattcacaatttcattttacttcgaatattgggtggggacattgctaacatttctgatcattctttttagcactgtgaatagtcggcgttggggaattcggtcattggattggcgaacgatgattgatgacgagaataaccgaatgcatactgtttatcaattctttaatttatttaccgatgtgccatcgttgaatggttctgttaggcggcgccgttatttggattggctgttacggcggattaggctaatccctgaaaatacgtatctgtatttatacgctcatggcattttacgggatcacgaaatgggtggactatatttccgactaaccgttattggcacactttttttggtgtttattaaaggtgaaatgttgccaattgctttgtgtttaatcttcctgtatctgattgggtttcaaatgattccattttatttccattttgacgacaacgcatttgttcatatttatccagtgacgaatgatcatcaaatgaaaaattttcagcgggtgctactaatcatgttatgtgctgtggcaactatttttgccattgccgttattgcgattaactatacaaatgtggtgacgattattggtgttatcgttggtgaactgcttgaggttttggcatttatttatttgtatgtcccacgacgaattcaacgtgggcagcgaagtcgaaatatatagtacttggaatcatgcacgctggcaaatttaagaataaaaaataattaaagatgtctttattctaacaatgaaggcggcagatcggctggtttgattagcctgaatgactagcagttatctttgtttttgagtcagattcgagaatccgtgcaattaaaaagagagtgggacgaaaggcggttaacttcccgagtgtaatcgaattatccaactattccacccggaatagttggataattcggttatgcggcaggaagttgccttttggcgcacgtttccactcagtaacaattgtgattacaaaaaacgggactggacaaaattacttttgcctcagtctccactttttccaagttgtgttatttacttaaaagattaaggtaggagattattaatgcgcataagaaaaaagccttgggcggctaaatatattcaagatcatgctgattatattgtgaccaatcctcaaaattggattggcaggtggcaggaacgatttaccaaaacacaatcattggatgttgagattggtgccggaaagggccaatttattattcaaatggctaagcagcatcctgaaataaattacattggggttgaacttcaagagtcagtgattgctacggcacttaggcggtttatgactgatccactgccaaacttacaattcgttctgacagatggtgccgatttggacgaattctttcatcaaaatgaaattgaaaaaatatttcttaatttttccgacccctggcccaaaaaacggcatgccaaacgtcgtctaacatcgccgagatttttgaagacttatcagacagttttggctcatgagggtcagattgaatttaaaacagataaccgtggtttatttgaatattctttagtgacaatgaataattttcccatgcattttgatgaggtatcattagatttacatgaatctccagaaaatgaaaccaatattgaaactgaatatgaggaaaagtttagtccaaatggcccaatttacaaacttgttgttcactttaattcataaatgcgggtttttaatacttttcccgtggtagggtttgcccaaaattcgtgaacttcaacttgaccgcttttcttttgatagttgaagccaaaatgaaattctgttgacgttgattgtgttggggataaggaccaatttcctaaataagttgtccctggtgttgacaccaaattctgattaccatgcatgatttgttgtaaaagccttttattagctcgacttttttggtaatctttattcagactgaacgcggcacaggcaccaatggttgcgccagccaatgataaactataaagaattgtttgttttttcaaaatttacccctttttcgaatcaaattaactatactttaatatagaaagggatattgagcaaatcatgctgataattacccaaaatgcgatataatttacttactaaataaaagtaaaagccattgaaaggatgattcattaatgaaagatttacaaaaaaccgacttgaaaacaatgaccaatgatatttctgatggtaagtatatgctgttctttaccgcagactggtgcccagattgccgatttatcaagccagcgatgccacagattgaaaatgaatattcagattatacatttttaaaagtggatcgggatgaaaatattgacctggctggcgagatgaatatcatggggattcccagttttgttgcctatgatcatggtaaagaaattggtcgattttctaaccctgaccgaaaaacaaaacaagaagttgaaaagttcattgactctttgaaaaaataataaatgagacggaaggatagcgtaatgttaatagcaagttataaccctcgaagcactggcgatacaatggtggtcattttaaatcaagatattggtgaccaacaagttgaaattcatgatgaggttgctcgaatttatgatgaggacagccagaccactttggggtacaactttttaaaagcgagtgaaattcttcctgaaattgttaatgtgaatggtcgggtttcattaacacctgatcaaatcaaaaaaataaatcaatatcttaaagatcaccgattccctggggatattcagtttgatgacgatcctaagtttgtagtcggctatgttcaaagcgttgttgatcatccacattcaaatcatttgcaaattaccaaaactgacgttggcaatggacagattctccaaatcgtcagtgggtctccgaacatgaaagctgacattaaagttgttgttgcaaaggttggtgctatgatgcctgacggtcaaattatttggcgaggcgaattgcgtggggtacaaagtgacggaatgatttgctcaggtcgggaacttgaattaccaaatgcaccgcaagttccgggtgcgctaattttgcctgatagttatcaaattggtgaatcatttgaatttgataaggcaaaacatttatttgattaataatattgggtggcaggtagaacatgaaaaattatgatggaccagctttttttcgacggcgcaaatttattgaatcgcggtcggaaaagcacaaaaaaactgaacaaaataatcaacgtgttcaatccataaatgtcccggaaaaacacgttaagccggttttgagacgatcacgttccgttggtgatcgtcaaacaccggcttttcttgaggaaatcaaaaactttgttcccaaaaaacgacctcaagttgataaacgaaaaaaacaaattatgacaaattatttgacgagtcagcagcatcggcgtgatcatttatacgatcgactgacgaacaagttacgaattaaaactgctgatcttattgttttagctgatagatcgggggatgacagagactttcatcctcaaacagctcaaaaccttcccactcagtcaaagagccaaacgtcaacgactgactctgacgtttcaaaagagatggtaatgactgagcaaatagctaaaccagttgataatgaatcagttgctcagccagtgaagactcaatcttttgaaaatcatcctggggagtcagaccgtaaacagccttttaattctcgtttgaatcaccatgggcttggacaatcctttaaaacgattgtgaacgaggagagcgccggccgaaaagatctgagcttatttagtgattcgaagctaaacccaaatcagtctactgtgactcgcaaattagatcctaataacaatcgagtaaacaacaaacccacttcaaagcaaaagccgtcttcgggtgagctgctgaagtcacaggataatcattctcaaagtaataagaccaatgctgttggtagttctgataatagtcaagctgatgatcgtagttatcagtttccaccgctatcattacttaaaaaacctgatttccatgacgatacttcgttggatgactggattgaacatcaaatcgatgttttagatcgaacgttttctgcgtttaaagttaatgcccaggtcgttgattggacaaatgggccaacggtgacacaatttcaagtaaaacttgcacttggcgttaaggttagtcggatcactaatttaaatgatgatctcaaattggctttggctgctaaagatattcggattgaagccccaattccaggaaaaaccaccgttggtattgagattccaaatccacatccgcgaccggtggttctttcggaaattatttcaactgacaaattcaaagagaatcattcaccgttaacgacagctgttggcgttgatctttcagggacaccacaagcgacagatattcgaaaaatgcctcatggattaattgcgggtgctaccgggtctggtaagagtgtgtttattaatagtttattagtatcgctactttacaaagcaacgcctgccgacttaaaattattattaatcgatcctaaggcagtcgaactggcaccttatgatggcattccacatttactttcaccagttatttctgatcctaaaggtgccgcagcggcattgcattggttaacagaggaaatggatcagcgttatgagaagctatcagccgcccgtgttaaaaacatcgaacaattcaatcaggaagcaattaagactaaacaatacggtttaaagatgccatatattctcgttattattgatgagttggcggatttgatgatggctgcttctagtgaagtggaggattatattgttcgaatcacccaaaaagctcgggcggcgggaattcatttgattgtcgcaacacaacggccaagtgttgacattgtaaccgggacaatcaaaaacaatattccaagtcggattgcctttatggtctccagtcaagtcgattcgagaactattttggattccgctggtgccgagcgtctgctcggcagaggggatatgctgtatctgggcaatggtgctaatcaacctaaacgattgcagggggcttttgtcaccaataatgagcttgaaggcgtgatcgattttgttcgtcagcaaggcacaccgcattacttgtttactcctgagtcattgaaaaaggccgaggtaaacaatcagtcccaggatcgattgatgccccagatattaaaatatattgcaaatgaagatacaatttcaacatctaagcttcaacgtgtattttcaatcgggtataatagagctgcaaacataattgacagcttgcaaaagcggcagctggtttcggaacaaaacggatcaaaaccaaggcaagtttattacaaccctgataaggagcaagattcggaagaataattagctgacagcaattaacaaaattaataagacgggacaggtaggatgaatatgaattcagacacgatatatcactttgtaggaataaaaggaactggcatgagtgcaatggcattgatcttgcacgatcgtggcgaaaaggttcaaggttcagacatcgagcagtatacatttacgcagcgcggcctggaacaagccggaatcaagatcttgccatttgatgctgataatatccatgaaggtttaacagttattgcaggaaattcgtttacggatgatcatccagaaattaaaaaagccagagaaatgggcttaacggtttatcgttatcatgaatttcttggcaaaatgattaagggaaagacaagcattggtgtttctggcgcccatggtaaaacaagcacaacggggttactttcacatgtcctttcgggaattgcaccaactgattatctaattggagatggctcaggtaaaggggttcccaacgctcggttcttcgtgtatgaagctgacgagtatcgccgtcatttcttggcaacgagacctgactatgccattatgacgaatattgattttgatcatcctgattattataagagtattgatgatgttcaaacagcttttcagacatttgccgatcaaacccaaaaagggattttcgcttggggggatgacaagcgcctgcgtcaattaaaagccaaagtgccaatctattattatggacttaatgatactgatgattttcaagcggttgatgttaaacggacaaccagtggctcgagttttcatgtcgtgtatcaaggcaaagaccttggtgaattctcagtaccattatttggtgaacataatatctttaattcattggcagttgttgcggtttcgtattttgaagacgttaatttggatgaaatccgaaaagagttaaaaacattccaaggcgttaagcgtcgtttttcagaacgtaaaattgataacatgacaatcattgatgattacgcgcatcatccaactgaaattaaggcaacaattgatgccgcccggcaagaatatcccaataaaaagattgccgtggttttccaaccacatacatttagccggacaattgcgttaatggacgattttgctaagagcttaaacttggctgatgaagtctttttgactcagatttatagttctcctagagaaagttcaggaaatgtttctagcgctgatctcgcaaagaaaattaccaagggcggccgaattctgtcagctgataatatgtcaccattgttggattacgacaatgacgtgattatttttatgggcgctggcgacattcaaaagtatgaaaagacctatgaggatttattgagtcatttaagtcgaaaagttaattaagatatcttaggaaagccattagttaagtgaatttgcttgattaatgacttttatttagttaaaattgtttaacaagaaataaaaagggagcggattcaatggataattatcctaatgaagaacgacgagttgttaataacgctgctggtctgaatgcttttcttactagaatgtatagttggatgagcttggctgttttaatatccgcagcaactgcatttttaattagtggttctggaattgcgatcacaagaggaatgatgtggggatcaatgattctctggtttgtcattccgtttgtcgtatcgtttcaagcactgaaaagaccaactctggcttttggggcgttaatgctatatgcaattttgagtggttttgtcttctcaattattgctaaggcgtacacgggagcctcgattgcctcagcctttgtttcagcgtcagcgatctttattacgatgaccgtttttggattagtcactcgaaagaatctggataaggttggtcgtcaagcagttgccgcattaattgcgttaatcgttgcgatgatcatcaattggttcttacgaagcccattaatttccttcgtcttttcaatcattgccgttcttatctttacggtgttgactgcttatgatacccaaaagatgaagcaaatgtataatcaatatgcgggaagtaatcaaatttcgatgaccggtttggctgtgtttggtgcattgcagttataccttgattttgttaacttgttcttacagttattacaaatctttggtagtggtgacaaccgttaaaattcaatcgttaatttatgaagagactcagacaaaagtaattttgttttagtctcttttttggttgttcgtcaactgttgttggtgaattcaaatattaaagttctaatcatttcgtgattagggcttttttagtatgaatgcgcaaaacgtagagcacacgggttcggaaacgaaaaaaac

SEQ ID NO: 659 - DNA, 166960 bp, Unknown
  Metagenome-assembled genome
tttgaccattatcgaactaggattcaaatggaattatttgcttaattcaattaatgcaaaagaaaaagcaaatcctttcggatttgctatataagctgatatcaacctcagttgacaaagagcctatctttgtctaaattaatcggccaatttccgtgccaacgcatagccaagcttctgcgcggtttgagccgttgggtgaatttcccgatcttccagcgtgacatctttattttcagaagtgataatgctgggtgcgaattgctgaaagtcaattaccgtggcgcctagtcgtcgatacatcaaggcttcctcgtgacgcaattgaccataggtgtattggctgtcattcataatgttttcccggttaaatccattagcggtataacgtgaaattggcaagacaccatagattttggcgtttggattcagcttttgaatatactgcacgttgcgttttagatgattaatcacgttctctaaactgcctgaattagaaaaattggtgtagtcattagtcccaatatgaatgaaaatcatgttcattttttgaatggcactcttgtgataacgaatctgcatggtgagatcttggggctttaatattggcccaacataagcaaatcggtggccaacaattttggcacttggcacggcttcattaataattcgattgtttgtccccaggtatttcgctaaccagtcaccgtaggcgttgtttaaataaaaatggtaaccatcccaaccagcgggaatcgaatcgccaaagaagccaattcgcttattggtaaattgattacctgccgccgctaatttaacgttaaatgacttgctgttaattgatttgactgatgaatgcagtgcccaataggtgtatttgccacttgcattggttaacttataagcgactgcaggtttgccttttaccaaaagtttagctgcctgactgcgataccaggtatcctttaacaatggcttggcactcattccttgggagagacgcgcatcagtatacaaagtagcattttttctcaaggcataggcatgagcgtggattgggtaggtcgcttggacactgactttggcactagttgatgtttttgatgaattggttgacgtgtctgccgtagaatgatcatcgattccaaatgcaactcctgccaaaatgaccgtggcaatgattaatttgatgtgtttatgaaaaaatgcaaacatattattctcctcagaaaagtgattatttaataaaagtcaattttaaattcaatttaattagtgataatgatttaggttgatttctagaacccttatgaccgggacagagggtgttttcgccttttgttttttgatcttaactttaccattatacacaaaaatagttgcttgtttataaagaatatcgataacctcataaaaaaatacgatgtgccgcccaaatccgtctgtggcttaggcttaacgccatgattacatttttgggaacgctttttggcagccttatctagcatttttaaacgttgcaacttatgatagtacttgaggtgattttatggatattaagaatataacacttgaccaagcaaaagggtcatctttagatatttatcaaagcaatacggatgttaaacttcccggaatcgtcgtcattggcggtggtagttataaaaagttaaaggaacgggatactgaacgggttgccataacgtttgcaactcaagccttccaagcttacgttgttaactatccggttgaggaaaagaaaaattatgcggatgcaaaagcagccattgaacagtcgtttgactacattgtcaaacacgcggatgaccttcaagttgacaccactgaattagggatcatcggtttttcagccgggggtcaattagccgcagattacggtaacgaaaaagatactaaagcaaaatttgtgatgttgggctacccagttattaaaccgacgttggatgaaaagatgggcattaaaagcttggatgtttcgaaaactgttacaccaaatacaccgccaactttcatgtggggttcgattaatgatggattgacgccgttcttagaccatgttcatgtttatgcggaagcactggctaagaatcaagtcccgtttgaagttcatgaatttgggacgggcaatcatggcatcgccttagccaacaagtggacagcaattgtgaaccgggatcggtctgataagcatatggccaactggttcgagttggggatagaatggttcaatgaagttgtcgcaaaataatttatgggtttaaaatgataatcgcaaaaaatagtttctacaaattagattagttttcagtatttgaccattttttttaaaactgttcagatgatcaattagccataatgatagctaaatcccgcaaggtgttggactttgcgggatttttgagtggcgcgctaataagtcaggtgaaactgttcaagaatctgttaacacatagtccttccattttggcattggttgatgattttgctttgattgacgaatatcagagtagtacttaaatttgcgttgaatgtgtttgcgattcttttccagtaatgcaagttggtcatcaacccgcttacagtgtttggctaacagtgcgaccatatcgtctaaatcgtcatcattatcttgaaaccggaaaaaattttggagttcagcaatcgacatcccggtttctttaaaacagatgatcgcatctaatcgatccagatttgcctgatcataaatccggtttttcccgttccgatcgacatcgcacagcaagccaacgtcttcatagtaacgaagcgttgacacgggtaggtggtatttctttgagacttgcgtaatggaataggttgccaatttaaattctccttaaataatactttacctcaagtgtacttgaggtgatatggttaatgcaagtgataaattaaaggagtgtttagaaatgaaataccgtcatttaggtaagcagggaattagggtcagcgagttggcattaggtagttggatgactgatgttagtgattcggccaaacaggatttagccgatcaaagcattaagttggcttatgaaaaaggcatcaactattttgactgtgctgatgcatatagtggtggcgcagctgaacgatttttgggcaaagctttaaaagaatttccgcgtcaagaacttgtcctgtccagcaaggtttattttccggttggtgatggggttaatgatcggggcttgtcccggaaacatatctttgagtcgattgatcggtcactgaaaaatatgcaaactgattatttggatttatacttctgccatcgatttgatcccgaaacaccacttgaagaaaccttacaggcgctgagtgatttagttgatcagggaaagatcctgtattatggggttagtgaatggacacctgttcaaattttagaagcccaattagtgattcaacaacgtggactacatccaatgtcggtgattcaaccggagtacaatatttttgatcggtatatcgaaaatgaagctttggatgtctgtgaaaagttgggtctaggggttgtgccgttttcgccattatcccaaggcctgttgaccggtaaatatcgtaagggtcagccgattccagctgggtcgcgagcaacgtatcaagatcagattcaggcgatgctgacggatgataacttggataaagttgaagcccttgtcaagatggcagatgaactcaacactgatttagccacgttctcactagcttgggcacttcgagattcacggatttcaagtttgatcacgggtgccagcaaaccggctcagttaaagaacaatttgaaggcaattgaattggagattccggctgagtatgatcagcggatcgacaaacttttccattttaagaaattccatcgacaaattggctaatcggaagttctttgattattaaacacaagtcattagtgaacgttttatatcacaagaataagggactcgggtgaatttcaccggggtcttttttccgtctaaaacatggttgatttatctgcatatcgatgagtgtgataggtcagggggcaaaattggattttatttcgaccattcaattttgagttaaattcaaagttaaacgagtgaattactgatcaaccaaacaattcttcgatgattttttgaaaatactaatgcaagaaccgatgtttagggctaagatgattagtgattttattatttgagtgtcacaaggttaaagcatcattttagaggggatgagaaaagtggacgcgacttacctgaaagatttatttggtcaatattctcaaaagaaggaattgctttaccaaacttggtttatccatagtgaggatcgtctaaaagcgtttaatcaggtacgcaagggcgttaaacaaattgttaaagatattcgaaatggcagttttccaagagatttgcgcggttcatcattggaaactgtgatgaatgtgatcattgcgcaacaggaaatcttcaagggggctaaacacgcttttatgtggaagcctaaattgcgtatccctgatatatatgaaaatcgggaaaatcagttagcctttgcggaaatgcttgatcagattgtggctaccagtcaagaaatgaaaatgttacttgcggttgataatctggcggagaaaaaaattaagggattgggtccagcagtcgcaaacatcttatattttttggagccaacgattttctgtccatttaatacaagcattgttcgtggatataacgagttaacccattccaaaattcgattaggtaaatggtctgactattttaagttacgagacggcattatcgagttaaacgaatctgggggggctgttttccaaggatttaggagcaatctcagctttcttatttgatgttggcaaactgaattatgtgacgccggagaatagcgagcagtatcttaaggtcaccgagagtaagaccgctgccaagcttaaaaataggcagacaaaagaagacgagaaaaaacttcattatcaaatccagtatgtgttggcagatattggtaacaatatcggttatcgatcctggattgcctcaaatgaccataacagaactgttgacggtaatcggctaggcaactattcacttccaagacttcctaaaacgatggatcagttgtcaccacatttgcatgaaacggtttcgttaatcgatgttatttggtttacgaaacagggggaacctatcgcgacctttgaggttgaaaaatcaacttcaattatgtcgggaatgaaccgcatggatgacctttatgagattaatcgaggtaacatgatgttatatattgtctcacctaataaacgtgaacaagaagtaagggctcagtttaatcgaccacattacatgcacaatcatgatttgcacgatcatattcgatatattttatttgcggatttaattaacagctatccgtcacttaagcggtttggccaagattattcaattttaggaccaatttcgcatttttcggacgggaaacttgttagataagtcgttacgtttttttgaaaagggcggcttcatcaattacgattttgtaatgtgatggagccgccttttagttttggtttacttactcaaataagcgtgcgttaaatcaatgggagttcctaagttgtgagtaacgatgccctttagttttggattaatcaagtagtcacttgaggattgatagagcgggacaacggcctgctgattactaaggagatatttctgagcttttaacaagtcgctccaccgagtattaaggttatttaaatcatgatactgaattttatttaaaagttgatcatagtacttatcattaaacttggcgtgattatgtgggaaggttgaataaaactgctgtagcatgctaaacggatcaatgtcaccggaccagccagcaagtgccatatcaaatttgtaagtcatcattttggtgaatctggtttgcgccggtaacgattgaagcgtaattttaacgcccgggagctttgattcaatttggctttgaacaaattcaccagtattcttggcctgtgccgtatcatccgtaagtagtgtaaaatgaaccgtttttttatggagctgctgttgtgctttgcgccaaagttgtttagcttctttggtgctatagggaagtaagttgccagcatcaacagccaaatcggttttatctttgggactctttgctaagccctttggaatcacacccgttgcagcgcgggaaccatccgaaagaacatcccctacgagttcttgacgattaagtgacagactgattgcttttcttaaattaacgttttgtaaatttttatttgagctggttccaaattccaggttggacatggatagcgttaagatggatttgaaatcaggattctttttgaactgtttgacaaagtagccggaaagaatggcattatcagctttcttggcttggaataatttgacaccggttgacggatcttttgatacttgaacattgattttgtccaagtggacatttttcttatcccagtagtaaggattcttgacgtagcgccaattcaagttggtgccgctccaccccttcatgataaatgggccgtcggcaactaatcgactactgctggtaccatattttttaccgtatttttcaactgtttttgcatcttgaggaaacaggttctctgaagctagggtctctttcaaataggggtcccgtcgttccaaagtcagttcaagtttggtattggaaagtgccttgacaccaagtgaattaactggttttttgcctaaattaattttttctgcgtttttaatatcgtaataaacattcgcgttttgggcagctgttttggggttgaatagtcgacgccatgcataaacaaagtcgtgagcggtcagcatactgccattagaccatttgagccccttcttcaggttaaccacatatttggtcttggctttgttcagcgcgattggattacccgctgccaatgctggttgggcatcatttttgccatcaattttatataggccctcaccgaagaaatcgatttgttcggtgctgacggtatcatattctttgactgaatccgcggttggcgtttcagccgaggtcaaccaagtaatttcctgtttttgatttaaacttgatttttgtgatcctttagcaccgcaggcggctagaaggcctgcaagaagtaggctactagaaatgaaaatcatttttttgattaagtgaattgtcatgataacgattgttcctctcaataaatgtattttttcccaacactgaatttgactcagttagccacatgaaaataataccgccacaatttgaataataatttgaaatattgaccaacaaaatcctcacctgctcttctttttggttataaaaaacgcccctgcaaaaatatgcagggacgtttatacacgtggtaccacccagatttgcggccacttattgaaaaagctggccacctcatcagctcatataaaaaataggttaagaaattatccataaaagtttaattatcaatttgataattaaagatctcgttaataatcacttatagccaattctttgttaagcctgagactgtaacgcgtcttcgcgtggatatcgcttgcacgtatccaatgctctgagttcatcttcgcggtcgttattcttattgactctcaacggatgtcaattctctgtaaaaaataagcgaccattactcttctcatctaagcaatctatgaatttgaatgacattataatatcacgattaagagattgttcaagtaataatttaatggcaaaacgatgtatctttaattaaatagtaattagaaactgccgtgatatttggcgattgatccttcaagatcagttaaaacatgctattatgaaaccatgttatttcacattagggaggattttatggattcgctaaagtcacatacactcaatgcattttcaaaaaatgttcacctgacgaagcaccaaaatgatgtgcttcaccagatcattgattttacgaagcaacatcttcaatctgacggtcacgcggtatttgtcttaatgggtgatgccggtaccggtaaaagtctcattttaaaccagctgttcacgaccctttctcaaaaggtgacggacgcgtatttcctggttaatcatcctgagttattaaaggtctaccgtgagttggcgggtcgaacccccaacatgttaaagaaatactatcaacggccaacgagcttcattaatcaattacataaacaggatcaacacgttaatttaaccgtgattgacgaagctcatttattgctgagcaaaccagatcattataataattattatggcgataatcagttgaccgatattattcaactgagtaaagtcacgatcgttgtttttgatccccaccaagtgctgcgaacaaaaagcttttggaataaatcacggttgctgaaattaattgacccgtatccacacgaggtggttcatttaaacgagcagtttcgaatgcaggctgggccgaagttaatggactggctggatcatttcattgatggtgatgttattgggccggttccccaagatgttggcaattatgattttcggattttttcggatgcacaacaaatgtttcagaaaatcgttcgaaaaaacaatcaatttggtttatctcgaatgacgtcgaccagtggctatccgtcaactttagacggtggtaaacatttggtaaatgaaggcaactttcaccaaccttgggatcagtataactttacaagtaagccatgggccgaacagtcacaaacgattgatcaagttggtagtatctacacggtgcagggattcgacttaaattacattggtattattattgggccgccattttatttaactgatgatcaccgcttgggtgttgatccaagcaaggtaactgatgtggaaatttttaaacatcgccctgatcttagcggcaaagacttcgagcaaagtaagcaaacgctgctgcgcaattcgctgaatgtgttgttaaggcggggaattaaggggatgtatctgcatgcccatgaccctaagctggaagcgtatttggaacaaatgaacaggcgttgataaagttaatttttgggcgtgggatggcacggttgattaatcgagttaatcacgaaattaaaatgttgacagaattcctcgtagcatatatagttaactacacaagtaattaactggaggaaaacatcatgagtaaaaagttaatcacggtgatgatgactgctttgattgtgattgtcgttggcggatcggtttaccattataagtatggtaaaacctattattatggggttgttggtaagatggaccattctgaagaccaggggaaagggttaccgacaagttattattataaaattaagggatataacaaaaatggtgaaaagaagcttttaactgttgggtcttttgccggccataaatttgttgaaggccggtttattaaagtgggctggtcacgtgctaaaaaggttaacgagtatgagcaggtaagtgctaatcaaattcctaaagaagcttgggcaaagttaaaatcggaagttcctcgagatcggtgaggatagtcgtcattaaccgtatgtgatgtaggttggcgttttttatcaaagagatgtgtcattaaaaagcaaacgagattgggccgggtgaatggttctcaatctcgtttgctttttgtcattgattcaagaattggcaggcattaaaatcgccattacgaccgccatccgctaaaattaatagtccaaatatattggttcgtttattaatcttcgctattctcaaaccgaaatactattgatagacgaaacataatatgcgtgttttgtttcaaatatagtcagtaacttgtaagaattgtcatcaccctgaaataattgtcattgattatatgaaaaattaaaaaaattgtttattgaatcggtagattgttgacctatcaaccaattggatctaaatgttgtgactgaatcagttaaagatgttgtttggaaaaaacagttatgattttttcttgaatacttttagaaacttcaatgaagcttgatatggcagcgcctttggtgtcacaaaagtgagtataatcaatcctattaacaagtacaatattggggaatttaagatggacaatagtgaattgatgttgtttttagaactggcttttatcaattacaacgaatttgcaattaagcattgtaagctttcattttttacccagacggttaattcggaaatcgttatttatagtgttcctgagtcaaaaacgtttcatatcccaagtgatttaccaaaaattcttcgatacgtaactcgacatgaggatgataacatttttacgatggatgtgattgatgacttatgggtattggtgcgaaagattcgaaaattgggattggccgattatccgcagaaagcagtgaattcaattaatatttccatcggaagtattttgtgttccgataatatggcttctgattcaaccaagtattatcgggtaattgggacgtcaaatgcaacagttgaattgattgagattaaaaatcgcaaggggcgccccgtgatatcaatgccaattggtcaatcttttcaagttaaggttgctcacaatgcgattattttggatgggcggctgctggtcaagtatgtacatcagcgataaaagtggatgctaaaaacgggtaccacgacaagactacgttgttgtggcacccgttttttgtttgtgtttactaactaacctgaagtatgctcggcacataactgaataggcttaatatcctaaaagtagaaatattgagtgggttctgggcaactgagctaaaatgtgcgccaagagactgatcccggccatataaccagcttttgccaatattccaaggacaggaatattgagtgggttctgcaaccgagccgaaatgtgcgccaagcagcagctcccggccatataaccaacattcgccaatattccaagaacaggaatattgagtgggttctgggcagctgagccgaaatgtgctccaagagactgatcccggccatataaccagcttttgccaatattccgaggacaagaatattggcaaaagctggttatatggccgggatcaaagcgtctctttccgcactctgctatataatcgacagcaaattattcagaaaatgcaaggcgattgaatacctgatatctctgaaatgcatataggtgaatgacaggaagcatcccaaggctgagtacattaaccaattagcgtcaaactgcagttcgtgggcaaaaccgaacaacaggccacttatcacaatcgccagaatattattcagccgattctccttattgaagaaataattcatgaaaattcctctgaaaatcaattcctcaaaaatgggagcaaggacaatcgcgaagataccattccacagcggcatttggacggtctccgaagcaactgccttctgattttcgggtaacactaaaatgtgttgcgagattaaccagctccaaaacatctggaaaatcatcataaatagtaggattaataaaaattgataaattaccttcctagtgacttttgttcggccgatgtttcttggattatgttttttcagttgttgaccatatcgccaagcaattaaagcaagcgctacggcggtcaatacaaaaccgattcctaaaacatggcgggccttcaagatgtcattggtgtaatcaccagccaaactaaagacggttgaggcaatcagataagccaataaaaagccgatccacgctgcaatttgaactgtttttgttttaagatacgatgtgatttgcatagattacctaaattcgttaacctcaattcgattcttatcaggatccaagatggtaattgagttaacgtttctccttacttctgttttttcggttggttcactaacaatatcgacgaaataattaattaagtgagctttgatatctttcatcgaatcatgggcaattaatccaaatgaagtggggtgctcaaccttatcttcaatatgaaaatccaaaaactgttttcgaaggtcggcgcctttatcgccatttggcaggtcaacaattcgtaagtcgaaaacttcgtggtagaagcgaaggctgacttccaggttggaaacagggatggtgatatattcgatctctctgatattcataaacgtgattcttctttccgttggaattgtaaaaagtagtacacccattataactcaatgattggaatcatcgcacactttgcgtaacgattaattgtgagaagttggtttgttaatttttgattgaactgttattaaagatcattttgccaagctaacaatcctcaagaaaattggtaacgcttttatatccgacccgcttgacggcacttgccaaaccgtgtaacgtaacacaatgtatgtagaaattcgaattgattaaggagtgaattttttgccattattatctgtttcaaatctttcaatgagctttgctgaaaaggatttgtacaaggatgctgaattcacgcttgaaaagggtgaacacatgggggttgtcggccaaaacggtgtcggtaaatcaacccttattaagatcattaccggaagcgaattgccactcgcaggagatgtgaaatggcaaaagaatatcaaaattggttatttggaccaatatgccgatattgaggaacacttaacgcttacccaattcttgcggacagcatttgccgatctgtacaaaaagaatgaacagctggccaaattatatgaagactatgcgactaacgcggatgacaagttactggaaagagccggtcaacttcaggacgaactggattccagtgatttttatgatgtcgatacgcgaattgagcaaaccattaccgggctggggcttgatagcattggccgtgatcatctggttggtgatatgtcaggtgggcaacgatctaaaattattttagctaaaatgctgttggctgacccagatgttattttacttgatgagccaaccaactatttggatacagcacaaattgattggttagttgattatttgaacgggttttccggttcagccctggtcgtttctcatgattacgattttttggagaagattaccaactgtatcattaatgttgcttttggtaagattactaaatatcgtgggagcttcaaacaggcaatgcggcaacgagctgaaagagaagagttccagcagcgggaatacgataagcaacaagtcgaaattgaaaaggctgaacgcttcattcgtaaaaacaaggccggctccaaatctacaatggccaaatcacgtgaaaagaagttggctcatatggataaaattgatccgccttcgactaatattcacgcgacctttaattttccgtatgcggatactggttctcacgaagcattaacagttgataaattgtcggttggatataataagccattgcttaagccagtgacgtttaccatttcgatgggtgaaaaatttggttttagcgggtttaacggtgttggtaagtcaactttgattaagacaattttaaaccaattgccggctaagggcggaactgctcatttttcaccatcggcagttattggttatttcagtcaggaactgacttgggatagcaatcgcatgacgccaatgcaaattatctctgacaaatttccgaagctcaatcaacgaacgattcggactaaactggctaaatgcggtttggattcagagaatgccatgaaaccgatcacccaactttctggcggtgaacaaaccaaggttaaattggcgatgatggaatttacaccatgtaatttcttaatcatggatgagccgacgaaccatttggatgaagaaaccaaggaagccttgaagaaggcattggatcgtttcccagggaatctcatcattgtcagccatgaatctagcttctatgaaggcttggttgataaggtattgaacgttgagaagttgagcttgaaagagcaaccaattattcgagaatagatcaacactgattaattagtactgaaagttattaagctttaacttcattaacgtttttacttgataatagtcatgattaaaaaaacggggccggacaaaagtaattttgtccggccccgttttttgtaatcactatgaatcgatctgcttgattagattgaccatgtgagtagtggttgccctggatatgcgaatttaatgatgtggaaaatttattaacaatgtggcgttcaaatatggtctgaaaggcgctttcatttgaaacctaccagataaaatttctcaagcaatgttactattgatagtaataactaatatacgaggcgatacaatggatgataccaagcaacgaattacatacaatatgcaaattatcaaaagttggcagcagggattaaaaatttcatatcgaaaagttgaagcgatcaccggcattacatctgatcaatatagcgagtatgaaaggggaaatggtgatccaaacgttttggatgttgcgaccgataagctaagacggtttgcgtttaaacaaacgatgcccaatttggatatgcggtcggcatatttactgaatggcattaagtttgaaattaaggatttgagattgccagccaggaaggtgtcggaaatatcaggtgtcccaatggatcagtatcacgattttcttaacggcaatctggatgctggcgtatacgaggatgccttcgaccggctgggtgtgtattattatttgcagagtgtttcaaaaagcgattaaattccagaatataagcggcttaatcctaaatgcccgcatttggcatttaggattaagccgcttatatggccggaatttgctttttgaaacacgttttggcagcgccaaaccaagtgcaaccgaggatttgcccgaatttggcatttaggattaagccgtttatatggccgggatttgctttttgaaacacgttttggcagcgccaaaccaagtgcaaccgaggatttgcccgcatttggcatttagggttaagccgcttatatggccgggatttgctttttgaaacacgttttggcagcgccaaatccaagaccgaagaatgatcgaactcattatttaggttgctaattaatcaaaaagaacgtgcggcttcagcaaggttacccttgtgagtgaagtcgcacgtttttttgagttgttgagacgggaaataatctgttaaatcattatttattgaatgtcccatcttcaacctgacggataaaggttgccaaatgatcgtaataaacgtctggattatcaatcatatgatggtgaccgccgtttggtgttgagacaaattgagcgttgggaatcatttcggccatccgtttaccggtttcaaccggcatggtttcatgttcgccaaaagtaacgagcgttgggactttaatgtccttcaggtggtcggtgaagttccattcggccagtttaccagtaacaacaaattcgttgtctccttggaaggcaccgtaaatatcagtattggtaacgctaattaagtgatccaacttagatggttgttttcgatcaatatagcccttatttaaaatatctacgtatgcttgatatttatcattatcgtaatcacccttggcttcgcattctttcatgtaggccacttggtcgggagataacgccttgtcacggacctggttgagatgtttggtgtaatcgtcaatgcgatcaaccatcgatgaaatgatggcaccctttaaatgtttgccatatttggcagcgtattcttgaacgagtaggccaccccatgattgaccgatcaaatagaaattatcgagacccaatttatcacggacctcatcaacttcatccaagaagtaatcgtagttcaaaatatcttttcgaacttgcggatcgctgaaatcaggactgtcggaataccatgaacccagttgatcatacatggtcacctgaacgtttaacccttgctttttaagttgttgagcagcgtcttcccagtattcatgttcaccaccaggaccaccatgtaaggctaatagatgaatatcgccttcaccttgcgtgttggtccataaatgataaccgttgtccaaagtaatgatcttggttcctgttcgcatatcaatcaccttttctattagatttataattaatgataacactttttagtcatcattttggttaggctttcaaaaccggcaggacaatcttggagtcgtttagattcagtgtgtaagtgatgtcttgattgccccggatggtgtaatccatgtcagttgcgtaaatcacaattccaagttggtgaccggctaataggcgccagaaagttggctgaaatgccaaatcaaatgagtaggcctgtcctggttggacatcgtcggtttgatagctgttgtgccggttttgcaaattaatgtgcccatcggtaaatttcttgtaagtggtggttttcttttgtgggatgaattctttaagatcatcttttcgccagttatacgcggtaatgatttgttgcggttctaggacttgggggcgagcggttagtcggtttgccttgccatagtcaactaaggcaacactgatgaggcccacgttatcactgctggtaacgtttaaatgaatgtgggcttcaccgtcaacgatcaggtcttcctttagtggttcggaaaccaatttgatacagtgattatccatctttgaatgcgatttggtaaagagcgcgtgccgccatttggtagtatcagccacgtattctttaaataaatcatcagttaaatgatcattgaaggaacggttttcgcgtaagttcgtaaagcggctgtcacttaacgttacggtttggacggttgcgtcgctgccccaatctttgtaggtatgccatgtttcggcttcggcattatcttgaaccaacacgtcgggcacaacttggttggcgttgttgttaactgtcaataatttattggataaccataaattaacgatatcggtaaaatcaacagaacggaagttattcaggtattcatgttgcccttgatgcaggactaatttttgagtaattgcttctttttttaatcgattacgtaaattataaacgtgggataatttgacgttccagtcgttcaagccgtgaaccagcagcatatcggctttgatattcacagactttaagagattccggtcatcccagaacgtggtgtagctccctgaacgccgatcctgaccatctgtgagtttcttcaactgtgtcaaccaagtatctttgatcttcaagtaatcggcagcagattgttggcggctaaaggttaactcacccaacacatcggtatcttcgccttgaaagccgcctggagcaactactaagccattttcgcgatagtaattatagtagttggagatcccagcttccacaacggcagttttcaagccgtcaactccagttagggcggcagctgtagagagggttcccaagtaagaacggccggtcatcccaacgtttcctgtggaccaccaagcatcgataccgatattatcagttcggttggtgaaggcttggcgatcgccatgcaaccattcaataattgatgtcgcactaaccgtctcggctggacttccagtggttcggacgccatcagaatccctggtgccgactcctgctgaataaacaacggcgaacccacgggctaagaagtaatcatttaaagtgtaagtccagttcttaacaaaggtttcttcggctacttcggcagtgtcagcaacttggcgtggcgctggcaaatccggcttggtttcatcaaccttgacatcgtcataagtcagatcgttgggtgctttacgcacgagtggtttgttgacatcatgggttaattgatcagcggccttatcgttagttccctgatcataaggactagcggtgaagatgacaggaactttaaggccgtcttcagtttctgccggtcggataatttctgctttcagtaaatctcggtgaccatcatggtctgtgtccagtggtgcttccacgtaaacaacgtctcggattaatttgctggtgtcaaaaactgcttgcgctttaccattaaagacgagtggctgcttgagtgagtcatcggcaagaaattgatgatagtaaccctgaccagccagaaagtcaattaacgtttgaccatattttgtccgtgtattgagcaggcgataccaggcatcaatcacttggtcacggctcaactggtcatcaacatcggcaatgggcagtttaagtgcattcattgttgttagcggatcggttaatttaaaatcaagatcgacttcaaaacccagcagctgtaaagcaacgttataaaaggcagttttagaaactttgctttcggttgtggtgtattgataggcattttcatcaggagttgccattaaatttgaaactttttggattcgggtcgataagctctgagtttcgataaaaaattttaacaagaattgccgatagagcatgacagcatctgccattttggaagtcttcgctgttaagaaatggacatctgccaattctttaacaatctgatgatggtcagttgggacgtacgcaaattgattgattttcatataaatgagatcctttctaatttgaagttaagtgtttcgataggtgaccgatctgcctgaatcttgatgaccaccttatcatcagttgcacacattaatacaaattttaccatgcttaagcggttctaacgatctttaatgagaagtttgaggattcttttcatattcaccattcaatttggtaagataattattacaagattgaatgtttcgacaaataaaggggatttcttatgaattatattggtcaaattgcacttattttaatattgacgctgctggctggcgcgattagtcagcgggtaggcatgccggcggtgattggtcaactattagtgggcgtgcttttaggcccaggtctccttggtattttgcaaaatacagctttaatgcatgccggttcagaaattggcgtgattattctaatgtttattgcgggcattgagagtgatttggacctattaagaaaatactttaaacctgccatcagtgtggcggcaattggtgttttatttccaatggttgcctttacggtatatggtcagtggctcggccaatcgtttgaaaaagcaattttctggggcgttatttttgcggctacgtctgtttcaattagtgtggaagtccttagagagttcaagcggctaaatacaaaagagggtgccacaattttgggtgcggcggttgtcgatgacattattgcggtgattttgctaagtatttttgtaagttcgtttggcgtgggggaagcaggaaaaactaatttggttgtcacaaccggatatcaattcatttatttcgtgttagtgattgccgttgttaagtggggcgctccggttctcttaaagctggcggagcggttgccggttcatggatcagttgccattacgtcactctttttatgtctgtcaatggcttggctggctgatgcaaccggattgagtgcggttgttggtgccttcttcgctggggtggccgtttctcaaactgagttccagtctgaagtttcaactagtgtcagctcagtgggttatacgttttttatcccgattttctttgtaagcattggcttggatatgacttttggtggtatcatcaaaaactttggctttattgtgattatgacgggcttggcgatcgttaccaagttggtcggcggtgcaattggcgcgcgtttgacgaatctgaactggcacagtgccatcgcaattggttcaggaatggtttcccggggcgaaatggcactgattattgcccaaattggtttgggggcgcatttaatggcgactaacttgtattcagagattattattgtcattgtattatcgacgattgtggcgccactgctgctgaagtggtcattgggacatgtgccggccaaatcataggtcctttatctaaatatggtctgattggaaactgattttataagtttgtagttggactttttttgtttgtttatcgtcctaaatgatagaatagaaagcaatcaagaattaagatgaaaataattgaggaggaactcaagatgatcactgagtatgcaagtggggcggttgtttataatgttcaggatggtgaaatttgttacctattattacaaagcgcgactgacgacttttggggactgccaaaaggtcatgttgaagctaatgagaatctaattcaaacagcggttcgggaaattcgcgaagaaaccagcttaaagactgacatcgattcgaattttaaagaaaagattgaatatgacatgaaaaatgggcatcacaaagatgtcaccttctttgttagtaaggttgctccggatgtgaaagtaacgcgtcaagttgaagaaattaattcttttggctggttcgattaccaacaggcttacgataagttaacctataacaatttaaagcaattattaaagaatgctgatgaatatattcgcaataaagagggaattggggattaagcgatggaaaatcgagtgtttgtcattactggggcggccggcagcggcaagaccacagttcgaaattatttgcatgatcactttaatatgaccaaggtcatcacgcacacaacgcggccgccacgttcaaacgagcgcaatggggttgattattattttgaaacccggctgtcctttgccaagaatcattatctagagtcggttgaatacgccggcaatctttacggttcctcttacgaaggactacaaaatgcttggaagcagaccccgtttgcctgtattgttttggacacagctggggccattacttatcaacagaaattaggcacgaaagcggtcattattttccttaaagtcggtgacactcaggaacttcaagaacggatgatggttcgaggagacgataccgcgatggttgccaaacgggttaaaagtccggaataccatcgtgatctagaaatgccagctgcgcttaaaggtaaggcgttcgagattgttaatcaaaacctcgctgcaaccaaaaaacgggttgatcggatcgtgacaacttatttaaattaaggcaaccattggaatcgttgttgaatggttgaatatgtgatagactaactctaatagtaatgattactctataaataagttaactgataggtatttaaactaagaggtggatgttatgcctgcagcaattgaagaagcaacccgggtattaaaaagtaataattttaaaatcacgaagcaacggacggcaatgctggaatttttagttaatacggcaaccaaacgatttgttgaagtgaccagtattgacaatttcatgcgtcaaactttccccaaaatgagccataatacgatttatcgaaacatttccgaattcgccaatcttggaattgtcgaaagacaggttcaaggcgatcgggcttccgtaaaatttcagtgtgattttcaacatgaacatcaccatcattttatttgtagtaactgtggtaaggtcattgaattaaaagactgtccattaagtgaggaaatcacatcgcaattggatggttgcaaagtcacgggtcatctctttcagatctatggtctttgtccacagtgtgccagtttaacgaataattaaccaaaagtttacggatagtttaactaaaatgtgcgataatatagattaccaaattttagttaaggaagttttttgaatggataatagaattccgccattaataacgccatttgcaattttatcaatttcattagcgcttggggctacaaatgtcgtggtaaacaaggttacatcgactaatgaaggaacgcctaccaccactcaaaccactaatcaaaagaacgtttcaaattcgatttttggtaagtcaaagcctaagacaactaatgataaagataaaaatgaatcaagtgacgatgccaagacatcttctgaaaaggcgaaagaatcgtcgttaaaaaagaaggaagctgaagcatcctcacgtaaaaaagcttcatctgagaaggcttcttcaagtgccgataattcgtcagatgatacagcggactcaactgaaagttccaccaaaactacaggtaataccacaactggaacgactaagaaatcaactggaaccaagaagtcaacgaatacaggtaataccggtacaaccaagaagtcgacgaataacgataatactgcaacgacgggtaatactaacgataacactgatacttcgcaggataatacgggtgatacagggactcaaaataatactggtaatactacgaccgggacgaataaatcaacaacgaccactggcggcggtactacgggtacaaatgatgggacaacgacccaaggcactgatggggggacaaattaataatgtttagtttcttagatatgattaatcactacctcggttatttcaatattggtgtcacggttaaaagtcgaatttatactgttttgggcgcattaggtgatatgtatttgttctatatcagcttacgtttcttgaaaaacgggatttacaaacagggaattttaatcctggcagtcgcaattattttgctgtactttacaatttgtaatattttttactacttcactaaacgccaaccgtggtttgatatttctccacagttagctaaatggttgcatttagggcatcatccacaagaaacccaggttaattcaaaaatgggaacgaccgtgattcctgaaggtcggcaaaccaatattccggctaacggtgtttttgataactctcatgttttaccggcaaaggtttcaaccactgaagcagagcaggcaaatgtagatcgattagttgcgttgatgaagcaggctcaactgtttcgaaccgattacaacgggatgggtgatcgaaaaatttacgaattactaaaagttgacggtaaaccagtttatgcaattggcaagggtgtcatgttgccttattttgatatgcgtaagcagggaaatgcgttgattatttacggcgggctgaatcaagcagaaatctatccaattggagaaatcaagcgagtcggcttgcaagctgttcgttccattgatttatcggatttaaaattgtatttggcatcggttacgattgtcggcgggccatataaagagattggtcgcgcaggtgtgatcgaacaccctcaagaatataaattacgagctagcgtggcatataagaagactgatgcacttaggtagtgttaaggacacgaaaccagttaagggccgtattggctcttggctggtttttcttttgaccaacgtttaaagactgggacaattttccggatataagaaattgtttggggatcgtttggattggcgtggaaattttagaatgatggtgttttgaaaatgggtgggtgatttggtgaaatcgtgtttgagttccccgaccctatttggtgaattgctgtttaattgtgtagtgcgatgttttggactactgagcagaaaacgtgtgtaggcagacaactcccagaatataaggttagggtagcttttattttggactaccgagccaaaacgtgtgtggacaagcagcttccggccatataaggtgagatggttgctgattattacatagtgcgatgttttaggctgccgagcagaaacgtgtgcaagcagacaactcccagaatataaggttggggtagcttttattttggactaccgagccaaaacgtgtgtggacaagcagcttccggccatataaggcactttaaccgatattccaaaaccaagaatatcggttaaagtaccttatattctggaagctaagcgcttgttcacacactctttccacaaattctctttgctttcccctaaatgtgaattataattagatattcaagttaaagtattcggatattctaattaattaacgcctggcctaaaccactcttttcagctagtttgggccagttttgaactttatgcctatattggcagaagatgtgacacgggtatcaaatttttgttacaattttttgacctacggcgttttttaacataatatggatacaagaacattcttaggcaattttaataatgagcctaaaggtattggaggaaaatgacatggcaatgatcgaatttcaagatgtacaaaagtactacggcagtttccatgctttaaaagatattaatttgaagattgaggcgggggaaaccgttgttttaatcggaccttccggatctggtaagtcaacgttaattcgcactgttaatgggcttgaaagaatccaagagggtaagttgattgttaacggccaggatttggcagatcggaagaccgacatgaaccgaatccgaaaaaatgttggcatggtgttccaacactttaacttgtatgcaaataagacaattttggaaaatatcatgttggcacctcgaattgtgcttcatcgacctgaggaagaaaataagaaggttgccaggcagttgttggaccaagttgggcttgaaagtcaggcaaacaaatatccggcacaattatccggtggtcagcaacaacgaatcgcgattgcgcgttcattagcaatgaagcccaagtgtcttttgtttgatgaaccaaccagtgcgttggatcctgaaatgatcgatgatgttttgaacgttatgaaagatatcgccaacgattcagacatgaccatgttggttgtaacccatgaaatgggatttgcacgtgaagttgccaaccgggttattttcatggatgatgggcagattctggaagatgatagtagtgagaaattctttgatggtgaaccctccaatgaacgtgcacgtcaatttcttggcaaaattatcacgcattaaaaataagtttatcgggaggtttcatcatgaagaggatcttttcaaagattgggttattaattgccctagccgtgatgattgtttcgctgggtgcatgtagcagcagtggatcaaaaaaggatgtgttacgcgacgaccggcaatccaagaccattacttggggagtaaaagctgatacgaagctgtttggtctaatggatgttaaggataaccagattaaggggtttgaaattgatttagccaaagcaatgactaagcagattcttggcaaggatggcaaggcacggtttattcaagtaacgagtcaaacccgaatgccgttgcttcgaaacggaaatattgatgccattatggcaaccatgacaattacgccacaacgagctgagcaggttgatttttcacgatcatactttgatgccggtcaagcaattctagttaagaatggcagcctaatcaaaaatgttcgtgacttgaatcataagggtgacgtggtcttaggcgttgttggttccaattcggttcaaaacattaagaaattcgcgccaaaggctaaagtccttcaactaactgattattctcaagctttaacagccttaaagtctggccaaggccaagcgttgacaactgataacggtattttatacgggatgtcaattgaaaatcccggttattcagttgttggtgggacgtttactaaggaaccatatggaattgccgttgataaaggtcaaggtaagttccgtgatgcgctgaatcaagcgttaaccaaggttgaaaactctggtcagtacaataaattattgtacaagtggttccacaaggttaaaggatttgactttaagggggctgaacgatgattagtatttttcaaaattatggtggcgagctcctttatggcttaggtcagactcttctgtgcagtattatcgcattgatctttgcattaattattggttctggatttgcgattatggaagttatgcctaacaaatttgcaagagtcgttgccaaagcatatattgaactttttcgaaatattccacttttggttattacgatgttcttctacgttgttattccaatgtatattgttgaaattagtgggttcgcggccggaacagttggcctgattctctattcatcagcgtttatcgctgagacggtgcggtccggtattcaatcagttgatcccggtcaaatggaaggatcccgggctaatggattgtcgttctggcaagcaatgcgctatattgttttaccacaagccttccgttatgtcattccaccattaggcaaccaatttatcaacttggttaaaaattcatcggttctagcctttgttgccggctttgatctgatgtatcaaggaaacgttattgcatctgattcgttgcaaagtatgagtacctacttgtgtgtcggtgttttatacctgattctaactttgccgctcagttattacatgcgttatcttgaaaagaaattggcataaagggggaactaaactatgttgcatctatttgatatgtttaatgtattaggcgcatattcatgggtcaatatccggttccttcttgaaggggcttgggtaacggttgttgtatcggttctttcaatcattctgagttatattttcggcttgattttgggagtcattcggtacgttcaaattaaatatgtatctgcggttgtcgggtttgtgattgatattatccggaacctaccgctaattttaattatcttctttacgtattttggattgccacaaattgggtttaaaccagcgccaatttgggcatccgtaattgcgatggcaatctttgaatcggcaatggtcgctgaaattgttcgggctgggattgtttcaattccaactgggcaaatggaaggggccagagccaatggattgtcgtattggcaggcactccggtttattatcctgccacaggccgttaaaaacatgattccagccattgtgagtcagtttatttcactggtaaaggatacctcgttggcaaccattattgtcttgccggatctgatgaatcatgcccagatcatttatggtcaaaatacgaattacacgattccgatgttcttggcactagccgttatgtacttcattgtttgttattcgctgtcgttgctttcagaatatctggatcaccgaatggggcagagtaacagtaagaaggctaagcaggctgaagaagtggcagaatcagctgaacggtaagcaaataactattagcaaaaatgattttataaattaataagccagtcaaatgtcttcattttaggcatttgactggcttatttatatgatggtattttgatatgctattgaaaaaatcagttatgtgtttggtactttcgccgatacatcaacacaggaatcaggttggtgatgatgacggctataataatcaagccaacaccgatgacttgagtatctgacaccgtttctgctaataagaagagagcaaaaatgactgaagacggtaattctaatgatgagataatcggcccaatgccaatggcgaggtggggcatgaagtaggaaaagctggttagtggaaaaatcattgcaaaaactgatgtaatgccaccccattttagtgagatgatcaagctttgaggttcaaacaaggtatgtccccagatcatgataattagcaatagcgccccaaagctcattaatcgggccttcgttaatggatgtaaatcctgaccaatgccacccgtgaactggatggttaatgcataggccaacgcggccagaaagctaaagcttagcccaatcagtgaaactgcttggtgaattggaaaaagaccggttgccaagacggttccaactaaaacaattccaatactgaatacttgaagcagagacggccaacgtcgatgaaggacactggaaataataatggctaaccagacggactgcatcatcataacggcggctacagcaaccggcacgtatgaaagtgagagcagatagaatgtattggtgaagcccatggaactgccagagagaatgaccagccatttttctcgtttatcagggacgttttgtttggctggtttaagaaacgcactggccacgacaaagaaaaaccaggcgatcaaaaaggtgagacatagtagcataccatcgtgaacgccttgagcgcgggccattttgaagagtgacccggggataccgtagctgattgcaccaagcgcaacaaaaattgcggcgtattttttcaaatgatcacctcatgtcaatttatctccagaaaaacagccatgcaattaactaaaacgttaaaatgatggctgatatttttgggtttgaatatgaaattgtaaaagattgtaacgccactaaatgagtttaccaccaaggcttttaatcagccagcaatgattaaaagctcaatcgataacttcaatatgggtaatatccttgaatttagccatatccttgataaacgaatcgggatttcgtggcttttttaatcttaaacgaacttccagcgaaaaggagtccggattataagttaaaatccgcatttgagtgttgatgcttcctaagtcttggaggcggatcggaagtttatcaatgtcctttaattttccggtaacggtgatttgtaatctaagaagtgaacggttgggataccgtttcaaagcccgaattcggcgaacaatggtttgagtgatgaggatgcacaatgtcccggcgattccgatgataaacatatcagcaccaatcgccaatccaatggcagccgtggaccataggccggcagctgtcgttaaaccatcaattttgtggttacgggtcatgatggcaccagcaccgataaatccaattccggtaacaacgccagccgcgattcgtgaagggtcaagcccaatatcagagcgagtcgtcacgtcgaaaaagccatattttgagatgatcataaataaagctgagccgacagccaccaacatatgggttcgaatgccagccgtctttaggcgggcttttcgttcaaaaccgaccatgccgccacaaatagccgcaacgaacaaacggagaacccattccatttggtagagccaatagtccatgcaatcaccttcctcttaatgttggttaccgccattataacgcgttcggccgggtggttacgaaaatgagctacggataggcgacgagaaactcgtttcccatctcaggttcatctaatattagtcgtgattgcacaacaggagaggttgggataatagtcattttacccagtctcagttagtgtaaacacgattgttatcaagcaaaaatgcgggacaaagggcagcttccggccgtgtaaccgaattatccaaatattcaaaaccggaaatatcttattgaacttgttgcatagtagaaaacatggcccagcaagcaggctccggccatataagccctctaacttaatattccaaaaccgggaataccttgttgaggcttgttgcatagtaaaaacgtggcccagcaagcagattccggccatataagccccctaacttgatattccaaaaccgggaataccaagttagggggcttatattctgggatctaaccgcttgctgggccactcttgctatttaaaaacgtaaaccttactttcatacggtcggagtgttgtaccctgatcatcctcgtaattaccgattaggcgctcagttgcgtttgcttgatcgtagtcgcgggtcacagtttgatcggtaaagttgctaaggactagtaatgtctggccttcgtagtgacgacgataagcaaatacctcggcatcttgcggatcgatttcctcataggtcccataacggattaattcggaatcgtgacgcagagcaatcagcttttggtagtaataaaagactgattcaggatcttcaagttcaccggcgacgttaattgcagtgtaatttgggtttaatgcgaaccaaggtttgaccttggagaaaccggcattttccttggcatcccattgcattggtgtccgggcgttatcacgggagacgtttgctagatacttcagcattgtcttaccatcgacaaatttattttcatcgactaattcgtgatagctgttgatcgattccaagtcttcatactgatctaggcttgtgtagtgaacgttggtcataccgagttcttcaccttcatagacataaggagttccctgcatcatgtgaagggtagttccgagcattttagctgcccggacccgatatttaggatcgtcgttggcaaagcgggaaacagcccgtggctgatcgtgattgttccagtaaagactgttccaaccctgaccatccaattcaacttgccaacgagatagtgcccgctttaaatcagtaagtttaactggggcatcgttccattttccgagacgcttatcaggatttgaactcaatgaaacatgttcaaattggaagaccatgtttaattcattgctctttagccctgtatattcaatcgcatcttcaggtttggaactcggcatttcacccactgtcatcacatcatagtgggaaaggactttgtcgttcatctcatgcaaataatcgttaagctttggtccgtcagcaaccatcttttcaacagtcgcgtagttggcaggagctggggcatctggtaacccagctggtttggaaatcagattaatgacgtccattctgaaaccgtcaacgcctttgtccaaccagaaacgcattaagctccaaatggattctcgaacgtcggggttctcccagttcaaatcaggttggccgggtgcaaataaatgtaagtagtattggccacgttcaggaacataggtccatgcagaaccgccaaaagcagctccccagttgttaggttcatgaccatcaaccggatcacgccagatatagtagtcggcatattgattatcctgtgattttttactttcctggaaccatctgtgttgatcggaagtatggttaacaaccaagtccatcaataatttgatgccacttttgtgtgtcgcttcaagcaattgatcgaaatcggccattgtgccatacattgggttaatagcttcataatcagcaatatcataaccattgtctttattaggggactcgtaaattgggtttaaccaaatgacatcaacgcctaatttcttcaaataaggaagtcgttgtttgattcctggtaaatcaccaatgccatcattgttgctgtcttgaaaactcattggataaatttgataaacgactgaatcttgccaccatttgtgtgtcatgttaattgaacctccatttttattttaaattaatttagtttactttgttgctgtttttgccgagtaggctgggtgaatgacgctgacggctaaggcgccgataaacatcatgattccggcaattacaatcataccaggcattgatttgccgattaatgggaagattgcgaagctggcaactgacgcgataatttgtggtaagcagataccgcagttgaataatcccagataagcaccttcgttttcaccgtgaagtgattcagtaaatagtgagagggcttcagtctgcatggtcagataactgataccaatcaaagcaaacggcacgatgagcaacatttgtgaatgaacgaagaagacccaaaccataccggcaccacccatgattaaaccaattctgaaccagaacttacgttgagtgggctttgtgtgtgatagaaccatgaagccccagataacggcagctaatgattcaacacaggttaaaatgccaaaccagtttccggcagcctgataaccggcagatgctggattacttgtattccaaacgtttttggcaattgcaccggttccgtatgtccagatatattggaatgcgaaccagtcgaataattgaacaaatgatacttcccagaaggaacgaggagctgttttaactaagtgccaaagactcggttgcttttctttctttttatcttctggaatcccatgataacgggcataagtcattggatcgtactctttaactgaccagattgtgtagagtgatgtcaataataggacaccagcaccaatgtaaaaggccatcttaactgacagcggtacttcacctttaggggcaacattagaaacaccaatccaggttaacagaaatggaaagatggttgcaagcacgccaccaaggtttgaaaatgattgttgccaagaccatgctttgtctttttggctctcgttaaccatatcaccgataatcatcttgaatggctgcatgcagacgtttgatgagagatccatgaagagaatcgtaattgcaccaaacattagtgctgccaatgaggcgtacccaaagccgaatgaaccggcattgggtaacagaatcatgacaagtgcagcaattggtgcaccaatcattaagtaaggcatccgtcggccaaatcgattccaagtttggtctgaatattttccaattaaaggctgaacgaccattcccgcaagtggcggaagaataaagaagaatcccagtttagttgggtcagcaccaatggtctgaaaaattcgtcccatttgtgaggattggagtgagaaggccatattgacaccgaagaaaccaaatgtcattgcgaatatggtgcttaattttaatgttggtaatcctttatgttgcgttttagtttcagattgggcagaggctgtgttggcggccttaccaatttgttctttagcaatcatgaaaattcctccctagtaaatggttcttataaatgattgaacgtcgaaggttcgttgatcagtgtgttggcctggctgaaatcaaacatgttaattgagctgggacaatctaatgaagaaacaatctccttcaaacaattctaaaaacaactttgaacgaatgattcctaacaacttggccaattcatgaattgctagaaaacggtttcattcatttctacagtgatgataatatcatcaattgcaatcgcttgcaactcttttatatcaataacacaaacgtttgtggaaatatataagtttattgtggtaagataagagccgaagtgtccgagattacgggaaaggaagcggttatcatgggagccacaattaaggatattgctgagttagcgggggtgtcaccggcaactgtttcgcgtgtcttatccggacaaagcgatttttattcagaaaagaccgccagaagggttcatcgggcggctaaaaaacttggatatcagaagaatacaagtgcagttgaactggttaccaagaccagcaaaaccattgccgtgattgtgagttcaacccaaacgaattttgcggatcagatcattgatggcattcaggagcaagccatgcaaaaagatttgaatgtgatcattttgtatgctggcgaaaagaatgccaaattacagaagcgagcccttgaaaccgtaattgaacggtctgttctaggaattttattggtagcaattgatttggatcccagcaacgataatttgctaaggttggcgaatattccatttttatttctatcgatttgttttcgcaaccatcgctttccatttatttcatcggatgatttcaaaattggttatcaagcaacaacttatctaattgagaaaggtcacgtcaaaattggctttgcggcagctgatttggaatcgtttaccggccagttaaggttagcggggtatcggcgtgcgatggatgaataccaacttcccacaagccctgattgggtcagtgatggcgattttgcgtatgaagatggcgtattggcaatgaaacaatatggtgaagagactcagctaacggcagtaattgcctcaagtgacttggcagcaattgggatccttaatcaagctcaggcctttaatgttaaggtaccaaacgatctatcagtggtcagcatcgatggcacttatttgtgtaacattgtccgaccgagaataacaagtgtcacgcagtcgtttcgagaaatgggcatcaagggaatgcagacgctgttaggggggaagctggatcagtttgacttgctgtatacgggaattgggattacagagagggagagtgtgaaaagaagcggttaactcccagaatataagctccctaacgtcatattctggacttggaatatgacgttagggagcttatatggccgggagttgcttctctttcacacgtttcaactcggaggcctaaaccaaccacaatattcccgattttggaatattggtttgagtggcttatacgaccggaagctgtggcacttttgcacgtttcagctcggaggcccaaaccaacatcaatattcccggtttaggaatgtgggttaaaaagggatggttgaatcgggaagggttatcacgtaaacgttcattataaatagcactcacgtttagcaaaaaaacgaaatgaccttattaaaaacacggttgtggcagtaaatcataaagggatagtatccttggagatagcaaaaaaccagtcaagactgattgaagtcagtcactaacgggttttgtttaagaaatattgactttattttgttacgttggggggtgaatgctaattgatgcactcagatttagttttgactctttactgaattatcttgatcatcttcgtcgattggggcatcttcatttttaatgtcgacaataccgtttttcttaacttcataatagaaaacggggacgccgacagcaacaaagataaatgatgtgaggacacccggcaagtctgacatgatttcactaccaatgacaaatagtgaaccaaaaattgcgacaatcggtgtgaatgggaataatggtgttgagaaaacgcgctttgtgttgggattccgtttccgaagaaggaaaacacctacaaatgccattacgtagaagcaataaacggtaaagatacataattctgacaaccgatcagcgtttgaaaagataatcataatggcgacgatgattaattcggcaatggttgaaaagattggggtatgcgattttggatgtaagtaagctaacgtttttgaaaatggcagctgcttacgtttagccattgcgtacataattcgtgggaaggtcataattttaccattcatacaaccgacaattgaaataataattccgatactgaggatcttaccgccaatctctccgaaagcttgattggcgagataagggatcgctccggtacctaatttatgaatttgttcagcagggacggcacggtaaacaccgtatgaaaccaacatataaatgattaaaacagctaaaattccaaatgtgattgcttggggaagccgtttacgcggattcttaatttcgcctcccagattggcaactaaaatccagccatcgaacgcaaataaggttgctaaaatagcaacaccaaagttgccggctgattgatgaacttcagaaatgctttggccaaaggcacttttgttaccaaaaaagaggccaaaaataatcaaggcggcgaccggaactaatttacaaactgtggtaataatggcaaacgttgcgccgtagcgattagagaatagatttaaaatgccgactaaaatgatggtgccaatggcaattaatgcattatatttgcttgggaagccaaaaaaatcagaaagtaaaattgctaaataagctcctagtgaagcaatcatggccgggccataaatgatgatctgcatccagccggataagaaaccccagacttttccgtagatcttttccatataaacgtacaagccgccggtctctggcatttgcgatgcgatttcagcgatcgtcaagccggcagtgatggtcaaaataccacccgccaaccatgcaagtaaccccattgtggttgagccggcatcatccaagacggctgattggcgaacaaagacaccagcaccgataatcgttccgattactagcgataacgctgaccagaggccaaggtcccggtcaagcgacacttccttttgctgtttcataacgaatttcttcctctctgttattaacgattagtgattagtcggttgttaaaacgtacttagcaaaccgttttgcatcaacatcttttagctccgctttgatgactgtcccatcatcacggtagtcagtttttaaaatattagtgttgtcatttaaataggaaacgacgtcgcccttatcaaacggaattaataacgacaaggtctgataatctttaaaaatcttttccttaatcatggtggttaattcttttagtgagtcctcatcgtttgctgacatgatgaggttatctccctcacgattaggatattgaacttctaatttgtcagctttgtttaaagcaacgatcattggtacgttggtgatgccgatttcggctaatgtttcttcagttgtcttcatcatcaactcacggtggggatcggaataatcaaccacttgaatcagtaaatcggcactggcagcctcagccaacgttgacttgaaggcttgaaccaattggtggggtaactggctgacgaaaccaaccgtatcactcaataaaaaccgtttttgatctggtaaggtcagctttcttacggaggtgtccaaagtcgcaaataacatatttttgaccatcacttgtttatcctcgttttcaccatataagttaatcatgccgttcatgacggttgacttgcccgcgttagtgtaaccgaccagggcaaccgttggcgtttcgctgcggtcacgctgtttgcgtttggttaaatcagctttggaagattctttcaattctgcgttaacgtgggtgatccgtttctccagtgttcgtcggtttaattcatattgtgattcaccggcaccacggttggtgaagccgccgccactactagtaccggtttgctgatcaagccgttgactggcgctggtgtgcagacgggggagctggtactttagcttggctaattcaacttgcaatttagcttcccgggactgtgcccggttggcaaaaatttcaagaatcaagccagttcggtcaataatccgggcctttgtattcttttcaatatttcgaatttggctgggtgataattcatcatttgccacaatggtgttaacaccatcatcgatgaccacttgggttaactcttcgatttttcccttaccaaaataagtagctgggtctggcttatccaatttttgaaccaagctttcaacgaccttcatattatttgcttcaactaggttgtttaattcggtcattgaatagtcaaagctgtttgaatttcgatttaggccaatcgtaacgactggtgttaagttatctgttaagtccatgaagtcctcctaagaatttttctgttcaagtataacacacaagtgtaagaaaatcgtagacaaatcacttttgttacgtttctgtgataataaggctagtagagtcgtatgattggatctattaaccttattatgaaacgggatcgtatttttgtgtttagcacgagttttgcgagatgcagttgttgatgcttctttgatgttgcttaaaatgattctcatagtgaatctaggatttgggacaatgatgattaataatcaggctgttactttatcaaaacccaaggttaacttcaaatattttgtcatggatgatggttaattgtaaaacgtaactgatctatttggtgattaaaaaattcaacctattataggatgtccgaattcaacctaatttttgcggtcaaagtgagttgttggagaagtttagcctcattttttcttaatcgattggtggcttgtttacggcatgcgcacaagtaattatgatgaatttaaaatagaatctttggaatgcattacaaattcatgttgcgtttaatcgaattttcatttaaaatttaaacttgttcattaatcaaagacataatcgaagggatgtattttttatgaagctaggttcatttgcaaagattagcgggattgctgcactttcggcgttaattcttgctggttgtggtcagtcatcagcaactaaaagcggcaagaatgagttgacatgggttcaaagtagtaacatgccaacaatggatttatcaaaagcaactgatcaaatttccggtcaaaccttaaatggttctaatgaaggactactgaggatggcagagaataatgaggttgttccgggagtggccaagagttacacgatctctaaagatgggaaaacgtggacatttaatttacgacattctaaatggaatgatgggactgccgtaacagctaaggattttgtttattcgtggcggcgaaccttggatcctaaaacagcatcacaatatgcttacatctttgaccatgttgccaatgcaactaaagttaatgaaggtaaattgccgttatccaagttaggggttaaggcggacggtaattacaaactggttgtcacgttggctcgaccacaaagttattttaaatacctcgttgcccagtcgtatttcttcccacaaaaggaatcagtcgttaaaaaagacggtggcaaatatgggacgaccagcaaggacatgatttataatggaccttttaaattaacgggatggactggaaccaatgatacttggagtctggttaaaaataagcattactggaatgccaagaaggtcaccctggataagattaagttccaggttgccaaagacccggccactgctttgaatcagtatcaaagcggtaaagtgcaagtaacaccactggttggtcaacaagttaagcagtataagactaataaagactttgtgttacgaaagaacgcggcaaccttctatttggagatgaatcagaagaaatacgccttctttagaaatcggaacattcgtaaagcaatttctttaacgatcaatcgccaacaattaaccgataaagtcctcgctgacggttcggttccggcaaagggattggttgccgccaatatgtcactacataatggtaaggattttgctgaccaagcagaagttaaaggtgcgacatctcaaaatttggtggaagctaaaaagttatgggcgaagggattaaaagaaactggtaagaagtcagtttcctttaacctaatggccgatgatactgaagctggtaagcgaacaactgaatttgtccaaagtcaactgacaaagctgcccggttttaaagtaaccaatcaaaacctaccatataagacacgactacaacgatcggccgatggtcagtttgacatggtagtgaccgcttggattgccgatttcccagatccaatcacattcttatcgttgttgacatctgataactcatacaacaatggaaaatggcagaatgcccaatatgataagttggttgctgatgctgagggtaaggatgccaataatgctaataagcgttgggatgacatggtgaaggcagaaaaggtattggcaaacgatgagggaattgtgccgctataccaacaagcaaccccacaactggttaaatccggtattaaaggaattcagtatttcccaacggcgccaatttgggactggagcaaagtaacagtcaaatgagttttaaacatagataagtaaatagatgaaggctgaggcgatttttcatttgcctcggcctttttggcgtttgcgaacactgtttcatctgctcgaaataagaaagcagtctaacctaagatgtgatcagagtggcggcacgctttttgcattttatctctaaatgatgtatattttcacctataaaaaaattgtggacaatcttattttgttaaccgaatatgtgaacagaatgttaacaagtgatttaaacgattttttcgaaggaggattattctcttgatgagtttttattgttaaaatgagatcggtgatttgtatgatcattaatacgaaaagggcatctaaactaagtgcgactagcaatgaaggtttcacagatcaagcatctaatcataacgaaaagattaaaaattaaaaaaagttaatcatcgcattgcttttaatcaaattttaatttaaaatagatgcattacaaaattagttaagaaaatttggaagggaagtatcgcaatatgaaattaaattcattcgcgaaactaagtggggtagcgctattatcagcgttagttctcgcgggatgtgggagcaaatcctcatccacaggtactaagaaacaaacgttaaattggatggttccagcaagtatttcaaccatggacacatcaaagatgactgatctttattcatctcaggttgccaatgcgactaatgaaggactgcttcggatggggaacaataaagttactcctggagttgctaaaagttataagatttctaacggtggtaaaacttggacattcaatttgcgtcattctaagtggaatgatgggaaaccagtcacagcaaaagattttgtttttgcatggcaacgaacagttagtcctaagaccgcttcacaatatgcatacatatttggtaacgttaaaaatgctacccaaattacagcaggcaaggtatcaccttctaaactaggcgttaaagctaatggtaattacaagttggttgttactttgaacaagcctcaaagcttctttaagtacatggttgcccaaggatattacttcccacaagaaaaatctattgttcaaaagtatggttcgggatacgcaacaaatgcgaccaaaaatggctataatggtccttaccttcttaaagggtggaacgggactaatgatactttcaaattagttaagaatccgaagtattggaatgccaagaatgttaagctaacaactattaatttccaggcgattaaagacgcttcgacatccttaaatagttatcaaagcaataaacttgattttacaactttaaacggaacgcaagccaaacaatataagaccaacaaggattaccatgattatcttgaagcctcgacattctaccttgaaatgaatgaaaagaaagatccgatgctcaagaataaaaacattcgtcgagcaatctcactcgccattgataaaaaacaatttgtcgacaaggtgttaggtgatgggtcaattgcacccaagggttatgtgccatctaagatgtctgcccgaaatgggaaagactttgctgattcctcatatgtaaaggatgcagttgcatataatttatctcaagctaagaaatactgggctaagggattaaaggagaccggtaagaagtcggtttcttggaatctgctctctgatgatactgatggatctaagaagaacactgaatttattcaaagccagttgaccaaattaccaggtttaaagattaccaatcaaaacattccatttaagtcccgcttgtcgcgttcacagaatgggcaatttgatcttgttattactgcatggattgctgattatccagatccttcgaacttcttggacctctttacgtcaacaaactcacaaaataatggtaagtggaagaatgctcaatacgatgccttgattaagaagtctgaaagtaccgatgctaacaacgaagctgctcgttggaacgatatggttaaggccgaaaagattttaatgaatgaccaaggaattgtgccattattccagcaagctcaatcaactttgatgcgatctaaagtcaaaggtgttcagttcttcccaacatctccacaatggggctgggataaagcttcaattaagtagtcaaaatgtagtatcataagttaacagttcgatgcaattgaggctggtgattgtgtgtccagtctcttttacattatttggacttattagaaatagttactaagataattagaaatgagaggaatttctatggcaaagtacttggcgaaaagaatattctacattattctgaccttgtttattgttacgacagctaccttctttctgatgaaatttatgcccggaacgccgttgactaaccaagctaaattaacgccaggccagattcatcagatttataagcaatatggactggataaaccactttggcagcagtatttggtttatctgggcggggttgttcatggtaattttggaacatccttccagtttagtaaccaaccagtttcgtacctgattggcagtcgaatgggaccttcactgactattggtggtgaagcaatggttgttggtgtattggcaggcttagttgttggagcaattggtgctattaaagcgaacacttgggttgatacgacagcaacaatcatttcaatcttgggtgtttcaattccatcatttgttttggctgtcttgcttcaatattatttaggattaaaactaagatggttcccaattgctgactggggtggcttcatgtataccgtcctgccaaccttggcgctggccgcgtcgccattagctgaaaccgcgcgattcatgcgaacgcaaatggtggatgtgttaagttccgattatattgaacttgccaaggctaaaggaatgggtaaagttggcattatttatcatcatgctctccgaaatagtttgattccggttgtaaccattgttggcccgttggccgttggaattatgaccggatcaatggttgttgaaaacatcttttcgatcccaggaattggtgagcaatttgtgaagtcagttctgacgaacgattatccaacgattatgggactaacaattgtttattgtgcgatgctttgtgttgtgctgctgatcactgatatcgtttacggcatcattgatccacgaattagaattaataagtaggagggactatataataatggcagataatgcaaaacatatctcagctggcgattttaagccaatttctgctgaagatcgcggaaatttagatagtgaaaaaatttcggcgccctcattaactttcttacaagattcgtggcgtcgattcagaaaaaataaagcagcaatgattgcattgattattttgatcattttgttcattttggcatttggttccaatctctttgaaactcatgcgcctaatgcaaccaatccgaatttagctaatttaccaccaaagatccctggtattgatatcaatggctttaacgggacacttgatcagtccggtcaacggattaatgcttatgcgcaagctcatgccggatctaagtacttcattttaggaactgattatttaggtcgtgatttattttcccggatcctttatggaacccggatttcattaacaattgcgttggttgccagtttctttgatttggcagttggggttgtttatggtgtgatttccggctggattggtggctgggttgatactttcatgcaacgaatcattgaaattttgctgtcgattcctaacttggttgttattattttgttgatggtgattttgaaacccggaatggaatcaattattattgcgatcgcattaactagttggattaacatggcccgactgattcgagcgcaaacgctggaattaaagaaccaagagtttgtgttagccgcgagaacgttgggtgagagttcgattaaaattggatttaaacacttattgcccaacttgagcagtattattatcattaatttgatgtttacgattccaacggctattttctttgaggccttcctatcgtatattggaattggtgtttcggcaccacaagcttcacttggtacgttaattaatgatggacaaaagaacttccaattcttgccatatcaaatgtggtatccagcaattgtcttgtccttattaatgattgcatttaacatcttgggtgatggtatgcgtgatgcctttgacccaaagagtagagagtaggtgatttgagatggaaaacgcgaatgatattcttgaggtccgaaatctcaaaatcaacttcaaaacttatgccggtactgtcaaagccattcgagatattagttttgatctgcgaaaaggggaaactcttgcaatcgttggtgaatccggttctggcaaatcggttaccacgcgaagtattatgggattaaatgcagaaaatgcggtcattgacggcggcacgattatgtataaaggccaagatttgttaaagaaaacccgtaaacaaatggatcaaattcgtggccgtgacattgctgaaatctttcaggatccaatgacgtctctggatccgacaatgaagattggtaagcaaattgctgaaccactgattattcataaagggatgaaacgtgaaaaagcatatgcccaagccttggaaatgatgaaactggttggtattgataatgctaaagaacggattaacgattaccctcaccaattttcaggcggaatgcgtcaacgaattgtgattgcgattgcgttggtcaattatccagaaattctaattgctgatgagccaaccactgccttggatgtgacaattcaagctcagatccttgatttgatgaaagaattacaggcgaagaccaatacctccattattttcattacccatgatttgggcgttgtggctggaatggctgatcgggttgctgttatgtatgctggtaaaatcgttgaatatgggactgttgatgaaatcttttacaatcctaagcatccatatacttggggcttgcttaattcaatgccaacaatggatacatcaggaactgaattgccttcaattcccgggacaccccctgatttgcttgatccgcccaagggtgatgcctttgcagcccgaaatcaatatgcgctggaaattgatacgaagcagcaaccaccgttcttcaaagtttcggatacgcactatgctgcaacttggcttttggatccaagagctcctaaagtaacaccacctgatccgattattgaacgtcaaaagcattatgcgcaattaacgcatgaagcgattgataaaagtcgtggcaaacacattgaagaacaggaggagcaactgtgattgactattcagacgaaaataaaattttacaggttgaacatctaaaacagtattttaatgttggtaaaccagatgaagttaaagcggttgatgatatttcgtttgatgtttatcgtggtgaaacgtttgggttggttggtgaatccggttctggtaaaacaacgaccggtcgggcaatcatccatttatatgagccaacttctggtaaaatcgtttttgacggtcaagatgtttcaaagctaagaaccaagcagcagaagaaacacttccgtcgtgaaatgcagatgatcttccaagatccatatgcttcgttgaacccacgaatgaaggttaaggatattgttgctgaagggattgacattaatcatttggcaaaggatgatgccgatcgatccaagcaggttgaagatttgctcgagaccgttggtttaaaccgagaccattccagccgatacccacatgaattttcaggtggtcagcggcaacgaatcggaattgccagagcgttagccgttcaaccgcagtttattattgctgatgagccaatttctgctttggatgtttcaattcaagctcaagttgtcaacttgttaaagaagttgcagcgagaacgtaatttgacctatctctttattgcccatgacctttcgatggttaagtatattagtgatcgaattggcgttatgcattacggcagaatgttggagattgcaacttccgatgaaatatacgcccatccattgcatgattacactgctagtcttttgtcggctgtcccagttcccgaccctgagtatgaacgggcccgaactcagattccatatgatgccagccaagaatttgacggtaaggatcgtaagttagtcgaaattgcgcctcatcactggattagagcaagtgaagacgaaattccaatgtataagaagcgtttaaccgaaccttcacgattacaaaaatagctactaaaaaagtcgttgtccagatttgtggataacgacttttttagtagctacttttagcgttgaagattgtgattatagttgattaccaacattgttaaaatattcaactgatagttgtttgccatcccagttaacttttgtgacactgccgttttttgttgaaacgtcaacgggaatatcactccatttgctcacaacgtttcggattaatgtcccatgggtagccagcaagattttatcgccgtctttagcgtcttggatgacttggtcaattcccggctgcaggcgcgcccagaaagtgtcactactttcagcatcaccataaggatcacccttagcgatcatgtcttcggccttgtcgataccaaattcagcgattagaccatggaatgagttgatgccaattgggccgccaattgtgtgccatgttttcacgtcatcttcaccttcgtaatagccaaaattcaattcacgaaaggctgcggtagcaattgtggtcgttaacgttgacgggttttctttcaaaatcaattcgccggtttgaatggctcgcggcgcatcactactatatgccgcgtcgaaatgaatttgactaagtcgtttacccgcgtccactgcatcagcgattcctttgtcagttaacggagagtccgcccatccttggattcggtgatatttatttaaatatgtttgaccatggcgaacaaaataaagtgaaattgtcatctgaaatcctcctaaatatagtgactatttggaatattcatcatctcgtcatttaggttgagatgatggtttattgaaatagtcataagtatacatttacttaaaacatctaaattatatcatacgttataaggattaataaaaccgtaccaatcacaaaatgatttttgcaatctatttacaaagttgtcatcgagaatttacattaatccgtcagaataaaaagcagctgattatgattgtaaattatcttataatgagtaactaattacaactttaatgaaggtgaataatgatgacagaaatgatttatatgtttcatgggtacacatcctttggtacggatcattggtttccgtggcttgaaagggaagttgaacaaaaattaaagataccgtttaagaaactgaattttcctgattccaatcacccggatgtccaggcttgggatcaatattgcgacaggacaattgaggctaaagatgggatgaccttgattggtcgtagtctgggttgcattcaggtgctccattacttagctaaacaggatgttaaaaatgttaatgtattactggtttcgggctttgacgaaccgatttggacactccccgaactggattccttcacagaacatcccgttgattatacccaaattttgccaaagattaaccaagtgacggtgatttccgcgttaaatgatcccagtgtgccatatccctacacgttaacattggccaggcatctgcatgccaaatttgtcttgatgccaacggggcaccactttacggataacggtaaggataaacagttacccattgcatttaaggagttaaagacgttactcgattaacgcttgattgtggcttatagatgattaatgaatttgcaatggcagtttacgaccgatgcgcctttctcccacattcattaacgatcaatacttatttttcaagttaccggaccatttccaattcgtgacctctggcatatctgtcccataacggcggataaagccatgatgtttggctaacatttgatccatattaccaactaaattactggcttcgttgaccaacttgtggtccttttctgccaagtgaccccagttacctggatctgatggaatgcgtgaaaaatgtctataatgttcaatgatggataagtcacgtcaccatttgtttcaacaaagtgaggatgccaatctgtgcctctgaaatagtcagtaagggtttgatcattccttattagatattaagaatctaatattctgcagtataaaggccagcgagtggaaacgtgcgatcaccagcagctcccgtccatataagtgtccctaactaaatattcaagcccggaatatttgaggaatgtttaggcagccaagctgaaacgtgatccaagcagcaacttccggccatataacctctcctaatcaaatattaaagcccaaatattcgattaggagaggttatattctggaagttacccgctgcttggatcactctgctataaatctttgaattcattagataaatatgataaactagttagtcaaattgctaggggaggcatattatggcagataatattaaacaacaagaacaacaacacttagacggcgtcatttacaagattaaagtcgccgagactagtcttgaaaagaagattaaatcaactaaaaaagacgtcaaagacatttacgccaactttaacaatgatgttcgacttaaaacttcaacttacagcggcatgatggataccgcgatgtcgattcgacaacaacaacagatgctttctgaacgtgaaaaccgccaagaacatgctgcccgcgaacttgggacgcttaacaaacttgaaggtaatccatactttgctcggattgactttcatgaaactggtgagaaacgttccgaaacgatttacatcgggatggcgtcatttaccgataaacccgaccattatttaatttatgattggcgggctccgatttccagcatttattacaatggtgggattggggatgtcacctacatgacacctgatggtgaacaaaccgttaacgttaaattaaagcgacaatttcaaattgaaaattcaaaaattaagacagtctttgacaccgaagaagttgtcggtgatcagatgcttctcgatgcgttgagtaatcgttctgatactaagatgaagagtatcgtgacgaccattcaaaaggaacaaaaccagattatccgggacacaaattcagaattactatttgttcaaggtgctgccggatccggtaaaacggcggcggttttgcaacgggtcgcctatttactttatcaataccgtggtaatcttcattctggtcagattattttgttctcacctaatcaattgtttaatgattacattaatcaggtgctacctgaattgggtgaacaaaacatggtccagatgacgttttatcaatatagttcgtatcgattgccaagtttgaaagttgaaacactggcgcaacgatttgatgaacaaattgaggaacgcgctcaaaaaattaatgatatcaaaggtagcttggattactttaaagcggtcagcgcctatgctaatcatttgaacaaagaagacatgcggtttagaaacttgatgttcaacgggtcagtgatgttccccaaagaaaaagtcgaagaaatctactatagttttaatgagaactataatttacgaaatcggctggatgcgactaaggaaaagttgctgaaaatgttaaaccgaaagattcacgttgaaatgcggaagaaatgggttgaagacgccgtgcagaccttatcacgagaagaaattcaacagatgcatcaaaaaggtgaacaagaggaaattctggattctgacaaggaatttaagttcttagcgcgacaaattgtggtgaaggctttcagtaagctgcatcggcaaattatccgtaaccatttcttgagtatcaacaatcaatttgttcatatgctgcggagttgtccgcaaattgttgatttaggccactatggtcttgatgaaacgcagtggaaggaagatattaaggcaacggttggtcgcttgaaacaggggcggctatcattggctgatgcatcggcctatctttatctttatgatctgatgacgggtaaacggggcgataaggatattcgttacctatttatcgatgaagttcaagattattcagcctttcagctcgcctttttgaaatttagttttccacgagctaaatttactctgctgggtgatctgaatcaagccatttttactcatgaaaatagccgcaagttgctggatgaattaagtaccatgttcccagctgataagacgcgggttgttcaattaaccaagtcatatcgttcaactgaacaaattactaactttaccaagcacttattaaccaatggtgaggaaattgtgccgtttaatcgggaaggcgaattaccccatatttatgttgaagacggggtagacgcagccgttgaaaccgtcaagagacaggctgagattaacttgaacgatcacgaaacaacggcaattattggtaagacgttgaaagagtgtgagatgttaactaataaattagccgagacgggtgttcgggcgaccttgattaggactgagaatcaacggttggttaagggaattattgtcgtaccatcctaccttgccaaaggattggaatttgatagtgtcattatgtgggatgcgtcaagtgattgttacggtgatgaacgtgaccgacaattggtttacaccatttgtacccgagccatgcatcggttgacaattattgctactcacgacttgtcaccattgtttgatcgagttcctgaaagtgaatatataatggagaagtcgacggctcggtcgtagcgtggtgaaatcgacataagccttgtttcacatgtaatagaaaccgtcattatgtacgacgacgccttgtaacatcaattttaaaaggacaacactaatatcaaaagtcggggcagttaaattctgttccggcttttttgtgaatgtgttttagcagaagttccaacctcgttgacatgttataatgaaacgatataagaacattcggagattaagcagatatggatgatttaattaattattactcatttaccaagtctgagtggaaacacttttatgatgaaaatgaacgtaatttgccactgacccctagtgagttgaagcacatcaaggcttttaacgaccaaatttcaattgaagatgttgccgatatttacaaaccgttggtgcacatgattcggctgcagaaaaataactttgataagtggcagacaactaaagcccgctttttacataagcgggtgcggacggtaccgtttattattgggatttccggtagcgtggcggttggtaaatcgaccactgcccgagtcctggaagaactactcaacaactatttcaccggtgagcacgtgaagctgattaccaccgatggttttttgtattccaacgctgagttgagaaaacggggaatttacgataaaaaagggtttccggaaagttacgatatgcgtcagttgattacctttttgaacgaggttaaagccggggtgccggttacgaagtcgccagtctactcacaccaaagttacgacattattcccaatcgttttgaattggtcgaccgtcccgatgttttaatcgtcgagggaatcaataccctgcaattgccaagcaatgaacaaatttacattagtgactttaccgatttttcgatttacatggatgcagatgaaaagttaattgagaaatggtatttggatcgatttggtcgtctaatggataccgcgtttcaggatccggataattattactatgattatgcgattggtgaccgccaggaagcctttaagatggcacggcgggtgtgggatacgattgacctgccgaacctcaaggcaaatattctcccaacccggtcgcgagctgatatgataatgcacaagaccgaacatcatattattgatcgattgtaccttaggaaatattgaatgtttggattttcaaaataaagttgaccaaacgggttctaatcgtttattatttatgtagcatttaagacgcaactttgaaagggtggaagaattggcaaacgtggacttatcaagcttcgataagattttagtgctcgatttcggtagtcaatacaaccaattgattacaagacgaattcgtgatttaggcgtatattcagagcttaaatcacattcattgtccgcaaatgagatcaaagcaatgcatcccaagggaattatcttttccgggggtccaaatagtgtgtacgatgatggcgcactaaaggttgatccagatatttttaagttaggcattccaattttaggaatttgttacggcatgcagattatggcatacacgcttgctggcggtgaagttgaaaaggccgacgatgctgagtatggtcatgctgacatcgagattacttctgatgatgcggttctgttcgaagggacacccaagaagcaaaccgtttggatgagccacggtgatttagtaaccaaagtgccagatggttttaagacggttgcaaccagtcagaactgcccaatttctgccatgcaggatgttgaacggaacttttatggcattcaatttcatgctgaagttcgtaatacccagcatggaaatgaaattttaaaaaactttgcatttaacgtttgtcatgcagaagctaactggacgatgaatgatttcatcgatttgcagattgaacatatccgcaaagaagttggcgataagaaggtcttacttggcctttccggtggggttgattcatccgttgtcggcgtgctgttacacaaagcaattggtaagcagctaaccagtatttttgttgatcatggtttgttgagaaaaaatgaagctgatcaggttatggacagcttggttgggaagtttggtttaaacgtggtcaaagttgacgcgcaggaccgattcttatccaagcttaagggtgtcacagatcctgaaaagaaacgaaagattatcggtaaagaatttatcgaagtctttaatgatgaagccagaaaactaaacggcattgaatttttagcccaaggaacgttatacactgacgttgttgaaagtgggacggataccgcccaaacgattaagtcacaccataacgtgggtggccttcccgaagacatgaaattcaagttgatcgagccgttgaacaagcttttcaaagacgaagcacgtgagattggtgaaaaattagggatgcccgattcattggtttggcgtcaaccattcccaggccctggtttaggaattcgagtgctcggtgaagtgacacctaacaagatccggatcgttcgtgatagtgatgcaatcttacgggatgaaattgctaaagcgggtctgcaacgcaaagtttggcaatactttactgtattaccaggtttcaagagtgttggtgttatgggtgacggtcgaacttatgattataccgttgccatccgagccgttaattcagttgacgggatgactgccgactttgcccggttaccatgggaagtcttgcaaaaaatctcgacacggattgtaaacgaagttgatggggttaatcgaatcgtgtatgacgttacgagcaagccgccttcgactattgagtgggagtaaggatctgcttactatttgagaataagtcatatagtattaaggtgttcagtattctaagtctcacttgaaataatttaacaatgagttattaggacacaaagtcctaagaagctagaatatccaaggaaaccgagattatttctcgacttctttggatatttttattttatgtggcatagaaaaaatatctttggtattcttaaaacggtggtgctcaaaaaataagtatacagaagaatgttctgtggcaatttatattcttttacggaggaaaaatgaaaataaaatcaaccagacgatcagttttggcaatggacaaagaggatgcaaaggcatttttcctaaaaccaactagttatgtgaccactgttttaccagaatattttgatttttccaaggtacttaaatatgctactgatcaattgtctcatagtacattgaatggaataagcgtaaataagaattcactatctcatgcttctaatacgaattacacccttctaataaataaagacggtcggtatgattggagacccattgaaattgtacatcccatattatatgttgacctcgttaactgtctaattgaaaaatgggatgtaattaaagctagatttaaagagtttagagaagaccctcgaattacatgtataagtattcctgtaaaatcagaaagtaaacagaatgatcaagcagaaactattatgaactggtgggagaatttggaacagcgttcaataaaatatgccttaacatatagctattgtataaaaactgatataactaattgctatgggtctatttatactcactctatttcatgggcacttcatggtgttccgtggtcaaaagagcatagaaaatattcggacggcattggaaatatgatagaccataaaatacaaaatatgcaatacggccaaactaacggaattccacaaggaggcgtgttattcgactttattgcagaaattgtattgggatatgctgatttgagactttcagaacaactaagtgaagacgatgagtttaaagtaattcgttatcgagatgattatcgaattttcgccaactcaaaagatactgctgagaaggttattaaaactctttcagatgtgcttgctcaattgaatatgcattttaattcaaagaaaacgggaatagtaacggacattgttggaacagcggtgaaaccagataaaattttttggactaaggttcagccaattatatcaactaagttacagggaaaaatccaatatcatttaagtattcaaaaacatttgtggcaaatttatgaattgtcaaagaaatatcctaattctggaagtataaaaaaagcgcttaaagatttcttaattcgtattcaaaagttggataaaatgccaagtgattgtccacaagtaattagtattatttccagtgttattgtgaattctcccaactctatacccttctgtgttgcgattataagcttaatatttaataaacttagcaataccgataatttaatgccatttgttggtgatattattaagcgtttaaaaatagttcctaatactggctttattgaaatatggttacaaagacttagcatactaattgacaaaaactataattatggagatccgctatgtcaaaaagtgttttctaacgtaaatatttggaattctgaatggttaaatacacctcttgatgaatcatctatagtagattatcaggtaatagatcaaatgaaattagtcattccgcaaaatactatcgatatattttctgaatacccataattgaatataaatattttatgaacctaacaccatatattgtcatagattttatagaagacgaggggaaattctactacaggtaatgattgattccacggcttccggaaatcatcgcttttggagcgacgattgaagaagcaatgactgatttggaaggcgccaaagagatttggcttaaaaagtgtcttcaggatggcattcggataccagaaccgataaatgaaatatagccgtggcactattttcaaccgaaattaatgtgtcaccagtcatcccggaatttcgaatcgacaccaaggacttaacaatggctaagaaaaaatctgataaataacaacagtaagttttatcaagagtaatttaatgatcgaaaatttcgaaataaaggattttttacatgacagataaactttcaaaccgtttacgacgattgttaacagccactattttgggtgggaatcccaatcatccattagctggctggtcaattttaacgattttgcggcacaacacgcaaaatattgattcaccattaacgccggattttttactgcagcatttcaacatggcctatttggaaccaaatgaagcgccattgaccaatgaagtttttaagagaattcttgatcgactggtaagtgcaaatttaattgagcgtagtagtcataaagtacgtgaacagatgcataacggcactcgacatatcaagcaaaccaaagtctatcggattggggcaactggcctgtcgtttatgaatggcatgcagaaagccgccgatgcgcaggtacttgcgacagcaaacgtcaatcgaattgatgaatatgttcaattggttggtgaaatttttcggcaggttaatggaactgaaaccagtaagttgttcaaccgttttgaagagatgattgatgcttctcaggatgttttgagagggatgcacaaactagatgcagatttatcggacttggcagatgatatttcgtttaaccacggcagtgataaagccgaattgttacaacagctgttaaagcagcgggcaattccggctttttctaaaatgatcaggaccagtaacttagttcaggcgatggtgctggatgacaaatatgccgatcaaattgccaggagtaagcaagggcgagacagtttggatttaagcaatctactatctgatcagaagaaactcatgctcgattatcatgcaaccaaacggactattcaatctggtttgagccagttgaacaatagtttggaaacgacaaccagtgccattgataacagtgttgattctgtctacatgctctaccacacgattgagcaaaccattgatttattgatccgtgaatatgagcacagtcaccagcagcaattagatttaaggaaaatggtcgatcagcttgatgacctgctggctcattacccaacaattcactttcctcatgctttgccaaatcatttagcagatgaccgtggcgatgaagaaacagacaatctattggatgcttctctgctgatgccggttaattatgtgattgataattcaacccgtgaggtcgctaccgaagctgataatcctgaaattggggttgatacttacgaaaattcggattggcagcaggggctacgtgaattcaaacaggttatgaaacccgatgcgactggccaagccatggttaatgatgatctggaattttcaagtcaattagcaagggatgaggtcgcccgactttacacggcaaccgcctattcgaaatttacgagctttgcaccgtttggccgtcaagtaactgccgcatgggcactgcctaatactggtcgggttcgactgcattgccggagtgaaaagttcagcgtctatttgcccagcggatttgcaatcaagtttgccgaaacccgctaagaaggagtgaaatcgatgatcgaattagataataccgatcgatatattgtgaatcagttgattgatcgggaactgttcacagctattcccggtcccaaagcaaccaagcttcaaataaacgcggttcatacctttcagaacggttataaacaacggcgagtggccaacttttttcaaacacttattgggacatccccattaaattttggcaataatctggtgttaatgattggccccaatgagcttgatgatcaagtcaaacacgttttattggcaactttaaaagtaatcatcagttcaccgcaaatggatggactcgaatccgacatggtcattgattctcccagtgtcattcatcaggtccaaagcgaggtcaccgaattggatgagcagcggatttatgaaattattgatggaatttttgttaaacgatttggtctattgaccccggattatcctgaaggatcagtcaccaccgtgcagacagaaattatggatccgttttgggatattgaccccagttttattagcattacgcatgagttcattcattatttgactcatcaatcggatatggaatctttaaccactatccaacagcttaaccggatcctgttacaacaacgattttttacacccagacaaaggccgaaactttgggcctggttgattgaaaataaagtgcagttgagcaaagattggcagccgcttaatcgctttagactagaggttggtaacgactatgcagtcttgctggatagccaacagcacaaacgggaagccaaaccatttattgtggcaatcgccctagcaaataaaatgggggcaacattggccaaaacggccttcccaaaacaggttcgtcaagttgccaaggatcttttccctggtcggacaatcaacgcctcggatgtcaaaaaaggtttgttggagaatgcgttggtgctggacaaaggagattattttgaacggactccggttgcaaagcgatttagggctagtaacattgccgatattcctcaagtggattactgaaaggactttttatgaataaaagcaaaaaattaatcccggtttcatttcatttgcgaaatttcaatctgtaccgcaaacttgatttgccagtctcaaccaatggtaatttggcgttggtgggtgaaaacggcgtaggaaagaccacgttagctaattgtttctttccaatgttggttgatgggtcaatcgcaactccgtcatttaatccgacaacggataccggcaaactcagcaatagtattaatccccggaacagttcccaagacagtcgaacctttgatgccatgttattaggatggggaagtagtgccatgaaggtcaggactggttatgcttacgaaaagctttcatcaaagtatcgtgatgttattttggggattggtgcttatcgggctaatggggatccccgcagtcggacctggtggtttgtggcaactaatgaggattcgaagtctaatttaacggtgacaactacggccgatgatggtcatgctttggataaagatggttttagattggcaaaccagtccctgggcaaacaactgcatatctttgaaaaagcgaacgattatcgagaatttgtggcatttcagatttttggctttacaagtggtcaagaattgggattattggcacaagcagatcgaatgattgcttcgccaatgttgactgccggtaatgccaaattcgaaccaattcgtcaagccttggttaactcacaagagaaaattgatgatgaaatcattcagaaagcagcccaattacagcggcaggttaacgataagcaatcacttcaggcaagaattgaagaagcacttaagcggattgatcgaatcaagcagcttacttttttaggcaacttcaatcaactcaataaattattgattaatccttatagtacattatctggcaatgttcgtcggcagcaggccaatattgaatcattgaatcagacggcagtgattgctaaaaagtcaattacaacccagaaaaatagtttggatgaaaccgaggccaaactgactgagcttaaagttaaccgcgaacgtcaaaagctgattcaatcccagcgagaccaactagccagagaaattaaaaatttagaacgaactgcgcgccaatataaaagagtatctgcacaaaaggaaaagattcaggcgcaacagaaggaaaatgcggttgcggccgctgacctggaatcatcattaaccgatgttaaaacgtcgcaattggcgccattaattgttcaaattaaggagaacctcattcagctaaagtggcaggaagtgtttgaaaatcctgatccgactgagatctcgcaaacattaactcaccgttttcaacaagccagccagttgattagtcaatatcaacaatgggtgagcaacagtgacaatttaaatgatgctgtgagtgtttttacagacactaaggaccaaatgtctgatagtattgatcggcatgtgacggggtttcggactggcataatgaaggaacagttgcataacgataaccggtcaattcacgatactggcgctggtaaaattagtgataaattcaaaatgttaaaacagaaaatagctgatttattagcccagcatcctgaaataaaagcgatgctgagtcagcccgaattactgccaacgttaaagcagcagacgattaatttggaaaagattggtaagcagttaaatcagttgggtcaacgtcatgttacgattcaaaatgaaaagttgtcgcttcaaaagcaactggatacactattagaagcaatggattcagagtttaattttgaggataatcagcatgaaattgaaagccttaaaggacagctcagttctttacaaattgacccaacaattgacgatcagattcagcaaaagcaaagggagtacgatggactgaaacgtcaaattgaccgttcccaagctcaattaaccggtgctcatgcaaaaattgaaagttttaatcaacaaattgatgatgagaaacgggaaatgcaacagctgggtcagcgaatgactgaagcactggatcaacttcagccatatttacctgtcgatgctgaattgactggaattgagacagcgacggcttatttaattgaaaaccaggcaatgattaggaataatccaattggtgaaatgagtgacagaatcggccacatgattaatcgttcaaccgatgatcggatggacaggcaggccgttaataccctttttaatgagttgggatattctcaaatcgccgaccaaatgtttccacacacaaccgagacgatggaagatgttgtcttggtagcttttgatgtggatgaagcgtttggcattttaaagacagaacttaccaacgttcaacagatgctgcaacaaattcacggtggcgcaaatttagcggttgacacgcataaaacggctgtgattcagcggattactgcccaatatcattcggttcaggattttaaccagatgctgagtgagggaaccgccgatagtgatgggattaaaattaagattgaactggtggcatctaaggatgttgacgaccaggtcattaaagaagcactggatccatctttagacgcctttccagcccttgatcaggaaattgatcgtcggttggctaagttggcgacggatccagacttggctgatgatgaagctatgtttgtccagaaaaccgacgagctgcttgatactcgaaactggtctgaatttgttgtgaagattaaacggcgtcagagtgatgaagatcattatgaaattgttgatgacagattcgtaaggtctggcgggtcgggagctgagaaagctcaggccatggtattaccgttgttattagtgccaaagatgattcttaatcgatcagcgaaagcggatgccccctacgtcgtcatgtttgatgagtttgctgataagctggatccggagactgcccgaatttttgctaagacgattaataagttcgggtttagttttatcgcaaccatgcctagtggtgctcaaagcaaattattgtctgatggcgttgataacattacctatcaagtcattgcccctcaaaaccgaaaagatgggaagtttcatgttaaccaagtcaaacaagcctatacctggggagcttaaagatgagtatttacagcgatgaatatgaacggatgactggaatgccggctcccaaacaagctgaacagttggaccgattatttgatgaaattagtcagaaacatctattgccaccgaaaggacaacaggcggctgattgtggatttgtcgctcatacctttaatgatcgaaaaattaatccggcaatctatgcctattatgactgggtgttgagcaatgaatttaacgttgatgaaatttcagaattacctgctaatatcattggccatgagtttgtctgtgccaatatttttgcaacggattggccgcaaccggtgactgttaatccttggcaaataaaagacatccttcaaatgaaagttgcgactggtaaggccgtgattattgagaataatggtgtttttatctggttactgcatcgccatccaacgtggccgttaattttacaatcgggaaatgactttaatgcgacttatctaaaggtaatgaaagctttggcaggcgagattaaattagcgtatcttggtgatttggatacgagtggcattaggatagcagatcagcttaccacgtatcttggaaatgagggctttcagaatttagctgtcattcaaagcccaagtcaggtggctcagtggctagccggctatggaaaggcggctgattctggtagaattcaccgcggtgctgagctgcacaaccaatcttggaaagaagaaagttatttattgatggttaaccaacagtttgtcgaacaggaacaattgattgattcgtatgaaacccttattcctgaatggttgggacaggcttaattgatcatagtcactattgtgagggacttgatcattttttcaattatgtatctcctgaaaaagcagttggttcagatgaggtatacctccaaagttaaagtaaaaagctttaactctggaggtatttttttatgaccaagatttcaaaaaccctcaaattacgataatttcaaaatcaggcttgcattaaagttagctccaaggtttaaggtaaatgagaagtgtgagggaagaaaagaatacgtatcacaagaatatttgtaagtcattttaaatgaattatgaaattggaggcagctttgcaatgaaactagcaaatcaagcatcacagaataatgaacgagacgcaagcggggaaatcgatggtcaactaatccttgccccgcaactcagtaaaacagattcccagtggcaaaatggtgctgggatcatttccgatggaaaagataccaatagtcagaatcagccaactcgtaaaattacctcaacggccaaagaactaatcatttacttttctcgttctggtagtaccgaattattggccagtaaaattgaacaacaaaccaatgctgatattttagaaattgttattaaagacccatacgcaagtaattatcaagagactctgtcacgggttaactctgagcggaccaatcaggattatccagaattgaatatgcaggttcctgatttaagtcaatatcaaacaatttatttaggctaccaagtttgggcgatgacgttgtcccacccaatggtgtcatttatcaatacttatggtaaccagtttatcaataaacggcttgcaccatttatgacccaaggcggctacggtcagggtgacagtgttcagcgtttacgacaattgattcggaaccagggggatcaaggaaatacatttgctagtgctttagtggttgatggtaataaagttgaccgagcaaattctcaggtatccaactgggttactcaggttaacgaaaacagttaatcaagatgcgccgatcttaagtcgcttaaacatcttaaaagaaaatatgttatgagtaagaaaaacttgttaaaaatattaaattaggtcacgacggtcttctgaaaccttgattgatgatgacagcgatatttctgccagaggagtttttgtatcggcagaaaattggttcaaacctcggttgcaaaaatctaactttgattaaattaagcagttgaattgctttttagtaacatttaaatgaatttgtttagttactcatcgaacccagtgatcacggtattcctccaaacagaaatacttgtgttactgggctttttttattattaaatggttaattgcggtcagtcgaaatgttatgaattaaataaaatggttccagcaacgaaattgttatgaatcattgctatagtgaaagagaaataacttgtaaaagatgagggggatatcattcatgtttcatatatttggaaagccacgaaatattactgaggtcattcgtaatcgaaagatcagctggttggagctcttctatgatttgatctttgctgtggttattggccgaattactgatggcgtggttgaacatttttcaatccagtcgttgattaattcgtttattatttttggctggttcttctggagctggcatgaaacgtctggttattttgacaatcatggaaatgattcagtacttaatattgggattattaatattcagatgattttaacgggaatagccgcgatttacattcctgaagcgattgaaggccactttcggtatttgattattgccttactgccaattgaactgatgctcatttttgtttggtatgccatcagttattttgatgctgctcacggacctgcttcaaaaatttggtctcgaacgtatatgggcgcgttcatattcttattgactagtgcattggttagggaacccgttcaatatattttgattattgtggcattgataatcaattacagtgctgtcttttttgcgaactcggctttgaaacatgaatataccaccattaaaatgccttatgttttgaaagattctttaattgaacgatatggattgatgactatgattgctttaggtgaaatgatttcaggcctttatgccaagttgaataatattgtgccacttcgattatttgactttattatgggagtcgttttagctgcattgatcggtgctgtttattatcaggtaattggggagctacacattcaaatgcattcatctgttcaagtgatgggggtccgctggttgtttttgttggatatttacttgattatcttgaacgccgtatttcttcaactacttttggcagagaatagtcggttaataaaagtggtttttattattgttttatttgccagtctttttatgatgtgggtgattcaacggataacggcacaaaaagttgcggatcaccgagcggggttgggcttttttacggttgagtttttgattctaattgtgacaatcatcctgccgacaccagtgatgttaggcttggtaaatttagtattgctggtcattaatattcggtatcgtcggaaaattaatcaggtattgattaaaccttgattgttgttggtagaaattagggcgaaaggattattagggctggtgcaaaagtaattttgtcccagtcccgttccttttgtgcaatcacgattattaccaagcgaaaacgtgagataaaatcccttccagagtacaaccgtcatttgtctcactctgcataattttttattttgaataatctcttgcgttggagttaagtccaaggtttatacttttttcaacttaaaggataagcaactgaaccaaaaagataaggagatgaccaaatgcgtaaaataagtttaatcattgttggggttattgcagcagcgggtgtgctgacaggattgtacttcgcacacgcggcaacaacatcaaagaactcaagtgatgtatccaggaccaaacaagaagcgggtaaatcacatcaaggtaataaaaaattgattatttacttttcggcgtcaggaacaaccaaggcagctgcggaggttattcagtctaaaactggtgcggatattgttcggttgcaaccaaaggaaaagtatccagatgactataataatttagtcaaagttgctaagaatcagttggacaacgggattcatcctgctattaaaaccacgattcccaacttgaagcgatatcggacgattctggttgggtttccaacgtggtggcatcaaccgccaatgattattcattctttatttgatagatacaatttctcaaataagataattgtgccgtttacgactagttcaagtgatccgatgagccgttcaatgcctgagatgagaaagttggcacaagcggatggtgcaaagatcacaagtggttttcgctatgataacaatgatgatgccttggacaatttcctgaggaaccatcatttaaatcagtaactgagtgtttgaatgaagattgattaagaaaaagatttgcattggagttcacaccaaggtttatgatgaccttggaattataaattaactactaagcaggttgaacctcttgaattgggattcaatagaatgggagaaataaaaaatggaaacaattaaattaaataatggcgtcgaaatgccggttctaggttacggtgtttttcaaatcacagatcaacaagtcgcagaaaacgcagttgtcgatgcaattgacagtggttatcgattaattgatacagcggcttcttatggtaatgaagaagctgttggtaaggccatcaaacgtagtggaattgccagaaaagatttgtttattaccactaaattatgggtatcagataccggttacgaagcaaccaagaaagcatttgacaagtcattggaacggcttcaactggattatcttgacttgtatttgattcatcagccatatggagatgtgtatggttcttggcgagcaatggaagaattatataaagaaggtaagattcgggcaattggggtctcaaacttttcttccgatcggctaattgatttaactttaaataacgatgttaaaccagctttagatcaaattgaaaccaacccttggatgcagcaaaaggatgaagtagcttacttaaaagctcatgacattcaaccggaagcttgggcacctttcgctgaaggtaaacgcgacattttcaagaatgaggttttgacaaaaattggctcaaagtatagtaagtcagttggtcaagtcattttacgttggttaacacaacggggaattgttgcggtttcgaagtcttcacgaaaagagcgaatggcagaaaacctcaatagtcttgatttccatttgactgatgatgagatggctcaaattgcatccttggataagcatgaaagccagttttttgatcaccgtgatccggcagctgttgaacgaatcctgaacttggttcgtaaagtttaaatttaaatcataaggaagttagcgccatgaacattgatacagttgcaaagaagtttgatgtgacaaacgacacattacgttattgggaacgtgttggcatattaccgcctgtcaagcgtaatcagagtggttatcgcgagtatagcaaatatgacatgaactggattttttatattaaagctttgcgtcatgcaggaatgactattgaagcattgatcgaattcgtgaaattgtattgcgatgatcatccaaatgctgatgttcggaagtcgctattgattgagcagcgccaagacttagttgataaggttgccgcaattaatcaaacacttaattatttgaattacaaaattgatcattatgaagatcatacgttgaaatatgaacaagaaaaactctcttacgaggaggaaaattagatgggtaaagtgattgttattactggtgcttcaagtggaattggtgaaacgacggctaaattattagcaaagaatggccatcaactagttttaggagctcggcgtgattctaaattacagcaaattgtaaccgacataaaggaggcaggtggcacagcagtttataagagtacagatgtcaccgatctatcaagtgttaaagcgttggcaaaattggcacttgattcattcggcaaaattgatgtttggatgaataatgctggtctgatgccacattcagaatttattaagggtaaagttgacgattggaaccggatgattgatgttaatttacgcggggtcctttatgggattaacgctgcgctgccaagtatgcgagcacaaaaatccggtcagtttattaatatggcatcggtagccgctcatgcggttcaccaaggtggtggggtttatagtgccactaaggctggtgttttaatgatcagtgaggctttaagacaagaggaagcggccgccaaaagtaatgttcgcgtgacggtggtttcacccggtgccattgcaactgaattagttgagaatgtgaccgatccaacaacaaaagcagcacttgaaaagtattatcagcaaaccgccatttctcctgatcggattgcgtcatcaattatggcagcaattgatttgccggcagatgcatcggtaaatgagattgtcatcagaccaacaggccaagaataggatgtgattttttggaaaagaggcacctaggtggcttaaccgttgatgcaatgggggttaggttgtatggggatgagctttgcctatggcgaaatcccggatcaaagccaaatggtcaggttacttcaagcggctgtggaaaatggtgaaactttttttgatacggcggaaatatatggtccttataccaacgaagcattattaggaaaagccctggcaccatatcgagataaagtaacgattgcaactaaatgtggcttacgaattgaaaatggtaaacaagttgtggacgctaatcccaagggtatccagcgctccgttgagggatcccttaaacgattaggcgtagatacaatcgatctttattatcttcaccgggttgatccacatgttccaattgaagaagttgccgatacgatgggacagttgaagcgggctggtaaaatcaagcattggggattatctgaagctagtccgaaaacaattcgaaaggcgcatgcggttgaaccacttgccgctgttgaaagtgaatattcattatggacacgggaccctgaggcagcattattaccaactttagatgagttggaaattgggtttgtcccatttagtccattgggcaaaggattcctaactggaaaaattaatgccaatactaaatttacagagggcgatgggcgtcataatttgccacgctttacgcaagaagcaataattgctaatcaggcattattaaaagtgattgacgaatttgcttcggctaagcaggccacaccgtcacaaatcgcacttgcgtggttgttagcccaaaaaccatggattgttccaattccgggaacaaccaggtttagtcgattacaagagaatctcggcgcacttaaggttaaattcactaaagctgaattggaacgacttaatcaattgtcaaaaagggtgaaagttactggtgaccgttattctccagaattggcaaagcgggctggtttataaaggttcaactgctggatctttcatttataaaaaaattaccatcatttatatgagtaactgcagtaacaaatattattgagaatataaagaggtcttggcaactttccaagactcaaataactgaaaagcaaggggaaaatatgacaacaaatgtactgattatggcagcgaacggacaaatttcacaactagttgaacagcgggttttaaatgaagcacaattttctgacattcacttaacgctctttttgagaaataaagatcggttagatgatttagctaacaatgatcgggttacgcttgttgaaggcagccttgacgatctagaggatgttaagcaagctgttaagggccaggatattgtctttgttgggacggtcgatcatactagtgatgattgtcaaactaagaatgttgtggcggcaatgaaggatgccggtgttggacggttaatttatacgaatgaacttggcatttatgatgaagtgcccggtgcctttggtgaatggaataagcaaacaattgggaccggtttaaaaactgcattggaatccgataagattgttgaaggatcaggattaacatatacgacgcttcgattaccttggttaaacgacaaggatgtcaagtacgatcttactcacaaggatgaacaatacgttggcgtttcaggttcacgaaagagtattgctgatgttgtccttcgaatttttgctgatccagaatttttaaagaatgacagtgttggcattgctgatccggatacgcaaggtatggatcgacctgtttattaagattaatgttgtgatgaaattgaaggagagctcttagaatgaaagcagcagtatttatcaagccaggcgaagttgatgttcaagatgttgaaaagccaaccattcagaaaccgacggatgcgattatccggattgtccgggcaagcgtttgtggttctgatttatggtggttccgaggtatttctcatcgggatgctaattcgttggttggtcatgaagcaattgggattgttgaagaagttggaactgatgtgaccgatattaagcctggggattttgtcatcgcaccattcactcacggctgtggtcattgtgccgcttgtcttgccggttttgatggtgattgtctgaatcaagaagcaggtggtaatggcggttatcaaggtcaatatcttcgatttaccaatgccaattgggcgctggtgaaaattccaggtcaaccaagtgattactctgatgatgtgttaaattcattagtaacgctagctgatgtgatggcgaccggatatcacgcagcggctagtgccgaagttaaaacggatgatactgttgtggtgatgggtgatggcgccgttggtctctgcggtgtgatcgcggccaagttgcgtggtgcaaaacgaattattgccatgagccgccacgctgaccgccaacaattagcgcgtgagtttggtgccactgatatcgtgtcggaacgtggtgatgaagcggtgaaaaaagtcatgtctttaactcaaggttcaggtgccgatgcagttcttgaatgtgttgggactgaacaatccgttgatacggcagctaaggtcggccgaccgggtgcggttgttggtcgagttggcgttcctcaaaagccggaaatgaataccaatcatcttttttggcgaaatattgggttacgtgggggcgttgcttcggttacaacggatgataagcagcttctgctaaggaaagttttggatggcgaaattcatccggggaaagtatttacccagcggtttgatttggatcacattcaagatgcctatgatgcaatggatcagcgtaaagcgattaaatcgttgattgtgatcaatcaataattaattttataatggctaaatgaaagatggactaatctcaaagtggcgcactttgatgttagcccattttttgatgatttgtatgaataaatctggtatcaagttagtgaatttatccctagttaaaaaatatattaccaatttcgaattcttcactacaagattgttgtaattaaccacgaatatatcatggcaaacaaaagaaaaattggtttattaatgccgatcggtcaagaaacaacaagtggttgacagcaattttcctaatatctcatgttggatgtaaatagtgtttatctctgtggcgtttcgtggccttgtaaaattggtaaaaagagtccatttacttctttaagttatccaactatgatgagcgttgggtctgcctataaaggtgttgatatcattatgggttggtatttaacacagaagtaaaactaattgaggggtgttttaatgaatattagaagatttgtaggtaatttggtattgattttaggaatggttgttttttcgtggatagcggtgccaaacgtaaaggcagatagctcaaatacaggcgtaagtgtgattaattctgctaaccaggggaccgattaccagaccgcgattacaaatggaattggttatattaataaacaagatctaagcaaattggatgcttggaacgcacttgatttggcccgttgctcacaaccgatgacgagtgcgcaaaatgatcaaattctagaaaatctgaaggcagaacttaattctcaagagccggatgttcaggcaaaagaatatggaaaattgattattggtgttgtctctgcaggtggcgatccgatgaattttgatggtaagaatttagttactgcattggaaaagtcttctccaaatgatatttatggactgggttatggtgtcatggcattaagcaccaacaattatggtgatgagagcaatgcaattattaaaatttgggtggccaacctgttaaaacagcaaaaagatggtgtttggaatttatttagtgtttgtgatgatacgggaatggttttgcaggctttggcaatgcaccaggatttacctggtgttaaagatgcaattcaaaatgcggaaaaagctgttgctgctaaatattaccaaaaggatactggtgaatttgttgataaaaattcaccttggggagtatcagttaattcaaatacagatgcatttttggtaactggattagccgcatgtggtgttgatgttggcaaaccattgataaatcaaagtggcgctgtctcacctattaatggtttattaaagtatcagcaatctgatgggggctttttctggcagctaaatactgctgatgtagactcaatgtccaccgcggaagctgtttacgcgttagagcagtatcaatatgaacaagcaggtaaaggatctatttatgatttccaaaagaatcctaaagaaataattgccagtgatcagaataaatctgatgctattagcgcattgaagagtgccgctgttgcaagaaaacaatcaattgccagtgatcaaagtgctaatgctgatgatcaggcaacggtcaatgcaacgattgatcaaattgtcgcaaggtatactgatctaatcaataaggaccgttctgttaatcaaattcttacagataagcaaagtgggattaatgccattaataatgttgtggcaagccattcagatattgcgacaacgacagacaaaagtaatgcgattaatgctttattgtcaactgcaacgaatagtaaacaatttgttaataatgatcagaaactgaatttggcaagtcgcaataatgtgttaactcagattgaccagattgtgacgtcttataccaacacaattaacaacgatattttaaagaatcaggttcagagtgatttaaatgctggtgtgttggcaattaataatatgacattactcctagacagctataataacaattctggttccggtaatgttgttaatcacacaggaaatgtaggaaatagtgccaatccggtgaattcgaccaatactctcggttcaactcagaatagtcattctacaaaaacagttaaacagcacaagagagttatcttattaacgggaacggctcgtttgtaccgtaaatctcaatttacacaacataatttaataaaaagttacttacgacaatcccgagttaatcgaccgatgttcttgattattcgtgaaatcgccaagaaccgatatcaagtgagagatttgaatcatggtaactattacggggaaatagggtatttgaatgtttcagcgaataaaatgacaaatgcgtattatcgtaagaatccatctaagattaaagtaattggtacacatggtattaattcgtatcggcgcagtaatttgactcgtaagcaaaatcacctaaaaaaaggaaccataataaaaattaaaaaggttgttaacagaggattaacgacaagacttcaattgaagaatggtcaatatatgaccgcaaataaaaaattattaatcaaggattaggctaagttggatttttcgaaattaattggttaaaaggagtaggtaaacagaatgaaaagtcgtatttgcagaattttatgttctagtttaatgctgattagttcaattggattatttacttttagtcagggaaatcttcccacctattcaaatacaggtgtggcggttcacgctgcggttgttaatcacaactatgatcgttcgattaaactaggggtcaactttattgcgcatcatacgcagaagtctcttttgaatagttgggatgcattagcactctcacgttcgccacaaggattatcaagaaatcaaaagaccttcttttataacagtctgaaacgacaattcaagagcttgaaaggaaactatgcagctacggactttgaaaaaactgtcatcgggttaactgcaattggtcgtaatccaaaacattttgaggggcaaagcttggtgaatgatgtcattcggacggccacaaaagatggcattaacggtcaagcatttggattaattgctttaagcacaaatcattatggtaaaagaagttccgttaaaataaatgagctgatagcaaaattattgaagtcacaaaatgcatctgggggttggtcgcttagtggaaataagagtgatttggacatcacgggcatggtcttgcaagcgttagggatgcaccaaaatgttgtaggggttcaatcagcaattaacaaggcagtccgtatgttgaaaacagaggcttttgaaaagaaaacgggtggctttctcataaaaagtcactttacgaagaaggaaaacgctaacgccattgccagtgttgttgcaggattggcagcttgccgtattgatccaataaaaagttttaaaggtgttaatcatgtaaatccaattagccgattgctgctgtaccaaatgaaatcagggcaattttactggattctgaaaagtcacgatggggcattgaacatgtcaactcagcaatccgtttacgccttggaacagtatcgtttctttaaattaaataaaggatcaatttatgattttagtcgttagtttatcggaataataagtaaaaaggagtatttaattctatgttgctcaaacgattcttaaaaatagtagccttaattttctcattgactctgttctttagcacaattggtcaagagctgattacctcaacaccggtacaagccgcaagccaaaacagtcggctgattcaagtgaagagtggtcgagcaaatcatcaaagtagccatcataaaacccacaaatctaagcatggtaaaagggccaaacaaagtaagaaatctcaacaaaagaagaaggttaaacagaataaaaaacaagcaaatacaaaaaaagttaatcgttcgaagcgaacgaacaaaaagactgtaaaaaataaggtttcaaagaaatctccaacttctaaaaaaactaaaggatctgatcagattgataaaactggagatgccaacaagccgcagaatccccaatcaactacgaagagtaatcaagggttgccagcaacctcatctagcaataaccccacggtttcttcgagttcagctacagtatcctctcaaagttcaagttcagaaattaatgcttcaagtccaacggctccagcagtgagtacttcgccaaatccggggataagcacttcaccaacaactcccgcaccgacacaacaagtgacggtgatggtttatggtccaattagtaagggcaaccaactattactaaatggatcagttactattaagcagggggatacagtttatgatgcgattaagcgggcttgctcgcaacaaaatattccatttaacgcgctagatgacggctcaagtgcttatgtgacaggaattggcggatttaatgcgggaaactttggagcaacgagtggttggctttatagcgttaatggcagcttttcaaacttatcttgcggttcttatccgattaaggatggtgacattattaactggatgtttacacaaaaccaaggtaaggatcggaatgcaccaattgcttgatgtgataagcaaatagcttagtcttaaatggataaatgttgaaagtagatagctaattttgattcaataataatttctttagtcagacttcaaggtcgttacctcttgaataaaaagtcgtataatataggtattctaataaaattaggaggatactcatggcagaactaacacatttttaccagacattccaaccgacccattatgatatttttttgaatatcaatcgggaaacgaaacaaattacggggaaaacaacgattaccggggatgcaaaatctcaggcaatttcgattcatcagaagtatttagacgttacaactgttcaatcagacgggcaagacgtcccgtttacgaccgatgacaagaatgatgccattcgaatcaaacttccaaaagacggccagacgacattgaccattacgtataatgccaagctaacggatacaatgatgggaatttatccatcgtactacgaagttaatggggttaaaaagcaaattattgggacccagtttgaaacaacatttgctcgccaggcatttccatgtgttgacgaaccggaagcaaaagcaacctttgatttagccattaagttcgatgaacatccaggtgaaacggttttgagtaatatgcccgaaactcgtgaagaaaatggcgtgcattattttgacactaccgttcggatgtcgacatatttagttgcctttgcctttggtgaactccaaggaaagcaaacaacgactaaaagtggtgttaaagtgggggtctttgcgactaaagcccacaaagccaatgaattggattttgctttggatattgctaagcgttcaattgaattctacgaagacttttatcacacaccatacccattgccacattcttggcagctggcactgcctgatttctcagccggtgcgatggaaaactgggggcttgtcacataccgtgaagcctacctgttacttgacccggataatacagccctcgacatgaaacaattagttgcaaccgtaattgctcacgaactagctcatcaatggtttggtgatttagtcacaatgaagtggtgggatgatctctggttaaatgaaagttttgccaacatgatggagtacgttgctattgatgctctagaacctgactggcacatttgggagactttccaaacaagtgatgttccggcagctctgcagcgtgacgcgaccgatggggttcaatcggttcacgttgaagtcgaagatccagctgaaattgattcattgtttgatgctgcgattgtttacgctaagggcgctcgaatgttagtgatggttcgagccttattaggtgatgacaacctgcggactggtttgaagaattacctgaatgctcacaaatatcataatgcgaccggtgatgatctctggtcagcgttgggtgaggcttctggtttggatgttggcggcattatgaaatcgtggttgcagcaacctggatatccggttgtgaatgcggcggtagttgacggcaaattaaccatttctcaacagcaattctttgttggtgacggcaaagaagtcggccgccaatggcagattccgttgaatgccaactatgatggcgcgccggctatattcgatcaaaaacagttaacccttggtgattatgaccaattgcggaaagctaatgctaaaccgttccgggcaaacgttggtaataactcacacttcattgttaaatatgatcaaacattgttgaaggatattctggatcatgttgattcactggacgctatttcacagcttcaaattcttcaagatcttcgcttattagcggagggtcgtcaattatcatacgctgaaattgtgccgttattatcacaatttgcaaatagccattctaacgtcgttaacgcggctttgtatcaagttgccaacgatttgaagaaatttacgacacctggttccgaagaagaaagacagttgcgggccctgtttgacaaattgagtgccgctcaggttggtcgtttgggctggacacctaaaactggcgaatcaaatgatgatcaactgactcggccatacattttgagtgcggcattgtacgcgcaaaactcggatgccgttgcctcagcccatcagctctttaaagcaaaccaggatcatttggaaagtttgtcagctgatattcgggtctttgttctgcaaaacgaagttaaaaactttggtagtgaggcgttgtttgacaaattattatccgcttatcggcaaacatcggatgcaagttataagtcagatatcagccgcgctttgaccaggacggcggatcctgaattaattgcgaaactaatcagtaagtttgaggatgccgatacgatcaaacctcaagatttacgtgcatggttccgtggcgttttggccaataatgatggtcagcaggcagcctgggattggattcgcaaagactggcagtggctggaagatacggttggcggtgacatggaatttgctacttatattacggtgattgccatggtattccataccccaactcgattagctgaatttaaagcattctttgaaccaaaactgaacacaccaggtttgactcgtgaaattaagatggacaccaaagtcattgaaacccgagtggcattggttgaagatgaaaaagcagccgtcaatacagctgtggccgacgcaatcaaataatcaaccgtccagtttagattttgattcgataaatcttgaaatcaatacgagattaagatgggaaatgcctgtcttagcttccagtgactaaaaagacatggggtctgattaaattttaatcagaccccatgtcttttaatagtcaggtaaaacttttatctagcgtttctcgtgatcatttcacaacccagccaaaccacaaacgcgaccagggcaatgcctcccagccagaatccccagataatgattctggtgaaaatggcaacgataatcaataaggcgagaataccaccgaaaaatctgataattgagaagccaattttcaaaagtaggtaaaaccaaccgaatattagaaagaataatagtgccattttgtcggcctccttagaaaagggtcgaaacccaatccctgtattcacgattattatactagaattgcgtgtcgtatggtccataaagatcgaattaaatgtcactgatatattattatatttgactgatttggttgaataacgctaatgtgtaaatcgtttacattaccgatgtaagcggtaaaatgaccatgtaaataagtgtcgattacttgggaagcctttaaaaatagaatggagcgattaatgatgacaaagcaggtaactgatcttttgaagattcaatatccgatcattcaggcacccatggcttggctgactgacgcgaaactcgttgctgcggttggtgaagccggtggccttggtattcttggccccaatgccggccaggatgagttgacaagtgatccggttgaaacagcagaacggatgcgtcaggaaatcattaaggttagacagttaactgatcggccgtttggcgttatggtagcaactccgcggcctggtgaaaggattgccgataacgtttttactcgggaaatgttaaaaatgctttttgaagcccaagttcattattttgcggttgtgggaagcgtcaacgcagaattgtttgacttgattaaggcccatcatggactgattatttatcgggctttgacgccgacagtcgcagatgccaagcaagctgaatcacttggagctgatctaatcgtggcaacaggtcgggatgagggtggactactgcccgctcgcgaatatgggacgtttaccgttgtcccggcaattgttgacgcggtttcggtcccggtgttggcggccggtggcgttaatgatcggcgtggtgtgaaggcagccttcgcgttaggtgctcagggggtatacgttggcacccggtttatggtgacccgggaatcaccacttgctaaaccggctaaacaattaattgtcgatagtacctatgatcaagttgcagaggtttcactagaccagcgatcaatcaccactaaattggcccgccagtttgcccaagcatttcagcaaccaagccggcgtatgaatatggattcgaaaattaaccaagcaggtggcttacggccggcaatgcggttgggcaatttggacgaaggaattgttgaagttaataccggaattgatacgattcatgatgttccaactgtggcaaaattagttgaacgattaatgacggactaggatatgctttttgctggtattaggtgaaacgttatcaaacaaaaacgtggcgtaacaagcagatttagccatatagatagtttcagcccggcttatattagattggttttcggctagctagccgaaccgtgtgccggaatctaaccgccttctggcacactctgttctatagactttcttaattaaacttacattcccttaagcatttaaggtaaaatcaatcatcacgggctaaaatatggtaaaatttagcaatagttttgatgtgttagccaccatttactaaaaaaggagaacagaattggttcttagtttattaattttaattttgttggttggtggtttaatgagcggctatcgagctggtctcattacccagtcagttcgaattatctcgctgattttatcatttatcgtggcattctattatttccaaccagctgctaatttggtgatgacagttgtgaaaaaactgggcgcagagcccaattttcaatggatttacattatcgacattatcgcgtttgttttcctttttggactaactcacacagtttatttaatgctcggaaatcatttaaatggtattgccaaagttcccggcttccacattggtaatgcaatcctaggctcagcagttggcttgttaacccagtatctggtgatcttctttgttctaaatattcttgttgtctttccaattaattggattcaagatcaatatcgacagtcagacatttcgcaaacaattgttaaaaaaacgccagtattgtctggacaattttcccggaatttaattaaaaataagtcgtttattcaagatgacaccacgtatcgttacgacggaggaaccataaatgaagtggataaataggctcattgcactgattattgtcttgctaaccttgaatatttttatccagccgggttcattaaaatcaattggccatcgggtgaataacgcgattgatttaccaactatgctcaaagttgaaattgataaagataatcaccatgaaaatcaaacgcagcaaaaggcaactcagactaatgccaacgcgacgccaattgaaagtatcgttcaggggcgaacattgtctaacaggtactattatcattttgccagtggtgttggtgatcgagctaaacaggcttttctgagtgcggttagtgattacaataagaccggaattgtcagattggagccccaaaccggtaaagtagattcacaagccaaccaattaacattttatgtttataaaaaacgagttgaaaatggttcgggagctgttgaactagggctcggtggcccacagatttacccatggattggcaatcgaaatgacgatttgaatcgtgggcgagccggattaaatgctgaatatccacaatctagtatgcaaaaaccggttgcccttcatgagattggtcatgccttgggattagatcacagcacgaagcgggattcaattatgtatccggtcgatcagggtgaaaccaggttatcaagtggcgatctggctggtctaaaagagatttatcataaataatgatttgatattgcggcttttaccaattctatgtaaatgaatgtggctgcacaagtaaattggctaaaactgagctgtgactgtgccaactactatctgaatttaaaggccctggataaacaattaccgctggattgctttataatgatccacgggatacattaattaaatgatttaggaggctgctagccatgaattatgctgttacgggttcaacgggccactttggaaaatatgccgttccgtatttacaaaaacttgttaagccacaagatactgtcattgcattagcgcgaaacgttgaaaaagctaaaagactatatccaaaaggagtcgatgtacgccctggcacttatgaagattcggagcaattaattgaatcacttaaaggtgttgataaattgctgcttatttcgtctcagcctggtgcagcgatgtcacggattgaccagcacaaaaacgttgttgaagctgccaaaaaggcgggggtaaaatttattgcctacactagttttccacatgctgatacgactgaggcacctttggcggctgatcataaggccactgagagtctcgtcaataaatccggtattgaccattcgtttcttcgaaataattggtacctggaagatgaactgttatttattgaaggcgctcataatggtgaaccatttgtctattcagccggtgacggcaaggttggttgggcacccgaggagctatacgcgcaagctgcggttacggtcctaacaaacgatcagccgaaagaaatctatgagtttgctggtccaatgcattcgtatactgatctagcggatgcccttcaaaaagtaactggtaagcaatttgaaattgccagcgtttctgatgatgagtttatggctaatttgcgtaagtatgttcctgatcaagtcgatgccatgatgacaatgattcagaaaatgattcgaaatcataatttggaagaagaaacgactgatttatcggatattttgcaaaagccggtgccatcattggaagaacagattcgggcacttactgaaacttcgacaaaataggcgaaaacttcggtttaatgagtaatcaaaagacgctttaatcgcattgccaacaatgactgcgattagagcgtcttttaagattccaggtaaaaatctgatataaattttggttatcttttagaaatttccgttacttttaatctccttttcgtatctaatttatagacactgtcgaaaaatctgtgatggttggtgaaatagatgatgaacgtaattgtattagaggatgacttggatcgattggattatttaactggttttgtaaaacgatatagtcagtttgaaaggctaccggtaaaagttgctttggctactgagaaatttgatgaggttaaggagtatgttgagcgcaatagaggtaaggatgcgctgtttttcctagatattattttgactggagaggttcgcgatggcattgatttagcgatctttattcggcggcggatgcccaacgctcagattgtttttgtgacgaagcatcgagagttagtcatgccggcagttacgcataataccttgccaatggacttcatccctaaagatgtcggaccacgccaatttgaacagactatccgccaagatattaaattggcgttgcgaaaaataacaactggcaaaccgactcaaagtgaaacgtttgtctatcatgtaaatgaaaaatattatgagataccaattgatgatgttgttctgattgaatcagttcctaaaaaagctaatcaattaattttgtacacaaataaaacgattatccctatctacggtcaattaattgattttgagcgaaagtttaaaatcctttatcgttgtcatcgaagctacttagtcaatcccaacaatgtccggcgggtatttgggaagccaccgcatgtgttattaaatcgagttggaaagaatacctgtccggtgtctgaacgccatatccgagaattacaccagattgtcgataaaattgactaaccggttgatttcggatttagacctgagaagcgatcaggttgagcccaaagttggtttagccaatctcacgaaggttagtcatctttgataatttcttccaacgtttttcgtcgagcctgtaactggacgtcgtatcctctaaccagcggcataaaaatggcgacaatgccacagagaacggtgccaattcccgcaatgacaaacagttgttcaacaccgatagcatcagcaagtggtccggcaaaaaccaatccaagtggaccggtcaaactaagtagtgaattcagaacccctagtacccggcctaattgatgtggcggatagctttgctgaatcatcgccattagcagggtattaaagtaaggtgttgcaaagccggcaattgcattgaggacgacaaagtaccaaaagccggtttgattacccggaagcaggccactgattccaattggaattcccactgcgaaaaaagcaatgataaccggtttcatccgatctttccaatcaccccaaataccaataattgcgccaccggccagcatcccgccagagtaaatcacttcaatcagcccggcctgaccaacggttccgtgaaaataagacattgtcattaagggatacatactggctgccggcataaagagtagtgtaaagaccgcgccgatgattgtgatgtaccaaagtcccttattgttaacaagctgttggacgcccaatttagtattgtgcagaacatggagggcgccatcgataatcttgtgttcgggaattgttacccacaaccaaatcatgatcgtcccgatagctgctcccagcacatcgagcaagattaaggttttcatcgggataattgaaaatagaaaggcgccaacggccggagcaatgatcatattggcagattgaaccattcccaattgaccattggttttggttaactgtttttcaggaaccattgttggaataatggcttgaattgtcggcatttgaaacgtttgggcaattgatcgcatgagtaatgaaacgaaaatcagccaaagtggaaattcatgaaagatcgtcccagagatcgataagataatcgcaaataaggctgccacgagatcagggacgattaaaagggcttttttattccagcggtcaactaatgggccaacaaatgggctaagtaaaaccattggcagcattccaagaatagttgcaaagctaaggacagttgccgaacccgtagccttggttaaataccagatgattgcatattggacgatcatactagtgatcccggttaaaaattggctggtcagaaataaaaacgtatttttctgccagtgagacaaattattatccatattcaatacctcgttagaagattcacaacaaaagaatcacaactattttaccttatttgaatgaatttgtgtgatttaacaatcggggattgttgctgactttttgtactgggtgtggtaatcttaagtttacgtgagcgtcgtaactaggggatatttgttatcataactgagaagactaacccgaattaattgatgcactttacacttgaatgttaaggagaaaaataaaatgacgttaccacaacttgatttagcaaatgcaactggtccaaaggccactatcaaaacaaattacggagatatcattgtccaattatttccagaacaagcacccaaaactgttgagaactttgtggccttagctcaaaaaggctattacaacggcgtgacttttcatcgggttattcccgacttcatgattcaaggcggggatccgactggaacgggagctggtggtgagagcagtttcggtcataattttgaagatgaattttcacaagaattatttaatattaacggcgccttgtccatggctaatgctggtccgaatactaatggcagccagttcttcatcgtatctaacgagcatgtcgatgatggcatggttggtcaaatgaaggcggccggttatcctgatgacattgttgaaacttacaagaatggtggaactccttggttggattttcggcatacggtttttggccaggttattaatggcatggatattgttaaagaaattagtaaagttgaccgtgattctcaagacaagccaaccaaggctgttgtgatggaatcagttgaaattaataaccagtaatttccgataattagaatcaaatatgtgatcaaagacctgttagcagaatctaatttttgctgacaggtcttttttggtcacacatcaatttttactatttgatgactcagttcaacataccgcgctgttaaaatgcttatattttgtcatgtgggttaatatatatctgagtattttacaaactttttaaaacgtttcttaaagctttctaataatttcggtgttttagatatcgttactagcattatgacttagttttgttactataggttcagcttttaaatcaattgtaattgttcaaaatataatgaattaaagaaggggatgccaatgttacgaaaacgttggttactagtgataccagttatcttattattaatgggctgtcattcaacggcaaccacggcccaaaaagccggtcgtgtcaagaatgggcagttcaatggcatcacattagatgtatcaagacatcattatcaggttagtacattggaaaaatttatcacgcttgtagctgatcaccatggcagtttcgtgcaacttcattttaccgacgataaagactttgcaattgagaacgctgtcgttggtcaaacgattagccgggcaacgaaaaaaaacggtatttggcggaataatcggacgcatcaagccttttatagtaatcaacaaattcagcagttactgaggttagcgaagcagcggggagttacgttaattccagagattgatacaccggcccatgttaccggtttggttaacacactcaaagcgtctgggaaagctgcgttggccaaaaagctaagttggcattcaaatagttatggcgatgaactgcatcttaatcaagccagtatcaactttgttaaacggatagaccatgaagtagctgatgactttgctggtcaacggaatgcgagatttcatttgggcggtgatgaatttacggataaaatgaccaagaatactgcttatattaaatacttaaatgcaaccagtatgaatgttgagcagcttgggtttatcccggaagcttggaatgatggcttcctgaataccagtttgaaggcgattaatcaccacattcaagtgacttattggaattggaccgccgatcagtttggaacactgggaaagcaacggcgtaagacttgggcatccatgcccaggttgattgccaatcactttaaggtgctgaattacaacgactactatctgtatttcaatattacgaaaaagggaatttcgaaaagggatgtggcctatatgagtaacgatatgaagcgctactggaaaccaactttgtgggataatgattctgcaaccaaactaaaatcattgcatggtattgttggcagcagcgcgtcgttttgggccgattctgcaggttcaattaccgataaacagatctatcgagcggggaataagtttatcgaaacctttttaaggttggcgcgaaagccgctatcttagaaaatggaaattattatttttttcgacgatgactgcggatgatcttgggggtctgaaggggaaaaccagatcatttttatgaatcataagggggatttaggatgcagacgcttagttcatttgttattttatatccagtgattgtttcactggtttggattattggatcagttttttttgccattcaacaacgaaaagtgccacttcgaaatttacatgcggggcaaccggctgatctggtttcagtattgattccagctcataatgaagccgaaactttggatcaagtcgttcaatcagtttccaacttaacctattctaagattgaacttatcttgattaatgatgggagcgacgataagactttaacagtcatgcatgagttagccgctaaattcagcggacaatttcccgttaaaatcattgacgttgaacctaataaggggaaggcgaacgcgttaaatgttggcgccaaagcagcccagggaacttacttgctttgcttggatgctgattgttacgttgactctcacgttcttgagccgatgttggcgagattttatgatcatcccagagttggggcggttgctggcaaaccgattgttagaaatcgaaccagtattcttggccgactggaattgttggaatatgttggcgttatcgatattattaagcgcggtcaagcttttgtaactggccatattacgactgtttctggggtggttgtcgcatatcgcaaggcagctttggccgatgttggctggtggaatgctgacgcgattactgaggatatcgatgtcacttggcgactttatcatcaccactggcgggtcatttattgcccacaatcggtcgcctggattttggttcctgaacacattaaggatttaattcatcaacgccggcgttgggcccggggcggttttgaagtattatttcgaaatcgtggcatgttaatcactggtcgactgagtgaacagtggttgctcttagacatgattttgagtgatttgtgggcaatcagttgttcattcgtgaccctgttttatttgattaccgttgcctttactggtgatttgattatggatggggtcatcctcttcctactattattgatcagtctggttcaattcttaattggattcgctgattcgcggaagtcggattttattagctggcaggatttgctgttactgccattgtatgttgttttctattggtttattaatctcgttagctgtctaactgctttgggatcatttttcttggatccaaaacatgttggtagttggagcagtccggatcgggggctttgaagatgaaaaagacaaaaattccatcagatttgattatccggaagcattcttcattattaacgatgtttcgacgtgcggtgattttaattggtctttggctaattaccggctatattatttatattaatttttgctttttatttaatgcttattctgattcgttagtttcggattacctggtgctcaacctgtcgtttcactcatattttgtctttgcgattctcgtactggttgttgccagtattatgatcgcttttggttggtggcggatcaaaaagttggaacggcaggcgaaaaaagatgagtaaaacaaaacgaaagtggattttgaccacgtttattcttgtcttcttggcattactggcggtcactgtccgtcacaatattaagtatcaacttggcaatcgccccagttatgccatttccaagtacgatgaacggattaaaaacggggtgatggttttttgctatcaccgcgtccttgacgataccgataatgatatcgttaaatttgatgaagaagtgtcacctaatagtcaatttcacgattttaacgtgaatttatcgagttttaagcaccagatggcctatttacaaactcaccatattcgggtgatttcattgccaacattgattcatatggtcaccaaccgccagcccattcatggtcgctacgttgtgattacgtttgacgatatcgaccgtacggtgatcaacaacgcattcccagtgctgctgaagtaccattatccatttacggattcaattattactggcaacacaggctggtacaaagctggtgagaaattagcaacgtggccggcaattcaacgaatgcaaaaaaaggccggccgtttggcaacctttgctgttcatacgaatcgaatgcattatttggttgataacggcacgccggtcttcaatctgccaggcaatttggtaagatttaagcatgattatgcaaccagtcaaacggttttaaagcgcaaaattggctatcgatcacctatttttacttatccatatgggagtgggacgcctcaggttcagaagtttttagctgagcagcctggtttgaaagctattttgactttgaacaacggcatcgtgaccaatcaaagtgatttaaaagttacgccccgggtcattattaacaatagcagctggccgagtgttacgaagtggattcgccaatgatgggcgttaaatgaccggaaaccggataagaacgttagaataagggttgaatgagtcaattttaatatttgattgaggacggtgattgttttggcaaagtttgatcaaacgtttagaaaagaagttaatattgtccaaccatatattcagggcgatactgaggatatggttcggcggaaatatcatttgaataaagtggttaaattgggatccaatgaaaacccatatggaccctattaccatgcgaaaaaagccatgatgcgcagtattgattcactaaatcgatacccggaagatgactttgttaacatggaaaagttgttggcagaccaatttaaattaaaacctgagaatgttgcgatcggcagtggtgctggtaacattattgaaaccatttcgaaaatgtttttaaatacaggtgatgaggtcttaattgcccaacagtcatatcgactttatcgtgaagtatcaaagttgatgggggctaaggtgatcgaaatcccattgactgatgacttccaatttgatttagatactttcaaggcaaagctcaccagcaaaaccaagttaatttggatttgtaatcctaataatccgacctcaacgttaacggacaaagcaaaattaaagcagtttatggatgatcttccagatgacgtttgggtcgtagttgatgaagcgtacgccaacttcgctgacaaagacaaactgtttaattttgtcccatacattggcaaaaaacgcgtcattgtcatgcgaacattttccaagttttatggactggctggtgcccgtctggggtatattttggcggacccacaggcaattcaagcctataatacggtgacagagccatttaataccaaccgaaccgttttagctggtgccgaagcagcgattaaatttgatcaggcacaatctgataaagcgttggctaagattcgcggcgatcgagcgatgttagttgaggcactgggattgttgggctgccaagttgccccgtcagaagcgaactttgtgtttgcaaagttaccggatgatgcaccaaatgccacgatcgtttctcagcggttgatggaacaaggggtcattattcgggatgggacaccttggggttttccaaggtacatccggattacaattggtaaacatgatgatttggagtacttcttggagaaattcagagccctcattcagtgagtataataattaagttgttcttgaagataacaaaaaaaggattcagtcagatctgacaccaatcctgactgaatccttagaggctgggataataatcattttgcccagtctttttttgtaaacgcgatttactacaaagcgaagacaaaaagcaacttccggtcgtgtaaccgagttattcaatattaaagcccggaatacctcgttggactttttctatagttgaaacgtggcccagcaaacagatcccggccatataagccccttaaccttaatattccaaaatcaggaataccttgttgaactttttctatagttgaaacgtggcccagcaagcagatcccggccatataagccccctaacttaatattccaaagcccggaatatttggttgaactttttctatagttgaaacgtggcccagcaagcagactccggccatataagccccctgacttaatattccaaagtcaggaatatctcgttggactttttctatagttgaaacgtggcccagcaagcagatcccggccatataaaccccttaaccttaatattccaaaatcaggaacattaaggttaaggggcttatattctgggatctaaacgcttgctgggccactctgtttatttttgaatatcatcaattacttttttcaaagcctgagcctgaaattcagcttgagcttgtttagcaatcttagcttgagcagcttttgacatggttgggtttttcttcatcgcggtcatgacttgtttagtgacaaatgctttaccttgagcctttaattgcgcttggtaagttttatttgccatcttcttttgcaaagccttggcttgagtagttgaaaggactaaccagtttttattaacgtaaagtgtgttttgacgcttaactaatttgtgaccttcatcagcgatgccaaaccatagcttagaggcattgtttttgtattgccaacgggtcgttttcgtgaccatatgggtcgttgcatttgtgcggataactttgttatgagtcgtatccttagcttgggtatgcgactttttcttagcatttgcggatgtttgataaatataaacctgtttcttattagctgttccaattggttgatacaataacatctgcatttgctttgacttaccaactgaataaagttgttggcttgttgttgtcgtcgccttttccataccgaagtgatcccggtcatttctaacgatgaagaatgtcgaagcaacggcacctagaatggcaatgaccgttaagatgttactcaacggcttgttttcgatatagacgaaaaagataaacgagaggacaacgctaattgctaatgtgagtaaaatcattatttttcaccatgtcctttcgtataatcgcttgattgtgcccggttcttcaagaagaaggccgttaccaatgcaagtagacagaagataaatgaaattaagaaagcagcatgataaccagttaaggttgcgttaatggcacttgtctgatatcccaaaggatttgacttcaatagatgcttacccggcatattgttattcgtgacatttgttaaaatactgattaagatggccgttccaactgaactggcaatctgtcgttgggtgttgttgacggcagttccgtgacttagtaagttaactggtagtgagttcattcccactgttgttgccggcatcatggccattgaaattccgaacatccgtactgcatagaagaagacaatatagatggtcgaagtatctttagtaataaagataaatggaatggagccaagagtaagcaggaacattccgataattgaaagtcgtttagcaccatactgatccacggcccgaccggtaattggactcataattcccatcatcacagctccggccaataatgttaatccggattcaaaggctgacattcctttaacaatctggagatacaatggaataaccatttcaactccaaccatagccatcatcgtaacggaactcaaaatagctgagatagtaaaaggtgttgaacggtaaactcggaattccaagaaaggttctttcattgttaattgacgccagatgaataaggcaatgaagactgccccaataagtaaggttgaaatcactgtggcactgccccaaccgtcatcacctactgatgagaatccataaagggcacttccaaatccaacggttgagaggacaactgataagacatcaattgcttccttcttggttggcaggaccggtttaacgaaccagaagctggccgcaatgactaggatcatcaaagggacgatcatcccaaataagtcacgccaagtccagttatcaatgacccatccggataaggtaggaccaatggcaggtgccagaccaatcacgattccggcaagtcccattgcagtaccacgtttagcgggtggaaagattgataacatgattgtttgaagtaacggcatcgtcactccaactccgacagcctgaattaaacggccagctagtaaaacgccaaatgtgggggcaatgtagctgacaactgttccggctaggaaaatcgacattgcactgatgtacaacatttttgtgttgaagcgggtacttaaccatgcactaatcggaatcataattccgtttaccatcatgaatccggttgtgagccattggaccgttgatgtcgaaacatcaaatgccttcataatagttggaaatgcagttgataggatggtctgatttaaaaccgtacaaaatgttccaatcagaagaatgataatcatcatcccacggttataagctttcccgttaatatcttgcgctttagccacgatttactaccttctttttctctaaataatttcgtctttcaaaaacgattcttgactaatataaactcatttgtgattattgtcaattatcttgacaactgtatttaaaaatatatactaaatgttaagaaatgcgcttcacgtatcagacaatttaataattaaaacgtgattgcatcggcaatggaaactgttacaaaattcaagaaatgagaaacgaggcctcagtgtggacaaggaatttcaacaaaagcttgccaaaatcctccaaaaaaatgactggcatcttggcatcggcgatgtcgaaaacgcaaccggtgtttcccaaacaaagttaaggtattgggaacgcaagggctatatcacgagtgaccaaggcaagggccaaaatcgaaaatttaaatatagtacattgatgaaagtttatcaaatgaaaatgctattagatcagggctatacattggcggttgccgctcaaaaagccaaggagaaggacaaaattgcccatttagtccaacaatttatttttgatcgctttgaaggagtggaaacgattgatggttatcccgcaattaatttaggttattttgatgatcagaatgatcaaatcctctacgcagttgttaaggataagaaaactgattttaaattggttgcagcgggtaatccgaacaaccaagaaggataatattgattaaataaatgaggagagattaataatggcagaaattcattttaccaaagcacagttagcaaagtttgatggtcaagacggccgcaaagcgtttgtcgccgtcgacggaattgtttatgacgtgactaacgtcgatgcatggattaatggcaagcatcatggtcatgtagcgggcaaggatttgagtgatgcaattaccaaggcaccgcataagaagtcggtgttggccaagttacccaaggttggcacgtataccaactaatcttttaaaaatgattgagagattggctacgaaattggtagtgggtctctttttgttttgggtgatccaataccttaactaattattttccaaacttttttaagattagggcttgcatttctatgggtaaaaagagttaaactgttattattaccaatttattgatggaggttttgaaatgttagagaaaacggtttatcgtgaactattgagtcgcgcgtttgatattccagtacaggtgacatactggaatggcaagactgaaacatacggtgacggagagccacaagtaaaaattgaaatcagaaaagaaattccgttgaaagagatgacttccaaaccaacgcttgttttgggggaagcatacatgaacggtgatatcgaaattactggtagtatccaagaattggtggcatcagcttaccgtcaagccggaagttttttgaccaacaatcctttcctaaaacatttaccaaagatttctcattctgaaaaagagagtgagaaggatgttcaaagtcactatgatattggtaatgatttttaccaattatggctggataaatcaatgacttattcgtgcgcttattttgagcatgatactgacactttggagcaggctcaaattaataaggatcgccatattttgcataaattaaagccggtggccggcaaacgacttcttgatgtcggcagtggctggggaaccttaattattatggctgccgaagagttcggtctgcacgccaccggaattaccctcagtgaggaacaatataaatacaccaagcagcaaatcaaggaccgtcacttggaagataaagtggatgttttattgactgattatcgtgaagtcaatgaccaatttgactatgtgacttccgtggggatgtttgaacacgttggtaaagagaatttaggactctactttaaagaaatcaagaagtttcttgtgcccgatggccgcgctttgattcatgggattaccggacaacacgaaggcgcgggggttgatccatttttaaacaagtacattttcccgggtggttatattcccaatgtggctgaaaacctgactcatattatggacgctggtttgcagcttaccgatttggaaccattgcgtcgtcattaccaaaaaactttggaaatctggtacgccaactatgttaaggttatcgatcaggttaaagaaaagtatggtgagccattctcaagaatgtggtcattgtatctccaaggcgccgcagcttcgtttgaggctggcaacatcgatgtgatgcagttcttattgacaaatgcgccaagtggtactgatctgcccatgaccagacagtatgtttatcaagaagaggactaatttggacttgttttaaagggcatgttttcaaatgttgagatcgttttttcgaacggccgctaaccgataatgtaagtcaaagtaaaagcacagctagcaaaacaagatttacttgttttgctagctgtgctttttgtgtgttcaaatttaatattgcttttggcttgatattaatgtcgatccagcatgactgacacgagcttggaaatgtcaccagcggctggtgaaaacttaagttgttcgagtggggtgggggatggatacggcaattcgccggttaacattgtgataatcaagtccctggccatcgctaatgattctgcttttttatcgccctgggtccatgtaccgccattaatgtcaggaatctcgacactgtatccaattttttcgggatgtaaaataatcggatagctgacctgactggtttgattgtttgacattctatcacctagctttctgtgcttttgttagttccgattgaaatattagttagcgatatttttatctttattgtaagtcattatcagtattatgagtaggtttgagcgctgttaaaccaacttgattgaggctgttgttaaaatttttgagaataatccttgctttaagtgcacttcaaggttgtagagtagaggtggattaagaaataacctggatgaggaaaaatggaggaaaaaatatggatacagtcacattaaataatggcgtcaaaatgccacaattaggcttgggcgtttttcaaatttcggattacgatgttgctaagcaatcggttttagacgggattaagaatggttatcgcctaattgataccgccgcagcttatcgaaatgaatcggctgttggcgccgcaattaaagaaagtggtattgaccgcaagaagttgtttgtgacctctaaactttgggttcaagatatgagctatgaaggtgccaagcaggggtttcagacgtccttagataatttgggtttggattatattgatttgtatttgctccatcaaccggttggcgatacgtttggtgcttggcgagcattggaagaattttatcaagccggtaaaattcgggcaattggggtgtcaaactttgattcagcacaattggcaaacttgattgcatttaataaggtaactccagccgttaaccaagttgagcttcacgttttcaaccaaaagcccgaggcaattgactatatgcgaagtaagggtgttcaaccagaagcctgggcaccctttgcggaaggcaaacatcatatttttactcagccattattgaagaacattggcgataaatacggtaagacgccttcccaagtggcactgagatggttattacagcggcatgtggttgcgattcccaagtctactcatgaaaatcggttgattcaaaacctggatgtctttgattttcaattgtcggctgatgatatgaaagaaattgccactttggatattggccatagtgaaattgtgaatcatcaagatcctaagtttatcgaaatgctggcagggatgaggattcatgattaattttaaccgtttctggcatggtaaatatgctatcatcgacttaaatgaatggatgaaggggatattgacatgtttaaaacgtggcgtcgaccaggtaaaattcttgaacaaaaaaatgtttattcaggcagagtgtatgatgttgatcagttgcacgtgcaaacaccggatggcttgaaagttgaacgggatttaattcgaacggatccaacggttaccattttggcaatgacggctgatgaccaagttgtcatgaccaatgaatatcgggtgggggtcaatcgtgattcggtttcactacctgccggaattgtgaatcctggtgaaaccagcgaacaggcggctgctcgggaactcaaagaggaaacaggttatattgccaaatcggtccaaaagatgactcggattacgtcatcagaaggttttatggatcaatttgctgatttgatgttaattagatttgacccggttgaccgcgtccgccaacatttcgataaggatgaatttgtctcaagtgccttggtgccaattgatcaggtagttggttggattaagacaggtaaggtcaatacggcacaatcggtttcttcagtgggatattatctgttgtttttgaaggggaaggaataaagattgccactaacttctcacattggataaataattgaatgatttgagaatattaagaccttatagagccatgttcttggcactgtgaggtcttttcttggtacttcattgtgaatgattggtagaaccatctgccaacagttcttttgtatttggatatacacgataaatgtgtgtgttctatttgtttaatttgtcactatccggaggcgttaagaagcttagaattatcaacccgacaaaagttattgtaatgccaagtatcggataaaaatagattccaaaggcagtggcaccaaccgacaatgggaaaaagattgatgctaagaatctaaaaggaaacattctgccaatctttttactaacggaagtattaatgtgttccggcatttttctaattgaacttgaaagccacagataagataaactccaaaaaacaaatacaaataaatatagatattccggcccggagtattgcgaaaattttccgacccaaccagttgcaaccggtaataaagacatgctaaaaagccacagattattcacccagtatacttttttagagattctaatggctaaggcaaacatgtagtgatgattgtaccaagccacgccgacgaaaagaaagctaacaacataagcaaaaaagtaaggtaattgggtgatgattccctcccatttcgcggtttccggtgttttaaattccagaatcataatggtgaggataattgcgactactccgtctgtgaatgcttcaacgcgtcctttattcatattctccctctttataatgaactatctgcttcaatcaaaactgtaattcgatttcctttggatcttagaagtgattttatacgctcttaaaagctgcctcaaattttttagtaactccggtaaattgaatatggaaaaaatcaatccaataattacccggataagtcgacaattgattgcattttcttccccaaatcattgtacctcattggtttattttagactgaagaaagactcgctacgaaacataaatttgcgtaagcgatttacgattagtcaagatatgattaacgatgaaaatcaccgcttttctaccatgctataatatgatcaacgattgttaattgcaggtgtagtccgatggtaccattgatgtgaaaggatagtaacgatgttatcgatgatttacttgatcctaatgagtttatttgccggcatccttacggggattgttggaatggcttcactgacattgtacccggtgttactttcgattggcataccgcccattacggcaaatgccaccattacagttgctcaagttggcgctggcttcagcactgttttgtcgtctttaagagaactccatcatcattggaagcaggcgctgcagatcgcggcattaagtacgactggtagtatctttggggcagtcattctgattcatagttccaatgccggattcaagaaggttgtgccaatttttatttttcttgccggtgtgatgattttaacgccaaaaagaaaaaataaccgggccagaacctatcagtggggaacgtatcttagctggggtggcgtcttgctggttggtatttataacggctattttggtgccgcatcgggcctgttaatggtcgcggttctttccaaaattgtccatgaagattatgcgacctataatgccatgcgtaacttttcttcatttgttaataatatttgtgcggcattgatgttcatttttatgctatcaattgactgggcagtgatcattcctttattgctggggctcacgattggcggctacattgggccgattattgttcgttatattccttcaaaaataattgaaggtgcggtgggaattttcgcgattatcttgggaatgggactggggtatcaggcttatctctaaatttgtttggctggctttatttccgacagtctagtctgaagagtcgagcttatgatgcctcattcgctagtcctcaaggtataattaaactgtaaagatgatagtctactggaatttcaagagggtgatggcatgacatttaataaaaatttctataagtcctatgggttctggttggtagttgtaattctgatggtaaatttagcagctgcttttatcgtaacgccaccaatgtatagtattggctggtggttggttatcattattgggattactgccgtgatcgcgatcgtctatttagggatgcgtgcggtcgatgaagcaaatcataaaaagatgtagtcaaaaaaagacagagtgaagcaatccttgtgatgatacaaaagtgggtttggcaaaatgattagtgatccactttcaataagcgcggcggttctttccattgggaaaaaccgccgcgcttattttgacttaaccagtggttgccaagcataaaaatttagctcatttattgcaacgacctattccgtgtgtcccagtcgtttcaaataatcggcaaaagcctcgctatcctgattattacccgtttcttttgcttcataccaattaattttatcattcaaaatttgtaagtgatgttggacctcgcgatactgattcataaaatctgctttggtatttttgagcaatgccagtcggttagggatagtttcgtcgcccattgcccgccaagttacgtactgtttgagatcgttaatgctcattccagttccttttaaatgtagtaggaattttacccatttaatatcaacatcagtaaaaactcggcgctcactggaatcccggtgggcttttaaaaggccctcgcgttcgtaatatctgatggttggggcacttaatccgactaaagacgcgaattcaccgattgaataagtcgttcttttctttaaggtttgcattttttctccatttctttgaatttatcattgacttaaagtccactttaagatgtacagtgatttttgtaaagatatttatagcgttaaagaaaggaagaatctgatgacagttaaaaataaagttgttgtgattactggtgcttcgtcaggaattggggaagccagtgcaaaattgttagctcaaaatggcgccaaagttgttttaggtgcccgacgtgactcacgattaaaagaaattgtgtcgcaaataaaagccaacggtggtcaagcagcctatcagacaactgatgttaccaatcctgctgaggttaaggcattggttcagttagctaaaagcgaatttggcggcattgacgtcattttcaataacgctggtattatgccaagttccccaatcagtgcacttcacattgatgagtggaatgcgatgattgatattaatttaaaaggtgttttgaacgggattgcggccgtaatgcctgattttaccggtcaaaagcacggtcagattattacgacatcgtcggttgccggcttaaaatcatttcccggtgccggtgtttatggggcgaccaagtttgccgtccgtaacttgatggaagtcattcggatggagagtgctcaagaaaagaccaacattcggacagtcacgctctatcctggcgcaattaacacagaattattaaagacaattagtgatcaacaaacgcgttcgggaatggatcagttataccaatccgttggtgttgggccggatgccgtggctcgggtcgttaattttgccgtcgaccagccggaagatgttgatgtcagtgaatttaccgtgtatccaacaaagcaaggataacgaaaaacgaggagaaataataatggtaaaaaatgaatcagtaaaaaacggggttatcttcccggcaggacctaagaatgacgcatttgcgaaatattttgttggccaaagttatttacaaggtctggttaatgatcctaacgttaatatcaatgtcggtaacgtgacctttgaacctggctgccgaaacaattggcatattcatcataatggttaccaaatcttgctggtaactggtggtgaaggctggtaccaagaagctggtaagcccgcgcaacacttagtacctggtgatgtcgttgtcactcacgatggggttaaacactggcacggggccactaaggatagttggtttgaacacatcgccatcacggccggaacgccggaatggttggaaccggtatctgatgatgactataatcaattggaggtaaagtaattatggcgaaaaaacaaaccgctggtcgcgataatttgggtgactttgcacccaaatttgcggaattaaatgatgatgttttatttggtgaagtttggtcacgtgagaaggaattatcagctcgggatcgaagcatgattacttgtgcaagcttgatgtcgcaagggctgtttccacagttggaagctcatatgaagatggcaaaacaaaacgggattaccaaggatgaaatggttgagttgattactcatcttgcattttatgctgggtggccaaaagcatggtctgcgtttgggcttgctaaaaaaatttacgctgataaatgaattgattaaaaaagggaatccattacctcacgacttaatgtgtggtggattcccttttgggttgaattgttgataattgatttggtttagctagttactcaggaaacatgtttgagagcaacttgggcaagaagtacttggaaacgtcaattggaaaaacgttattttagccgttaacatgaccggcgaagtttggcataaatgcgctattgatggtttggatttcgacgttttgaccaggttgtggtgcagcaacgtattggttatttccaatataaatagcaacgtgataactagcaccttgattaccccagaaaagtaaatcaccaggttgggcattcgaaacagtttccttagtgacatggctttcctgggtaaccgtgtagtgtcccaaactaataccagcggcttgttggtaaacatagtcggttaagccggagcaatccattcctttaagggattcgccaccccacacataagggatgttttgcccagctaactgtttagctaaattgacgactgcggttgcctttgatgaagttgtgtcggcttgagaagcagtagtgttggcgctattagctgcatagttagtgtttgtttggttggaatttgtttcctgactataattagtctggttagtttttcgtgtttggtaatttgttgaataagctgagttatgactggtataggtatcggcgttggcactcgttgttgaaatgccgaaaatggtaccagcaaatgctaaggctaaaagtgatttgctaaatttcaaaagaacacctcattaatttttatttgattcaaggccatgatacccgatcattttttcaatgaggttacagaaaatttgtgatctgttgacggaagatgtcagcttgaaatagtgttaaaactttgtttatgaggataaaaaattgcttaagatgcttgcaggattgataaaaatatgatttctgatacgaggccgcctaaaacaagttttaatcagtcggttaaacctaatcctgattttttcgtcaaaagcggctgaaaaaagcagctttggccaatattcccgagtttcaggaatgtggctaaaaccgcttatattctggaagctaatcgtttttttatcgattattcattattaaacttagtatataatttatcgaaattaattgtgcctagtccggttgcttgattataaagcttgccaggttggccggtgtagtataagttgttgttattatcagcatcatcgaggacgttaaatggggtatccggttgagcagcaaatttataaatctgcggattccagaacccaatccgagtttgccgaccgctattcatgactgcatttgccgctgccatttgtggcgaagtatagcttgtgccgccgccaatcatccaaattttagaaggaattcgggtgatctttttcttcttcatattgatcgcgattcgattacctgaaaaataagtggcatagccggttcgaatatcggcatttccggagacgtctggtaggtttctggaattcccggtgccaaaaataattcggggatgtttgttgatcaccatcttaccctttgcgtatttcagaacgtcaactgctctaaacgtgttgacaccggagaaaccttgttgatagcgaggtgtggggttaagagcggaaaaaccaccaccacttcctggaaagacaccctgtttgatttcggcagcagaagccgtgtaggtgtcgccccaggcccgttctttgtttaccgtgacaagtttattgttaatgattttttgataaggaagggtggtaccgccaacaatgacttgatatggcgaagaggttacggaatggttttcccgtttttgaggggtatcacgcggcccataatcaccactggctttgaagacggtaatcccttgagtggcagcttgttggagaagcaggttaaaggcatggttatattgtttgagtgatgaactatgatcggaccattgacgagctaattcaacggtgggggcaaaactggttgaaatttgcgaatccagattatcagaaattgctttggcaaaggttgaaaagtaaatagctggcgatgtcgtcgcgttgtttgcggaattgccgatgtagaaatcaatattggcatttggagccaccgcacttgcggattgaatatccagcgaggcctccatttggtattcagttagcattttattcatattgttcgttgatgtctttgcattgtcgacggtataaatcttatggattcggtctaaagagtcgttaaccccggcttgttgccaatatttttgcagatccccagttttaaagtcaccgtaagaaacaataccgattcgttgaccttgaccagttaatcctttattgtaaaggcgattcaattggtactgtttggcaaacttaccggcaccatatttgttggaaaattgattatcagacaaagcagtatcaggcttttcaccgctggttggcaggtcggcgctggccactaggtgtttcttagtagttgattttttgactacctttttcttgccagttacctttttagttgtcggcttttcagcgtaaacaccgattaccgcaacgacttgatcggatagcttaccgggtaactgatattgtgttcgggattctttacccttttctttaatatatttggctttaaacgctttgttcatattgacgcggtggcctttaacttgaatagccaaattgccagaaaatgtggttgtcttaagatgatattttgatagatattgtttaaacgaattgatgtaaccgtcagactgaccaaattttgatgcaaattcgttcggcgttaggtatttatgataatctgcggccgatggatcaacggtatcataaacatagtttgtgagatccgtttcattagttggcttaaaaacaacattggcaatagttgttcggttatcaggcttttttacctttgacttggcgttaatggtactgccggcgccgataactagtagtccgcttaacgcggcaatgatgacttgtttcccccgcatattaatccccatccttcttgaaaaatcgaaaattgattatgttaattataacagtttggtcggacaaacctttatttcggtacttattaattttacttgcgttgaagtgtacttcaacgtttatcctagacattagaggtgagataaatgaaacgattgtttgttaatgctagtagtgaacctgatggacaaacggcgaggctggccgctgaattgtttggtgcccaagattaccaaacgttaaacttagttgattatcatattgcgcaaattggccagaaaactgatggtcgggatgatttcaaacgggtttgtgatcagattgcggatgctgacatgttagtcatggggacaccgatttattggtcggatatgacgggttacatgaaaacatttattgatcgaatgactgatgttagactaactactaatccgtttaatgggaaaaaattatatttaatcatcacgggaacggctcctcaagatgctattccaagcgtgacacatgtttgggaacacgttgctcaaaggtatggcatggcctttagcggggttgttactgattccaaacaggcaaaatcaattcaaatcgattagcgaggtaaaataaatgaacattaataaagtaagtgaagaaatggctgtttccaaggatacattgcggtattgggaaaggatcgggctacttcccgaagttcaacgtaatgacagcggttatcgtgattattcagagagtgatatgaactgggtgttgtacattaaagcattgcgaagggctgggatgtcaattgagtcattaattgattttgttaaactgtatcgtgagcccgagaacactaaagctgccagaaaatcattactgatggaacaaaagaaacggcttgaagcacagcaacaggaaattcaaaagtcactgaattatttaaactttaaaattgaacattttgatgatcacatgctgacatttgagaatgaaaagctgagttaccgagcaacagttacgaaataggtgagaacagccaaagataactaacgttgcagtggtcgatcccggatagcatgcaatcattctaaaaaagcgttatcagcgactcgaatagtttagagtcgttgataacgctttttagaatgattacttttaaatgacgaattgaattgccatgatgaccatgataattcccataattgggcggagaattgcagttactttgcgcggatcaaagtgggccagaatccgtggcataattgcggcaccaactagtgatccagccattacaaggagaccaacctgccaatcaatatttccctgagtggagtggaaaaacaggccgatgattgatagcgcaattagcacgtatgaggaagtggctgcagattggggcatgtttaatcccagtaacaataaccctgccataactgggccgccgccactcatcccggcgatcccgaccattaagccgctcagcgcgccaaacaaatagacagtccaaggcttcaaacggctctttttagaacctttcaaaaatgattgacgaatcgtctggattcctaaaataaataaaataatagcgattgcccatgtataaatgatgactggaatatattgagatgacagactcccaataatcgttgctggtaacgccgtgattaataatttgttgccgtaactgaatctcatattgccagttcgataatgactatatgtaccgacgattagggcaggcagtgcggtaaaaagggatgttgccgcagcgcttgaaggtgacagatgcgcaatgctgaccaaaataccaaggtaaaaggcaccgccaccaccgcccatactaatgatgaacgccccaactaaaaagcctaagaatattaataatgctgccaactaaaagcctccttaaaatgtgccataaagtcattatacacgtctgccaaatattatttacatggaatgtaattaataatgactattaaattagaatcattattgaaagcaagacgaatttgttttacactaaatatagatttaaaaattaattggaggcttatcgatgacaaattttattggcaaagaagttgaagattttaatgtaaacgcatttcaagatggtgacgttaagcaggttaccaagaaggatttattaggccattggtcaatcatgttcttttatcccgccgatttttcattcgtttgtcccactgaattgggtgatttggctgatttatatcaatcattcaagaagattggtgccgagatctattcggtttcagaggacactgagttcgttcatcaagcatggcatgaaaagagtgaggaagttggcaaggttcagtatccgatgattgctgatcctgcaggcaaacttgctcggttctttgaggtgctggatgaagatgccggccaagcctaccgtggtgtctttattattgaccccgaaggcaaagttcggtcatacaccattaatgacatgagcattggccgtaatgccagcgaagtattacgaacccttgaagctgctcaatttgttgccgaacatggcgatcgggtttgtccagccaattggaagccgggtgaaaagacgttgaaaccagggacggcgttggttggtaagatctaaaatatcttaattaacataacagttttcaaaataatactttttccttatttcgggtttcattttaaatcaaagaaaatcactatttttcagtttgtaaattacgctgcaaaaatagtgattttttgatggtttatgtgtccaactgttcaatggtctggaataacattcgcacaaactgttttgcaagttctggttgattcagttgaacggtgatgcccttgttttgattgaaaccagcatcagaactaagccagagttgatctttatccacaatgagacaatttggtaaatttcgatcataacgcgtatataggacatgatattttttcaagagttctttctgataggaagtgatttcgttggtgagaatattaattttgcactgctcgtttgagtgcattaatacctgctctaaaataaattttgaaatttggttcgcacagatagtcagttcatgcgcatctttaattgaatctaaaatgggatcttgatagttgccttctagaaacttaatgccggattgttggctgtactggtcatttacaatttgataatgtaaataatgatatgttttttgacgtttatgatacattttagccaacattggtacaaacatatctacataatcgtaaactcgaatttctggtttttggtttaaatttcgttgcatacgacctaagtattgttcactgctccctttccaagaatgtggcattgctagaattaatgtgtcaattgttgcaatatccagtccttcaccagcatattttccagtcgcaattacgacgtaaggcccttttgtattgttaatatgctgaataactgctgtatttagtgcatctgtttgttcgccgtacagaagaaaggccggttgatttttgttgagtagtttggctagttgatgaagatgctcgattcggttggttaacacaagaatatgccgtttctcatttaaattgtgttcaatatctttgattaatgatcggtttcggctatcatcatgtaaaatcgcttcatagtttttgttaatatcgttatttgcaatttcaagatttgtgatacctaaacttgtaaatctagggattacaagtcgttttacttttagaagtgttttttcatcaatgggcgatgtctgatatcgaattgcaccaaaacgcatggtaataatgggatcttggccatcacgtcgaaagggagttgctgataatccatacagatatttacaatgtaactgtttaataatttgttcgtaagtatatgctgcatcatggtgaacctcatcactaatgactagaccgtattggtttaaaatatcctgactgattttgtcttctttgaaagattgaacagtggcaacatcgataatcccacttcgattgtgcttagcaccaaagtaactgccgatgacctttttttgacgttttcggccagtaggggttagttcagtaataaaaggtttatctgtgactttcaaaaattggtttagccgttcgatccactgcttagcaagttctttatcgtgaactaaaattaacgtgctggtacttagatgagcaattatttttgccgcaataaccgttttgccgaaaccagttcgagccgcaagaaccccggtagtgtgatgaagaagtgttttaaaagcgatttgctgttctgcccttaacgttcctagaaatgtcgtatgaatttttctacccttgatcgttttgtcgatccaagtaatatgtggaatcatttcagtaagcctgtcttctaatccgcgaggtaataataaatattgattattttcatcaaaaacgttaataattcttggaacattgaaagttgaaactcgttgatgttgtttttcatagaattctggattttggaaagatgcgaaccatttaagctgcattatttgttgtttttttagatctgatttatcaatgtaaagttcatttgaacgaattattgttaatggttggtcaatattaagtggttctttaagtaaattaatttgggattctttatcatcaaaaagttgaaagtttgattgaagctttaaattgctcactaattgatcgagctttttttcatcaattagttcaatattacttaaggcttgccattgattaggaattggttgaaaagaatgatctatgaacacactttttccttgtcttcttcgttctccttgcaatgggccggcaattaaattaccaatttgcttgctaccaataatatcttggctcggaaacattcgatcaaatgcactaaatgataaattaggatttacggccatagttgctttcaaaagtgtatcgccgagttgacgagccttcgaagcgggaaccagttcttggaagaaaatccacagatggcatccgtgccctgattgtgatagttccgttaatgcaggcaaatgatgttgttcacaaattttacagattgaagtcgtaatttcctgccaatggtttccctgatgatggccgtcaatatcaatcaccaaatattttgttgtattatctggcagcattggataaaatcccagaaactgcttaccagttaaatgttcttttaatgcggtatccgttaacggaatccaggcatttaaaagtggtcggccattcttaaatggcacaactggggcatacatatctctggcagcttttttattataatagcgatgtgcatatacgtccgtccggtcaatgaaccgtttcttatataaatttaggcggccttgtaaaacatcttcattatcggaattggagtttaaaaatgagcttaagtctaccattggcatcacaccaaataattgtgtgccttgttgtcggaaaacgcccattttaccttggtttgattggccgaagtctttagctgttgctacgagctcatagtgtttaccattcatctgaaaaagcggaaaatgtttcgccatttgctatcctcacattcgtatggttcattatcgtttcatctaaatcaacccataatgcttcaatccctccaagacgccatgatcactctgggccacataggtcgcccgttgtttcaatcccagcgttgcctgtttcattgcgataccgtaatcagccaacgaaaacatgctaagatcattgttttgatcaccgaaggcaaacgtttcaatgttggaatgaccgactagttttttgatcttttgaatgccttgtgcttttgaaatttcaattggcatcacatcgacagcgtcgggcgcatatcttaaaatactaagttgatttttgaatgcagtttgatatatttcttcacgggtgttcataatgaatagattgaggaagttgactggttgctgaatgaagaaatcgtggttaatcgggacatgagtgagtcgcattcgatcgacatgtccacgggtgactggattcataccagaaattgcaaatccttgttggttaaaataaccgaccacatcatcattttgatctgctagtgtcaggacttctttaattcggttaattggaaaatggtaattctgaattacttggtcatcatgaacaatgtagcagccgttagccaaaatgaaagtatgcaagtccaacatttttagcaaatcgtgaacttcataataactgcgaccagttgcaatcaccggtaacacattttcatgttttagtttttgaatggcagcaaaggtcgtctgagtaacggagaggggaccgttatcacagagagtgccgtccaagtcaaagaaagctaatttatcaaccatcatattttctcccataaaaaatattgccgcataagtaaagatccgaataaataagatgttgaattcattttatattcggatcttgttattaatgctattttattgtaaatgattgttaaacacaaatcctttagcgttatttcacgaaacaaaattaataaaatgacggtttgtcaaagttggtatttggttcgttaactcccaaactttgacgggcatacttaccggtttcatctttaagaatggcggtaattaacttagcaactgcttggcgactaacctcagtcccaccaaagggttgaccactatcggtgatttcgtaggccgtgttcttgtcatcgttaaataaccaagcaagtcgcaggattgtgtagtccaaatcggaatccttgatcacggctgccgtttttttacgtcgagtaatggaactttcaatcatgctggtgttccaattaccaaaggcacccttaacttcatcttcaataccaaggacggttgcgccgataaattgtttgactccgttatcatccattgccgagacgatctttttgacagatggcagatcacgcatttcgtttaagtaaacggcatcgacatccttcattgcgatagtcaaagtttgggtatcattaaaatcaccatcgatcactgtttcacgactgggatcagtgacgttgattcgcttggtggcatttcgagcaaataactttagtttaaaatcagtttctttcagtagttcggaaacgagataactggaaatttgaccagctgctccaagaattaagactgttttcaattaaattcctcctcatcattataaatccggaatagattccaactacactataacgcaaaacagtacaggcactgaaacattcggattgaataattctatattgaccttaagtagtctttcgtaaagcgggacgccaaatgggttatactaaagttggcattaattgttcaaagattaacaagtgagttaaaattcattgatcgcagggtgcatcgaatttggcagtcagggggcggataatcatttttacgacaatcattaccggatttgtctcatttgttgggactaatgttgatgatacttttgtactggcaatttggttttcccaggttgactccctattaagaactaaagacatcgttttggggcaatttttaggatttgaatttttagtcttagtcagtgtcttagcggcctatagcctaagctttattccaacggataaagttggctggcttggggttgtgccaattttcttgggaattaagcgttggctccagtatcggttgcagccccgtcgtgatcctgaagaggacgaggttaaacggaccatcagccgagaaaaagatgaccgaccaaaaggaaaatgggtgactaaattaattcgtccccaagtcttgggggtctcgttagtcaccatttcaaacggggctgggaacttaaccgtttatattccgttatttacccgctatacggtgccggaattaatcgtcaccgtcatcatcttcactttgatgacggctgcatggtgttatttaggctttagaattgctaatttcccagtgattaaaaagcggcttaatcagtataagcatgttttgataccggttatctttattgttttaggcatttacattttagtcgacagtgggattatttgatggcatttcgatctggtcgccgccgtcaaagcgccgatttaaactggtggcgaaaaccgctggtctggtcgcaaatgaatcaagttcaatggggggcaaaaggtgattacgcggcagaaagttgttcttttttcatacctttacttggtaatcattgtaagcatacaaaacgcgtggctgagacaaaattacttctgtctcggccacgcgtttgtgacatcaattatatttaattactcccaggttagtgatggtaatttatttagcttgttcattcttcagtgctttttgggctgccacattcataatgttccaaggacgatcgaatcctggttggaagaagaagtcagcatatgccaagtcatttaaggtcattttaccttgaattgcaagactaatggcattaatattggccgttacatcgcgcttggacatgatctgagcacctaagattcgcttgttacttggatcataagttaatttaaagtaaacctttgtattaccagctgtttccggcacaaatggtggttgcgtcgtgtccgtaacaaagactgaggcagatttgacgcccaatgcatcagcagttccctgcttaacaccagttgaggcgaagtgataatcaaagactgagagggctgatgatcctgaaatagcaggcattgtcatgtcgtggcccagaatgtttttggcaacaacccggccttgacgacgtgcattggtggctaatgcgatttgacgctttttgccagttggggcaaacggcacctcggtactatcaccaacagcgtaaacatctggttgattggtttccaaatggtcgttaacgttaaccagaccttttttacctaattcaagggttcccttcaaccaatcggtatttgctttaagaccggcagcttgaataaccaaatcacttgggtattctgcttgatcggttttaaccgctgttactttaccattttggccaacaaattccttcactgcctgaccagatgccggatagatattgtgagctttaagcgtctctgccaaaatatcagtgaattcctggtcaagataaagggcaagcggccgtggcaacatatcaatcaaagtgacatgcttgccagccttagcaaagacttcagcagcttcaacgccgatgtaacccgcaccaataacggtgacattttcaacatccgggtcaactgtttttgctttaagcttaattgcccagtcacggccacgcattgcataaacattttgcaaatcattgccgggaaccggaatggttgctgggacggcacccgctgataagaccaacttgtcgtagttttctgtcctggtagaatcgtcatctaaattatgaacggtgacctgatgtttatcagggtcgacatgggtgacctcctgatgaacgaacacgttaacgcctttagctcgcataccctttgctgttgcgtaacgaacactgttaacattcttgacgacaccttcgagataaagttgcatcccacatgacagaaaagaaatgaagtcacctttttcgtaccattgaatctcggtgtccggcttttcagctaaaaggccgcgaaccgtttcgaatcccccgtgtgatgaaccaacaacaataactttcatgtttatttccacctttcgaataatgtatcaattactgaattgaaattgacagttctaatatgtgttagggagtaccaggtaaagatctgatgaactcctctgtatttactttaacatatatcaagctaagattgggcgtcaatttagaattattctaaattagacgaaaaaattcattttaaatggtcataaaaatcactaaaaagttattgttcgggaatttaaatactgtcaattcagcaatgaatctcaatcgtcgagaaaaagttcttgtgaattatttatattccttggattcgaataattagaattatttttaataaaaaacggacagaaaagatttgtgattaagtagtcgtcacggatcactccattagttgtccaaatattgcaagacaatggctcccattgcttttgccgcaattaaaagacaacgttcatccatcaaaaaatcaggactgtgatgtgggtgaatttgaccgtcagcaacgtcgcagccgacgtatagaaatgaactgggtcgtttctgcgcaaaataggcaaagtcttcggatgggtcttgaggaccaaagtcggtaatttccaaaattttagcggtcctgatggcttcaacaacttgatgagtaaatttaggtccattcatctttaagattcaaacttttttgcatgattgatgagcctgatgagtagtggcttgattcgataaaaaacaacttccgctacgacaaacccgacagctaatgagatcgcaattgtcagtgaattaaacatgtattgtgatgtgcttgattcttttcccaacgtaaagctgcgcattcctaaatacataatgccaccaggtaccagtgaaacgaggctgggcacatagataatattaaccgggacccgaaaaagaacggctgaaatattgccaagaattccgatcacgattgcagccgtgaaattgggtaatattagcccgtggttcacctgtaaaactaaataataggcaacccaggcaactgagcccgtaatcccggctgccggaagtgatcgacggggaacgtttgtaatcaggccaaatccaactgaagacgcgaagctcacgataaattcgattaaaacgtccatgactaacctccaactatccctgtgatcattgaacatagcgacatgccgatgacgacgccggcaccaattgagccggcgatgatgatagcatcgactgcccgaacaagtccagaaattgtattccgatcaataatttcgcgaaacgaattggtgatggctactcccgggacaagtggcatcagtgcgctgacaatgatattaccggcgcttgtggcaatgccaagtgtctccaataatgttgccaagaaaccaatgataaatcccccacaaccggctgcaacgtaaggggtcatgatatgtttgcccgcccaaacagcaataaggtagccaatgatcccaacaaaaaaagccaatgataaatcggaccaggttgctttaaacagcagcatcggcgcaaccgacaccatgcctgctcccaaaatctttaacggccaattgaagtcgatcactttccggtcaatttggtcgatcttttcttcaagggtcgtgaagtcgatttttccggttacaaattcgcgagaggtggtattgatctcatcaactttttgtaaattgaagtctcctaaacgggcctttaccaaatgcgtcttggtttgatttttaacgccgacaaacaaggctgtgatggtggcatgacatgtaatctcaaaatgggcagctcggccgatatattcgacggtgctttcaacccgggccgtttcggcaccactggtcagtaaaattttaccaattttgccgcagacggcaattaattcatcttctgaaattgaattagacatggttcgctcctcggttctctctttttatttattataggcgaaattgatggcagaaaaatagaaaactttttttggtgaaagcttgacagcctggattaacgatgatagagtaatgacaattattaaagaaacattagacgttgaagagaagagtagcgtttatgcgaatttgacagagagctttgtttggtgaaagaagcaatttgcagcgacgtgaagatgagctctgagtctgacatccggttcaaaggctagggtgtccggtagcgaccgatacattgcggggtattccacttaaagggagtacctgtcgaggttgttattgtgaaatgacaacaaatcagggtggcatcacgaagctttcgtcccgtagcgatatttagttatcgctatgtggacggaagcttttttgtttttaattaatgacgcaattaaaaagattgctcttagcgcgttacccattaaggagatgatctggatgacagcaaatgcaacaaatggatttctacatgcggctggtgaatggcctaatcgggacttacatcaaccactatcgattttaattttgaatttaatgccgaccagaaaaaatacagaacaacaatttttatcacgatttaatcaattggattcagatgctgtactgacatttatgtatcctgtcagccatcatttccatggcactccgcgtaataagattcagcaagattatgttaactttaatgagattcgcgatcagcattttgatggcttgattatcaccggtgcgcctgttgaaaccctgccatttgatcaagttgattattgggatgaagttcaaacaattattgaatggggtcgcacgcatgtgaccgaagaattagatgagtgctgggctgctcaagcaggtttgtatcatgattttggaattcaaaaacgattgttgccaactaaattatttgggatctttaccgcaaccaaagtcgcccatgaatcaccgttggcacgcggctttggggcaggagggcttctaaaaatgccacaatctcgacatactgaaatcgtgcttgatgaaacggcggttccaaccggtttaaccgtgattgcctctgcaccgcaatccgggccaatcattttatcagcaccgaaatatcacaccacatatgtgaccggtcatcctgaatatcaggaacagacccttgccgaggaatatcatcgtgatcttcagaagaatctgccaattcaactacctatcgattactttacaaattccgatgcaaccgaggttcgatattcctggaaggatgccagtcagcaattttatcaaaattggacgcaacttttagtagatacgaaagtgagattatcaatatgacagaagaaaatttagacaaaaacttacattttgaaacattacaagtccatgctggtcaaaccgttgacgaaaccggttcacgagcagtgccgatttatcagacaacatcttatgtttttgacagtccggaacaagctgccggtcgctttggattgaccgatcccggtaatatttatacccggttaaccaacccgacgaccgatgttgtagacaaacgggttgctgcacttgagaatggaactggtggtgtgaccttggcaaccggatcagctgccatcactgccgcaattttgaacatcgccggcaaaggtgatgaaattgtttcggcaagtactttatatggcgggacgttcaatttatttaacgtgactttgccaaaactgggaattaagactcactttgttgatccagatgacccggagaattttgaagcgccaattaacgaacatactaaggcactttacgttgaaagtattggtaacccgggcattaacttggttgactttgaagccatcgcggccgtagctcacaaacatgggattatcttgattgttgacaatacatttggaaccccttatctggttcggccacttgaccatggtgccgatgttgtggttcactccgcaactaaatttatcggtggtcacggaaccacaatgggtggtgttattgtggagaatggtaaatttgattggaaagccagtggcagatatccaggcttcactgagccgaatgcccaatataatggattggtctttgctgatcttggcggggctgcctttacgaccaaggttcgggcagaatcactccgggatcttggggcaaccatcagcccatttaattccttcttattacttcaaggattggaatcactatcgttacgggttgaacgccatgttgagaatactaagaagattgttaactttcttcataacaatcccaaggtggcttggattaattatccgggacttgaggatagtaagtatcatgatttggctaagaagtatttcccaaagggagttggttcaatcttcactcttggactcaaaggcggcgaaaaagccggcaaggaattgattcagaacttgaaattattctcactgttggctaacgttgccgatgccaaatcattaattattcacccggcttcaacgactcatgcgcaacttaatgaagaagagcttaaagaggctggcattaccccagacttaattcgggtttcagttggggttgaaaatgcagatgacttgatcgctgatttaagtcaagcattagataaaattccggcagtcgaagaagttgatgaaaaagtgggggcaccaaaagatcgtgattagttttgttgcgatggcgattgtggattaatgatgtgcattgcttgagtgcatattattgataaaagcgatttaatttagacttagtgaccgaataaatcaaccttaattttgctaaagatatattttggaccccttcttagtaaacagagtgggccagcaagcggttagaccccagaatataagccccctaacttgatattcccgattttggaatgttaagttagggggcttatattctggggtctgcttgctggcccacgtttttactaagtaacaagttaagcgagatattctgaacttggatatttggataattcggttacacggccggaagttgccttttgtcccgcgttttcgctcggtaacaatcgtggttacacgaacagaggctgggacaaaattacatttgtcccagccccttttgttgctgatcagtacataaatattcgttatttcgataatcgtctttaacgtaactaggtgaataatcatcataaaggtgtataaatattgattttaaaataaattaatgaataaatctaaaaaagacttgcattttatgctatcccgttgtaagctgttttcaattcattaatatacgaaaataacgaataaaccagaggcgatttgatggaagtagcattagtggggattacgggatatgcaggaatggtgctgtaccaattactgcaaaatcaccccaacgtgaccaaaattcatatttacgatcataacttaaatgaaccaaccgaattaaatacaatcctaccaattttccacgatgatcacactgaagttcttccatatgaagactctgatatcgttaacgataatcaagtcgctttttttgcaactccagctggtgtgacttcaaaaattgcatctgattatatagaagcaaactttccggttattgatttatccggtgatatgcggctcaatcagagtgactatgaacactggtatcataagccggcagcgtctcagcgcgatcttgatcaagcccaatatgggttggcggagtttgaatcagcaagcggccattcatacatcgccaatccgggatgttacgcgacagcgaccttgttgggattggcacccttaatccaacagcatctaattgaactcaactcgatcattgttgatgccaagtcaggaacatccggggcaggaaaggctttatcgcctctgacacatttcactcaagttaatgataatttgcagatctataaacctaatacgcatcagcatattcctgaaattgtcaatgaactgcaaagctgggatattaatgtttcggccattcaattcatgacgacgctaattccggttacgcggggaatcatggcaacaatctatgcgaaggctaaaccgggagttgacggaattatgatcgataaagcattttctcaaacttataatgataaaccatttgtccattttctgggcgaaaccttaccggatattaaacaagtggttgggactaataactgcgatattggtgccatctataatccagcaacgaacactgtaacaattgatagtgtgattgataacttattaaaaggggcagccggtcaggcaatccagaactttaatcagctgtttgactatccagaatcaagtggcctgaacttacaaacgtttttaccttaacacttcattttgagaggaagagattgacatgcagatggaaagtgaaaattcaattgaaattagtaaatttgagtggccaaacggtttttattcggacgcggctcactcgggtttaaaggcgactggcgatgacttgggatggctttattccaaggtgccggcatcagccgctggggtttataccactaatcaatttcaagctgccccgacgacgttgactaaacaaaccattaatcttgaccactgtttacaggcaatggtaatgaacgcgggaaatgcaaattcatgtaatggtgaccaggggatgactgatgcagaaacgatgcaacagttagcagctgaaaaattagacattaatcccaagctggttggtgttgcttcaacaggtgtgattggtgaattactgccaatggtcaagattgagaatggcatttccaaactggatttgactaaaacagatgcggtgacgaaggcaattttaacaacagacacccaccctaaaacaattaccgttaaatgtttaattgataatcagctggtcacactgactggcttttgcaaaggctccggaatgattcatccaaatatggcgacaatgttgggctttgtgactacggatgcggtgattgccggtgaccaactacaatcgttattaagtacgacagttgatcagacgtttaatcaaatcacagtggatggcgatacatcaactaatgatatggtgattgtgatggctaatgggatggctcaaaaccaaccgctgacaacaaatcatccggattatccaacctttgtttcagcttttaaaaccgtcttaactaaattagcacaggccattgccggtgatggtgagggggcttccaagttggttgaggttaacgtctctggcgctgctaatcacaatgaggcgcaacaggcggctaaagaaattgttggttcaaatttagtgaaagcaatgatctttggcgaagatgccaattggggccggattatgcaagcattgggacaaaccaacgttcatttggatgtggatggagtcagcgtatcagtaaatggcattcaactcgtaaaaaatagtatgggaaccggctttaatgaagataagattgccgaaagcttaaaggccaaaaaggtgacgattgatgttgatctgaatgttggtgatgcatttggcactgcttggggttgtgatttgacttataaatatgttcaaattaatgcggcctaccggagctaaaggcttgatgagggaacttagtgtccgtttcaaaattagactgatcatagtgaccgattcttcagtcacagcgattgaatagataactgttatgccattatttaaatttaacgaggtgaccttttatgagtcagacgattgtgatcaaaatcggtggtaacgcaaccgatcatctttcaacggaattctatcaacagctacatcagtggcatcaaaagggcgatcaaattttgattgttcatggtggtggtccccaaatttccaactggagttcaaaattaaatttacctgttaaaaagattgacggaattcgagtgaccgatttagaaacaattaaagtgactcaagcggttctccttgggttagtgcaaccagcattgtgtcagcatctcactgctaatgaactgccggttatgggcctaaatgcaactggtcatccagtggtctttggtgattatcttgatcaaaatgtttatggtgaggttggtaaagtcaccagcatcaatcaaaagtacataactgaagtcctacagcagcagattggtgtctgcgcgccgttggttgtcactaaagcgggcaaagtcttaaatgttaatggtgatgctgccgctgctggaatcgcccgactgattggtgctgacaaattaattttattgactgatgttcccggcgtcatggttgccgatcacattgttgacagtttgacccagcataaggcacaaaagttgcttgctaataatgtgattaaagcaggcatgaagcccaaaattttagcagcgttcgaggccattcaaaatggtgtcaaaaaagttgaaattacaaatgaaattaaacacgccggaacgcatttgatggcaaaacaaattgtctgttaacgcatgttgatgatcagaacgcgttttaaaagataggagaaaaggataatgaaacatatttttccaacatataaacaatatccgatggaactcgtttcaggccatgattggcatctaaccgatgagaatggcaagcaatatttggattttacaagtggcattggtgtctgcagctttggttacagcaatgattggattgaacaaagtgtcctgaatcagcttggaaaggtttggcacacttctaatttatatccaagtgctttgcaggacgaggttgctaagatgttgtgcccacaggggatgttggcatttttctgtaattcaggtactgaagccaacgaggcagcttttaaattagcccgtaagtatacaggcaaagcgaaaattcttgccttcaatgatgggtttcacggtcggacgtatggatcaatgtcgttaactgggaatcccagtattcaatctggatttgcaccattagtgccaggaattgattttgccgactataatgattcgagcgctgtcggtcaaatcacaagtgattacgcggccgttattttagaagttatccagggtgaaggtggcgttaattctggtcatggggactggttacatgcgatttctaaaaagtgtcatgatcagggtgttctgctaattgtcgatgaagttcagaccggaattggccgaacgggcactcaatttgcctatgaacattttgatatggatccagacatcattacctgtgctaaagcattagggaacgggttaccaattggagcgatgcttggtaagcaacaacttgctgaggcgtttggccctggttcacacggcacgacctttggcggcaacaaaatcgcgctttcttctgcaaaggcagttttacagcaattaacaccagattttttgcaaaaggtaaccagtaagagccaagctgtgtttcaacaaattgatcagacaattgctgatttaccaattgtgactaagatcagcggcctaggtttaatgattggtatccatttgaactcaaaagtaaaagttgccgatgtgattgcaaaattgcaggaacaaggaatgttaacgttgcctgccgaacataatacgttgcgtttactaccaccacttgtaatgagtcaggttgatttgctgaaaggaattgacgtgatcgcaagtgttttgaaaactgcttcggtaaaggtggagacgttagcgtagttgctggggaattaaaaaagaaagagtggatgaaggcggcagaaagttgcctttcgctccactttttcactcggtaatcattgtaattatgcaaaaaagaggctgaggcaataatcaaaaatttatatgagagcgcctcagctccaaagtgaagatcccgtaaaatcagcgtttttgtaaactgattttacgggatcttttattgactttacgcagccactttttgggggatccttatggtagagatgattggttgggtgcgttgctgcatcaaaatgttttggttccgtgtaattggaggtgtgggtaaattctactaagccaaaacgagcatatcttggccatataacacctctaaccccatatccccaaacccggaatatggggttagaggtgttatattctgagatctaagcgctcgttttcacactctaatctaattccccagttgacgtcatcaactgtgccggccacaacgctaacaaatagccgcgaccattttggtcaaacgataagctttcccattccttttttgaattgaaaactgagtaatgaatatcgcttggcgtaaaactgccgtcacgaatttctccagttgggatggaagttaagatatcgtcagagacaaagtatagtcgatcattggcaggattggcactggttccctgattaggtgaacttccgcgggttttgacataggatggggatgcttggaagtgaacggaatgttcatctaggcggccaaagaagaacatgtagcccatgccattttttcgaccccaataagcattaccgtctttatcaaaggcgagggtatgcaattgtaaattggctgaatcgccatggaacattttaaagttatattgacgaattggattcatcgtttcaggatccagttcaagtaccgtgttattttcatcacggtttcgcaaatcagttagcgtattatcctcaaccatgtaaagatgtttattttgaggattaaaggttaaggtttgtccgtgaccaatgtcgacttgtggactgatttgggctgcctgggcgatatccgcatatttgaagagttgaggatcttgttgtttaacggttgaaacttgtttttcataaccggcaattttggcgctggtctgtttaattagcttttgataaccggttattttttgacgagcagtcttgtaggctgcctgccatttagccagtttggcttttgctggtttatccgctttttgagctcgtttttgccaatgcttagcccattttttggcgtttttctcgttgttaagtactgtattcattgatgacttttcctgatcaaggctttggttcaatagtttaatttggtcaaatggtcctttcatttgctgatagtcattttcatattgttgattgtgggcaactccttcatcagtataggggttaaagtagttaaatgcattccagagagccatgacatctttatcagcaccgagttgttggagtttggcgatgttaaatttaataatgacacctaggttggtatcgctgccgttggattcgacaaagtaaacattgccggcatcatcaaccgccacactttgaaaattaccatgctgataattggtaacgttaaaaccatcgggtaagtaccatttggttttaaaactattcgatgatgtactgccgttgattgttgaaaaggtatctcctggatttgttgaggtgggatcaatcgttgtctgattatattttcgatccatgttggcgatgggggactggttatcaactgcattcaatttcttttgagtataatcggttaagacattgccggcattaatttgtttgatattagttgcaggaaccggcgtctcaatcacatcagcctgagcattgccggggctgaccgtaaaacataaggctgccacgattaacccagccgttaatagtaatttaaaatgtcctttcataatctgaaatcctcgtttttctataaatttcgtttatcttttaagatacaactgacgatttagcaaagcgtctgtgataaaaaatgattgtgatattggctgcggtatttgatgataagtatcgccaagctatatcggcaaatcactggattattaaattaacagctagtcactatacgtgtaataaacctttgcccggttaccggatgtgccattatccgcgtgactagcgtggtattgaatggtttgccagttaatcgtaacggtgccgtcattattcttttggaagactgggtatttaggcgactgaagtgtggctagttcagtttttccatttagataagccataatagtttcggctgttaaatttgtgccattttggctgtcattactgagcgtgagactgccaggattaatatactgaagcgttgctgccgatctaaattcatcgttgatttttgtcaggtcagcatcgcttgcctgactaagcgaactggttagtttggctttgtcggaatcatttaagttggcgatctgggttgcacttaacttactgtaataaggctcgtcgttgtcagtaccggtgaattcccaacttgcgttaacgtattggtcagttgtggcggccatctggcgggaatcactgctggcagcattactgttataaccgtatggaacgagtgaacttcctttgccactattggtactattgacatcgatattaacagaagaaccaaattttgctgcgcccaaagttgcttgttgcgttgctgataatttatcacctgtcaggccgtaacccgttcctgataaattggtttttgccagcgctgtgatcccggtaacgtcttcatcagcaagcacccaagcaccatttgattgagtgcctaaagtagcgcccttttttgcaggatcatcggcatccgtattcacataatccactgatttgatgacttttttgctggctgcatcgacaaagttgattcgaacagcattatcggcaatcgcaccagaaccggttgttgcttttagatagacagaatcgccaaacctggcattagcgaggtcactcaattggtcagctgaaagtttacttaattggtaatttgatttatttaaggcggtattaatattggtttgtagggcagattggtcatcctgagaaagctgattactgccactggtaatgcttccaagtgattggcctggttgctcaccggctttttggtagtcaaaggaagcaaccacagcattgttatcatcggtgatgtttatccgaattgcgtcactagcgattggatctgatttagtcagcgtgaggcttgttttgctgccaaaagttgctgctgcaaggtaaccggtttgattggctgtcagagcctctaaagagtagccggttgcctttagggcgtctctaattttagcttgaatgtttgcctgatcgtctaagttgagtaaataagagagattatcactaacaccaaggggctgtcccttttgggcaccggattttgtgtaattaatgtagcggattagctttccatcagtgttgacaaggtcaattcgaaccgcgttgtcaggaatcggggattctgcctgggccaatcctttgtaggaaatccatccgttggctttgctattggcaggatcaattgcggtaatatgcacccaagtgtcgccttcacgggttcgagttccgatttgatcaattttaaagctggcatttttgtatgtaacagaatccccaatggccttaccaatcccatattgtgtattaataggtgattgataagtgatggttttgccgtcgttactcaagcctggtgcagcaattgtgtagttgtattgtgtgagatcgggtgatggcttagtagtggtaaaagtttgaaagctactgagaccaccattaaatttaccaagcgtttttccaccgtaaatccaaccactgtaactgccactatatgatttaactttgtagtaaacggtacctttgttggtggttgctactttggaagcgataaagttatccgccgaagagttcgacttggcgagttgggataattgctttttgctggcgatcataattgaactgttctcgaagtcgggttttgtataaagcgcatttttccctgtgaacgttacgttgcgagtttgtggattactagtcaatttcttattggatgtcacgtgaatgggtctgctgctggcttgggcagtagatgcggtgaaagcactgaaactgacggcggttccgagggcaacggcggtcaaaaagagcggctgtttccatatcatggtcatgaaaattcatctccagattctgtaaaatttgctgccggcatggttttataatatcgtacaaaggaacgatttaacgggcattggcaaaacttttacagaggatttacggaaagtttacagaccagagtggtgaaagtagcgcttagcttccagaatataagcccgccaaccaatattcgagtttgaatattggctggcgggcttatatggccggaagttgctactttcaccacgtttcggcaaggttgccgaaaccatcaccaatattcgagtttgaatattgatgcgagggcttatatggccggaagctgcttgctggcacacgtttcagcttagtagccgaaaccagtaccaatattcgagtttgaatattggttggtgggcttatatagccggaattctgttcgctagttcacaatgattgataaaaaacgatgttgaatagccaagttgaaattatctccgtattcctgatcaaaatcgaaactaatatcaggtaacaatgtaaatgtttggtatctattctgtaatttattggtaaataataactttcacggcatcttttatggcatgctaatgataaattaaatgatttatcaatacgaggagtcttgttatgttagatgtgataaaagcaattattttaggaattgttgaaggcattactgaattcttgcccattagctcgactggccatctgatcttggttaatgaatttattaagatgtcgcagtcaactcaatttaccgatatgtttaacgttgtgattcagctgggtgctattatggcggtggttgtcctgtattttcacaaattgaatccactatcgccgagaaaaacagcgattgaaaagaatcggacttgggttctgtggtttaaagtgattgttgcggtattaccctcagttgttctggggctattattaaatgactggatggatgcacatctaatgaattgggccgttgttgccgctatgctactagtgtatggggttctgtttatcgtcattgaaaattggaacgcgaatcgccgtcccagatttaccgatttaaatacgcttccgtatcaaactgcattgatcattgggatgtttcaactattgtcattggttcctggtacctcaagatcaggtgcaacaatcttaggtgcaattttgatcggtgcatcgagatatgtcgcaactgaattttcatttttcttagcaattccgacgatgtttggcgcctctttgttaaaagtttataagtactttgcccatggtggggtattcacaggattacaaacggtgattttggcaaccgggatgatcgtttcgttcgtggtcgcctacttggcaatcagattcttattgaactacattaaaaataataacttcaaagtatttggctggtatcgaattgtgttgagtttgattgtgattgtatatttcggctttatgagcaagtaattatgattaaataatttgcggcaaccaagccaaaacgtggtacattaaacaaccccggccatataagtaaacatcggctaatatccctaaaagacaggggtattagccgatgtttatttatattctgggatgtgcgccctgtttacttgaacttaactgccgttccatatgctgctactgattgcatgtcggttccaattgatccggaatcaaatcgcatcatcacgacggcatccgcacccattttttgagcgttttcccgaaggcgttgaacggaaatgttccgcgcttcatcgagcatttttgtgtaatctttaatttcgccaccaactaaatttttaaagccggcaccgatatttcgaacaacgtttttagattgagtcgtcaggccgaagacttcaccgagaacctcgtattctttacccggaatatgttccgttgtgctgatgataaatttattgtctgccattatcattacctccacatattttagctaacaaaactaattgctacttgcctaatgataccgtaaattaccagctaactgccagcaattgccaatatgcagaaagttataatgaaaaaaggggaggtagtaagaacatgttctcaccccttcccccatgcacttatgagacgtctcatgtggtttagaagagtcgtcatcacttcatgcacacttattataacgtagatcagaattggttacaaaatcatttgttgttaacgttgtgttaagaattggctgtggatagttgatcgattattcggttttaaaagatcattcatcataatttgaattggtttttaaaccaagttgggttagaataataaggctttaaaacagtgttaatgaataaaatgaggatgagtaaatggcaatcagaattgaggaagttcattcagataagcaacgttatttaccactattagaactcgccgatcccgatgttcatatgattaacagttacttggaaattagtacattatttaaaatttgttcggaagataaattgattggtgtcgcagtgattttgattgacgataaagtggctgaaattaaaaatattggacttgaggagcaatggcagggaaaagaaattggttcacaggcattggagaagttgattgattactgtgttgatcaagattgccaggtgatgacggtgggaactgccaactcaagtattgataactttgctttctaccaaaagaatggatttcgattcgttcaaattattccggattttttccgacagtatcaaaatccaatctatgaaaatggtattcgggcattggacatgctggtattggaacgggaaatttaatcatgggctgctttaacacaaccgtgatttgtaacgatgacggatggctttatttagaagattggagaattaattgacatgaaatttacatggcagaagactgccattgaacctaaaacactaaaaaaatttttgaatggtcatgggatcagccatcgaatgtataaaacgttaaaaacggatggccgctttaatattaatggtcagccgacaaccagcgaagtcattattcaaacgggagatcaagttgaggtcattttgccggacgaaaaaagtgatccccaagtggttgttagtgaccagccgattaacgttgtttttgaagatgagaactggctggttgttaacaaaccggcggggctgaccgttgttcctggcccggcaaatcgagaggatacactggttaatcgaatcaaaggccatttgattcaagagggcgccaaaaatttggtgccacacattattacccgtcttgaccggtttaccagtggattggtcctcgttgcaaagcatcggttggctaatagcttggcaaatgaaatgttagcaggtaagcaactccacaaacgttatcaagcagttgtttctggaattggccttcccagtcatggacatattgaaaaagccattgccaaagatcctgatggttttgggcaactgatttctcaagatggcaagccggctgacactgagtattgggtgcttagagaaatgggtgacaggacgctggtggatgttgttttgcatactggccggacccatcaaatccgagttcattttgcggcaattggccatcccttacttggtgaccaactttatcatgggccaatgaatcgtgggattgaccgccaggcacttcactccacaatgttagattttgctgatccattttcaagaaaatcaatgcggtttaaaagtccgctggcaaaggatataacccaattaatagattagagaattactcatattgctcacttcgtaacgttgttagatcaatgaactacaattattttaaaacaatcattagaatcagatgaaaaccgaggtattccggttgtgtttagtaagtaaccacgttatgatagcggtatcaaataaaggaggagactagaatatgtctaccaatggggaatcatctgaccagactgtccaaaaaattattgctgaaatggaagccaacgtatctgttctttcatggataaaagctgctgaggataataaggaagctcaagaacacattcgtgcgatcaaggccgctttatccaaggccaaaaaagacttagtcaaagcataaaccctcttgacatcggttttatttggttagacaactagtttttaatcgactggaaactaaatcatgaatgactcgggcgcctcactgatataataactgtgaggcgtttttttgttacatccgtttatactgaattggtaaggtaactgattacttggtttttattgcggtggttgtcttgatacggtgttttaattatgattaacaggagatactttagatataattggaattaatgggagatgaaaaaatggatcaagaaaaaacggcgatttgtttagttgatcatcgacgccatatgattcttgacggtcgatttttgaaggatctagagccagcaacccgcaacctgattaagggtgagtatccatcggcaaaagtgaccgattttatttgtgaccacgatttactgaaatatcaattaatgcgagtggatgggatggttaattccgatgtcaaacagacccgcaagattaaccgacggctaaccaaagccatgcagagtgatgattacgatatcatcgatgtgaacgacaatttggaaaaaacgttaacatttggtcaacgggtgtcggatgcagtggctcgatttggtggtagctgggggtttattggtatctttacactggttctggttgcttggatgattttaaacggtgctcaattatttggtattcacttcgacccgtttccgttcattttacttaatttaggactgagctgtattgctgcaattcaagccccaatcattatgatgagtcaaaaccgagctgctgatcgtgaccggatgaactcagaaaatgactatcatgttaatttgaaatcagaacacgagttgcggattttgcacgcaaagctagacaatcttacacaaaatcagttgccacatacattagaaattcaaaaactggagattgaaattttaggtcagattcgaaatgaattggatacgatcgagcggaaccagtttttagattctgccaaagaaaatgaaagccttcgtgaaagcgatacaaatcactttgaaaaatctcctaaacaaaaaggctgatttaacggtgtcctttgacaatttatgaaaatttcagtaagatatcaattaacacatagaatacgtttaatattattaggaggatttttttgataaccgttagagaagcacagcaggatgatgcgggccagatagccccattaattgatattatttttgatgaaatggaacttgatgaattagaagacgttcccgaacctggattagccaaggtcatcacgagggcttaccagacagatacctatttgtctagtaaagcatcaaccgtggtggccgaggccgatggtcaagttgttggggtggtgtttggttaccccagcgaaaatgaggacgcaattaatcaggtgctgatcaatttatccaaaaagagtgccgattttaaagaaccatatatccctgattccgaaaccaataccgatgaatggtatttagattcgattgccgtagatccacgctatcaagggcacggaattggtagtaaattactaaacgccgtcccaagaatggcgttgaatgatggtaaatcagtggttggtttgaacgtcgattatgaaaatccaaatgcggaaaaattatatgctcgaaagggctttaaaacagtgggaacccaaatgattggcgaccatttatatcatcatatgcagaagccggctaagcaagagagcttactatatgtttaattcagtgtttgattacaataatcaaactattgatcaataggagatgtccttgttgttacttacaataattatcttaggatttttagttattttaattattttgggaacatttattgataccaagtggcgacagaaaaaaggccgttaccctttttcattactgcgagatgatcaacacgttgatccattggcacctaagactttttggcgggtgtttattggaaacttgattaatgtttttactttttgggtgtaaatttaaaactgaataaactaaacaaaggagctggacaatagtccaaaatatgtattatagtatcttagctctgaagtggaaatcccgtaaaatcagtgtttttgtaaactgattttacgggattttttaaaagacaattgttcaatcaatttatgtcgcagcctttttaggcagtcacgatttttatcacgcaaaaatgtagaccagcaggcagatcccggccatatgagccccccttaaccttaatatttcaaaatcgggaatatcttgttgaactttttatttggttaaaacgtgacccagcaagcagtctccggccatataagcccgataacttgatattccaaaatcaggaatatcaagttatcgggcttatattctggagtctaaacgcttgctggtccactcttttttgtcatatataattgacaaaataaaacaatcagggtatattagccatatagaaatgacacatatatatgacaatcatttccaacatcatgtaagaaggtggttatgctgtgaaccgagtcagagaatatcgaaaaagacaaaaattatcgcagtttagcttggccgaaaaaattggcgttgcgagacaaacgattaatttgattgagaatgataagtacaatccatcgttgaatttgtgtatcagtattgccaaaacattgggcacagatttaaatacgttattctgggaggtcgaggatgatgaaaaataaagaatcgtttggtgtcagagcaattaagtggttttatggcgttccgggaatcggcgatgaacactttgtttctgagttgaatcgggttggaaataatgcgtttatcgtcttggcgttatattcatttttttcaagtattggcagttttttcctagcattgggcggttctcgacagaccgtattaatctggttggcagccaatggcgtcgctattacctggggaatcctgctgtacattgaattcggcgttgaccatcatcatttattagacgcagaatatcccatcggtcaagctgctcgaatggcaaaatgggagatgattcaattcattaaagcctggatcttttatttccctggtgcatatttagcctattttattattaattacggaatggggcacgaggcattatcagtatttttatatgatccggctaatccaattttggcggctatctggagcctggtactgggtttgttaacggttgggccacgggtaatgcgaattaaatatcacaaatcaaactgaattaattaggagtggtgaatgttatgaaaaataaggaaagcatcagtatttggatcattaaacacttgtacggcgtttccggtgtattagatgaacggaagcggcaggagattgggcgaattgcaagcaatgcctatttcatcttattagtatgtaatctattatcagctgtcattgcgggctttatcgccgatcaaagtattgagaaggcgtttgaattcttgttctttgccgttttacttggttcgtttatcttagtcaatctttatgttttttacgcaacaactaaacttcacttgatcgatcgggaaatcgaggcccgggattatccaaatgcaattaaaaagagtgtttggcgcgctattgaatttggaattggctttgggctcctgatgtatctaatcaatgtcatctttgattggagcgatggcattcagctaacttcagcggcaacttcaataaattatattgttcgttcaacaggcgctgggatcgtaatgggaattgttcatttcctaaatgatctgtttaaaattaaaaagtatcgagaataagttgaaggattgtatcaccattgccactgacaattgttttcaactatcaaaaacattgctatcattctcaaccttgggaatcataacgatgtttttttgacatgataattggctactaaatttccttcttcagatgatacggttaatttctttatcaagagcaaagattgataatgcgactaaggtagttatggtgaaaagctgaaaattaagtgatgagtaccgtcttgcttttgcattgttcgctttagtgaattgtctatctggaaactgaatggttggccgattcatcaaaagtgccactccccccaatcgaaaagttattttgcgagttggtttaaagttaacggggcaacagccgggcgattcgttatgtcaacttaatccagaattaatttcatagtttgattgcatctcaaagttggtctgatataattgaatttcggatcttaaattgatcaactttggagacaataacatatgaaaaagaataccgcacttgccgttgttagtagtgtaaccattgcagcgaatacaatcgtcgcaattgtttcaactgtcatgatatcaaagttgacaactaacaatgccaaaaaacatcgatagaaagaggcttaccatggaagacaatattaaactcggcaatccggtttttgataagatgatgtttgttcttgataaaggaattaccgaacagaatcatcgtgattaccggtatgaaaatgaagaactgattcaaattagtaagggcatttgggcaatgccggcttatatgaaggataatgacgactttagtatgttctttatcatcacacaaattgatgacggcaatacggtcgttgcgttttcaacaggggagaagaaagatgagcaattttccttaagtaatccgatgattaccggcaaaggactaaatttgctgaccaaacacaataaagatcgggccgcttcgattttgcatttcttaaaccaaatttctaaagctgctgaaggaaattggcgaattgtttcagaataggcaactatcaaattgaactaatttgatcagactaagatagctaagcatttcgaaccaaccctggaagaatccgcttgtattcttcactaatcctgttagactgattgtaatttaaatgaactaggagaaatgattatgaaactcactttggttgaatctgcagaaaaattcaacgttagtccggacgtaattgttgactacattaagaatggcttagtcccatccaaaccacaacttgacgattcatcaacggaactggatgatcatgacatgtattggctagatatggtacattgttttattgaaaatggttcctcaatcgatgatgttaaaagattggttaaacattgccaattgtagacaaagtcgttgttatatttaaaatctgatgatattctaaccatagaggggttatcggtactcttaattgacattaattagattgtcgtttgtatgaatgttggattgcataagtgatgtgacagttaaagagttccatcgtgcgaatagaagcactttgagtatccaattataaattggatcagtattcgaatataaacgaagtgacatttgattaaaaccaacagagtggccgattcccctcgaagaagctgaaacatgacattttgttttgtgacagcttcttttttgtatgctcatccttcactgaaaccattaacccgaacaatttgggctttcatcaggccctttcatttgtcaggatgtttttcattgaatcgatccggctaaaaatgggaacattcgtttggaagtgaatctttattttctgcatccctaaaaaaattgttaaccaattatggaaatttcacttcagtaatgccataatgaaaagtggattggagtgatttgatgccagaacatgatcataatcacgaagaattatcaggcaaccgtttcttttgggtcacaattttaaatgtggtgattacgattgctgagtttattggtggggcgttatcaggaagtttatcattgatttcggatgcttttcataatttgggagattcggtttcaattgttttcagttacgcagccaatcaaattagtaaacgtaagcaaaatgcccgtaacacatttggctacaagcgtgcagagatcattgcagcatttttaaattcgattgcgttggttttaatttgtgtgtttttaattgttgaagccgttaagcggatcagtcatcctgagccaattaacgggacgttgatgttaattgttgcaattattgggcttgctgcaaatttgttgtcagcttttcttttaaacgcggggtccaagagtaatttgaatatgcgggcaacttacctgcacattatgagtgatgcattgtcttcaatcgccattattattggtggggttctaattgatttatacaattggactttagctgatcccgttgtcacgatgttagttgctttgtacattatttatgagtcgattccgcttgtccgacagaccttcagaattttgatgcagggggcaccggatattgattatgaagcaattaaacgtgatttgcttgaaattgatggggtctttagtgtccatcatgttcatgcttggtcgattgatgaaactaacattattttttcagcccatgtgaatctgcatgatatgaagattagcgaagcacaaccaatttattctgaaattgctaaactgttgaaagaaaaatatcatatctgtcatgtcacgattcaagcggaaacaacgcgtggcgaacacgaagatattatttatgatcgtggtaatgatattccatagaaagtaggagatttttgtttaaatgactccaatgaaagaggactatttaaaaattatttttgagcttggtggtgctaacaaattagtaaccaataagcaaattgccatcagcctaaacattgcagctggttcagtcaccgaaatggttaataagatggtcgaggagaaattggttgttcataagccttattcgggtgttcagttaacagccaaaggaacaaaatatgctgaggaactggttagaaaacatcgaatttgggaaacgtttttaatcaataccctgcattttgatctaccagatgttcatgatgaagcagaactgctggaacatgtcacgagtgacaaaatgattgatcatcttgatgattttttgggtcaccccaagcgctgcccacatggtggcattattcctgatcggtatgggaattatgagaaggaccatgataaaattctaacggcggctaaagacggtgagaccgttgtggttaatcgatttattgataatcatgatttattaacccttttaggtgatattaagcttgatattggggataggcttaaaattatatctcatgatccgtttgagggatcagtgacggttcaaaatttgactgataaaaagaaattagtaattggttacaaaacagcgcattatgtatttgtaaagtagttgtgtcagcttcagtaggtttgaacgattgaatgttgatctatttatgaaagaaagtaacgctggggcaggaagaatggataagaggctgggataatgcaatataccccagtctttttatcgttaattatgcccaagtcaagccgtccgtatctgaagtattggatgataccgatcggttagtttgaggcgtttaatggggtgaaagaatggctgatcagcaacgtaagtacgatcaaatggtacttgatacctgtatccttgcaggaacaattatgattgaatctggatctgaaatgactcgggtcaacgatacaatcctgagaattgcccataatgctgggttaaaagatgccaaagtttatgttaccgtcactgggattataatgtcgggtggtgtttcggatgttggtgctcaagttggatcaattgataagcggtcctttgatttggaaaaagttgccaaagtcaatgaactttcgcgatcgtttgctgccaaacagattgatatccaaaacttctatgatcaattaattcatattgacgatatcgtcggaacctttccactgtgggttcaagaaattggtgccgggattgtgagtggcacgctggtggttgtttttcgaaataatttggccgatttttggatcacctttttagttgggatggttggttgggcagtcctctatttcttaaatatttatgtccaaatcagatttttgagcgagtttttagcagcggctgccgttgctgctttagccattctgtcagttcaatttggcttggggcatcaagctgatgatattattgttggtggaatgatgccattggttccggggatcccgttaacaaacgcggttcgggatgccttatccggtaatttgatcagtggaccggctcggggaattgaagcgctcattagtgcctgtgcactaggatttggcgtggcaattgcactacacttcatgtgagagggaacaactatggaattgtttattattaagtgtttttgtgtgtacctttccggggtgggcttcggcttaattgtgaatttaccacataaagcattaaatattgctggttttaatgctttgctaggctggttggtctactatgtgattatcaacgcgtggggtggtttagggtcagccaacttttttggcggcctttgcatcggggttgtctcggttttaattgcccgatggaaaaaaatgcctagcattttattcgatgttccgggacttgtcccactagttcccggtgggcaagcctacaatgcaattaagagttttgcgatggggagttatgaatcagcatttagttacttgtcagaagttgtttggattgctggttcgattgctttagggtttattgtagcggaattagttaataaaattcggttgcgaattgaacatgaatttattaaggggcatcagaaattttaatggtgtatcacggtgagactcgggcaatgatctttgcctggtctctttttttgttgccattagttgggatggtgaatcgaaatgtggttgaaagcacggcgtatggtgggtgcaatccagaatagcttaacttcagaagcttgttcccaagacgagggggtggcccgcttgtttgagatgtttgaagccaagcagttcctctccttgtaggcgtccctagtccaatattttctacccgggatattggactggctacctagccgaaacgtgtgaagccaagcaaacccctgccatataagcacttcagctaggtattcccggcttggaaatatctagctgaagtgcttatactctggagtttaaccgcttggtttcgaactctgttcatttgacatttcctcctttttcgtctaagatatcaatgaaattatattatatgaaatatagtattgtggaggtggcagtatggcaattcaaatcagttccgaattacttgatgggtgtgttctgggaattctcctgcatgatgattactacggttactcgttgacccaaaaagttcaggagtcaatttcagtttcagaatcaaccatgtacccggttcttcggcgattaaaaaagaacgatcttttatcgacttatgatgagccttatcaaggtcgtaaccggcggtattataagataacatcggaaggaaaacgtcagtttgaaatgattaaacaggactggcaggtctttaaagggagtatcgataaaatgttaggagatggtgtggatcatgaatgattatattaaacagcttacagccctgcttggccaattgagcgatgaagaacgtggcgaagtagttgacttttattccgagtatttacaagatggtggttttgtgaggtttagtgattgcgttgcagaacttggaacaccccggcagctggcaagaaaagtcttggcggactattcgattaaaacgttagaaaatccatcacgatctgattcaagaacccagcgttccaaaagcgatgttcagaccatttggataattgtcttggcgctactttccacaccagtcacgataccattggcagtcggtgttgcggcaatgtttgttgttgccattgctgtgacgtttgcattaattgtgtctgtgattgctatttttgtttcgatcatcgctggtggtttaggttcattcattcttggcattagtatgttgtttagtcatttctgggttggtctcttttactttggaattgggctagccgtggtgggagccttgctgatgttgacaccgatttttaagtgggcaattgacgggttaattcatggtattaccctgttttcaaaatggatttacagtaagatttcctcgaaaaatcgtgcgcagagaaaggacgatcaaaaatgaaaaaaatgtttatcattggtttttcaatcatgattcttggattgctttttgccggttttggatttgcccacggcggtaatcaaggaatctactgggataatgggtttaaggcagttgactcaaaagctcaagatcgtcactatcgacaacgatcattcagtaatattaaccaaattgacttaactgctgatgacgatatttcaattcgccggggtaacgtttcaaaagtcactgtccgttatttaaacgggaatcaagttgatgaagttaacgggaaattaacaattagtggtacatctcatcaccggcatttttcttggattattggcggctttgaggatgattacaacaacgacagtcctatctcgatcaccattcccgagaaggccaaattagcgtccttaaccggtaatcccgaagattctgttgaagtagaagggttaacaattaacaaggttgatttaaccggtgaggctgatgtctcaatgacagatactaatattaagaaatcatttaacttacaaaatgacggtgacgtcactctgagaggtgtcaaggcacccgcacttttgcaaagcagtgatgatggtgacgttacaattaccgaaagtacttttaacaaaggtcaaagttcgttgtcaactgatgatggcgatgtgacgttaagctcaaatacatttgatagtgtcaaaacaaatacgagtgatggtgatatgacatttaggaatcaattgatcaacaagcggtttgaggcctcaaccgatgatggcgatatcagtggtcatattaaccgtgaaaaaccaattcgagtaattgctcagggtgatgattcggatgttactttgtttggtcggtcacggcgaagctatgggatcgataatgttaaaggtgttcagtaccgatttgatacaaatgatggtgatattacagttgagtaggaaataaggcgcttggttacgactaaacaattattgtacagaaatagtcatgcttgtttggcttaaaactaaaattcggatgtgctttatccccaagatcttaatgattaaaagaaatcctaagattcccataatgaaaaaatcactaattagaatgtgatatactcaattctgagttttaatttagagaggattgttgaacatgtatgggaatgacgattacatgctgatgcaaagagatcctaatcgagtggttaaattcattgttagtctatgtattaccgctattctgtctctttcagtggcatttaattttgactatttacaatttttagattcagtttttaccaccgcaattcagggggcctctccaagtgaagtgatggaaaaattttatggaaccgtatcattattggcaagcccgaaaatggatattctgtggatatttgtaattgccttttttctgtggggatttaaatacaaggttcccgcgctgtgggcgttatttacattagctggtggcgatattgttggttttttgataaaaaatctgattaaacgtcatcggccaccgttgcatcttggaaccgatagtggctatagctttcccagtggccatgtgcttggtatcttcttggtgattgctgtgttgtggattgttgttgtgccaatcattgagcaagtttcgattcgcgtcattttgagagttctcatggtagttgtcttagtagtggtgatgttttccagaatttatttgaatgcgcattatcctaccgatacgattggcgcctgcttagtcgcatatagttggttgctggtatctgagatgttgtacgcaaactacgcaactcaagtggcacaattgccattcattagacataccaaagtgtgaggaggaaggcagcatggatatcgatcttcacacatcgcgtcttcatattcgtaaactacaaatggctgactttcaagcttattatgacttggtttcgcatccagaaattcagcaaggagccgggtttggtctaatgagcaatcctgcaatgattgaagagttgctaaagcggcaaattaaggcgccagggtcgttggcaattgagctgaatggtaagctaattggggctattttgctgttagcgaaggtcggctttgatgggctgcctgatccaaatcaagttgaggtaagctactttctggccccacatttttggcaccaggggattatgacggaagcgtgtttaacagttattaacgatttaaaataccggcgaaagattcacaaaataactgcggaagtttttgcgaacaatgtcaattcgattgcattgttaaagcgcttggactttattccagtcactaaattaatcgatccaattgttggtaaaccaaaaatcgtttttgagtatcagcttgagtaactagtccgtgtcggttgttaattatggggatttgagttacaattctcttgtttgaaatttaaataatttaatttatcgatatattcgagtagaggcgcatttattaaaagtatatttcaggaacttgaaaagaagtgatgactgaaataaaaagggatgaatgccgaaatgagtaaccactttttctggttggttgttgggtcttaatttaagagattaaggactgtcgtagtttgatactacggagcgctatcaagatgttgagaaacacctgcggtctctttcaatatggttattgaaagagactttttttgtaggccaaattagattttggaaataaacgatatgggagacgaaatttatgagcgaaaaagcaagtgaacagcctggacaggttaagagaggcttaaaggcccgccacgtttcgatgattgccttaggtggttgtatcgggaccgggttgtttgtagctagtggatcaacaattagtgatgctggtccaggtggagccttggttgcctatggcttgatgggattaatggtctactttttaatgacaagtcttggtgaaatggcaaccaacatgccaatttcaggctcgtttgccgcatactcggctaagtacgtcgatccggcgcttggttttgcaatggggtggaattactggtttaattgggcgattacggttgctgttgacattagtacagcagcactggtcatgaaattttggctgccaaacgtgccagcctggatttggagtgcaatcgcgctggttttgatatttttcattaatgcgatgtcagtttcaacatttggcgaaaccgaattctggatgtcagcaattaaagtaacaactatcattatttttctcattgttggtgcgctaacaatttttggaattatgggtggccattttgtggggatgcgtaatttcaccttaaaacaagcgccatttgttggcggcgttccggcgattattagtgtctttgttgttgcagggttctcgtttcaaggaactgagttggttgggatcactgccggcgaatctcaggatccacaacatagtgttcctaaggcaattaatgaagtcttttggcgaattattctattttatattttaacaatttttgtgattgctgcccttattccttacacaagtcattcattattgggctccagtaccactgatattgcaattagcccttttaccctggtctttcagcgagctggtttggctgcggctgctagtgttatgaatgcggtcattttaacttccgtgatttcgtctgctaattcagggatgtatgcttcaacccgaatgctttactccttatcaaatagtggctatgcaccaaaagcacttggcagaactgcccacaatgggattccttattactcgttaattgtgacaacggttgtttcactattaacatttatctctagtattgccggtccgcaaatttatatgtggctggtggctgcttctggactaaccggatttattgcatggtttgggattgcaatttcacattatcgattccgacgagcattcgttaagcagggacatcagctgagcgagcttaaatatcatgccaaactgtttccatttggtccagtattgtgtttgatcttatgtattatcgtcattgttggtcaaaaccctcagtcatttgcaacgtttgattggaaacaaattttggtgacctacatgagtgtgccgttggttttggttctttatattgtttacaaaattaagcaccatacgaaaatcattccgcttgataaggttgatgtttccccagcccataaggatcaaaagttaacggatttaaatgaaaagtagtatattaattatgaattggtctattcaaacgaataggcttttttattttatttaggctggaaacttgctatttaccactattgtttggtagaattttgtcgattggtatatttaacttaacgaggtggatattatgtcaaaaaaattactttcaaagggaaaatacgcgcggatgcttaaattaaccactgatgatgggattgttgatgcattggcgttggatcaacgtggatcacttgtcaaagggatgaaaacagcagccgccaaatacggtaaacttttcagcatggatatggtctataatttcaaacaaactgtttcagaaatcttgagtccgtatagttcggccatcttgctggatgatcaaatggggttcaaaggaattgaagccaagtctgttgataccggactaattatgtcatatgaaaaaaccgggtatgatgctaacgaacctggtcgattgccaagcttgattcccgatcaatccgcacagattatggtccaacgtggtgctgacgcattgaaagtgttgctctacttcaatccaaatgatccagatgaaattaatgatcaaaagaaggcttttgcccaacgatatgggactgaaggtgttgctgccgagacaccaactttcttggaaattgtcacctatgatgatcggtatgatagcagttcgttggaatttgccaaggaaaagccggaacttgttttgaagtcaatgagggaatttactcaagataaatatcatattgatgtcttaaaaatggaaattccgtttaatccaaagtttgttgccggctggaataaagatgcttctgactctgcttataccgaagccgaggccaaagattatttgaagcaattaagcgatgaagcaactcggccatttatttttctgagtgccggggtaccaacggacgtctttcagcgtgaattaaaacttgctggcgatgccggtgctaaatttaatggtgttttaagtggccgggcaacttggcttgaaggcgttgatatttttgcccgtgacgggcgtgatggattggtagattggttgaaacacaaagggactcgtaatgtaaccgaattaactcaaattctttcggataatgccactccttggtttgaggcatatggcggcaaagataatattcaggtggttgatatttcaaacattcaataaaagcaatacaagatgttgaagctacctgacaaaactagtacaatatgtagtactagtttaaaagttaggggaatttaacatatgcttgtattggctggaacaattggtgccggaaaaacgtctttaacccacatgttggcgacccatttggggacacctgcatattatgaatccgttgagcataatcggatcttaccattattttataaagacccgaagaagtatgcttttctgttgcaaatcgattttttaaatcgccgaatggatgatattaagcgggcttggaagaatggggagagcgttttggatcgatccatatttgaagattcactactctttcatcttaatgccgacctcggtcgggcgactgagacggaagttaatatttacgattctctgttagcaaatatgatgcaggagttacccaagacaccacatagtaaaaatcctgatctgctgattcacatcaacatttcctttgaaacgatgttgaaaagaattcaaaagcgcggccgaccatatgaacaaattagtaacgacccaagtctgtatcaatattacagagatttaaacactcgttatcaagattggtacgctcactatgacaaatcgcccaagattcaaataaacggcgacaagtatgactttgtcgaaaaagatacggataagcatgctgtgattgacttaattgaccaaaaaatggatcaacttgctatttagtggcttgtgatttaaaaatgaattggttataatcaatttagataaaacgttttgtgcctatttagtagatttcagagagacaatggttggtgtgaattgtcatcgaatattccagcacaagtagacgggcaggtaatgctgcacggtgtatgccgttaccatacttaaagagcttggcttttgtatgccgagaacttgggtggtaccgcgaaaaggatccttcgtcccagtgacgatagggtcctttttatattctaaggaggatttcaaatgctagatattaaaaagattagaaaagatccggattttaccaaagaaaaattggcaacccgggggattaaaccggagacaattgatgagctgttagggtatgatgccaagcgacgtgacttaattgtccaatccgagtcactaaaggctcgcagaaatgatgtttctgatcagatttcacaagcaaaacgcaacaagcaggatgcttccgaagcaattaaccaaatgaaagaggttggtcaacagatcaaacagctcgatgagcaattgcgggatattgaaaagcaggaacatgatttggccgctcacttacccaatattcctgcggatggggtgccagtatccttaaccgaagaaggatctgttgaactacgacgaattggaaaaattccgtcatttggtttcaagcccaagcatcattgggatatcggtgagagtcttggcatcttggatttcgaacgggcagctaaggtatccggtagtcggtttgtttactatattggtgacggtgcgttgttggaacgggcggtctataatttctatctggatcaaaataccgcagctggttatcaagaggtgatcccaccgtacatggttaatgatgattctatgtatggaacgggtcaattccctaagttcttggaaaacaaggctggctatgaacttgttggcacggacctaacaatgattccaactgctgaagtcccattagtcaactattaccgaaatgaagtcattcctgaagagaaattaccggtttcgtttacagcactatcaccagcctttcgttcagaagcagggagtgccggccgtgacacaaagggattgattcgacttcaccagtttaataaggttgagatggtgaagtttaccaagcctgaggattcgtgggctgcattggaagaaattactcatcaagcagaagttaacttgcaaaaattggggttggcttatcatgttattacgctaacaacgagtgatatgagttttacagcagcgatgactcacgatttggaagtttggttcccggcacaagataagtatcgggaaatttctagctgctcaaatacaactgattttcaagcccgtcggtcacatattcagtatcgggatgaagatggtaaattacagtacgtccacactttaaatggatcgggcttggcagtgggtagaactgtggcggcaattcttgagaattatcaaaatgaggatggatctgttaccattcctgaagttcttcgaccatacatgcatggtaaaactaaaattgaaaaacaaaattaaaaatgttcgataaaaagtgcaattttttgcgtagttaataagtgtaaccaaaaacaaggtcattgtttttgactttgcggttacagtattgataatgctgaggcccccctcctctagcagaatcacccccccgaactccctcataagggttatatctagtaaaaggtccagttggaaactaattaattttagtttctgactggatccttttttatggaaatggaatcgaaataagtaattgaccaatttgaaacatgattgtgagtcgaggtaagatcgattgcgatacgtctttttatttgactaaatacaaatcagcttgtttctagcgtgtatgatcacttaaattaatagggaaagggaattgttggctggtaattgtggtaaagaaccaagcagtaattataaagtcgcttcttaaataagctgacattaggaataagtgattaggaaaacctcttttagctgtccggtgtttcggtaatatttgttggacaatcaagggaaaatttcaatgtctagtgaaacaatcggttaaaatcgacgctttagaaataaaaatcaaaaaaattcaaaattggactagtaatgttttcgaagatacggtataatattttttgtcggaaaatgacgttgcacataagctgttgggtttttgcttaataaaaaagtcttgacttcaattaagtggtaatgatacaatttaatagttgtgttgttactgttactaccaacaaacattaatattgtttcacggaggattagctcagctgggagagcatctgccttacaagcaggaggtcacaggttcgatccctgtatcctccattgagccgttagctcagttggtagagcatctgacttttaatcagagggtcggcagttcgagactgccacggctcattgccagttttttacaatgcgggcgtggcggaactggcagacgcgctagatttaggttctagtgtcttatgacgtgggggttcgaatcccttcgcccgcatagaaccatatgttatgaattttgccgacttagctcagttggttagagcgcttcactagtaatgaagaggtcgggcgttcgaatcgtctagtcggcatttatgcggaagtagttcagtggtagaacatcaccttgccatggtgggggtcgcgggttcgaatcccgtcttccgcttttttagtcagtctgccggggtggcggaattggcagacgcacaggacttaaaatcctgcggtcagtgatgaccgtaccggttcgatcccggtcctcggcattacaacaattaaataaacattatgcacccatagcgcaattggatagagtgtctgactacgaatcagaaggttgtaggttcgactcctactgggtgcattttttattttgatgtgttttcgggaagtagctcagcttggtagagcacctggtttgggaccagggggtcgcaggttcgaatcctgtcttcccgactttttagattaagcattttatgctatattaatcttgtcaactaaataaataacatcaccatcgggaaatagctcagcttggtagagcactacgttcgggacgtaggggtcgcaagttcaaatcttgttttcccgatttttttgtgtctattttttctttttacttacatttttgaactttcatgcttaacataaagacagaagcggtcattattatagaagaaagcattgtttttgcatgatcatatagattttggtatgctctgagtactctcagaatttttcgggttaaacatactttataaagaaacgtctgaacttttgtatctacttggttttgcctactttgattagggctaaacttttgaagaacgttgggtctaataagtcttaaaattgaaaccgaatccttttcattgcattttctctacttcttcgtataataatagtcaatattagtcaaagaatgggtgatgaaatggcggacgaaaatatttcggacttaattgaacgttatttaaaagaaatccttgctgataacgaacagattaaaattcgtcgttcagaaatcgctggtttgtttgacgttgtaccgtcacagattaactatgttattaatacccgttttacgattcaaaatggatatattgttgagagcaagcgcggtggtggcggctacattagaatagagaaagtccacttattggatgacattgacgttttggattcgctgattgccgcaattggtaacaagttatcgaaaagagatagtgaaacaatcgttcaaacgttatataataatgacttaattgatcgtcgagaggtgagcattattctggcggcaattgacaaagacgcaattgatttgaacaataacgatttaacggatatcttgagagcaaatatcatgatatcgattttaaatcgtttgcgttacgaacgatagaaagcgagggtatctatgaataatttatttacgccaagcgctaagaacgttttaaccatagctcaggaacaagctaagaaatttaagcatcaagctattggtactgaacaccttttgctgggtctactgattgaaactaatgggatcgcttataaggcacttcaacaattttcagtaactgctgaagatgtgacagaagaagtagaacgctttgccgggtatggcaatttaaaggatcttagcagcaacgattatttaccatactctccaaaagctaaagaggtattggcacaagcaggtgaatttgccaagaaaaacggtgttccaaaagttggaacggaacacattttgctttcactattaactgatgaaacgattctttcatcaagaattctaattaatttaggacttgatctatcacaaatccgtaaagtaactttaagaaagatggggattagcggtggatcgatggggtcgaacatggcttcaaaacaacgaggcacccgtcagtccaaacgctctgattcaaagacaccaactattgattcattagctcgtgacctaactgagatggcgcgggaagatcgtcttgatccaacaattggtcgtgatcttgaagttaaacgagttgtgcaaattttggctcgtcggactaaaaataacccagttttaattggtgaacctggtgttggtaagacggcgattgctgaaggcttagccgagcgaatcgtgaatggcgatgtccctggtgacatggcccataagcgtttaatgatgcttgacatgggttcgttagttgccgggacgaagtatcgtggtgagtttgaggatcgcctgaagaaagtcatcgatgaaatttaccaagatgggaatatcatcttattcattgatgaattgcatactttaattggtgctggtggtgctgaaggagcaattgatgcatctaacattttaaagccggctttagctcgcggcgagcttcaattaattggtgcaacaactctggaagaatatcaaaagtatatcgaatcagatgctgcgttagaacgtcgctttgctaaagtaatggttgatgagccgacaacggacgaaaccgttcagattttgaaaggattacgccctaagtacgagcaacatcatcatgttgagattacagatgatgccattcaatcagccgtaagcctatcgaatcgttacattagtgatcgattcttgcctgataaggcaattgatttaatggatgaagcagctgccaaggttcgaattgatcatttacaaagttcagatgttgttgatgatcacaaaaagctgtcagatttactttcacaattgaatgaggcgttggtcgcacaggactatgaaaaagccgctaagattagaaagcaagcaaacaaattgcaggatgagttggctgaagacaaagaagacactgatgataagactgataccaagtatcctgttaaggaaactggtcaggatgttgcccaaattgtggcggagtggactggaattccagtgacccgattaagtcgcagtgaagctgatcggctggttaaccttgaaaaagttcttcatcaacgagttgtcggacaagaagaagcaatctccgctgtatcgcgctcgattaggcgtgcccgaagtgggttgaaagatccaaatcgcccaattggttcattcatgttcttaggaccaacgggggtcggaaagaccgagttagccaaggcggttgctgaagcagtctttggatctgaagacgatattattcgagttgacatgagtgagttcatggaaaaatattcgactagtcgtttgattggttctgcgccaggatatgttggttatgacgagggtggccaattaacggaaaaggttcgtcaaaagccatattctgttgtattatttgatgaagttgaaaaggctcatccagatgtctttaacttacttctacaagtgttggatgatggttatctaactgattccaagggtcgaaaaattgactttagaaacacagttatcatcatgacttcgaaccttggtgctacaacccttcgtgataagaagacagttggtttcggtcaggaagatactaaagaagactacaatgctatgaaggatacgatccaggctgcattgaaacaacgattccgtcctgagttcttgaaccgaattgatgaagtggttgtcttccactcattaactaagacggaacttgataagatcgttcacttcatgactcgaccggtaattaaacgaattcacgatcagggaatcgatatcaaggttactaagaccgcaattggcattatttccaagcgtggttatgatcctcagtatggtgctcgtccaattcgacgtgctattcaaactgagcttgaagataaattaagtgaaaaactattatcgaaggaaattgttcctggtgattcggtaaccgttggtggtcgaaatgatcaaatcacaatttcagtcaagaagcccgatcgaaagacattggtaaataataaaaaataaaaggcgattcaaagttcattgtgttgacaagttttgaataagttgttatattgttaactgtatttgttgtgaatcgaaatggtcgacgcgatctattgtccgggttggcctgcataaaaaccaaaagcaagttggacttgtttttggttttcttttgcccaaaatccggtaaaatacctaaaaaggtgcaattgtaatcaaattgtaacatttcgattcctgaattttttggagaggtgaaaaacttggcaggacatttagttaaatacggaaaacaccgtacccgacgaagttatgcacggattaaagaagtgcttgatctaccaaaccttattgaaatccagactgattcttaccactggtttttagatgagggacttcgcgaaacattcgatggcattatgccaatcgatgattttcaaggaaaactatcattagagtttgttgattatcaattattagaaccaaaatacactgttgatgaagcacgggaacacgaggcaaactactctgcaccacttcatattactttgaaattaaccaatcacgagactggtgaaattaagacacaagatgtattctttggcgattttccattaatgactgatcaaggtacttttattattaatggggcagaacgagtaattgtttcccaattagttcgttcacccggtgtttattatcatgaagatactgacaagaatggtcgtccttcatatggcactactgtcattcctaaccgaggtgcctggcttgagtttgaaaccgatgcaaaaaatatcgcgtatgttcgaattgatcgaacaagaaagattcctttaactgaattaatcagagcacttggctttggtagtgatgatgaaattactgatattttaggtgataacgatagtttgggacttactttggaaaaagatgttcataaagatacggatgattctcgtgttgaagaatcgttaaaggacatttatgaacgactacgtccaggggaacccaagactgctgattcatcacggagcttgttaactgcacgattctttgatcctaagcgctatgatatggcaccagttggtcgttataagactaacaagaagttaagcttaaagactagattattgggattaacattagcagaaacattagctgatcctgatactggtgaggttattgctcaaaagggcactgtcgttacaaaagatgttatgaaagatttggccccttatcttgatcaaaaggattttaaggcgtacactttcaatccttctgatgaagctgttgtcactaaaccaatgacggttcaaatcgtgaaggttcaatccgttaatgatcctgatcgggttgtaccaattattggtaatgataatattccattgagttttaaacacattacaccagctgatattatttcttcaatgaattacttctttaacttacaagaaggtattggttcaattgatgatattgatcacttgggtaaccgacgaattcgttcggttggtgagttgttacagaaccaattccgaattggattatcacggatggaacgggtcgttagagagcggatgtcaattcaggacgcctcgaccgttacaccacaacagttgattaatattcgaccagtggttgcctccatcaaagaattctttggttcatctcaattatcacaattcatggatcaaacgaacccacttggcgagttaactcataagcgtcgtttgtctgcccttggacctggcggtttgactcgtgatcgtgccggatatgaagtccgggatgttcactacacccactacggccggatgtgcccaattgaaactcctgaaggacctaacatcggattgattaacagtctttccagctatgcccgggttaacaaatatggctttattgaaacaccatatcgccgtgttgattggactactcataaggtaacggatcgaattgattatttaactgccgacgaagaagataactttgttattgcacaagctaactcaccattaaatgatgatggctcgtttgaaaataagattgtcatggctcgtcataggtcaaataacattgaaatcagcattgataaagttgactacatggacgtttcacctaagcaagtagttgctgttgcaactgcatgtattccattcttggaaaatgatgattctaaccgtgcgttgatgggtgctaacatgcaacgtcaagcagttcctttaattgatccgcacgcaccacttgttggaactggtattgagtacaaagctgcccatgattctggtgttgctttaatttgtaagcatgatgggactgttgaatatgtcgatgctcgtgaaattcgaattcgacgtgaagatggtacgcttgataaatacaaactaatgaaattccgtcgttcaaatggtggtaagaactacaaccaacgaccaattgttaaagttggcgatagcgttgataatgacgaagttttagctgatggcccatccatggagggtggcgaattagcgcttggtcaaaacccaattgttgcctttatgacttggcaaggttataactttgaagatgccatcgcaattagtgagcgacttgttaaagacgatgtttatacttcaattcatattgaagagtatgaatccgaaactcgagatactaaattaggacctgaggaaatgactcgagaaattcctaatgttggtgaagacgcattgaagaacctcgatgaaactggaacggttcggattggtgctgaggttcatgatggcgatatcttggttggtaaagtaacgccaaagggagttactgaattatctgccgaggaacgcttactccatgcaatttttggtgaaaagtcacgggaagttcgtgatacttcattaagagttcctcatggtggtggcggtattatccaggatgtaaaagtctttacccgtgaaaatggagatgaactttctcctggtgttaacaagatggttcgagtatatattgcccagaagcgtaagatccaggttggtgacaaaatgtccggtcgtcatggtaataaaggaacggtttccgttgttatccctgaagaggacatgccattcttacctgatggaacaccagttgatattatgctgagtcccatgggtgtaccttcacgaatgaacattggtcaagttttggaacttcatttaggaatggctgcccgtcgtcttggtatccacgttgcaacacctgtttttgatggtgctcgtgataaagatatctgggacgctgttaaagaagctgggatgccttctgacggtaaatatatcttatatgatggtcgaactggtgagccatttgataagaagattgccgttggtgtcatgcattatctgaagcttgcccacatggttgatgataagatccatgcacgttctattggaccttattcattagttacccaacaaccacttggtggtaaagcacaatttggtggtcagcgttttggtgaaatggaagtttgggctcttgaagcttatggtgctgcttataccctgcaagaaatcttgacgtataagtctgacgacgttgttggccgagttaagacatacgaagcaatcgttaagggcgaaccaattccaaagccaggtgtcccagaatcattccgagtacttgttaaagaattacaagcccttggtcttgatatgaaagttcttgataacagccataaagaaatcgaactacgagatttagacgatgatgacgatgttgtcaacgttgatgctttaagtaagattgctgaaaagaaagatcaagaaaaaaaggaccaggaaaataaagagactgcggagcttgaagccaagtcaactgatgccaaatcaactaacgctaacaatagtaatgactaagggaggtcaaactagtggtcgatgttaataaatttgagagtatgcaaattgggctagcctctcccgacaaaattcgtagttggtcctatggtgaagttaaaaaacctgagacaattaactaccgaactttaaaacctgaaaaagacggcttgttcgatgagcggattttcggtccaactaaggactgggagtgtgcctgcggtaagtacaaacggatccgatataaaggaattgtttgtgatcgctgtggtgtggaagtaactcgttcaaaagtccgtcgtgaacgaatgggtcatattgaattagcagctccagtgactcatatttggtactttaaaggtattccaagtcgaatgggcttggtattggacatgagtccacgagcacttgaagaaattatttattttgcttcctatgtggttactgaaccgggtaatacacctatggaaaagaagcaactgctttcagaacgggaatatcgtgataagaaacaggaatacggtccccgttttgaagctcaaattggtgccgaagcaattaagacattgttaaatgatgttgatgttaacaaagaggttaccgaattaaaagatgaattgaaaaatgctaccggtcaaaagcgaacccgggctgttcgacgactggatattttggaagccttcgttcaatctggtaataagctttcatggatggtaatggatgcaattcctgttattccacctgatctacgaccgatggttcaacttgaaggtggtcgatttgccacttctgatttaaatgatttgtatcgtcgagttatcaaccgtaataatcggttgaagcggttgcttgatttgaatgcccctggtattatcgttcaaaacgaaaagcggatgcttcaagaagccgttgatgcattaattgataacggtcgtcgcggccgaccagttgcaggccctggtaaccgtccacttaagtcactatcacacatgttgaaaggtaagcagggacgattccgccaaaacttgcttggtaagcgtgttgactactctggtcgttcagttattgatgttggtcctcatttgaagatgaaccaaatgggattgcctgttccgatggcgatggaattattcaagccgtttatcatgaaggaattggttggtcggaagttagcgtctaacattaagaacgctaagcggaagattgagcgtcaagatgatgatgtctttagcgtattggaagacgttattaaagaacatccagttttattaaaccgggcgccaacacttcaccgtcttggaattcaggcatttgagcctgttctggtaagtggaaagtcaatgcgtcttcatccactggtatgtgaagcttataatgccgattttgatggggatcaaatggcaattcatgtgccattgtctgatgaagctcaagccgagtctcgattgttaatgcttgctgctgggcatatcttagcacctaaagatggaaaaccagttgtaacgccatctcaggatatggttatcggtaactattatctaacgatggaagaaaaaggtcgtgagggtgaaggaatgatctttaattcacctgatgaggcacaattagcatataagaacggtattgttcattggcattcaagagtgggaatccaaacttcggtttatgcaaaaaagacgtttactaaggaacagttaggtaaaatcttggttacttccgttggtaaaatcatctttaatcagattctacctcctgatttcccatatattaatgaaccaactgaaactaatttaaacggatttgttgatgacaagtacttccttgctcctggtgaggatatccatgaacatctgcagaatgccaaaatagtaccacctttcaagaaggggtatttaagtgacatcattgccgaggtttataagaaatacaaagtaaccgaaacatctttcttccttgatcgaatgaaggatctgggctataacgaatcaactaaatctgggttgaccgttggtatttccgatatcacgcaattgcctgataaacaagaaattattgatgatgctcataaaaaagttgacatggttaccaaacagttccgtcgtggtttaattactgaccatgaacgttatgaacgagtaattggtatttggaatgatgctaaagatgttattcaaaaacatttgatggaagcccaagatcctcaaaaccctatttttatgatgagtgattctggtgctcgtggtaacatttcaaactttacccagttggccggaatgcgtgggttgatggctgctcctaacggcgaaatcatggaattaccaatcacatcaaacttccgtgagggactttctgttttggaaatgtttatttcaacccatggtgctcgtaaaggaatgactgatactgcccttaagaccgccaactctggttacttgacccgtcgactcgttgatgtggctcaagatgtcatcgttcgtgaaaaggattgtggaactgatcgtggattaaccattagtgctattcgtgaaggtaatgaaatgattgagccactttatgatcgaattgttggtcgatacgctcacaagacggttaaggatcctaagactggtgaagtgattgttgcagccaatgatatgattaatgaagatgctgctcagaagattgatgctgctggcatcactgaggtaacgattcgttcagcatttacttgtaacacggttcacggcgtatgtgagaaatgctatggtcgtaatttagctactggtgatgaagttgaagttggtgaagcagttggtactgttgctgcccaatcaattggtgaacctggtactcagttaacgatgcggaacttccatactggtggtgttgctggtaatgctgatatcacccaaggtcttcctcgtgttcaagaaatttttgaagctcggaatccaaaaggtaaagctgaaatcagtgaagttactggtacagttgaatcgattgaagaaaatcccgctgaaagaactaaggaaatcacgattaagggtgaatctgacacaagaacttatacagttccgattacggctcaaatgaaagttgctgaaggtgacttcattcaccgtggatctgcgttgaacgaaggttctgttgatccaaaggaattgttgaaggttcgagatgtcctttcaactgaaaattacctcttgcatgaagttcaaaaagtttatcgaatgcaaggtgtggaagtttcagataagcatgtggaaattatgattcgacaaatgctccgtaaagttcggattatggatcccggtgatactgatgtgctgcctggtacgttgatggatattaatgactttaagaatagtaatgccgatacggttgtttctggtggaatcccagcaacatcgcgaccagtattgctaggaattaccaaagctgctcttgaaacaaatagtttcttgtcagctgcatcattccaggaaacaacaagagttcttaccgatgctgctattcgtggtaagaacgatccacttgttggactaaaggaaaatgttatcattggtaaattaattccagcaggaacaggaatgccagattatcgtggtattaagccggaagagattggtagctcatcgactgatggtgtttattccattagtgagcttgaaaagaaaatgaaggccgaagatgcaagtaaaagcaaatcgaccaagtaatcacgacttaatttagttaaaaagcgttcaacagcaaaacgggaaaccggcttgctgttgaacgcttttttgatacatataaaatttctaaaaagcaattgttgtcgggtaaactgacagaaaatcagaaaatctataagcaataaagtaacccatggttaaaaaaggaacgaatgggattttattttcttttggccagggagcaataattaaataaaaggttgcaaagacacatgccagacaaattgtccaaagaagtaaattaatggtagatgctaaccatagacaaaacaaaatatcgatatcaccgctgccaacaaaaaattgcttgcggttgacaagctgaacacctaaataaatatagcaacaatgatgtggctaagtggctgattagattccacgaagcaactggcaaagagaaggcaaatgccggttgttggaatgagttgtgttctatggtcaaacaaactcaggtaagttagaatcaagatcgaacctaagaaggtcagtgcttcaatttgaagtggcgttgatgcaaaagcgacaccaagaaggatttcaactaaaaatgaactgattgggatgtgctgtttgcattggcgacacttgccaattagaataatgtaactgagcaccgggatcagatcaatcgcccctaattggttgccacatgtgtcgcagtgcgaacgtggccaaacaatcgattcgttgcggcacttcctaatgacaaccaaattgacaaaggaagcaagactggcacctatgaaaaagtttaaaattatcatgattttacctccaataattaactacgaaaaacgactaaagttttgttcttttgtcgtaaatttaaaattatttttcagaatgattgacacaatttgttagtcatgataaattagacaaggtgctttttgtgacagattcctgaataatcagacatgctgactgtttatgacaaaaagtgttgggcggtacacatttctttttacataaaaaagaaccgcctggatgtgtggacttataacaaaaattgaaaggagtactttttagatgcctacaattaatcaattggtccgtaaaggacgtcattctagaagttcaaaatcaaagtcaccagctttaaactatgcttacaatagttttaagaagaaggccgttactgttccagcccctcaaaaacgaggtgttgcaacccgtgttggtacgatgacaccaaagaagcctaactcagctttacgtaaatatgctcgtgttcgtttatcaaacctaatcgaagttactgcatatattcctggaattggtcataaccttcaggaacatagtgttgttttaattcgtggtggccgtgtaaaggatttacctggtgttcgttatcacgttattcgtggtgctcttgatactgccggtgttcaggatcgtcgtcaaggtcgttctaaatacggtactaagaagcctaaagaataattttcattatgcaatctaattaatttgttttatagaatcatgaggaggataacgaaatgcctagaaaaggaaatgttcaaaagcgggaagtacttcctgatccaatttacaattcaaaattggtaacccgtttaattaaccgtttaatgttagacggaaaacgtggtactgcatcacaaattttatatggtgcatttgatttaattaaagaagaaacaaacaacgaaccagttgatgtttttgaagaagcaatgaagaacgttatgcctgtacttgaagtaaaggctcgacgtgttggtggttctaactatcaagttccaatcgaagttcgtcctgatcgtcggacaacattggcacttcgttggcttgttaattacgcacgttcacgtggtgagcatacgatgactgaacgtcttgcacgtgaaatcatggatgctgctaacaatactggtgctgctgttaagaagcgtgaagatacacatcggatggctgaagctaaccgtgcatttgcacattatcgttggtaatatcaggctatccaatagttttaaattagtaggtggctaatttggccactttttgtacgaatcggaaggagttacacaatggctaacaaacgagagtttccgctcgaaaaaactcgtaatatcggaattatggcccatattgatgctggtaagacgacaactactgaacgtatcttgtactatactggtaaaattcacaaaattggtgaaacccatgatggcgcttcacaaatggactggatgccacaagaacaagaacgtggtatcacgattacatctgctgccacgactgctcaatggaaagaccatcgtatcaacattattgataccccaggacacgtggacttcacggttgaagttgaacgttcacttcgggtgctagatggtgctattgctgttttggatgctcaagccggtgttgagccacaaactgaaactgtttggcggcaagcatcagactatgatgttcctcgtatcgtatttgttaacaagatggataaagttggtgccaactttgatttttccgttcaatcgattgctgaccgtttaaatgctaagccacttcctatccaaatgccaattggtgctgaagatgattttgaaggggtcattgaccttattgaaatgaaggctgatctttatgatgaagatcaacttggtactgagtgggacacagttgatgttcctgacaagtacaaagaagaagcaaataagcgacgtgaacaattaattgagacggttgctgatgttgacgatgacattatggataaatatcttgaaggcgaagaaatcagcaaagctgaattaaaggctgctattcgtaaagcaaccttaaacctcgagttattccctgtattggccggatcagcatttaagaacaagggcgttcaaatgttgatggatgctactattgattatttgccatcacctcttgatgttaagccatacaacgcaactgatcctgacacaggtgataagattgagttaaaggcaaatgatgatgcaagctttgctgcactagcatttaaagttgctactgacccctttgttggtcgtttgacttatatccgagtttactctggtacgcttgaatctggttcatatattttgaatgctactaaggacaaacgtgaacgtgttggtcgtttgctccaaatgcattcaaatcatcgtcaggaaattccagaagtgttctctggtgatattgcggctgctattggtttaaagaacaccactactggtgattcgttgactgatgttaaccgaccacttcaccttgaatctatggaatttccagacccagttattcaagttgctgttgagcctaagactaaggctgaccaagataagatgaatgttgctttacaaaagctttcagaagaggatccgactttcaaggctgaaactaaccctgaaactggtgaaactttgattgccggaatgggtgagttacatttggacattattattgaccgaatgaaacgtgaattccatgttgaagcaactgttggtgcgccacaagtttcatatcgtgaagcatttactaagaaaacgtcagctcaaggtaaatttattcgtcagtcaggtggtaaagggcaatatggtgatgtttggatcgaattcactccgaatgaagaaggaaaaggattcgagtttgaagacgctattgttggtggtgttgtccctcgtgagtacattcctgctgttgaacagggattgaaggaatcattatcgaatggtgttttagccggctatccattggttgatcttaaagccaaattatatgatggaagttatcatgaagttgattctagtgaagctgcatttaaagttgctgcatcattagctcttcgaaacgctgctaaaacggctgatccagtaattcttgagccaatcatgaaagttgatattaatgtccctgaagaatacatgggagatatcatgggtcaagttactgctcgacgtggccgtgttgaagggatggaaagtcggagtggcgcagaagttatccactcattcgttccattggctgagatgttcggttatgcaacaactcttcgttctgcatcacaaggtcgtggtactttcacaatgacatttgaccattacgaagctgttccaaagagtattcaagccgagattattaaaaagaacggtggcaacactggagaataatggctctttgtcaactgaggttgatatcagcttatatagcaaatccgaaaggatttgctttttcttttgcattaattgaattaagcaaataattccatttgaatcctagttcgataatggtcaaa

SEQ ID NO: 660 - DNA, 8058 bp, Unknown
  Metagenome-assembled genome
ctgaaattcagcttggcaagcctcgtgggcataccaaaccatgtaactgtgaccttcggaaacatctaaagcgatcacatcagacaatttatcgcttcctagcaatttatttatttttgaagttattcgctcacctagacaactaaactcatttcctgtacacggcctcgtaggtcctcaatcttaaaccagcttaaagctgtggagatggcgacgacccttttttactacggactcgaagtccctcagagcatgaacggtctttagcttcatctccagtgtaacgaaaaagatccagttagaagctgatttttatcggcttctaactggatctaatcttagattgtttatatgagcttacttttgccgttaaacaataattggtgagaacgacgaaattcgagattagaatcgtggcataattcgccacacatcgttttctaatcatcactctgatagtccataattaacactgtttccgaataattaatatattgtcttaaatgagcggccattgaccaatcaatatgtccctgctccaatagtacctgaacaccttccctttcagctgctaaagctttaattcgcagatgttggtactgcatagtatgatctttaatttgctttttggagtgttcctttgccaattcaatttgatttcgatagtgaacaatcaaatgataaactgattgactgtcaaaccgctgattatcaatatcatctctggcaaaataacctgaaagttctttgatagcccccttggcttgttcacgctgaaccaacgcaagctcatttgaaatatcttcgtgactgcgccgttgaatcaaccataacgacattttatttttcaatcgaataaactgctgcgatgtgccatgtccaagtcgaactttgcgaccaatcgagcgaatcatctgattttccactcgttgaaggcgtgcattagaaaccagataagtttcttttgaaatttcatgatcgtcgaacagacgctgaattgcagaccgttctcccttcaatgccacccttctaagggctaattcatccgaaatgattgtcgccatttcttttttatcctgaagttttaactcgagtcgacgaatcaaaaattgataatccagaatcagatcataagcttccttctggttaaaaggacgacgttcctcttcaatccgttgaacagccaacttcataatataaagccgagcttcatcttcagagatatattgaccgtcttgctggtcttcgttttcgttttcaatttcgtccggatcgtttgtagaatttgctcgcgtcaacaacggtgctttatcttccgaaataagtggtaatgtcacggttgcaacaaccaaactaataataattacgccggcagccacaaaaagggctaacgatcgggacggaaaacgatcaccactcgcaacagtcattggaatagataaaacaccagccattgtcacagcaccacgaacaccggacagaccagctaaaagagcagccttgaaagtaggcatttgtttgttcttaagaaacttattgcgatttgaacggattgtgctaacccgctgatagccataaatccacacaactcgaataactaataaaattaaccaagcaacaaacgagagtcccaaagcagcaaaagtgttgattttatcattttgaatcacgttagtcatggcaattggcaattcaattcctagaattaaaaagacaatgccgtttaacgtgtagataataatgtcccatgttttttcactgaccaatgttaattcgggctgactacgatctggcgctgttccataaaaatgaaaaacaatcccagctgccacaacggcaatgactcccgaagcatggataaactcctctgtaatcagataaacaacaaacggggtcgtgacctgcagaactgtactaaagatcacatcgttaattccctgacggtatagccaattttcaatcatcaaaatgattgcaatgatgacaacgccactgataaagcccatgatactaatataaacaaaatctgtaattgcatgtcgaagcgagaagacaccggtcacagttgcagcaatcgcgtatttaaaagcaatcaggccgctggcatcattgattaaactttccccgctaacaatgtgcaaaataccttccggcaactttgcacgcttggaaattgattgaacggcaaccggatcagttggtgataaaatggctgccaatgcaaaactgaccgaaaacggcattgtcggaataatcaggtgaaatagtaatccgccaagcagcgttgttaaaaagaccaacacaattgcgttggctaaaatgggccctcgaagcttccaaagttcccgcttgggaaaccgccgaccatcattaaagagtaatggtgcaataaataacagtaaaaaccaatcagtttcaagtggaattgatgtctgcatgatcagggcggctcccagtcccagaacaacttggatcaggctgactggaatagcagggacaaaatgatcgatgacatttgaaaagacaaccaatgtcattagtaaaataacggcttcaaggatgtgcaaaaatgaccaactcctatttatttaagatttcgtcgccaataattcgaacctcagtgtgtaaatgaacaccgaactttttataaacagtttcttgaacatgagaaataacatttaaataatcggttgcagttgcgtggtcaacattgacaataaaccctgcatgtttcgttgatacttgtgccccaccaacttgaaagccttgcaagcccgagtcgtgaatcaacttacccgcaaaataccccttgggacgtttgaaaacacttccacaagaaggtaaatcaagcggttgtttacttgctcttaaaaaatttaatcgatccatttctttttgaattttgtcagcaattcccgtcgacaaagaaaatgttgccgacaaaacgatttgatgattttcttgaacactagaatgacgataacccagatccaattgttcatgattcagatgaatgactttatcatctgaagtcaagacttcggcacctactaccacattctcaatttcaccgccataggcacccgcattcatgaagactgccccaccaacgctgcctgggatgcccgcagcccattcaatgcccgttagtgagtgagcctgggctgccttggtgacatcaattagagcggcacccgcgtcggccacgaccaggttctcatgtgaggtaatcttgttaatctttgtaagaattatggtaagtccacgaatcccaccgtccttaacaatcaaattactggcatttccaattacagtaactggtaattggtgatcattggcgtattccaccaattcctgacactgtttaacagatgttgggaacgccaaaatatcagcaggaccaccagttagcgtatttgtatagtgagatagtggttcattcaataaaatgtcaatctgaggataagcttttaatagtgttttatcagtaatcattagtccaaatctccatctttataaacgtatatgataattctaccacgaaatatcagccggatgtgattgaagaaacggcgtcacaaatatttcagtgtgcggaagtaaagaaagttgcctttcaatataaatattgtaaaataaggatattattgaggtgaaaaaatatgaattttgttgcaatggactttgaaacagccaacgccaaacgcgcaagtgcctgttcgttggcattagcgattgttagaaataatcaaatttcccacgaattttattcattaattaatcccgaagttgacttcagttggcgcaacattaatgttcacggcatccatcaagccgatgttgctcagtcgccaacattcccggaactttggactcacattgagccactgttcacagctaataagcttgtcgttgcccataacgcttcgttcgataattctgttttaaaacgaaccttggaacggtatggtatccaaccaccacattatttaacgctagacacgttacggacatcaaaacaattttatccgaattttatcaaccataaattaaatacgatgtgtgacaatctgaatattgaattagaacatcaccacaatgcactggatgacagtgttgcctgcgccaatattctcttgactcagcagcaacagttcggtagtgatgtcctaagacaatttgtaaaagcaatttaatcctttttcaaatcattggtgacagtttagatgcttttccagatgtctaaaaagaagagccgaggtagattgttgtgttggacaacacagcgacctacttcggctcttcttttctctgcagatctcttaaattaagcatcatcaccggtcattttaaagccgttaatcgcgaaacatttagtgtgaccgatctagcggttcaatcatgtcaaaatagtggcttcaatacactacttctcctctttgagctgctttaaattcagcttcatttcaatgacatcatgatcgttaacctgttcggattttaatttttcaaatcctaatttttcataaatgtgaattgccggagcattatcagaaaagaccgtcagcgtcaactcatccagtgagctaaacgttactccccagtcaagcgccaacgtcactaagttggttcctaaagtatagccttgaaatgcctttagaacagccacgcccagttcaccggttttttgatccgttccatcaacagtcacaataccaaccaaatcagtatcaaattccgcgactgccagtaaattttgtttcgaccgactaatcagatcgatttgttgggattccatttccggtgttaactctgtcaaatcagaatcaactaaaaaggtgttggattctttttgcaaggtttttaacaaatttaaaaccgcctggccatcttgtgctgctgcaaggcgaaaactcacttcttctgccatatcaatctcctaataattctgaaatcattttttggaagtgcgacccttccgcttgaaatgatagcgttcgaacgttatctccctgtgagtcatcacgtttgaaaataattcttaaatagttatcaggaatttcagtgctgacaaatttagaccattcgacaacattaacgccatccccgttaaaatattcttccaatcccaaatcatcaccaccaccttcttcaagacgataagcatccatgtgatatagtggaatccgtccgtcctgatactcacgaataatcgtaaatgttggacttttaacgggtcgttgaattcccaatcccttagctaatcctttggtaaaagtggtttttccagctccaagatcaccgtctaaaaggatcaagtcctggggaatcaaatatttagccaatctttcacccaaggccattgtttccgtagctgatttaacagttattgtattattcaacagatcacctgctttcaaaaaatgaaaaattttaacaatcccttaaaataataacacacaaaagactggcattaaccatttccagcttttgtgtgttagtttaataaaaacaaattgattctaatttaacgtctcggcagcagtaatgatcgataccttataaacatcatcttcactggtcccacgtgataaatcattaaccggtttatttaacccttgaagtaatgggccaagtgcttggaaaccgcccagccgttgtgcaattttataagaaatatttcctgattgtaattcagggaaaataaagacatttgcgtgaccggcaactttagaaccaggtgctttcttctcagcaacggaaggtacaaatgcagcatcaaactgtaattcaccgtcaattggaatatctggtgccatttgttgcgctaatttggtagcttcctgaaccttagtcaccatatcgcccttagctgatccctttgttgaaaaactaagcaaggcaactttaggatcaatatcaaaagtttttgcaaaacgagcactttcaacagcaacgccagccagcccctcagcatccaattcagggttaatcgcactatctgcgaacaaataacgttcatcattccgcagaagtaagaatgagccgctcagcaacttaattcctggctttgtcttaataatttgcaaggctggtcgaacagtatcaccagttgcgtgggcagctcctgaaaccattccgtcgactttatccatataaaccattgtggtcccaaaatagttaggatctttcaaccaattacgtgctttagcttcatcggttttaccttttcgacgggccacaattgctgaaaccatctcatcaacttcttcttgaggttgattctgataatcaacaatttcgatgtcacccaagtcaatgtccgcatctttagcaacttgattaacctcacctttatcaccaagaataattggtttgagcaatccatctttggctagccggcttgcggcaccaagaatccgaacatcgttaccttcagggaaaacaattttgatattttttccgctgattttttgcttgagactttcaaatagttccatgacaaaatcctccaattcctgcaaagttactttgtattaagatgtctgagtgaccttttccggcaactgccagttaattggttcttcccccattgcaatcaaagcttcattagttttagaaaatggtttagatccaaagaaacctcgattggctgataacggactaggatgagcagactgcaacacaacattggtgtcagtatcaattaatgaaattttgttgcgggccgcccgaccccagagaataaaaacaaccggtttttgacgagccgacagcttttgaatggctgcgtcggtcagctcttcccaccccttacctttatgggaaaaggcttgaccattacgaaccgttaaaactgagtttaacaggagcaccccctgctttgcccaactcgttaaacaaccatgatgaactggtttaattcccagatcggattgaagctctttataaatattttgtaacgatggcggcactttaacaccaggtaaaactgaaaaacttaacccatgtgcttggtgcggttcatgataagggtcttgacccaagatcacaactttaaccttgtcaaatggcgtcagctgaaacgcttcaaaaatatggttcatatcaggatggatatattgcgtttgatattctgatattaaaaatttacgtaactgctggtagtaagctttttcaaattctggttccaaaacatcccaccaatcattttttataaacggtttcattcccaacacctcacgttttattctaccatatccattttcaaataacatcagcgtaattcattgcgttccgtggtaaaatgaaaataataaacgaaaaggaaatgcatttatgagtcgaaaaatccagttaaacttaacggaattagatcacacaagatcaacccgagtcactgatgaatacaaagacactaaatatttaatcgttggaaaatggggactcatttctgatattttttcgctgtattcaattaccggagaattgttggcaaaagtccgtcagcaatctatgggaaccacaccacgctttgatttgtactatttacatcaatttgttggtagttcaattattcacttcacattacattatacgacaatttacatcaatggcatcaactggttaattaccggaaatcaagaaaaacagtcctacacgattagtcacggccgtgaaaaaattgcaaccattaaatcttacaaccagtctgatcaggttgtccgaattattgacgtcgataaaaccgatcatgaaccgctggtcatcttaattgcggccatcttaaatcatccatcccttgtccattcatcagtggtgaaattaccttcactagaaaaatactcggaaagattgttgcccaaaccagggacagcaagttcattcagccggttacaatcaaaactgtgtccgaaaaatcggcaacaaaataagggtctaaaatttttggggttgataccgtaaggtatcaatctttttttgcatataaatagggcatcgccctactattgaattagccaataattcagatagaaagaagtaaaaacgatgtcccaa

SEQ ID NO: 661 - DNA, 10766 bp, Unknown
  Metagenome-assembled genome
atccacgaataacagaatggttaactgtcgattggacttatgttccttggtttatccatgcccctgatggaggatgagcaggatttaaatttgtgacttgacaatggtcacttcataacagtgtaattgaattatccgaatattctgaacttgaatatttggataattcggttacacggccggaagttgccttttgtcccgcgtttttgctcggtaacaatcgtgtttacacgaatagaggctgggataaatgactattgtcccagccccttttgactactaattaattttaaagtgtaataaaacaccagttggacgactgttagtaaaacgataaagaaaatggcactgtgactccacatgttgagtaaaggccgaataaacatttctggtgttagaaacaaataaatagtgtggatcctgagaaagcgaccgatgaaaatgccaatcgacgatagaatggttaagataataatcaccaagtctttaaatacgggcatatcactcattttgaagcgagcggaaattgccgcggcaattcgatccagtccccacattcctagcagtgttgaaaaaatagttgaaataaggagtaaagaaaattttaaccacatggtgtcgtccaatctcagcagcccgttaacgccatatgggtttaatagcgaaagatgaaacaaatcggtcaataggtatggtgtgttggggtagaaaagcatccagacgatgattaacagccagaaaagaatcatatttttaggtttaccaacatcaatatgaaagcttagttcgattgggataaatgccagcagtgtgttgagaaccaaaaaattgaatggaggacgttgcaaatatgtgtatataaaaacgagccagccggcaaaacatgccctgactacccatttacttgatcgactcacaaaaaatacctcccatcgcttccaacactaattaaactatttttggtgagtaaaagctattagttgttcgatttaatttgcttttttataaattatttaaacatcttcaaatatttgttatgattagttgttcacttagtgagaatgatataatatggctgaaaaactttttaggggagaaatgcatgaactggtctggaatttttacattacataatttaacaagcttgatcgatatttgtgtcgtttggttcttgatctacaaattaattttgatggttcgtgggactaaagcagttcaactgctgcgagggatcgtcattatctttatcattaaaattgccagttcattacttgggttatcaactgtttcttggattgttgatcaagttatcaattggggtgttattgccatcattgtcatttttcaacccgaaattcgtcgtggcttagagcgggtcggtcgaggatcattgttcgtccgtggccgaaaagaaaatgaagctgccaagaagttgatttcttctcttgaccgggcaattcaatatatgtccaaacgccgaattggtgctctaattacgattcaaatgaatactggcttggaagaatatattgaaaccgggattgatgtcgatgctgacgttagcggtgaattattaattaatatttttattcccaacacgccactgcatgatggtgctgtgatcatcaaaaataaccgaattgctgttgccgctgcttatttaccactctctcaaagtaatttaatccccaaagagttgggaactcgccatcgggctgcagtcggtatttccgaattaaccgacgcgttaactgtggttatttcggaagaaacaggtgaagtttcaatcactcaaaataacgaattgttgcggggaatgacgcaggacgattacctgaaatatttcagagatcagttattgaccagcgatgatcaacaaaatcacaatagtttgatcagtacgatctcgcggttcattgatgatcacttcaaagggggccattaatgatgaaaaaaattcttctgactaattgggcctatcgtgttctctcgcttgtactggcaattctcttgttctggtatgttgggacaacccaatctggtccctcaaaccaagtgagtgacaatagtaactctacccagttgacgtctaaccgggctaaaacgttttcggttcctttatctctaacagtcaatagtaataaatattttgttaccggttatccggaaaaagtttctgttcatttgtcaggcccgtctgcacttgtgacaacaactgccaacacgcagaattttaaagcctatgctgatttatcaaaattgggcgtgggaacccatactgtccgcattcaacaggaaggcttaaataatgatttgagatatcgctttgaaccggctacaataaaggttgatattcagccaagaaaaacggttacctatccacttcaagtgaaatatcagaagggaaatattgcatctggataccaagcagggaatgcaacagctgacgtaaagaatgtcaaaattacaggtgcttctgatcagattaatcgaattagatctgtggtagcccaattgaacgttcctcaaaatgcaaagtcttcaattaatagccaagcgattgttgaggctctggatgccaaacagaatacggttaacgttgtgataacgcctgcaacagctgatgttaccctgccaattacaccagggaatagtaaggaactacctttaaaatttgaagctaagggaattacagatgataacgaaaacttttcactgtcatcaagaaccaaacgagttcgggtgttcggcacaaattcggaacttaaaaagttaaactccgttgaagtcgaggttgatacgagtgacgtaaagacctctaaaaccaaggaagttgagttggattcaaagctaaacggagtcaagggatttgatccagatcgaatttcggttaagatcactaggaataattaataaataatttgaaatgaggaatttttgatgaagtattttggtactgatggcgttcgtggaattgctaataaggagctcaccccagagctcgctttccaatgtggccgtgctggtggttatgtgttaacccatcactcggaacgtaaacaaccacaggttttggttgcccgtgacacgcggatttcgggtcaaatgttgcaagaagctttgattgccgggttattatccgttggcattgaggttttgaaccttggtgtgattacaacgccaggggttgcttacttggttcgcaatcaggaagctgatgcgggtgtcatgattacagcatcccataatccagttgaatataatggaattaagttttttgggggagacggttataaactttctgatgaacttgaggaagaaattgaagcaattttggaacgttctgaagatattctgccacgcccggcagcgcatggattaggggttgctggcgattatcttgaaggtagccagaaatatattcatttcttagagcagacgatttctgaagatttatctggaatgaaggtttgtgtcgatgccgctaatggttctaccagcaagttggtgacaacgctatatgctgatcttggaattgagtttgaaacacttgcaacgactccagatggtttaaacatcaatgatcatgttggttcgacacatcccgaacagcttcaaaagtttgttgtggataagggtgtttctgctggcattgcatttgatggtgacggcgatcgttgtattgctgtcgatgagaatggtaaattggttgatggcgatgtgattatgtatatttgtggtaaatatatggctgaacgtggtcgacttaagaaaaatacgattgttacaacggtaatgagcaatatggggatgtataaggccatggagcgtgaaggaatgaccagcgtcaagacccaggttggtgatcgttacgttgttgaaaaaatgaaccaggatggttataacctcggtggtgaacaatcaggccatattattttccttgactttaatacaactggtgacgggatgttaacgagtttacaattattatccgtgatgaaagcgactggcaagaagctgtctgaacttgctggtgaagtcaaaaaatacccacaaaaattaattaacgttaaagttcgtgataagaaatccggattgtccaatgaaaagattcaggcagctattaaagaagttgaagagcaaatgcatggtgatggtcgagtactggtgcgtccaagtgggactgaacccttactacgggtcatgactgaggccccaactcaggacttagtcaatgcgtatactcaacaaattgctgatgttgttcaggaagaaattgggattgataagtaacaactatattatagtgttcaatcgataacataaatgatttagctaatagtggatgaaaagactaagtgtaaaaatgcttagtcttttcattttgctttcaaaacgttgatatattaattgtttattaagacactttagtttcctataccattcaaggatattcggttgacatttacgttgtaattgtgtagattatacgtgttatataaatatattaatagcgaattttgtatataccaattttaaaaacgttgaggagaatacaactatgtgtggaattgttggagtaactggaaatgataatgccgtttctattttactggaagggcttgaaaaactggaatatcgtggctatgattctgcggggatttatgtgaatgatttaaagggcaaagactacttaatcaagcgtaagggtcgaatttctgctttagaggcagctgttgggcctgaagttcacgggtcagccgggattggtcatactcgctgggcaactcacggtgttgtaagcgaagctaatgcacatccccaatattctgaagatcaccgtttttaccttgttcataacggcgttattgaaaactacaaagaattaaaggctaaatatctaagcaacacgacttttgaaagtcaaaccgacactgaagttgttgtccaactggttgatcgtttcgtccaaagtgaaggcctgactaccaaacaagcttttgttaagaccttaagcttattggagggatcttcttatgcctttgtgctcgttgatagcactgatccagaaacattgtatgtagcgaaaaataagagtcctttgttgattggattgggcgatggctgcaatgtggtttgttcggatgcgccagcaatgttaaatgtgacgcatgattttttggtaattcgtgatggcgaagttgtcactgttaaaccgcatttagttcaaatcgaggatgctgaaggtaataaagttcaacgagatagttttcacgttgatatggatgctcaggaaacagataagggtccatatccttactatatgcttaaggaaatcgatgaacagccaaatgttatgcgtaaattagcttctttatatactgaagagtccggaaaaactaatattgacagcaatttgattaattctttgaaacaagctgaccgaatttatatcgttggtgctggtaccagttatcatgctggattagtcggtaagaaattatttgaaaagttggcacatgtgccaactgaagttcatattgcttctgaatttgcttatgagaatccattactgtcaaagaaaccattctttattttcctatcacaaagtggtgaaaccgccgatagtcgtgaagtcttagtaaatgttaacgcaaacgattatgaaagtttaacaatcacgaacgttgaaaattctacgttattccgtgaagcaacctatacaatgttattgcatgcggggcctgaaatttcagtagcctcaacgaaagcctatactgctcaaattgcggtcgaagcaattttggcaaaggcacttggcgaagctaaggagcaagtgattgctgaggaatttgacattcgccagcaacttggttttgtggcaactgggatgcaggctattattgatgataaagatgaaattgaacagctggctaagaagtattttgttcatgctaatcgagctttctatattggccgtggaattgatcaaacggtttctcttgaggcagctcttaaactcaaagagatttcctacgttcaagctgaaggatttgcttctggtgaattaaagcatggtacaattgcattaattgaaaatgggacgccggttattgggattattactcaaaaacgaacggccaatcttacacgcagtaatcttcaagaaacaatgtctcgaggagcggcaacatttactattgttcgcaaaggattagcacaggatgatgatacgttaatcattccagatgttgatgaattgattacaccattattgagcgtggttccagcgcaactgatcgcttactttacaagtttgaataagggacttgacgttgatcgtccaagaaatttagctaaaagcgtcactgtagagtaaagagtgggtcagaagatttagttcaaatgatataaacagagtgagccagtaagcggttagaccccagaatataagccctttaacctgatatttccgatcttggaatgttaggttagggggcttatatggccggggtctgcttgctggcgcacgttttcacttggtaataattgtgattacacaaagcggggctgagacaaaattatttttgtccggcccttttttgcaatcacgactattgccaagcaaaaatgtgggcaggaagttaaccgcgtttcgttccactcttttatataatttggaaactatttttctggcttgtcttttacttgaaagctcaaaatacaattccttatgagcgtatgttacctgttcaatgagtttgtttaaacgcagagttagttttatcataaagaatttgttacctttttgtttaatatgaccatttttattttcttaagacaatatttttgtgttagcgttcgtgttaatatatgattgttagtggattgaatgtttaagaaagtctaaaggttattatgaattaattacaaattagtgatttcttatacaacaagatattaaacattgaagcaagtaattaataaggggtggacaatttgagaaaggtaataaagtgtggattaatggccgtcgttattacggggatggggtttctcttatcgatacttccgtctagtacatacgtccgggcacaagcctcaacggcaagtagtttcattacgaagtataaaagtgatgtcaaaaaagcatctacgaaatataatttatacgggtcagtaatgatggctcaggcgggcttggaaagtggttggggtcagagtgagttgactcaagatgccaataacttttttggtattaagggagcttacaatggtcagtcggtttcgatgccgacagtcgagtacaatagtaatggtcaaatgactaatacaaccgcaaactttaaaaagtatccaacggcatatgcctcttttgcggacaatggatcgacattgcgaaacgggacaagttggaatactaactattattccggcacctggaaagaaaatgcgggtgattatgcggcagctgccaatgcattaaccggtaagtatgccaccgcaccgaattacgggacatcgctaataaaaattatcgagacttacagccttgatcagatatttggtgaaaacggatcagatggatcgtcatcatcgtcaacagcaacaaccgattcttctgatttacaggattctgcttcaactagctcgaacacaaattcaagcgcaagtacgaatcagccggatttaacaactggtcagacaacaaaagctgccgtttcagttaattattcacatggttctggaaaagacttagttccgctttcagcaaagtatagtaagtattacgtttataatcatgtaaaagggtcaagtcaaaatgaaaaacgatattcttggacgtcacttggagtcaaaaaccgagtccaagtgtatcttgacatgaaagcaaccaaacagggaacttctggatcgtggtatcgttttagattctacccaacgactaaggcgaaaaaattttgggtttacgcgccggcactttcgtttgctaaaacatattatggtgctgctagtggcaaattagttccaagccgaacagccagtggctcgttatatacacacatccttggatcgccaacattgtcgaaacaaactacgaaactcacatcgcttaaagctaaaaagcattattcagttaatcagacagcacttcaatccaccaagagcggtccggttctttggtatcggttggcagatggtaaaacaaaagggtggattaaaggcacaaatgttttatcgtttccgtcaagtattgccatggtgaatgccaatggtaccaagacaatttctgaggccgcaaactcaagttacttgtacaataatgcaacaaccgcaatcacgatgcagaagcattataagcttgctcaggttgatttaagagctggaacgaaagttaaggttgataaattggggtataaagtcaaagataaatcattatggtaccggattatttgtccaaacactgataccaaatattggatttcttctaaatttttgtcatgattggtgtcgttagttgaatctgcctaagaaccatgtataataattctttagcaattgataataggaaggactatgaattaggatgcatcagaaaaacattttcgtaaaagtaatcgcgtgctttgttgccgtgattagttttacttttcttagcgcaggtcaagtaaatgcaagtgttgaaactgattttatcaatcagcttagggcacctgttgtagaagtcagtcgacagaatcatctctatccctcagttatgatggctcaagcgattgttgagagcgattttggccaatcagggctgtctgttcaggctaataattactttggtgttaagggcagttacgacggtcagtatgtcaatatgagtactggcgaatatagttcaaagggaaagcattatgtaactgttgcccaatttaagaagtacccaaatgtgctggcttcaattaaggataatgcctatctgttaagacacgggacgttaaccgatcctgattactattctggaacgtggacaactactgctattacagcaaccgatgctgcaatggcactatcatctacgtatgcgactgatatggcttatggcaataaacttaacgccgtaatcaccaagtatcacttggataagttggacgagcaatctggtgcagcgagtgattcaggagatattaatagtcaaattgaacgacagctaaagaaacagcttggtgggacaactactaaggttcaacccaagtctgaagccaagaatatcccctccaaaataacaaatattaatcaaccgattgttaaaaattttgttttcagtaaagatccgaaagtttcccagccgggctcattagattctgataatgattttaatttacccattagaacgatcattaagaaataatttttaaggatccgcaaagtttgttgcgggttcttattttatgcagaatatttgttataataaacaacgtgaaattggaatctcttaacgtaggagagaaaaaatggaaaaagattacaaagtaaaagttgaaaatgtcacaaaagaatatgatttatttaagacacaatcagaaaaactgagatctttcttttcagtttcaaagaagcgagttcctcatttttggtcgttgatgggcatttctctgacgattcaacctggggaaacgttgggattgattggtgttaatgggtctggaaaatcaaccctttcaaatattatttcaggcattattcctcaaactaccggttacgtcgatgttcgtggtgatacctcaatcgttgcaattcatgccggtttaagaaataatttaaccggccgtgaaaacattcggctaaaatccttaatgcagggaatgaccaacgagcaaattgatgaaatgatgcccgatattattgcttttgcagacattggtgatttcgtagaccaacctgttaagagctattcaagtgggatgcgctcgcgcttaggttttgccattgcggttcacattaatcccgatattttaattattgatgaagcattatctgttggtgatgatacgttttaccaaaaatgtgttgacaagattaccgagtttaaacaagaaggcaaaacaattatttttgtcagccattctttaaagcaaattgagatgctttgtgataaagttgcctggatcaattatggcgaattaaaaatggtcggtgagactaaaacggttactaacaaataccgtgaatttaccaagtggtttaaacaacttagtaaaaaagaaaaacatgcttttgaaactgaacggaaaagcatccaaaagaactttagcattaaaaactatcaaaaacagattactgaggaaatgcagagtcaacatcctgaagagaaagatattcattctaaaattcataaacttttttatggttcggtcattagtgaaaagatgtcggtttggaatcagttgttaacgtgggccgtcctgttagttgttatattcttctgtttagtgaatgtttccggttactcggttgggcatgttctcagtgatccatctctgattatgcatccctcgaacattctacgcttaccaggaataaaataatttgccttgaattaatcatcattaattggttcttatttaacttaattggccaaaaatgatgatttttggctctttgtcaactgaggttgatatcagcttatatagcaaatccgaaaggatttgctttttcttttgcattaattgaattaagcaaataattccatttgaatcctagttcgataatggtca

SEQ ID NO: 662 - DNA, 23907 bp, Unknown
  Metagenome-assembled genome
tattagatgatattgtagcgagtagacactggttcgcgcataatgtaaatctttagattttccttgcataatcaacacacctcattgctgttccataagtgtattatatcattatttattttgcatatacaagtatttctaatttaaaaacccgctcggaaaccagaaagcgcaaggcgctttcctctcggtactgaagtgccgagtttcctcgcgagcttcgctacaaaactacttaacaaaacttcggatcttatgaccattcgctacagttaaaatcggctgtcggtaaggtattttagcaattattttcaattgatagtgtttgttaagaccgttttcaatcattaaactcgttttttcaaacccactaaccgtttttggccattttaactgctgtgcctgcttagggtgcgtcttcaaataggtcattgcttgattaaaatctttatttgaaattgttaggacgaacgttttatgcgtttgatcaagcataaccgttcccaattttcgatagtccttacttagctgcttcttaatcaccttttcagcaaaaagttgcttagacgccgctcgctgatgggctccgccgtcaaaagggccattctgattttgattaatggacgacatcgatgcttgctgttgggcggatgccggcttctgagagacagtctgttgcgcataagcatggggaatcatcgagccgccgccaataatcatcacaacgcttaacccaatcaaaaagacaaacatcccccgggtttcatttttgtaagttgccgtaatataggaaaaaattcccaaaaacagcataattaagccaataatcgtaatggcaacaaatatttttagcaatgttggcctcctcgtaattttagtttaaggttcaaataacagttttcaacttaaattgattttgaaaacacaatttaaatatcggtatgaactcaatttttaactaacttttcttaattcattaaagccttcatttcccaatagttaataacttgttgcaacaaataatttagcatttcaataacccgcagtcaaattaatttatgggcgctaaatcaacgttgcatctaagtaggacctgtttctaaaaatacaaattatcaaaattggccatagcgttattttaatgacccactttcacatattttgtaaccgtttccgacaagttgccgctaaaccgttttctttaccacaaaataaggaataatagagatgtgaggtgagtaaaatgctattttttccatttactcttgaaaaaacgcttctttattatcaaggtggtgaatttacttccactggcggttggcaactttcaaaaggcaacaatcatggcgattatgagttgatcttctgtattgaaggcccgatctatctgcaaattgatcaaactcactacgtcttgaattctggtgatttactactgattccaccgtttaaagacttcggtggctaccagtcatccccaaagtccgtcagttattactggattcgtttcttttcccaagctcgggacaatatgtttgaagaagatgagcaacacattatcgacgagatgagaattgatgaacctgccaacaatcgcattgtcttaccggttacctttaagttagccgatccagatcaaacgatcgtcttgattaaccagattctcgcaatctatccagattcatcaccacttcaagaacgtgattatttaacatccgcgctcctgatcaaattgttcaaacactatgtcagtcaaaatggttactcagaagaaaatgcccggatccgctttctcaaagaatggattcgtgccaatatgtccaataacttaacagttagagagatttcagctagggtggacctgaatccagattatttaacccggttatttaaagggcaaaccggaatgacgctccatcaatatctcaaccatctaaagattgaagttgcgacactgctactggttcgaaccgacatgcccattaaccaaatcgcaactaacgcctatttcaacgatccccgcgttttcatgcgccacttcaagaaatcaaccggtgtaacaccaagcgagtatcggaaatcttacgatactctacctgaagacagtccaaacgtcgacgccaagattccaattccgaaacgaattgctgacttgatcgattatgtgccagaaaatggtgacattccggaataatgtcatgatttgaatatcggaataaccacctttatcaagtctcttattaattttattttatattcttatttgcaattatttttccaacattaaaggagaagaattattatgaagtatttagcaaagccaatcgctggtcaatccattttatcttgggtctttcaagttgctttaatcgttttagcgtggaaggtggccgaccataccctggcaaacaatttaaccaccattacaattgcagctgtcctattaattgcgatttatttaagcattaatttggatcgcaaaatgcggcgacgtgaagaaaagaagcagtaatcatcgcttaattccactaaattaagtttttaaccaattacttaatctctaaatacaaagtgcaatcatcgattaagaccatcatccatcagcattaagttagctgatttgacggataacggaattcaatcaccgatggttgcactttttctgtgaaaatctcagattatgtttatttacagccactatccctccccgatgacggctcttaaactagaagtaattaatcatcgaggtgatttatatgtcagaaatagtatctcagcaaatgacttcatctaaaactcaggccaatttattgttattttggataacgaaactaattgtcaccggaattggcggctggatcgccttaatgttatcgcaattcatttcccaatccgtcacactattattaaccgcaacaatcctaattcacttattaaaaaagcaacacagcaagtcaaattcgcattcaatcgtttactggttaatggttggcttggcagcggcagttggcacgacaattgccaatatattaagcttggactttggcatcggcagcttgctgcttatcagtggctatctggtgaaagttttttcaaccgcctatttaaagcggcatcctgaatttaacggcaatgtcgcccacttactgttaatcgaaaatgacctcacttactggttgaatctcggcttcgaattcacatttgaatcagccgttggcacctggttaagtactgacctaagcctgcctgtattgggagctttactaacagctgacctaccaaccttattttcatttctcaaaattaatcgtaaccaagttactttccgtaacacgagtgagttagaattggcttaaagctattttaggaaaggtcacaggttttaaccatgacacacacaattttattagtcgaagatgaggaaggattaagctcctatctcacaactgaattacaatttgaaaattacacgattattctggccaccgatggtaagcaggccttacaaacctacgaaagtatgcgcggccagctggacttaattatcttagattggatgctgccgaaattagatggtctcgaagtcctacgccggattcgtcaaaacgacaacatccccattttaatgatgaccgccagagattacgttggcgataaagttgccggtttagatgccggtgccgacgattatattaccaagccctttgaaattgaggaactcttggcaagaatcagagtgatgctgcggcactcccagaatcaagcaacaagcgatgatttgtttcatatcgaagatcttaccctaaacaccaagtcccgccaagttactcgtggcaattcgctcatccaactcacccagcgggaatacgaattattattaacgttaattaaaaatgctggtgaaacgatgacccgcgatgaactcctgaacctggtttggggcgtcgattttgaaggtcaaccaaatgtggttgatgtctacattcgatatctaagaaacaaggttgaccgcaacttcaagaaaacactcatccataccgttcgcggggttggctacattttaagcgccaattataagagctaggagatgagtgtcatgcaacgaaaagcgccttcagtgaccacaacgtctcaagaaattcagcatcggtttcgaatgctgtttatttcgtttgcactaattattagtttagcagtcgtcggtgttgtcggtgtgcaactggttcatcagcgacaagccgaatcgattgaattacttagcagtcttaagcgctcaatcattgatgaccgccctgattgggaacaatggcggaaaaacagcacgatcaatacacaaaacacgtatgtgaaagttaatgaccgaacccgaaacacaccaaccaaattttattcgagcggtaccaaggcctttttgcaggccaaacaagttcacatgccactatttccagccttgacctatgtcgatggctatggctttatgtattaccgctctggctccaaattgggaattatctctcagatttggttaagcttaacccccgtcgtcaacgtcttactttcagtcattattgtggttttcttcatttttattctcagtctcgttttaggctggtattttatttcaacaaccgcgcggcgcttgacccaaccgttgagtcagctaaccgcaacggccagaaaacaaagcaaatccgaactggcttatgaaacgctcctgccggtgccatcgaccccgctggaagtcaaacagttaaccactagctttaacgaattactcacatccattaataacaaaaatcaacaggaaaaaacattcatctcgaacgccgctcatgaactgcgaaccccaatcgccgcaattcgcggtcacatccaattaattcagcgtcacggccaagagcaccctgaaattgtcggtcgttcaattcagtttattaatgacgagtcttcccgaatgcaaaccctggttaatgatttactcgcactgtcacgagctgatcgtggtagcgccaaactgacttacttcgatcttaatagcgcgttaattgaaaccgttgaagaacaacgggccgttcttaaacaagccattcaccttaacgtcatcccgcaagcggttgtatctgccaatcctgacaatgttcagcaaattctatctgctctcctggacaatgcaggcaagtactcaccagctgattctcagattacggtgacgcttcaaaaacaagccggaaaattcgttctctctgtcgaaaatacggggccgtcaattcctgacgaccaaaaaacacagatctttgaacggttttaccgaggggatcaggcccataatcatcaggtcaccggaaccggcttaggcctttccatcgtcaaacaactagctgagctcaacaaaatcaagattactgtgaccaatctttcccctcacggcactcgatttaatctgatttttactgatcccgaaaaagatcatgcaactaaatgatcccgcatcaattcttagataataatgtcattcactaactaaattaaccaatcagactgattctgttcagacaagcccagagcgggacaaaaggcgcttaacttccagagtgtaattgaattatccgaatattccgaacttgaatatttggataattcgattacacggccggaagttgccttttgtcccgcgtttttgctcggtaacaatcgtgtttacactaacggaaactgggtaaaacgactattgtcccagcctcgtacttatcgagtaggatcagtctttttgttctgcccttttcttagtaatgttcctgattacgaaataagacactgaataaattattttcgtcccagcaccttgtcataaagaatgtttccccatataagatcagcacggcgtgttttgaactgaatgaaacatcagcttaaaactaaagcattggtgatatcgatgcagccaatttctattaatcatcattctgagaatttctcatctgcctcttcttttacgcctatttcgacaaccaaggcctttctctatgatagagataatcattgatgctgagatatttgccgtgaatcatgacaatcacaatccaaacaaactcacgtcagcgactatgaaactaatgactcatcatttgccatctaagcttatctatccacaagaaagaggttcttaacatgacacttatttcactcgttgtcccctgctacaacgaacaagccagcatcccaattttttatcaaacggttgaaaagattttaacaaccttcgcgaacaattccggtcactatcagtgggaatattggtttattaacgacggttccactgaccagacactggatgaactggaaattctcaataccaaagatcccaatcgggttcattacatcgatttcacacgtaacttcggtaaagaagccgcgttgttagccgggctgactcaggctgacggtcaatttgtcggtgtgatggatgttgatttacaggatccaccggaattactgcctaaaatgattgagctccttgaaacaaccgacaacgatgtcattgcgacccagcgtaccgatcggaccggtgaacccaagttacgatcgtggtgttccgataaattttatcgcctgatcaaccggatttcaaacatcaaaatgcggtccggggttcgtgactttcgcctaatgcgtcgatcagttgtgacagccattatttcattaccagaatacaatcggttttcaaaagggatcttcaattgggttggctttaaaacgacctatttgccgttttctcaccgcgaccgggttgccggcaaaacccattggtcctttaaacagctgtttagttattcattagatggcatcatggatttttcagctgttccactggctattgcttcatggatcggtattctggcgtttatcacatcaattttaggcttaatttttattgttagccgcgccttaatttacggcgatccgacaattggctggccatccctcgtgaccattattctaatggttggcggcattcaactgttttgtctgggaattattggcaagtacatcagcaaaatctacttagaaaccaagcaccggccattatatctgattaagaaagaacgttgaggtgattaacatgattaaaaaaagtgaatttgatcggcaacaattaatcggttggtggggactattggccgtcatcgcaattctggtaaaaagccaatcaaacgtcttatttagtttcgatcaagatggcctggttactgtacatcaatttttacaaccatcccagatttcattatttaaatggctggcactctcaggcagtccagtcgtgaccacggtagccattattggaattgccggttggctgcttcatcgcaatcagccaattttgtcactgattgccgtcacaacaattgttggtggcgacatcctaaccctatttatcaaggaagccatccagcggccaagaccggcttttgaactagtccgagaatccggctttagcttcccaagcggccacgtctttggtgcaaccattctggtaattctcatttggcagctcctcattccaaaaattggccggattcaatttaagctatttttcctattattgttaatttactgggtgggattggttgccatctccagaatttatttgcaagttcactttccttccgatgttatcggcgggtttgtgcttgcccaagcctggtggcaaacggtcaaaatgggttatctccgttgggaacaacaaattttgaccaccgttaaccaattaacccgttcaaatccgaaacaattgaggtaaccgttatgaaacggatatttcgtcaaaatcaagttgttatcattatcgcggcaggcttatttgcactactactggccgctgctgtgatggccatttatcaaattacgccgtttggcgaccgaaatttactgttcagtgatgatggtgcgcaatacgcgacctttttaactgcctttcgacacgccttacttacccatcaatttagcagctactcatttagtcttggcttaggcagcaacgcgatgccaacaattgcgtactatctaatgagcccgttcaatttattgctgatcttcttttctgcagcacaagtcccgtcggccatcaccctgatcattattttaaaaattggttgcattgccgcggccatggcctattttcttcaacgtcatttccaaaccattagttggtggtcggttttgtttggggcagcctttggtctctgtggcttcgttgccgctgattattttgacatcatgtggttggacagcctcatttgtttaccattgattatcgacggtctcgacaccgtgattacagggggtcgaccaaccaaattgtttatttggctactaatcagtattatcgtaaattactatttaggctacatgacctgcatctttatcgtttgctacacaatctacggtatttatgaacgtggcaatggccgattaccatttcataaattagttggtcgcaattggcacgccattctgacaattatgatcactggtctctgcagcgtattaggttcaatgatgatccttctgcccacagtttttggaatgatgcagacagctaagcaccggtatttaccaaccaatttcactttcaaatcaatgtttagtttcccagtcttaacgcaattggggattggcggtgttaattttaataatcatttaattcacgccccagcgatctttagtacgctggtcgttacgttattagcactgggctactttgtccacccccacatcagtcggcctgccaaatatcacgcagctgttttcctgttgggattactgctaagcatgaagatttgcgcgaccaatacgatttggcatctattccaacaaccatccggatttccttttcgccaagcgttcttctttagctttatcctgattatgctcggctatgggacttggttaaaaaatgcaaaactcatcccacatctctggcagttaaccttacccatcctgcttgccattggcttaatccttggcacgctggaacccaatttgttaagcgcaaccgggttcaacaacttaaaccgttatcaacttggaacgctggccattaatttgatcttggttttggtggctgccatcgcactctttctgacgcagcacacccttcaaattggattaatgattagtttatttgccatcgaacttggcggcaacttcggcttaacgttagccggctccccatttggcaatcagactcgttaccaaacgctttatcaaaaacaagctaaccgtctccagccagttacgaaacagtccaatcaactttatcgaaccgataatcagagtcagctgatcaattccgcatacgaaaagtactataactacaatgattcgctcctgttccagtatcatgggattcccgaatataattcgacaatcaatgacacaacccggcgaaccttaaattcactcgggatgtttagtcgcaacgttcggcgaatcagtgcccagggattaatgcccgtaactgaaatgctgcttggcatcaaatatcgggttaaccgggataatcagctaacctcaaattcaaataacgttggcatgggctttcctgtcgcatcctcgtttttaaaaatcaatcttcacccaaccaaaaaatttaccaaccttgagcaaattttgaaatcattgaatcaaacactggcaccctatttttatccagcgactatcagccacattcgaaacgttcaaaggcattcagcaagctaccgccacacgcttaaaatgacggttggcgcaaccggcccactatacttgaatgctcgaattcgtggtaccaactacgcgacccttactgtcaatggccggcaaatatctgtccctcagatcccggcaaatggctaccgctacttggcacatctaggcacctttaagaaaggaaccaaactttcaattggcctaaccacgacacacccttatcgatcaggacagttacagtttgaaagtttaaatcagcataaatttagtcagattgtaaaattcttaaaatttccgggctttgttcctaagatcgttgggaatcaaattagtggcgatgtggtggctaatcatcatgaaaaatgggcctatttggcaattccctttgataaaggttggcaggtaaaagtgagcggccagccagtcgcaaccagaaaagtgttaggtgggttaacagccgttccaattaagccaggcgttaactatctcgtgctaaattaccgaacgccgggcctgctcgttggattactgctttcaatatgtggcgtcggcttcttctggataacagatttagtatcaggaaaagctgggagacccaagcatgccaaaaaatttcgttaactacctgatggcaggcagtccaagttaataaccagttatttcagtcaccctcttgaaaaattaaaatatcatgataaaatcattaataacaattaaatcagttgcgttgatgagaagagtagcaagcatgattgctttaaagagaaccgttcatcggtgaaagacggtaacaataatgcttgcgaagatgagctcagagcattaggcacgtgaaagcgatgcctacgttaagacccgttaccgtctcaaacttgactagccattggcaaaagagttgatgaggtgattgctgcaaaacaatcacaaattcgggtggtaccgcgtcaaaacgtccctgcagattttctgtggggacgtttttttgtgtctcgatggctaagcaataattaatttttaggaaatagaggttggttgatttatggcaaaatccaaagaagttgaaatcaataaagatgggacaattcgggggttatccaataccgctgtgcaaatgattgcctttggtggttcaattggaacgggactatttttgggtgccggcagtacgattcatcgcaccggtccctcaattttatttgtttatttaattatcggactctttttcttcctgatgatgcgggcaattggtgaaatgatgtacgccgatcctgaacaacataccttcgtctcgttcattggcaaatacgtcaatccaagattgggctatttcgctgcatggagttactggttggaactcattttagctggaatggcagaattaacagccatttcaacctacgtcaaatactggtttccgggagtgccggcttggctgattcaagttttcttcctattaatactaacgattgtcaatttggcaatggtcagttcgttcggtaaatcagaaacctttttgtcggggattaaaattctggctatcattgccctcattggcttaggcatttatctggtttcaacgagtcatcgaaatccatccgggacaaccgcttcctggggaaacatttttaatcatttcagtatgtttcccaatggcttacatcaatttatcaacgcttttccaatggtcttctttgcttttcaaggaatggaatttgttggcattacaactgccgaaactaagcaaccgctcaaagtactaccacgagccgttaaccagatcattggccgaattctgttattctatatcggttccttgctcatcatcatggccatcaccccatggaacacgttgaatccaaacgaaagtccattcgtccaaatctttaaattagccgggcttcctgccgcttcacaaatcattaacctggtcgtgattgccgccgcttgttcaactttgaatagtgccatcttttcaacgggacgccacctgtatcagttagctgaagaatcacccgcaaaatcaatgggtttcttcacaaaagtttctaaaaatgggattccaattgtcagtgttctcttctcagccgggatgatgattttggcaccgatcatcagttcatttaattcattaagcaccgcgtttgctttcatcgcgtccgtttcaagtgatatttatattttagtttgcattttgaccatggtcgctcattataagtaccgccaatcagctgatttcaagctcaatggttttaagatgccgcaatatcgctggtcaaatccgttaaccattgctttcttcattgcaattttcgtcagtctcttctttaatcaaacctcaatttggcctgccattggcgccttggcttggggattaggctttaacgctttgttatcctaccgtcacaaacgcgtcgaaattgcggaagaggattaacccgacccgttaattttcatggaaaatcgaatcacttattacaaaaatggggctgaggcaaaagtgattttgtccaggcctgtttttgtaccatcatgattattaccgagcggaaacgtgaggaaaaaaacagcttccggccgtgtagaggactcatccaaatattcaggaccagaatattcggataagccccctacactctggaagctaagcgttttttgcctcactcttactttagcggttacataaaataatgcccgaatacctattgtaatcaggcttcacaagcgttataaaagagatagacatttaatttttttacaatactaaaagaaggtaacccttattgtgataactgagtttaataaaataagtactggaagattttggaaatggttgagcattttgctgctgtttatttccttttgtaccagcttaagtttccacttccagattgctaaagcggctgatattaccagcagtattagtggtatttcggggaccagccccactgctattgatacagctactaacgctcccgctaaaataagtgattccaagaattggagtccgtatgacaattatcagctgacatacaattttacaatcaaagacggtaccaacgttcaaaagggtgataccgcaaaagtcgctttgccagcaggaacaaagttttcttctcaacaaagttttaatattatgagccttgatggtaaaaatattgtcggtacctttcaagctaatgccggggataattttggaaccatcacattctccgattacttttcaaaaaatccaaataagatggccggaaacctcacttttacaattatcggaagtcatgatcccggcggtggtggaaccggcggaacttcctacattggcaaacgcggctgggggcaagatggtacttggctggataacaaaccctatggattagataaaaacggccgctatcaatacgtcgtatgggatttacaagttaatccagatagtaaatcgttaaccgatgtttcaattaatgacacactggacaatctgaatcaagaaataatgctcccgagtacgctatacgttacgagcaatagtaagcctgcaactacttataaagaaggaaccaattacacaattgattatcagcctaacaaaacagatccaacctcctttacaataaaatggctttctccaacaccattacagaatccggtaaatattgaatacttatcccaaattaataagaattcaccctatctgcagaatggatcgggaataacgctcacaaacactgcttcaatcagtggtaatgatcagggcagcggtggaaaattcactgctgatactactcacacaacggcgactatcccccttggcggtaatgggcatgccggtggaacctctttaaccatcccagtagtcaaaaagtggaaaggtgttccgaccggcacaaacacaccaccgattaatgcaactttgtttaagaagtctggaaacagtgcccctgccaaagttgagacaattaccttggatcaaaccaatcagtataaaggttcatttcccaatttacccgaatatgattcaagcggaaaaccaatcatttacaccgttgctgaagattctgttccatcaggctatacctctgacgcaacaactcaaaatccactgacggttacgaatggacccgtcaccattaccaacacgtatgtaccaaaaacgacgacagtcaccgtcaataagatttggaaggggatcccatcagggacacaaacacctgatgtaacagctgtcttatatgaaaacggtaaaaagacggataagactgtgagtttaacgaccaaaaacagttatcaagccgagtttagtaatcttgatcaaaatgatgccaatggcaaaccaattacgtatacggttgccgaatcatctgttccaaagggctataccaccacatcaaccgaaccacagtcagtcataaatggcaagtcaacgttgaccaacacttatattcctcaaacaaccgatatcgcagttaaaaaggtttggcaaggtgctcctaaaggaaccaagacacctgatgtgactgcaacgttatttgcgaatggtaagtcaaccggcaaaaccgttaaactaactcagaataacagttattcaggccaattttctaaattagccaagaccgatgctaatggtaacaagattacctacacggttgccgaaacgccggttcaaggatacacgtcaaagacaccggggcaacaaacccctgataagaatggcactgttaccctgaccaacgaattcaaaccggttgttccaaagacaaccactgtcaaagttgataagatttggaaaaatgttccaacggggacaaaaacgccaacaattacggcaacgctgtatgccaatggcaaggcaaccggtaagacaattacgttggatcagaagaatggttattccaatcaattttctaatttaccgattgccgacaaagctggccacaccatcacctacacggttgccgagacaactgttcccactggctatacttccagcaccactggtcaacaacctattaaaaatggcaaggtcacgttgattaacaactataagccggttattcctaagacaacgacgatcgcggttcataagatctggcaagacgttccaaccggcacagccaccccaacaattacggcgacattgtatgccaacggtaaatcaacgggtaaaatggttacgttggatcaagccaatggctattcagccaactttactgatttaccagcgactgaccaatcagggaagatgatcacttacacggtcgctgaaaatgcggttcccgatggttacacaactaccacggctggccaacaatcagtaaagaatggcagcgtaacattaatcaacaggtttgtaccaaaaacaccaagtacgccggtgacacctggaacgccaacgacgccaagtacaccaacaacgccgtccacgccgacaacaccggatacgccaacgacaccggatgtcccattaacaccagaaacaccgaagacacccgtcattccttccctaccatttaatcagccaaatcaaccaacccaaccaacccatcataagggttcaaagggctcaaacttcaactttggttcaacgattaatcccaaggtaccagcaaaagttactccgaagattccggtccatcaatcaaggaccaatcacacctcgacaacacccacaacaaatgggtctaatcatcgtgctggttcgacaacaactcaacctaccaatggcttggcaaaattgccacaaaccaacgataatcgtaaccaaagtatcgtcatgacgattgttggtgccgtgttgcttagcatcttaggaatggctaaagccgttcgacctaaatcttgattgtcttaagaagaatcggattcatttatttacagcccattaagaaatcacgaaatacaaaagaaccggtatcaatcacgctacgaaggtgattgataccggttcttttagacccaaaataagtaacctgattagaattactttttagatttggttcgttggctgacttttcgccaaacccagaaaatataaacaaaacacaaaatgcccacagccgtgttgacatataagttccaggccggaaatttatcagtaatcaacgtgccaacataaatcacaaagaatgtcacccaaatatcccaatctaaatggcggtgctggtaaacaaagaggtcaatatccaaaataaccagaatcactgccacagtgatgaagattggcatcggatttttgctattcataataatgaagaaaccaattaagtttgcgactgaggccaacgtgttgattatcgcttgtaataaattttgttgtgccttcttaaatctgtcacccccaattaaccaattattatgacttaatcttaccacttcggtacttccgccaaagccaaatcatgtagccaatgcataagatgtctaccataacgttaacggcaaaagtagcattgggataaaaattggtaattaatgtgccaatataaatgacgaagaagaacgcccaactatcccaatccagatgacgtcgctgtttgataaataaagcaacatcaacgatcaataggataatggcaacgcccataaaaatcaccagattattggtaccggcgctcatcagcatgtatccaagcaaaatggcaaccgtcgcgattagattaaaaaccgcacttataatgacgggttgaacttttttctgcaacttattttcctcacattcatcaatttcttaactattgatctattgtcgatcaatttagttgtaagtaacagtataacgcagcaaccggaaaaagtgaccagattcaaaaagttaactaaaaatcaaccattagtcgccatttcagccgagtcatttgaacatcccaatactcactaaaatttacacgccttttacgaattttaagtctaaaaatttacatctccttgttatgttaagagtgtcatcaaagaacataataggggtgacaaatccaacttacgaggggtatttttatgttaacagtcaaacatcaagccattatggcagcggccctactcatcattagtggcggcttgcttgctcactcacagcccgccaatgcagcatcttcgcaaaacacgacttacggctcagccacaaccaaggtgtcaccatttaaaattattgttaaaaaggaagtccattcttttaaaactgccgattttaccaaaagcaacttgaccggcattaatcatccatccaaacaattagtggttaccggcacccaaaaatccagtgcgggcactctgcgatatcagcttgacgatggtaccttcatcacttctgatccagactatgtgactcggcagttttatgcctccctacccaaatcaaaacggatcatcgtcaccgataccattgggataaatagttacaaatcaccaacccttaaaaataagatgaaccattttcaatttcatcagtcacttaaggtcagcaaaatcaagaagtttaacaacggcaacattgcgtatcgacttgcatccggtggttatgtcaccgccagcaaattatttgtgaaggcaatgtagctactaaattttcctcaataaaacaatccaggattattctcgagaaagcatgggcagaaaagcaacttccagcgtaatcgcctttcaccccactcttaataaataaaggatcagttatcggcaatcgaccgtgactgatccttttttgacccgctaatccttatagcttacattttatgatgcagccgtagcatgatcaatagccaaacaatcaaaacggcggaaataataatggcaatgatccaagcatcctgcatggccgccagtggtaacttcacgttcattccataaaagccggtaatgatcgtcggcacggccattgtcagtgaccaaatcgtcaaaaacttcatggtatcgttcaaattattattggcgatactattaaacgtatgatcaatgcgatccacaacttgggtttcaatttcaatcattcgctgaacctgttcggcttcaatcgtcacatcttcaaataaatcacgcttttcctgattggcatttttaccaaagtaggtattcggcagtcgttgaagcaagctcaaatttaactgaaccgcgctggtcaggaaggtcagtgtctgttgtaaataagataatgccactaaatcagcattcttggtctttcgattgagcattttatccaaatgatttcgtttgcgggtaaccgcccgagaaattggcatatagctgtcaaccacggcaaacaacgtttccaaaataaaagcgtcaaccgtttgaacttccggattttcagcagccgtctgaaacgcatcgtcgacctgtttgatccgactctcattaaaggtgaacagaacccctttgtgtaacagaatcccaaacggtctggtaatataccgcagtaatttgcggtccaaaacatacggcgccaaaaaaataaacaattgatcgtcttcgttaatatcgtgaacaaaattggtactttcatctttatcaacgacatactcaataatatcctcatcaatgccgtactctttcattaactgctgacgttcttcaggggttaagcgaaccgtttcaatccacttggttccccggatttctttttcaggtttaatcatacgaactctcctgtgaatcgttatttaacaatgcgttatctctatcataccgaatattgaggggaaaatgtgatattaggttaataatattatttaaacgataatgagatttgattctaaataaaagtgattgctttattattgcgaacttgctatcatgaaagtatgaaaaagctgacttttacatattatgactgggaaaaatttgcaacatttttagattcgttgccagcaaaggatgctcaaaaattagtccagctaatccggaaaatcgaacaatatggactacaaacatccgaacgacaagaatgggttaaaaaactagaaaataatttatacgaaattcgatcaaggcaaggatcaaatattcaaagggtgatttacttccaaatagatcaaagccaatatatgatcacccatggtttcactaagaaaacacaaaaaacgccaataaaagaaattaatcgaggaatcagactgcggaatacatatttccatgaaaggagaaatggtcatgagtaaaatcgatgaatatatgaataatcgccggacccatgataaagaatttgcatctggtcttgatcaagttggctttaatcttgatgccgccgttgctgttagtaatttaagagaaagtttgcacatgactcaacgtgaatttgcaaaatatataggcaaaccacagtcgacaatttcacgaattgagcatggcaatatgaatgtttcaacgcaattgttaaatcaaattgctcaagcggcccataaaaaattaaagatcgaatttgtttaagcattgtcgatctcattactacaccttttcgtcatgtcattatgacgatattcaaaattaatcttgataaaaagaccagagtgagacaaaaggcggttaacttccagagtacaactggattatccgaatatttcgggcttgaatatttggataattcggttgtacggcaggaagttgccttttatctcacgtttcgactcggtaataatcgtgattacacaaaaagggactgggacaaaattactattgtcccagtcccgtcttttcgtgggaaaggtgactaacattagccatcaatccaattgatttatcgctgatgttaatcaactttcttttaaccaatcacgccaacagtttgtaagatgagataaatgtttaaactcaccagcataactgttgctacccaggcactgtacttaacccaagctttattcacaaactcacccattaattccttgctactggtgaatttaaccaatggcacaatcgcaaatggtaaagcgacactcaggaaaacttgtgacagagtcagcagattttcaatcttagcttcgttgccatgataatagatggcaaaaatcaacactggcgttactgacaataatcgagtaagtaaccgttgcgcccataatggcattcgaagatgaatgaatccttccataatgatctgccctgacagcgtcccggtaatcgtggaactttgacctgaggaaagtagggccactgcgaacagcatgctcaacattggactggcaattgcacccacaatgtgcgagttgttcaatgaattaaataaatcaacgaatcgcccgaccgtgctattggttccgaagaacaacgcagcccctaaaattaacagcaaagagttgacaatgaatgcaattgtcagttgcaaattggaatcaatcgtcgtgaatttaatggctttagccacatcctggcggtcatgtcgatcgactgcccgggtttgtgagatagacgaacccagatataaatcatggggcatcaccgttgcaccaacgataccaagtgccaaatacaacattgatttattagtgacaatgtctttggtcggcatgtaaccggcaaacatttggtcaagttgcggtcccgctaagaatacttcgtaggtgaagaccaacagaataacggcaaccagtgtcgcaacaattgcttcaatcttcctgaatcccaatttcatcagaagcaacaagatcaaaacatcagcagtggtgatcaaaatgccaacgactaacggaatgttaaatagtaatttgagagcaattccggaaccgataatttccgcaacgtccgtggccataattgctgattcggtaattaaccaaagaacgattcccattgtcttactggttcgttcccgggtcagctgagctaaatccttaccggtaacaattcccagccgagcagccattgattgcaacagcattgcaattaggctggagattaagataaccgacaataaactgtacttgaactgggcaccaccggcaattgatgtaatccaattaccaggatccatgtaccccactgcaattagaattcccggaccggtgtaggcaaataatgttcgccagaagccggcattcttcggaactttaacgctgccgttaacttcatccagactcttgttttcaccttctgtactttgaaaaaatttatgcttaggttcttctgctacgctctcacgcatatcaataccctctttcattgagttgaattcaggtcagttgcttgagtgagcactcaatcaattcccacaacctattatacacatcaataagtttaggtcaaccaaaatctattttaaatattagttaacaaatgagaaagattgagtgtatacttaaaccagatgaatgatcaaacttaaaataatccaagtttatgataagttcgctcgttcaattccaaaattgaaacatattgaggggttaaccatgctgaatcatactgaattacaactactaacagatgcacacgtctttgatgatatgactgacaagcaaattaagatctacaccgcggcaattgaagtttttgccgaaaaaggctatctcaacaccagtaccaaagagatcgcagccaaagcagatgttgcggaaggcaatattttcagcaaatttaccaacaaacgcggcttgctgaacgcgattatcgaacccgttgcgaaatcgattttccctgaaacattatcaagttttactgatagtgaacccattccaaaagacctcagtctccatgaatttgtcgattcactcgtcaaagatcgaatggattttctagaggataatcaagatgttttaaaaatcttcatttccgaaatggtttacgatgatcaggttcgtcaacaatatttgagtaaatttccagatgcctattggcacacaattaacgataatctcaacctgcttaaagctacgcataaaatggtcaattgggataactgggaaatcatgcagatcatgtggtcactgattggtggaatggtgatcagcttcatcttctttcatattcaaccaaccgacaaagcggtcaatcacgcggtggccgcactggttaaggcattaaatccccgattgtaagttatcaatatttgcgacaaaaaatagatgaagttaggataattcaactgaattgtcttaacttcatctattttatttacaggttatattcactcatgacccatcttttaagcttaatttcacaaaaaatcactaattgtttgaacgattagataaatatttaacccaattagaacaatcgttgcaaaccaagctgcgtatttcacccatacccgattagcaaattcacccataattttcctgctactggtaaaaatcactaatggaacaacggcaaatggtaatgccacactcaaaaatacttgagacagggttaataattgttcaattttggcttcattgccatgaaagtaaatcgcaaagatcaccacaggcgtcacagaaattaaccgggttaacaaccgctgagcccaaagtggcatttttaaatgaataaacccttccataatgatctgcccagacaacgtcccagtaatcgttgaactttgaccagatgatagtaaagcaaccgcgaacaacatactcaaaattgggctggcaattgcacccacaattttaggatcgcccaatgcattaaatagatcaacaaatcgaccaaccgtactgttagttccaaagaacaaggcagctcccaagactaacaacaggctgtttacgataaaggctagcgtaagttgcagatttgaatcaatcgttgtaaatctaatcgctgtcttaagtgactggcgatcctttcgatcaacttttctagtcagggaaatagatgatcccaaatacaaatcatgaggcattaccgttgccccgacaattccgagtgacaagtaaagcatcgacttgtttgtcaaaatgtcacttgaagggaaatagcccattaatagttgattgacttgtggtcctgacaagaaaacttcataagagaaaaccaacaaaataacagctaccaacgtggccacaatcgcctcaatttttcggaagcccaatcgcattaataatagcaaaatcaacacatcagcactggtgatcaggatcccgataatcagtggaatcttaaatagcaattcaatggcaattcctgaaccaataatttcagccatatcagttgccataatcgccaattcggtcacgacccaaaggaaaaaaccaacgcccctagacgtatgctcccgagtcagctgggcaagatcttttccggaaacaattcctaatcgagcagccattgcctgaagcaacatggcaatcagactggaaattaagatcaccgataacagcttatatttaaactgggcgccaccggcaattgatgtaatccaattaccaggatccatatacccaacggcaattaaaatgcccggcccggtatatgtaaataacgtccgccaaaagccggcgttctcaggaacggtaatgctcccgtttacttcatcaagactcttattctcagaactttcattctcgaactgaaacaacttctttttcttaggttccatgtcgctctctcgcattctgaagccctctttccattggattgaaattcaggtcaagttattgagcgtgactcaattcattgccactcggaattatatactgcttaactttttagtcaagcctaaaaataatgaacaaacacaatggaaagataatttaaaacctgtagctaacgatgtcacgcaataactgaagacaaggtttaattaattttgcctcccttatcattttatgccgttatttacgcagtacaagcaaagtgatgtaaagaaactgtaaatctgacgtaaaaaggatcaatttccattttaattctccctcaattagggctaatcgttttgacaatttggctggctatgcgcagcttttctaaaaaataaccgatccattgccaaaaaggcaaaggagtaatcaagaatagccggaaagcgtgttaacaaataagatagccattcttaaaaagtagttatgccattcgccaatgcgaaagcccgatcctttagtacttggattattagccatttttcacttcattgccatataaaactctccgaggagcgcttcgcttttcctcgtaaccatcaatgaaaagaaccgtcttcctttgtataatataggtgaaggcggtttcattgtacatcgttatctttttggtgctaataag

SEQ ID NO: 663 - DNA, 3065 bp, Unknown
  Metagenome-assembled genome
tattagatgatattgtagcgagtagacactggttcgcgcataatgtaaatctttagattttccttgcataatcaacacacctcattgctgttccataagtgtattatatcattatttattttgcatacacaagtatttttaatttaaaaactcactcggaaaccagaaagcgcaagacgctttcctctcggtactgaagtgccgagtttcctcgcgagcttcgctacaaatctaaacgatgggcaggagaactcatgacaaattcagaatccaagcgccatgaaaatttatccgcaaaactcgccgatattcaaaaagaaattgacgaaagtaaatctagtcatatcgttgccaagtcaagattaaacggcaatcaaagacgattcagagttcaacccgataaggcaactgcttttaatgggccggattggattcaggaaaacattaaacggactagagcgtatggccgccaacttgagaagcgctatccgttacataaggtttatttcaatcgactatccaagctcaactggacgtggattgatcaaatgccgctggacactaaccggattaacggtctgcttaagctgaatgatcagcagttaaatcaaacatttgttgatacgttaacggcaaattccaaccaattattgaatgaaaatttggatgatttggctaattcattagattccggccatgctaagcaggtgacaatgatcaaagaattgattaatcagaatcagaaatattacatcgtcctttttaacacactttttccaattttagaaagtgaaacgattaaacggtttggtaatcataagcaggtgacgtggaattttagtccgtcgttgaatgttgtccgtcgaataaccagggagatgcgcagtgaccagcagatgcgatttggtcgtctcttggaattaaacgaattaaacgtgttgatgggattgtatacgtatttcgattttaatgattatagtttggcaagcatgccatattcgagacacacggtggagcatggccgttttgatcccaataattatacatttacgcaatttatgcagttggtgctcattactcgaaacattacttatagtaaccgtaaaactggttcataacagtatcgcgtttgctttattgtttgctgggcacagttactgtgatttgccaaaaaatgttacactataattacttgctcgttacatttattgaatttcggtgaaaatcgggcattaaccttgtgcttttgggggaaagccgttataaatgagtatgagtgataaatttctaaattaaactaaggtgggatatgaatgagaggacattttaagttagctgttttaacagcgctccttttcgcgtccgctggggtatttggcgttgcatcaagcgctaatgcggatggcgtcattgaagctcccggctctgctggtagtattaagcaggttaacgccggaaacgtcttgaaggattataatgaggaagcgttgaacactgttaataacagttcaccgcaaggaaacaccagcaagaagtatacaaagtacacattggatgaaagtggttataactacgccaattcatacaacacaattgatggtagttcacaaactaacacgtttaagaccaaatggttcctaccagatggatttaacgtatccaactaccaacatggtaacttccagagtgtttctttggacggtaatggtaatctgtattttgttgaatctaacgggactaacaccaatcagggtgcaatcgttaagtttgacatggctaaattacagcaattaggggtcaatgatgatgttttagcaatttggaaagcgtttgattactttaacccttatacgactgaaggaacacaacataaccaagaatatgaagatgcctacaaccaaatgcagggatcatttgatcaaattaagactttgaccaatacattaaatcaaaacaagtcttggcaaaacaaccagttaaattatcaaaagacagctcagaaatggtatttccattggaagacaaagaaagctaacaatcaaaagactgttaaatcaaacacggcttcctatgctaagaaacaaaatgccaagaaagttgttaaacaagcaactgccaagatggcacgttggatgaaatcataccagatgcataagaagaaagttgccaactacaacactaagattaccggcatccagaaccaaatcaatacttaccagagtcaagttgatgctgttaaggctcaaaatccggacatgttcaagtatgttgatattgcccaaacagctactttgagtccccaagttgatattggtcatgggcaaactttgagctttaacccacaaaaccaacatctgtatcttgctgaagataatacgttgacggacttggcatcacgtgatgataacaatactgttcttgaaatggatccaaatacattgaaaccaattcgagaatataactttaagatgtaccatggcgatagtgccaacttacaacttcatacgttagcatttgataagaatggtaatgcatattggggccgtaagttgggtaagggctatatgttcttctatggccgacttgatgaaaatggcgttagcttccaggcttcatcgtccatggttggtcaacgtggtggtaccacgaaccaaggcgttgctgttaacccacaaaataatcgtttgtactttatttctgacgatattttgacatcaattccaaccagtcaaattcaagatggcagcttcaaggcttctgatattcattatcaagcctttaactccggccgtgaatttgaaagcttggcatttgatcaagatggttatggctacttgttagcattgtggccacctgagttaatgcaatccactgcaccactgaactaatctttttcgtcagtttaggcgaagcagataatatcatttaaataaatagaattggctctttgtcaactgaggttgatatcagcttatatagcaaatccgaaaggatttgctttttcttttgcattaattgaattaagcaaataattccatttgaatcctagttcgataatggtcaaa

SEQ ID NO: 664 - DNA, 16026 bp, Unknown
  Metagenome-assembled genome
aattttgaccattatcgaactaggattcaaatggaattatttgcttaattcaattaatgcaaaagaaaaagcaaatcctttcggatttgctatataagctgatatcaacctcagttgacaaagagtcttattaacttactttaccaattcaaatttgtaataatgaaccggtgtattagcgaattgaactttaacagccttatttgatttatttactaagataaaatgtgtattatcggtaaatctcaaataaaaacgttcgtaattcttttgaccgcgttgacgataggtaattgcccaaaaagctttgttatacgtaataactttatagctagcgtaattgattaacttcttttgaaccttaccgtccttataaaggtattgattcaaaccggtcgactgactaaacttagttacaactcgataaccgttattattgccagaacgccaagtaccagttggttcattaatctttaacttactcccggcattactattcgtagttgaactactggtagttgatgaactggttgtcgacccagaattagtcgttgcatttgtagttgtcggtgccttaacaatcatgatgcgatagaaataagacgttgccgaacgacgcgcatagacataaagcttttggtttgctttaaagcttgtatgcaaatcagcactaaacttacctgtttgcgtatccgccgttgtcgtcgcaatagtctttttatttgcagttcggacaataatcgaaacacccttggatgcggttccgctgacgttctttgatgttgtataaacgttgttcaccttgagtgatggagaactagcagacgcattgatactgattcctaagaaaaacgatgcaagaacagcaataaatgcaataactttaattttcttcattatactgtttactccctagtctttattttgcaaattatattataagcgattaacaaccaaactgttgcgcttaaaccttcatttatgtatttcttaataaagagttcgtatattaaattagtgttggcaaaagattaacctgagtgtcctattcgcaaaaaagatctggcatgatttcgatattgttgccggaaaataaccacgtgctgaaatcattaccagtatttttaaaggccacaattgttgagttgaaaagtttttccaaaatgaaaacagcatctctgtaaatttttatcatttacatgagctatgctcttttgttgtgttgatttgtgttatataatgttagcgaactggtatagacaatatactgaaattacttagttaatcttttgataggagtgaaaaatttggcaactgaaagacgttctttgattatgctctttggggctactggtgatcttgccactcgtaagctttaccctgcaatgctaaagctttacgaaaaagggaatatccgtgatcactttgctgtgattggaagttctcgttacaagtttgatgacgctaaattccgtgagatggttatgaaatccgttgataaggaaagcagcaacaaaaaactaattgctgactttgcaagtcatttttactttgtaacccatgacgtgaccgacttagctcattatgccgttttaaaggataaggcagctgaactggataagaagtataaattaggcggtaaccgtgtcttttacatttcaatggcccctaacttctttggaacagtcgcaaagaaccttaaaaatcaaaacttactcagtactaacggattcaaccgtttagttattgaaaaaccatttggccgtgattttgagtcagccaaagcattaaatgatgaattaagcaacgcatttgaagaaaatcaaattttccgaatcgatcattatttaggtaaggaaatgattcaaaatatcgaagccattcgtttcggaaacaccattttcgaagccctttggaataaccgatacattgataatattcaagttactttagctgaaaaccttggtgtcgaagaacgtgccggttattatgataattcgggtgctctccgagacatggtccaaaatcatatcatgcagatcgtgagtctccttgcgatggagcaaccggttgcatttaaagataccgatattcgagctgaaaaggtaaaggcattacgtagtcttcgtgtttacaatgttgctgaagcctcaaccaacttcgtccgtggtcaatatggttctgttggtaatacgaaggactatcgtcatgaagatggtgtcccagaggattctaatacggaaacatttgttgccggcaaattattatttgataattatcgttggtcgggcacaccattctacatccgaactggtaagaaacttgccgacaagttcacccgagtggatgttgtcttcaagaaaccacttgttgacatctttgcattcccacaaaatggcaatgcaccgctaaacgccaacgttttgacaatttttattgaacctaatcaaggattctcattagttgtcaacgctaagaatagtgaacaaggattccacactgaacccgttaatttacaattcattgaggattcaaaacgtaccaagagtacgccacaaccttacgaacgactcatccatgacgttttgaagggtgatggtacaaacttcgccagttggccagaagttgccaatgcttggaagtttgttgatcaaattcgtcgtgtttgggatatccaacaaccaatgttccctaactatattccaggatcaatgggtcctgtttctgctgatgaattattggcacgtgaccaccgtgaatgggtatataagttaaaccaataaatcattagggttttactgcccgattgttggaacaattaatagtcgctatcaattatccaagcggctgatacaccagaaagctgactttttagttgtctttcgcctaaaatggtcaattggcttttttgcgaaagcacttaagggtcagcttttattattcaaaataatagtttgctacgttatttatgtcagcaaacgcaatgcaaatctgaaaattatttacgctttgaacgttctggatggattcttttccattgcgataaaaaagtttttcaaagcctcaatttaataaaaggcgatttttctcttataaatgtgaccattgggagttatttttgaaaatctttttcaaatattcagctttctttttcacaatctattttgtagaattaaattaatgccgttatgtcgacattattgtttcactttttgcttgtgcaatgttacactatcggtgtagcaagttacagtatttttgtaataatttttaatagaaaaggatggttttcaaatgtctgatcaaaaagcaaacatcggtgttgttggtatggccgttatgggtaaaaaccttgcccttaatatcgaaagccgcggttacactgttggtatctttaaccgtactggcgcaaagaccgaagctgttatgaaggatcacggtgagaagaagttagttccaagttactctgttgaagacttcgttaaatcacttgaaacacctcgtcgaattatcttaatggttaaagctggtaaaccaactgatgctgttattgatgaactgttaccacttcttgataagggcgatgttcttatcgatggtggtaacacaaacttccacgacacaatggcccgtaacgcccgtcttgataaatccggtattaactttatcggaatgggtgtttccggtggtgaattaggtgccttacaaggcccatcattaatgccaggtggtcaaaaagaagcttatgatctggttgaaccaattcttaaacaaatcgctgccaaagctcctgcagatggcgagccatgtgtcacatacatcggccctaacggtgctggtcactatgtcaaaatggttcataacggaatcgaatatggtgatgaagagttaattgacgaaagttacaacattttgagaaatcttgccggctattctgttgatgatttagctgacatcttcaaggaatggaataaaggtgaacttgacagttacttaattgaaatcactgctgacatcttgactcataaagatgatttgggcgacgacaagactaagccaatcgttgatatgattctcgaccgtggtgccaataagggtaccggtaagtggagttcacaagacgcacttgaagttggggttgaccaatcagtcatcactgaagccgtttatgctcgctttatttcaatgattaaaaaggaacgggttgccgcttctaaagttcttccaaagcctaagggtgacattgactttgacaagaaagaaatcgttgaaaaagttcgtgaggccctctacttcggtaaagtaatgagttatgctcaaggctttgctcaattaaaggctgcctctgacagctacaagtggaacatcaagcttggcgaaatggctaagatttggagagccggctgtattattcgtgctcgtttcttgcaaaacatcactgatgcatacgacaagaaccctgctcttcaaaacctgcttcttgacccatacttcattgatattgctaagaagtatcaagaatcagctcgtgacgtggttgctcttgcaactaaagccggcgttccggtaccatcattagctgctgccgtttcatactacgactcatatcgttcagaagttgttcctgcaaacttgttgcaagcacaacgtgattactttggtgctcacacatacgaacgtgttgaccgtccaggcagcttccattacacatggtacaaagaacaataaaaacactttcagttctgaaatgatctgagggattataaataaaaagagttagcgacaaaattaaattttgtcgctaactctttttattttgataaccttttcttaccaagatggccaacaaacaccaatttccgaactactgtaatttttaaaagcttcgattcactttttattttttatcaaaagtgatcagtatggcgctccaaccttataggcggcattaatttgattggcatccttttggaacggaaaggcctttgccaccccttcaatcttgctcttatcgacaaatccccagtatcgactatcattggataccgaccgatgatcaccaagaacaaaatattttccttgtggcaccttcacagcacccttatcctgtgtccagtgttgtgaaagagattgaagatcccaattgccagttccggttgttcgctgattatttgaaatataattctgattaatctgatggttattcacgtaaatttgaccgttattactagaaaccgtgtcccctggtaatccaatgacccgtttaacgtaatagtccgtgggcttagttgcctgtggatcctcaccatgtgcattaaaaataataaccgagttgcgatgaatagttgctggacgtaaaaccgttaccatttgaccactttgcaagttaggcttcatcgaatccccgtgaataaaactggcactgattacaaattgtttaacagctaaaccaattaccaatcccagtgctattggcactatccagcttagaacacctttaataaatttcaaaataaaaactccttatttagacttctaatacaccattgtataaaaggcaagattacgtcccgatgactgcctaccccttacgaattaataataacttgttcaactgcatcccgcagctttttagtcgtttcaaccggatcatcagcatgcataatcgctgatacaacagcaataccattcacatgtgccggggcaaccgctgatacattatctgctgttaacccaccaatcgcataaacggggatttgaactaatcgcttaatctttcccaaggtttcaacactggtatgaactgtcttaacatgagtcgttgttgggaaaatcgccccaacacctaaataatccgctcctaattcctcagccaacttagcttgtttaagtgttttggcagttgccccaataatcttatttggacccaatatttttcgagcgacatcgaccggtaaatcgctttgacccagatgaacaccatccgcagccacagcttgtgcaatatcaagccgatcatcaacgattaacggcaccttatagcgatccgtgatctgcttaacttgaagtgcgatttgatatatttcaagactcgtccctgatttttgtcggagttgaaccatccctactccggatcgacatgctaattcaattttctgcaaaaattcctgattcgttaaattagtatgatcggttattaaatataaaggtcgattatttaaacgcatttttaagtcctccaaatcacgtgaaatgactagataccgtaatattattattgtaatggatcagtcaaagaaataaaaggcatatttttcagcttgacaatcgaccatgaaaccgttataaatattttgtaagccaaattggctacatatcaattaaatacattcgtctggggtgccagttatggctgagattatacccatcgaacctgatgtagtttgtactgccgaaggaagaacgagctgggatatattgattttaagataacttccaaaccttctttttgcagaaaaaagaggttttttctttttctgctaattgataggataaaattggcaggctatttaatcaatttggcccctttcttcggcaactgaagaaaggggtctttttgcatggtgactgtcaatggtcatgaaacaaccggcgttgttggccaatccattaccgaattcctaacaaaacgcgatgcaccattagcaaatatcgttgttgagcggaatggtgaaattgtccatcgagccgattttgatcacacactcgttgagaaaaatgacaagcttgaattgatttcgttcgttggtggcggctaggaggaaaaaatttgaatgaacaacaaccagaagtccaaggattaagttatcaagacgtctatacaggaatgaaagaacgtaatgttaagggttctaccgcaaggctggcttctgctcacgttacaattgccggagctggcgggttagggtcaaacatcgcaattgctttaaccagaattggggttggtcatctaacgttaatcgattttgacaccgtcgaactcagtaatttaaatcgtcaacaattcaaattgagtcagttggatgtccccaaagtcgttgctttaaaacaaaatcttcaggagttcaacccatttattgaaattaaaacgatccaagagaaagtgactcacgacaacgttaaagccttttttgctcaggcagacattatctgtgaagcatttgataatccagctgccaaggcaatgctcttggatgcagtaaccgaattctatccaaataaaccgcttgtgatgggaactggaatggcaggtattcacagttccaataccatcacaaccaagcatccccgtcccaatctttatctgacaggtgatggcacttctaagggagtggaaggcttaatggcaccgcgggtaatgatctgtgcaggccacgaagctaacatgattacccggttgattttaggtaaaaccaccgtttagccagatgcctcacaattgactcaggaccagtgtcacccttgttttaaatataaaccagcccacgatttactttaggaggatattatgacaaatactgacgaactaatcattggtggtcacaaatttacatcacgttttattttaggatccggcaaatattcttatgatttaattgattcggcaattaaccatgccaaggcccaaattatcacgatggcacttcgtcggactaatacagctgaggagaacattcttaactacattccagacgggattaccattctaccaaacacatcgggttcaactgatgctgaagaagccattcgaactgctcggattgcccgtgaactcagcggtagtaatttcatcaaacttgaggttgttcccgacaaaaaataccttatgcctgataattatgaaacgttaaaagcgactgaggttttagctaacgaaggctttattgtcatgccctacatcttaccggatttaaacgtcgccagacaactggtcgaggcgggcgctgcaacggtcatgccacttggcgctccgattggtaccaacaaaggattggcaaccagagatttaatccaaattttaattgacgaaatcgatgtgccaatcatcgttgatgccggaattggtcggccaagccaagcagctgatgccatggaaatgggcgccgctgctattatggccaacacttcaatggcaactgccggtaatattccactaatggccgaagcgttcaagctcgcggttgaagccggccgaaaggcgtttttggcaaaaccgggccgggttattgaacatggtgccgtggcttcatcaccgctaaccggcgttagtgaaagctaaaccattagtcttattcaaaaatgttaccactagaacaaatgataatgaggcgatcgcaatgttaacaaccagcctggaccaattggatcagcggttgaaaacaattaattctttttcacataatggtcttggtcaaaaccgcttggtatacacgccaagctggatagccggccaaaaacaattaatcaattggggactctcaattgggttagccccaacagttgatgattatggcaccgtttatcttgacgtattaggaaccgaaacgcctaatcagattattgcaaccggatcccatatggatactgttgctcaaggtggcaggttcgatggtctatatggcgtcattggtggcttgcaatcaattgaaacgttactcaatgcgtttggccgtcctaagaagacgcttcgattaatttcatttagtgaagaagaaggcagtcgatttccaacaacgtttagtggctcgaaacactatgcccgcattgaagaaacggttggtctaaccgataagtcagggatttcattcgataccgcacgtattagagcggtttctcggcttgaagcatcatcggttaaccgatcgttacccagtctgccgctgacttttaccgaactgcatattgaacaaggaccacgacttgttgccaaacaccaacaaattgggcttgtcacttcgattgttggtcaacgacggtttacggttgttatcaacggtattgccaaccatgccgggacaacgccaatgaaccggcgacacgatgcacttcaatccggcattcaactaattagtcgactcgaacttttggcgcaatcattaagtccggatttaacagttactgtcggtgaattcaatgttgaaccaaatacctcaaatgttatccctggcaaagttagcttcaccattgactgccgacatgttgattcagagattctcaatgagtttgaaacgatgattcattgtgaggcaaagctgatgacccggcctcaattgtcaatccgtgtaaatcgttgggccaacagccaaccggttcaattagatcaacagcttttagcccaaaacgatcacttggctaatcagctgaatttaagtcatgtttcgctggcttcgggagctggccatgacagtcaaattatgagccaagtaacaaggacgacaatgatttttgtcccaagtattaatggcatcagccatgcaccacaggaagcaacgcatttaactgatttaaaagctggtgttaatttgttaacagccagtctacaccagcaggcctattaatcaaggagaaagtgatgttgagaagaataagcttaacaagccaaattagtattgggatgcttgtgggcggtttcgcaggcctcattttagggccacaaattgctagcattcaactcattggcaatatctttttacgcctgattcaaatggccgttgttttactaatctttggcgcggttattgaagcaattggcggtttagctgctaatcaactgggaagattaggtggcaaaaccgccggatggtttctaatcacaacgctagcggcagccgttttaggattgctaatcggctatctcgttaatcccgggataggtatgaacttgtcgcgggttagtcacgctacagagattgccaaagcacctagtaacatcgatcaaaccatcttaaacttttttccatcgaacatttttgactcccttgcaaagggaaacgtgatccaagttattatttttgccatcttgttcggcattgttcttaatcaggcaaataaagccggcacattcaatcaagtattgtccttaatcaagcaactcaaccaattaactgtcaaattggttatgttagtgatgaggaccgccccgattggaatcgcatccttaatggcctgggtgactgccgatagtgggttaaaagttgtcctgccactcttaaagtttctaatggcattcggattgggaagcgttgtcttcttaacttgtttgtttacacttatcagttggtatgcaaaaattccacttgggggcctgatcaaaggattttccagaatcatcctgattgcttttacgacaacctcttcagcgattgcactccctgttgaaatgacggatgcagaatcacgcttgggagttagtaaatcaattagtcagttggtgttaccactgggcatggcgttaaacagcaatggactggcaatgtacctatcacttgcctgcctaacgttaacgcagctatatggaatttcattatcattcgttgccatgttgaaaatcattttgctatcagttatcgcttgtttaggaacagttgtcgtaccaggtggtggtttagttgcattaaccattgtcgttccaaccctgggattgccaaccgaaagtatcgccattttagccggtatcgattggttctcaggaatgtttcgcactgtattaaatgttgttggagacaccaccactgcgattgcaattgcagcggatgaaaaagaattgaatcatgacatttatgaacaagtccgtccggtaaccaagtaattatgcgtattatgtgtactaagaacccaattccaaatttacgtcaccggattggcttttctggaattggtttctcgaatccgtctcaacaattcatccttcatctcgtttaattatgaatgaaggatgagttgtcgagaaccatttttaacacttttcttctaagccaaatcacctcacgcagacaaattggatatttgtttgcgtgaggtgatttgattgtccgcattttaatatccactggagttacacaatacgtggatattaaaaatcactttcttatcagcgttgattttattgacaagaatcgcaaaaaatcagcaaataaaataacctcattccccacagctgagaaattaggttatttttgatacttgataaaccggttacttttttaatgaatcattctctatgtgacaacccactaagccgttctaatgtttcctttttcaagtagtaaggagtaataccatcggccataaccttggataacaacccctgtgcttgcttttgcgcaataactgtcggcacttttaacgacatgaccgacttattaatcaccatttgatgaacggtcacatcagttttataatgcaacttcggctgtgtattcttttcttttgattgtttggacttttccttagccatgaaaacccctcctcactattacttgttaagtcaataatagcaaaatgcatgtcgaaagtatatttaaacgactagtcgcgaacacttagtttattaaattttgcttgataccactttttccatgttccagcaaccaagttaccatctggttgatattctgggttaataactgaaataacatgctcgatatcttgaccgcggtccttaagcaaatcttctctaatttgttcaggagtaaaggactgattttcgaaaacaaaatgattaatatctgccaaaaagtaatcaaccttatattctgaaagaatttcaaggtcattttttcttaggtaaggcaaataaaagtcgataaaatctttaatcgcttttgttgtcgttgtctcatctaactgatcgatagaaactacgtctgccacaatgacacctcctcttataactctaattccattatgccacaaatcttgttgaaaaacctaatttaggggtattatggagatgaatccaaattaaaattaaaggatgcggataatatgtctcaaagaaaagtatatactgattatttcttcgatgagccggcatataacactcatgacgggggatttgtaccacttgaggagcctaaaacacctcaacaaaagctaaaagttccagagttgctggagcctgatagagaaaccgatacagatatgtattatacggtaattgcgcaaaccggggaagttcagctattaccaggggaaaaaacaaaaacctggggatataataccgatctgcttggcaaaaccattctttttaaaaaggggaaaatgattcacattacattaaagaatgaattgcccgaattaactactttccattggcacggcctaaatgttccgggtcctgttactgatggtggctgtcatgcacctgtttatccaggaaaaagtacccagattgaatttaaatgtgaccaaccggcagctactttatggttacatgcccatccatgtccatccactgcccaacatgtttggaagggacttgcaacagccgttgttgttaaagatgatactgaagccaaactccccttcccaagaaattacggtgtcgatgatattccacttattttacaggaccgacgcttccacgaggataatcaatgggattatatggcggattatgacccagacggtgtccaaggaccaactccaatgattaacggtaccattaacccttacttcgatgtcacgacgcagaagctcagattacgcattctggacggtgctaatcgtcgtgaatggcgccttcattttagcgatgatttaaaattcacccagattgcttccgatggcggcacattaccagaaccagttgatttcacgcacttaatgttaacctgtgctgaacgggctgaaattattgttgattttggtaactatcaacctggcgatgtcgtaactttattctgcgataatgttccaattgttcatttcagaattcacgcctttaaacgtgacgaccgtcaactaccggaccatttggccgatatcccagatcctgatgttactccggatgcgcctgttcataaagtggtgatgtccggaatggatgaagaagttgaaatgaatggcaagaaatttgatatgcaacgaattgatgacaaacaaaaactcggaaatgttgaatattgggacgtttctaatactaacgacatgagcaatggcatggttcatccataccatatgcatggaactcaattccgagtcatctccagaaacggtcatgcaccatatccaaacgaaaatggattgaaggatacagtcggtgtcaatccaggtgaaaccgttcgattgaaagtttggtttgatcatcttggcgtttatatgaaccattgccatatcattgaacacgaagatggtggcatgatggcccaatttgaagtttatgatccggatcatcctaagacttacaagttaatggatatggatactttaatgaacgcatttgctaaagaacgcggcgttaaagttgaagacttaaatatgccagggatggatatgtgaccttaattcttgcaaagacatttttgatatgatactattagccatggagtgaaaaaagaataaagctgttaggtgaggctcctatgtggaaaatgctactgctcagaaacgtcgaaagacgccaatgagtcagctgtccaagtcaaagtaaggcttggactaacgtagctgttattataactacatcacatagtgctaaagctcaacgactggcgaaaagtatcgtagtgtgtccagtcgttagcggctggacactttttattccaaataaaattttttgaagaggtgagagttatgacaaacgaatttaaagatcctggagcgtcgaagcatcagtctattaagggaaaattggttgtggtaactctctcacaacttgaattttaatgagagattgttatgatcgattttcccaaaagcagtaatccttcgatttatctaaacgtattatttcttgattcatggctttagtgccaaatgcatcacaagaaaattctcgtattcgttggtttagatatttcaaaatttttgggaattcggttaatgcaatttctcagtggtttcgaacacttaggtactgacgtacttgtgctcgatagactgtttgcggtcgaaaaacgcttcaccttttaggaaactaattggggagaatgaattaatcgttcaacattgccaacacataaaaacggtaataatagtaatcatgagggcgcgacctccaagtatctggtggaaactgattcttgaaaaatgactgctatcttatcgaactaataatattataaaaccgtcaacgtaaattcgttgacggtttttgttttattcaaactgaatatgctgttataaatgagaaagcaaatcaacttttaaatctacaattggttgatctgctttcttatttcaattctgaaatatctgttattggtaaatcagcccatttacgataaaagcaatctattttacaagttactattttttgtactgagcaatgtattgtttagacttttcttcatcaaattctttttcagattttccaataacaacagacgcaagcgaattacctaccacattaacagctgttcgacccatatccacaattcggtcaatcccggcaatgaaagttaatccagttacaggtactccaatggttgaaattgttgccagcaggacaacaaaggaagcccctgggacgccagccattccctttgatgtcaccatcaaaacaactagtaatgtaatttgctgaccaatcgaaagatttatatgataagcttgtgccaaaaacaacgccgcaattgattgataaattgctgaaccatccaagttaaacgtatatccagtcggaataacgaatgaaacgattccttgacttgtcccgaatttatccattttttcgatcatcttgggaagaacggcttctgaactcgctgttgaaaatgcaagtaagatttcatttttgatcactcttaacagatcgaaaatattgagaccaaacaatttggcaacaattcccataatgactatcacaaaaaagatcatggtcgcataggcaattgctacaaagtatcccaatggtattagtgcactaatccccatttcagccaacgcgacaccgattaatgcacaaacaccaataggtgccgcatgcattacccagttggttaccctaaacatgacttcggcaacagcatttaatccatcaattaagatctttcctttctcaccaatggctgcaattcccagcccaaagaaaacggagaagaaaataaccggcatcatatcaccgttagccaacgatttaaaaatattagttgggataattcctaataatgtttgccaaattcccgaatgctttgccgctttagccgtcgccatatactgactaatatctgagccatgtagcgaatgaatatcaattaatgttcctggatgaagcacattggcgacaatcattcctaaagcaattgcaaccgtcgtcattaattcaaaataaattaacgttttcaaacccactcggcctaacttcttaatatcaccaatactggcaattccaaccgttaaacacgaaaccacaattggtaaaacaatcatttgaattaaattaataaacatggttccaatattttgcatcaccataattgccatttggttcttataaaaaataattccaaaaaagattcccaaaattaagccaattagaatttgccaacccagagttattcgatatgccttatagcgcctcatcatttccacctattccttacagattttaactgttttattataaaacaaaagccctcgatagtaaaaactatcaaaggctttcgattactttgcgcggcaacgtcctaccctcgcagggggcgatcccccaactactcttggcgtgcagaagcttaacttctgtgttcggcatgggaacaggtgtatccttctggctatcgccaccacactttgtgttgctga

SEQ ID NO: 665 - DNA, 31375 bp, Unknown
  Metagenome-assembled genome
cataaaggtgacctcctattgtcatgcggtaacaactcagtgtttatacaacatcattatgagtttaaatccgcgaattgacaattaggaggtcacttcatattatctctggaagttaaccgcctttcgtctcactctcttaatttctaatacgataatttactttgcccaactctcaatgagtgtcatttggccattcaactcatagtcttgaatctggttcggtaaaatataagacattcccttagttaggcgatattgtcgctgattgaccgttaggctgccctgcccagcaacaaccgtttgaatcaaatatcggtgctcctgagttagaaccgccgcaccgttaacgaccaccttttcgacagcaaaataagttgcattcactaattgcgtcatcgtcgcgtgagcaatcctggtcacttcttgtttaatctgtggatcacgatgcggcacattggttaccgctaaggcgtccttaacctgaagttcacgctttttacccgttgctggatccactcgatcaaaatcatagaatcgaaatgtcagatctgagctttgttgggtttcaagtgccacaataccagttcccagtgcatgcagcgtgcctgacgggacataataaaagtcgcctgctttaaccggcactgtgcggagaatcctatcgatatggccgcttgtcacagcgtctcgtaattcctgttcggtttttgctgtatgcccataatacagcttagcatccgaagtcgctgataaaatataccagctttcggtcttaccgtatttctcaccatgtagcttggcgtattgatcatccggatgaacctgaatcgataaatcacgattagcatccaagattttgaccaacaatggaaatgcttcatcaaccggatgaccgccaaacagctcaggatgattttgccaaacactccccagtgtctgaccggcaaattgaccattcgtcacggtgctggggccatggggatgagctgaaacgatccacgcctcacctgttcgttcgctcggcaacttaaagccatactcccgtaatttagtgccaccccacattttttcatgtaaagctgcctttagaaataaaggtgctgctgccaccattgttaaaacctccatcatcatttgttataaagcaaaaattgtttttgtaagtatttcgttgttaaactcgtcggttgtttaatcagatcagttggccgtccctgagcaacaattcggccgccttggtcaccaccacgcggtcccatatcgattaaataatcagcgttggccattaaatccaggtcgtgagtaatcattaatacagttgcgccctgatcgataagttgtgagaagacctttaatagaacccggacatcaagcggatgcaagccaaccgttggttcatcaaaaataaaaagtgcgttattttgactgcgtttcatgtgcgacgtcaactttaatcgttgtgcttctcctccggaaagggttggtgtggcttcacctaaatgcagataccccagccccatttgttgtagaacggttaacgtctgttgaatcgattcattctctttaaacaggccaagtgcatgatcgacgtcaatgtctaaaacgtccgcaattgataagccgtgccacttaacttggagcaccttgtcgttaaaccgttttccattacatgttggacaggtttcaaccatatccggtaaatattggatatccagtgaaatttcaccagttccgccgcaggttggacagccaccctgcttattattataagagaagtaactggcagtatatcctaactttttagctgcaggaagcatggcaaacagctttctcaagtgatccataatattggtatatgtcgcaacagtcgatctggcatttttccccaccggggtcgcatcaacactgacaatgtgttttaaacgtgaaggctcaaaatgggcaatatatttaggcatcgacagctttttgaattttgccttaaaggcatccaacaacccatccaacaccaatgttgttttaccggcaccggagaatccggtaacggcaattaatcggttaattggaaattccgcagttacgtcatttaaattaaatcgatggttaatcgtaagttgtgcacgccctttagcaaatacatctttaccggcaacctgccgggttagcaattcaccctttcccgttaagaacggactgattaacgattggggatcctgcttaatctgtgtcggcgttccttgagcgataatttgaccgcccttggtaccagagccgggaccaatttcaataatccagtcagccgcgttaataattgatgtttcgtggtcaaccacaaccagtgagtttccctgggcaaccaattgatgaaaaattttgattaagccggaaacattatcgggatgcaacccaactgaaggctcatccaagacgtataacacacccgttgtctgcgtccgcagggttcgtcctaattgaattcgttgtaattcaccagtagataaagttgccccagctcggtccatcgttaaataatcaagccctaagtcgagcaatggctggacctgatttaacaattctgtggttaaattgttggccaatttctgcatatctgcaggcagccactgcttaattgctttgacaaatttcggcaattggccaatgggcatctgacctgcttcggcgatattttccccggcaaccaactgggtgagccgatcgggattaagccgggtcccatgacaaactggacaagtaaagaagcgatagaatcggttaagccgtttcaacgccacgtcactcttggttgttttcatactatcctcaaccgcgttgtaagcattctcgtataatgcattatccatatgaaaaacccggccattcttgcttgggatatcgatggcataatgtttttgaccaccatgaaggaccatattccgttcctgatccgtcaactgattgtatggcacatcaatccgcacaccggccgcttgagcaacaatcggcataaaatttcgaccgggtgtccgccacgctgccacggcgccatcccgaattgttttcgtttcatcaccaatcagtctctccggatcaagttgtttggtaatccccagaccctgacagtttttgcaggcaccatcggagttaaaggcaaagtcctcagcactgaaagcataaaatttggcaccacaagtcggacatgtgatcaatcccatttcatcgccggctttatccatcgcttcggcaatcttaattgtcggtggtacttggtggccgttgggacattttggtgatcccaaacgtgaatagattaaccgtaaaacgttaaaaatctcggtcattgtgccgaccgtcgaacgggcaccaggaaccgtcggccgctgacgtagcgccaaagctgaaggaatgtgcttaacagattggacatccgcccgaccaacctgactgattcggcgccgagtgtatgttgctaaagcatccaaataacgtcgagctccctcagagtaaagaattcccattgctaacgaagattttccagaacctgataatcccgaaatcgcgacaaatttgtgtaacggaatattgactgagatatttttcagattgttgacgtttccgccaatcacttcgatatgttcaggttgcgaattttgtcccatgaaaagcctcccaaaattaaacatctttcattaatttaccaacatctttcattatagaacaaccctaaatttagtgtgatcggagatatctttgtgaaaataatagatagatctttaaagaaatttcatttgatgattcgcaagcaaagagttaaatatagcagcttacatgatctcttgtatcacttaaaataaaatatgttccaagaatattattgacattttttaattaaatgagtatattagtaataattaatctagagaaaaagcaatgcgtagaagagtattaattaactgattttacaggaagccccttaactgagaatgtggcactgatgttaattaaaaaagtaatctacaagctgttgttacgacaatcattgatcgaagtaacgactgggaatgcgcccattacagcaatgaagtatgtctgcctaattaacggcagttggtactttactgagagtcagttgttttacgacaactgaaaaataggtggtaacgcgttaaggacgtcctaacttgtgaaaacaagtaggacgtcctttttctagatcaaccggattttagagttaattattcttgataacaaggaaggatgttttaaatgacacgaaaaattggaattattggaatgggccatgttggttcaactgccgctcactatatcgtcgcctgcggtttcgcagatgatttagtattaattgataagaatgaaaaaaaggttgatgccgatgcgactgactttgaagatgccatgtcaaatctgccttaccacactaatatcacagttaacgattatgcggcgttaaaggacgctgacgtcatcatctcagcccttggcaacattaaacttcaggataataaaaatgatgaccgatttgctgaacttccctttaccagtgcagctgttaaatccgttggtaaaaagatcaaagactccggttttaatggaattatcgttgatatttcaaatccagttgacgttattacttcaatttatcaagagattaccggtctgcccaaagaccatgttttgggaaccggtaccttacttgattcatcacgaatgaaacgagcagttgctaaggagcttagcatcgatccccgttcagtttatggctataacttaggtgaacatggtaattctcaattcacagcatggtcaacagttcgagtactgggcaaaccaattacagaaattgccaaacaacgcggacttgacctgaataaacttgataaggcagcccgtgaaggcggcttcaatgtgttccatggtaaaaagtataccaactacggggttgcaaccgccgcagttcacttagccaatacaattattacagatgcccgaaccgaaatggccgtttccaactatcgtgaagaattaaacacttatctttcctacccggcaattgttggtcgcgatgggattattgaacgactaaatcttcaattgaccgacgaagaaaaggaaaagctccagacctctgccaacttcattaagaccaaatttaaagaatcgatggccaaagaaagtacccaagcttagcacgtcaaacagtatttataataaaagatcgaagccttttttgaaattgcgccctgcaataacttcattggcctcggtcttttctatttattcagtaataaagggtaacctaacaagataatcgtttccgagtttaaacgtgcaaaaaccacgcagcccccgccatataaggcacttaggcgctatcccaaaacctgggatagcggtgtggtctgactgccgagtttaaacgtgcaaaaaccacgcagcccccgccatataaggcacttaggcgctatcactaaaacctgggatagcggcgtggcctggcttccgagtttaaacgtgcaaaagccaagcagcccctggccttataaggcacttaggcgctatcccaaaacctgggatagcggtgtggcctggcttccgagtttaaacgtgcaaaagccaagcagcccccggccatataaggcacttaggcgctatcccaaaacctgggatagcgcctaagtgccttatattctgggagctaaacgcttggttttgcactctctacttatttacccacacccgcatttggccattttcccggttagcccacgcataatatgggactaacttcaaatcagttggctccgtgcttctggcttttaacggttgatacaacgattcgccatcctcagctaacgtttcccttttagctgcaacctttacaacaccgacaccatttaataattgtggctcaaaatgataatcggtcttcgcgttatcatcaacatggtataaccacaacggtgtctgattatcagcttgttcagcacaataaacaactgggcctcgctgaatggcgaccttattaatatctgaattaactcgattacttgcgcccattagcttaacactcatatccaacgtcaaatcaatcgtcaacgttgattgatcaatctcaacataaataaagccatccttaaccggcaattttcggttttcaccattaacctttatctcaaaatgatcaagtgaccatcccggaattcgaatgccaaacttgaccgactgtgctttcggattctgaactttgtaatgaatattgccgttccatggaaaatcattggtttgcgaaattctgatgccattacttaactcagcgtcattggcaataaattgagatgataaaacaaccccattcataatggtatagagatattggtcaactgaagcaatcagccgtgccaaattagtaggacagcaggcaacaccaaaccaggccatccgatgggtcaaaacgtgtgatttaccgggattacctttggttgcttccgggtcagcttctagtggattgacatagaagaaatgtttgccatcctgagccattccacttaatgccccgttaaataattctttttccaagacgtcagcatattcacccttggcctcaatgtttaacatttcacgagcaaaaaacgacatcccacatgacgcacaggtttcaccataatcagtatcattcggtaaatcatagtcataagtgaatgcctcaccggtcgttgtcgacccaatattgccagtaatatacatccgtcgccgaacaatgtctttccaaaagcgatgacaagcagctaataagacttgatcgcctgtataccgggcaacatacgccattcccgtacacagataagccactcggacagcatgaccatctgccgtcttttggtcagcaattggttcggctgcttgatagtaactccgtggaaagtcctgcataccaggaattaaatcacgatcaggactggcaccgtcagctttgatttgtttttcaaagaaagccggatcttgaccgcgttgcttcaaaaaatagtgggccaaatcaaggtacttttgttcaccagttgcttcatataatctggaaagtgccaattcaatctctggatgaccatcataaccgggaatctttccttcttccaaaccaaagtgccggtcaatgcaatcggccattctggttgcaattgttagtgctttcttattgtcggttgcttcaaaataagcaattccggcttcaatgtaatgccccattgtgtaaagctcatgggattgctgaagccgtttaaacttccgttctggggcctcaatctgaaagtaggtcgataaatagccgtcgtcttcctgcgtatcagcaatcaaatcgactaagttatccgtaatctgttgtaaatcagcactagggtgatacctcaaagagtatgccgcagcttccagccatttgtaaacatccgtatcttgaaaagggaaaccgtagtgctggcctttcatttggcccgccgcaattttaaaatttgcaactgcatggctgccctgattaatcccgttattttgaggatcctcagcaacagtgatattggcctgatcatttaagacatcccactgataaggaatcgcagctgtcgcaactaattcgcgataacggtgccaaaactctgacgttatttttacctgaccaactgaaagtgaattgtttgaatttgtcatagataaaacctccgtgaatttcatttattgattaagattcattactctcttcaatatggcgagctgctaaatcagccttaatctttggctccatcttttcataccgatgatagaacaacatgattgccccaacgatggcataaatgatgattggcagccaaataaagcagaaacgaatggatgccaatgaagaggctgattgactcttgtttgcgacaaaaccggctgcagccataatctttgacggaataaaactgccaaagcctgatccaagttgaatacaaaacgcactaccgacagctgttaaaaagcctgacgcgcgaataccggttttccactccccataatcaaccgtatcggctaacatcgcaaacggcattgcgatggctagtgatgcacccatgattccaatgatccaagcagtgataaccaacgcaaaattgttgccaacaaaggccatcattgcttgacccaccgcaccaatcgctaagccgatcaacattgccgctgttttattggtcactttaacaacaaaagggactgaaattgtcgctaagattccaacaacctggagaccattaaatacagataccagttgcgcattaccaagattatatttggcatagtaaaccgagatgccatttcgatcagcctgggcaatccaataaattgcaaacgatatcaccagtaaataccaaggtgcattaccaacagttgctttcaaactatctttaaacggaattggctttgtaacggcgaccgttcgttcacgaacatttcgaaatgcagtgaatagtagaataaccgctacaacgccaaagatcgtcaccgtccacataaagccaactttatcattacccctgccaagcaaggcgactaacggcaatgcaaacgtactggtaatgaacgagcccaatgcaccaccgaccattcgatacgtattggcaccaatccgctcgcctgcatcaccagtcatgttgggcaaaatagcagtaattggtgtttgaattccggtatagatcacgcccgccgccaaaatataagtcgttccagcatagactaatttggctgttccatgtaaattaggtgctgtaaatgccaaaaacgtggcgattgcaaatggaattgccagccataagaagtatggtcggctctgaccccatttagtatgagtatggtcaacgattgacccccaaactggtgcactaatcgcatcagccactctggcaattagtagaatcaacccggctcccgcaacagaaatatcaaacacgtctgtatagaaataaagaatgtaactcgaaattgtcacatagagtaaatttccggccatatcggtaaatgaataactgattttttcaagaactggtaattttgcattaacatgattatttcccttttccatcataaatccccctcgctttactgccgacgagcaacattaacccaacccgatgattttagcaagcgttttcattgacaaacaaaaaaataagtgtttctaaatgccacctcctcttcaaaagcagttcacaattgatcatcacgttgtaacagcattctattcccatttgtgaaattaaaaaatccccagaacaaacttatggtgatgatttacgacttgttaaaagtaatatagatctgttggaacttgagggtctcgaccagagcttgccttctattcacatatccaagcccaataattattaaatcaattttgaagatcatttcttttcttaaccacagcctcaaaaacagcacgacaaagtatctttaatctcaacgtcaaaaaagagtacccggcaacacaactaaggttggcaccagacactccatttaacgcactatctattataaagtttttaattttcctcggaaatcagcaacagattgataacctttcttatccataatttcctttaattccctggaaattcgatcaaaaatctttgtcccttcaaatccaaactgggtgccaatctgaactaagttggcaccacacaaaatatgttcaaaaacgtcctgaccggaacgaatcccgccggttccaataatcgaaatatctggtcgtaatcgtagtcgaagtgcacgaacgttagctaaagcagtcggcttaatatattggccaccaatcccaccgaaaccacctttcggcttaataaccgctgactcggtctctggattcacaattaatccgttaccgaccgagttaatcgcattgacgtaagtaattggaaacccatttaggacttccgcaattcgatcaaattgatgcatatcaaagtacggtggtaacttaatgccaagttgttttttgaaaaatttgaatgtatcagtcaagatctcgcggacagcttcaaaatcataagcgatttgtgactcacccttaatatttgggcaggaaagatttaattcagtcaggccatcaaatgaactggcctgaattttctttaacatttccaagttttgatcaactgacaaaccggcaattgataaaatcacctgcttacccgccttattttggttagcctcagcaaacttcaaataatagtcaaagccatgattaggtaatcccattgaattaatgcacccaagagctgtcgctttcatccgtggactctcattgccttttcgtggctctggcgtggcactcttggtgacacaaccgccagcttgagaatctagaatcttgtccagctcatcagttgttgcacaacgaattccagcagcgtttagcagcacattatcaaattggtaatcaccaatattagcttttaaagaaatgttatttggcatttgcttcctcccgtttagtccagtcccatggggctttgtgccaggttgacaggcgtgaatattgttcctcactaaatttgttttcgcgatgaccctgttcaattagtttcgcgtagctaagcagtgggtgtagcgttgtgtgggcatcggcaaaattcttgtcagcatcaggcagaccgtaagtgaagactgacgcgacaccaatcacgttaacgccttgctttcgaaccgctttaaccgcaccaagaacgctaccgcccgtggaaattaaatcatcaatcaaaaccactttgtcagccttcgtaatgcggccttcaatttgtttgccggcaccatgatccttaggcttggcccgaacatagattaatggcaggtttagccgctctgccacccatgcagcgtgaggaattccggctgtcgcaacaccaccaatcaccgtggcgtctggataattttctttgattaattctgccaacccatccgcgatcatgtctctgagttctggaattgatatggtcaaacgaaaatcagtgtaaataggagataaaatcccactagcataacgaaatggtttttcaaggttaatacttacaattcgattatcgattaatgattgaataattttatcagttttcattgttccactcctctaacattttatgataggcggcaaccggatcatctgctttaataattggccggccaacaaccagtgccgaactgccatattgagcagcttggcttggcgttgctgttcgtgattgatcatccttaggaaagtttgctggtcgaattcccggcgtaacgtataagaaatcatcacccacctgctgtttcaatgatgtgacttccaacggtgacgtgataacgccatcagctccggatcgttttgcaagcttagccagcgatacaacctgatcaaccatatccaagcgacaattttgctcgttttttaaagcttcatctgtaatcgaggtcaattctgtaacggctaacaatttcggtgttggaacgccagcttcttcactgccaagttccaaaccttctttggcagccgcaatcatttctgaaccacccagtgcgtgcacggtggtatatgtgacgcccatccgaccaatctgcatcatgcccattttaacggtgttgggaatatcctgtaacttcaagtccaagaaaactttgaatcccttttctaataaactgcgaacaatttccggcccttcaccataaaacagttccatgccaattttaactgtcataccttcatcggtcggaaattggtcgatgatcttgaacagtccttctcggtttgcgacatccagcgatacaattagtggtcctctcatgattaccctccattattttttacataaaaagagcccgcaacaattgcagatcaagccatctctggactgactctatctgcaaattcacggactctttgattaatatgtcgtccgcttttggcctctctgaaccaaattaaagctttgttatttgttaattactttatcacttgatcggcacttgttcaagataattttcctgggaaccacatttcaacccaatcgtactaacgaagatcacccatagacacagctcttctggtattctaaattctgttcaactatgatataagataatcattttttcaataaggaggcggctggcttacgacaattcattcaagacgggcttatttttccctagccctcagtccatttgcctcccaattaggttcagcaatttacattctgggactcaactggttaattgttcaagtcaccggcaataccaaactgctgggatggattgaaggacttggtggctttgactttttattaggcgactttttggtgggttccctggtcgatcagcataatcgtaaaaccgtcttgatcggcactgacgttatttccggattagcttgtctcatcgggagttttttactcaacagtcagcatccccaagtttggctgctaatcctgataaccgccatattaaacttgatgctggccattaattttccggcagccaaagcgatcgcacccgaaattatccccgcccaatttctacaaagattcaacgcaattgccaataccctgtttaatttcgccaatgtttttgcgccactaattggtggtagcttgttggcgatcaaaagcattgattttaatgaatttctgatcattaacgcctgctcttatcttgcagcaattctactaaacggactaattccctatcactatgaaaccaaatcaaatgatcaacctaatcaatccgccttcaagagcacattgcttgggttgcaatacatcaaagagcatcccattttgatgatcaacatgttggcaatggggatctttaatttttgttacgccggttttatgttgacggcgccatacgttggtcaccatttctttggtggtcaatctaatcattacagcctatttttaacgattgccgcgttgggaggcttattgggtggtctctggttaacccttcaaaaacgtcaaatcacggccaaaaccatttatcgtgaacaactattttacggtctgattttaatgatctgcggtttatttttatcgcttcccagttggctgctgattgcgttaacctttgggatcgttcaagccagattttttggtgggattaccacattcatccagcaggaaaccgacttgccttatctcggccggatttttggcgtaacctttttgttctttgacggcgtccagccactcggagacttcatctttgggccattcatcagcacttggcaccaatggacatacgtgatcttaggcagcattatttcactatcgtttttattgcttctccatttgaatcgacgcgtctaaaaaattaacaatcaattgctaccaatgataacagacgccaattaaaatggttaatcctcgagacggtcttgcaaacaacatcaattaatgccataatgttctcagcaaaaaataaaggatgtcagcgagcattcattttggaggatacgacatggaaaatacaagtttaacgcgcagtcatactttttcgaagaatcagaaatgggttattgcttctaccagttctggcttcgctcttgaaaatatggatgtgctttttttatcgtttgcaatgagttcaatgattagtcagttacacttaagcggtggtgctgccggattgatcggctcaattacaaacttagggatgttgtttggcggcattttattcggcttaatcggcgatcgctttggtcgagtaaaaacattctcatatacgatatttattttcgcgtttgcaaccgcggcaatggcatttgccaacaacattaccttgatttatggcttacggtttctagccggaattggtgccggcggtgaatatggcgttggcatttcgctgattgccgaatcattccacaaaaaccaaatcggtaagatgacgtcggttgctgccatcggtggtcaaattggtgcaattctggccgccattgccgctgcttttatcattccacaacttggctggcatgcactcttcctgcttgggttggttccagtggttttaacttatttcatccgtcggcatctccatgaaacaaccgaatttgtcgaagccaagaaagaagaaaaacgctccacaaccagtgccgttttcaaattcatgtttagttcaccaaaattagcttatcaaagttttgctttaatgatcatgacaaccgttcaaattgccggatacttcggtttaatgaactggttacctattatcgtgcaaaaacaactcggactcaacgtctcaggatcatcattatggatgatttcaacaattgtcggaatgagccttggcatgattacatttggttcaatccttgatttctttggcccacggcgggcattcggtattttcctacttgcttcagccgcaatggtcttcaccattaccttagctcataatacaatctcattgttgatcattggtgcgattgttggcttcttctcaaatgggatgtttggcggatacggtgccgttatcagtcgcctttatcctactgaaattcgctcaactgccaataacgtcatcgttaatatcggtcgggctgttggtggattctcatcagttgttatcggtattctaatggatcactactcaatcacagtggttatggcattcttatcaattctctacgtcatcagtttcattacaatgattacattacctggaatgaaaaaaatggcattacatgctaacgaagaataggtatttggattggaaacattccgaagtatataaattttttcgatgttttttaactatataacacgctacttacgatttttctcaactgtgaaacaccgatgctattcttgctaaaatgtgcaaaagtaaagcactctccggccatataagacgtttcctcttgtttctaaactgggaaacgctgattttattcttgctaaaacgtgcaaaagtaaagcagtctccggccatataagccacttaaccccctattccgaaacaccggaatagggggttaagtgtcttatattctggagcctaaccgctttattttgcactcttatattttgccaacgccgtattcttattcgtgatatcgataaatcgggcttcaccctcaaccgcatctaccgcatctctcaggcgatcacgggaacccttagccagtggtagtttaattaaatctttagttgcagtaagtaattcctcttcatcagctaccgatccctttaatggtcttggattagttgtatccagcgcccggttaaccactgccttcaatggccccattcgcattagttccaatacggtatcataatcaatgtcatacgcatcagccaagtccaaggtctcacggattccggcctcagctgccatgataccaacgtttgtgatgagctttaatttagcaccgttacctaatgcacataagtatttaacggttccaaacaccttcaagatcggtagtacgttgtcaaaagttgctttgtccccactaccaattaaaaccagtgatgcctcgcgcgcataccgaacaccaccaataatcggcacatccagtaagtgcgtgtccttaggaagtgcgcggttaaccgcaaagattttttcaggatcaagcgttgacgtaacgattaaagtacttcccggctgtaggaaattaacgattccgggctgatgatcatcaccaacatgtaacgccaatacatcatcggacataacggccgtgatcaccacttttgaagctttgactgcctcggataatgaagttgccacatgaatgtccggctgatcaatctttgccagctttttgggatcccgatcccagaccgtcacatcataacctgcatctggtaagtgggtaatcatctcagaacccatatcaccaattccaataaacgtcacttttgtcattgttatctccccttttaaatacgacccaagtgtggattcgattatcattcctcattattatgttagtttaactatcagatatctcgcaattgcgcaccaatcggaacacacggatcttacatttccacttcagcataccgagaaaagaggccttaggcaaacactttgccctaagacctcactaacaattatcctaaataactaggtagtgtctgcagacaacagacgttaaatttttttcaccgtgttcgatttgataggctaaaaacaaaagcttgcgatcacgatagaaaaataccgttatgaattaagtgatgaacaatggtttctaatcgagttactattcctcgcctattgcactggccgaccaccgcgtcatgattctcaccatcataaacaatgaaggattcctcaattttgcgatgggcaatgtcagtaatgttaattacttgtctgataatagaatttagaatgacgggaatttgttgttcagtaaagccgatgtaaagggttagttccaactaccacctaccactggtagatggtagttggataaaatagtaatttccctttcggcttttattcaaattgttaccattttcttgttgaccaaatagtttgaggacacaccctaactatttttttgccgctgaactgcattaattgccacttggtaatcatgtaaaatcaatgcatcagatttttcagtccgctctttctgatatgcagattgtaaatcccccaatatctcttcatcaccaggcttcgccaatcttcccagcgcatatgcggcagttgcccgaatcaccggtcgaacatctccagccatcacctctcgcaatttagggatggctgaacgatcatttaagtttgctaaagcaatgatggcattccgctgtaatggtttcttgccacgccatgagccggccatttggccaaatccagccttgaaatcgtgattggaaagacttagtatcggcaacaactccggtcggaccttatcaggatcaggtgtcatttctttgtgcaaatgaaaatcttttccttggttaaacggacaaaccaactggcagatatcacagccataaataacgtttcgagtcttcttacgcgcaaagtcgctcattagcccctttgtttgcgtctgatacgacaaacaccgctgggcattcattttaccattgcccaacaatgcccgaaccggacaagcatcaatacaacgagtacaatcgccacactgacatggaattggcgtatccgcctcaaattcaagattagtgatcatttctcccaaataaacgaatgagccatattctttagtaatcaacaagccattcttaccaataaacccgagcccagcacgattggctaccgcaacatcaaccagctcgccagtgtcaaccattggtttgaatctggcagtctcgtcaaggcctttgagttgtttaattagggaagtcattttttctcgtaaaatttgatgatagtcaattccccaagaagctctcgcaaattgcccccgttttaaatttgttcgaactggtgattctttcattcgactcgggtaagccagtgcaatagcaataattgactttggatgatcaaaaatcaaagcaggatttagccgctcatcaagattgggatgttcaaaaccgcttgtgtggcctgcagccttttgagcttcaaggccggcacgcaagtattcaaaattatcggcagttgtaaatccaattttatcaatcccgatttgttgacttagttcgatcacttgttgctttgagatcgacatttgatcatcccctcgaaagtttagaatcggcaaatgcttatcaatttggtaaacattgattcatttagtcaccatttgttattcccgatcccattcttcttgaatattatcacaatcgtggctgctgaactagccaaaaaatcctctaaaccaacgaatagatactcactcgccaattagagggattatttgaaattagataaagttcaagccattatttttgactcgggattaacattaattctgtgtatttggcaccaattttcgttgatgcagataagtgacaccgccaaataccaatgtccaaacaattgcgccaacggctccaataacatcttccggtatgaagaataagctgacaaagataaccgcgaagaacgcgatggttaatggactggtgacgctgtaccatggcatcttaaagccgtctggtaagaaatcacttgatgcccgatattttctgtgagccagcatcgacaaggtataaacaataatgtacatatcactggaaacccctgttacaatcgtgaagactgacgtaatcgcagtggttaaactcatcaagggtgtaaccagaaccaacgctgctgagaaaataattgcggctgcaggaacgccgttttgggaaattttggcgaacgttttgtgcatccaactattttctgggacttcggttgccaactggtagaaatgccggccggctgagaaaatacaactgtttagtgaagaagctgccgaggtcaataccacaaagttaattaccgcagctgccgcaggaaaaccagctaacttaaacacttgaacaaacgggctactatcagccgttaacgatgtccaagggataatacccatgatgacaatcaatgcgccaatataaaatagtaagattcgaattaacgtttcgttaaccgcttttttaattacggtgtgtggtgatttagcttcgccaattgtgatgctgacaaattcaattccctgaaaggcaaagaaaaccattgggaatgccgagacaaagttaaagacaccgtgtgggaacagtgtataattgtgaaaaacatttgtaatcgttgcgtggcccaatggtgtaaccgaatggctgaacatcatgaacacacctgttacaatcatggcaacgatcgcaataattttaatcatggcaaaccagaattcagcttccccgaacaaccgggcagcaattaggttaacacttgccaagactcccaaaaagatcagttcaacaacccacgatgggaaatttggaaaccagaatttaacatatgtggccgtcgcagtcaattctgccatacaaacaaagactaagccaatccaataagtccagccgctaaaatgaccaactgtcggacctaaatatcgagaaatgaacgaaacaaacgtgtgttgggaaggatcggaataaaacatctcaccgattgcccgcatcataaagaagaagaacaagcccaatgttaggtaaaccaacattacggacgggccggttttactaattgtacttccggatcccaaaaatagtcctgttccgattgtgccaccaatggcaatcatctgaacatgccggttacttaaggctcgcatggtaccatcctggttcttggtaatagttgatttcataagcatcctcctacaaaataagggcaaataagacagttactaattaaattctaattggaatgtcattattctaccacatattttcaatacgtgttagatatttttacatatgaaatcgtttttatgcaattttgcttaattatgtgagcctttcacgggtaaaatgtaaggtttgataacatattcgttttagagaaaatatcctttccggttaaatgaaacaccaattaattaattaccaactttacttgctttttctcacccatcgttctatactcctaattaaataatttaaagtcgaattacatgaagtagttccttatctgggtgtcaggaagttggtggtcgctgcgaaccaatcaggataagggagacgaaataccgtaatactctcgacaatggtcaataactagaatccattatcttctagtgagcggtgtattttttgaatacacaagttgggtggtaccacggtaaagagtctaatcgtccctattgcatatgaacatgcaatagggacgattttttatttaccagagaaagggatgttgaacatggaacgatcaactaatgggggcttagcgcgatattgatagccactctttatgaaaacaattagtcacgaaaaaacaaaaagaggttaatcaatatgacgaaaagtaaattatctttaagtgaagcaattattgttctaattatcatcttagcaattatgggttctggtgtaatcggcctgggcttgtcaccacaagttccagttttactagccattaccgtcaccattttttgggcaaagctgcgcggatttaactggcatgaaatcaatggcggcattaaggacggtatcgataaaggaatcattccaattgttatttttattttaattggagcaatgatcagtacctggattgctgccgggacaattccaactttaatggtcattggctttaaggcaatcagcgcacaatggttcctaccaacagtctttctggtttgttccctagttggcgccgcggttggaagttgcttcacagtcgtttcaaccgtcggaattgctttcttcggcatcggcgtaaccatgaactttaacccagccctcgttgccggcgccatcattgccggaggaactttcggcgataaattgtcaccattatccgagactaataacttagcggccgccgtcgttgatacggatctatttgatcatatgaaaaccattttatggtcgacattaccagctgcagccatttcaacagtggcatttgccgttctgggaatgggtcacaatcacgctgacatggcaaaaatcaacaccacggtcgctgcattgaataatgactttcacatttcaattattgcattaattccgatcgccctggtattcatctgtgccgcctttaaaatggcagccatccccaccatgctgctcaacatttttgtttcagctgccatgatgtttatgaataataccggtttaaatatgaataaggccagcgatatcatcacaaatggcttcgtggcaaaaaccagcaatcatgaagtcaacttactattatctcgtggtggcattgttagtatgatgccaaccgttgccctgattgtattaacattatctcttggtggtttgctcgttcactttggtttaatcagcaccgtaatgacaccaatcgccactaagttaaataattcagccaaattaattacagcagccttatgtgcctgcattggggtaaacattttcgtgggtgaacaattcctatcaattatcttaccaggtcgggctttcaaacaaaccttcaataacggcggcttagccagttcagctcttggccgggtcctagaggatggcggtaccgttctgaattacttggttccttggggtgtcggtggtgtcttcattgccaacacgttgggcgttccaaccatgcagtacctgccatttgtcttcttcagtcttctctgccctgtcttctcactcttaagtggctttacgggaatcggattacggaagttaaatgctactgaagatgccaaaggaaaagaaaccgtgccagtacaaaattagaatgtttcttaatccggatttggtttttaaaatataacacaactcaccccatatccctaattaaagtaaggatatggggtgagttgcgttatgggatatttgattagctttccgcaccattgcgtttcttgttgctaagatacgcaataagcctcggattctgaccatattaatcctacacatagtattccactctaaggaacaaatcctggccacataaaacaagcgtgtgataagcagtcccggccatttaagcggtctaaccaaatattcaaaaacagaatattcgttgctttcggctaccaagcagaaacgtgtgacaagcagcagcccccggccatataagcggtctaaccaaatattcaaaaacagaatattcgttgctttcggctaccgagcagaaacgtgtgacaagcagcagcccccggccatataagcgatctaaccgctgcttgtcacactctgttttaataatgtctcctcctatgaattccagcataccgtgccaacacaaacgctacatcacataaccaggtttccagctttttcatttgttgtcctccaaaataaacatgacccgctttaattcacccaacgcatcgccgccattttgccactgaaaatcatatcccaatgagatgttttgataagaaatcccatgatagctgattttatttggcatatgagagtgcccactaatcgacacactcacatgattctgctcaaagatttggcgataccgctcactgcccagcggatacatgaaccgatcatatccgggaattggcatttggcgagccaatcgcttcgttggcaacatatgcgttgcaaccagtatcttttttgaaccaatttgcatctggttaatttggtgctgccaagcaaaaatttgattggtgacccaatttcgatcacgtcgataactaatctggtttcgattaatatacatttgatccggccaaatgtgctcggcaacccaattagtcgctaatttaggacccaaggattcagaaaagtttttggcaaatgtataatcataccaaccgttaatgccagtaatgatccagtgtggcgttacaattggatgccgggttagcgaggtcggcaaatgatccaattgccaataggcttgccgggattgttcttggactgccgccactgattgccgccttggattatccacataaatatcgtgattgccgaccaaagttcgtaccgggaccggcaacactttagaaagcgcttgatcaaatttcagattttgagtcagtccatttgccgaatcacccataactactaattgatcaagctgctcatcctgtactaatgccagtaaaattttcacaaaatcatatcttcgattgaaatccgtatgaagatcagagacaaatccaatgcgcatgatgatccttcctttgatgactaattgtttccgtgcttttatcttcatattatcttgtcccttattattttacaaaaggatctggcaaattttaacaaagcatacgcatatcagcaactttttaaacagcgttaataaatccacatgaccattaaatgccatgaaaaaatctgcaatcccatttttaaagaggtcgcagatctttttaataatcactatttggcatccattaaatgaatcgtcagaacatcaattatgtctatcttaaatcttggttagtcgccgagacagacttgcaacgataaacaataatcccgccgcaatcagaaacacaaattgaacactgatcgtatcgcttaaccaaccaattgttaaagtcgcaagcgaataagttcccgtgtataaaacattttgcaacgcatacacaacaaccaactgatcatttgaaacatttttttgaaccagtgtcgtttgtggtacattcttcattgctgaactaacgccaaacaacattgccaataataacgtcactatcggcaagtgattaacagcgaccaacagcataatagcactactgattaatgctccccaaccgatgactcgaatcgtatgctgttctaatcttttagcaagggaataacaaccccaactgcctaaaaatgcaccaagcatatatatggcgttaatatacccccaccacgtggaagagacctgtaacacctggtggacaaaaacgaggataattgctgaaacccacaccgtatttgcggcagtttccaataaatccatcgccgtaaccacccgaagcaatcggctatttttaatcattttccaaccacttgtgaactgatcccaactgacttgctgatgaagtggctgatccacattgggcaataccaacatcaaaccagacgcaacggcggcaacaatcacgccaaaaattaacaattgatcaatttggaagaacgccagcaacgtgcttccgattgcccaaccaccgattccgagaagttgatacgccccacctaaaagactgtttgctttaactaaataggcatcggaaacgtagtggggaactagcgccgcactaaccggttccgccaaaccatccagtaatgcgatcatgatcacaaccacatcaatcaaaatcagtcggttaaccgatagccgaatagaaaaaatcatgactaagaaaagcaataataggaatttaccaaattgactgacagccaggacatggtttaaccgccaccgacccgttattaacggtgtcaaaaggccggaaattaccattgatgttgttagcaaaacggggataagcgaagtcacaaacgcattgtgagttcaagtgtaaacagagttgatcactgaaatcgtatacaaaatatccccaacattagcagctgactgcccgacaagcagtttagcaaatgaacgattttttaacatttctaaacacatccttaattaattgagatggtgaccaaagcttagaaatgatatgctaaatcgcttgtggattatgaatgaaagaaccgcttaattgattgatttccttcacccccttccatgattaaaaggatgcaagatattgaaatgggctgttaactgatcgttttttgcagaatcgttgtgcctgtttcaagtctccacctgaaagttctatttcattactatgctaacgcactaagacctgtaattctctcttcggcacttgcattacaaagttcaataaatttcaatcgcatactattataattattaaatactgtcgataaccaggcgtcttcgtttgctgacgccaattgattttctagcggagacctaattattgttatgggatacattaaaactcatcatatgcctccttccatctgaccagtagtaaacaaaataaagccataaatataatgaataaaaacataaacgactcccagatattatttctataaagtatatgaaatttgtaattccaaaaataacgtaagattctattcgcgtgatataagggattaaatagcgcagcttcctgcatccacttaggcatcattgttagaggaaccgtcgcatcagacaaaaagaacattgggaaaaaaagtgtcatcataaccatagtataagtattaacttttttaaccaataaggcgattatgattccaagcattaacgcgaataaggtaaaaaggacgtaaacaaagaaaaatggaatctttttcacccccaatgggatatgaaaacaaacacttgctgatatcataattagcataaatccaagcattgcaataatagtagcttttatcaagattacactgataaaacgcactaaactaataggagtagctctaatacgtttataaattcccttttccttatcagatatcaactgatttccgacactaaatacactagaagaaaaaagaataagcattaaaaaacttggtatataaactgtaaaaaaatcaattcctccataggtcatattagaatacatacttccaaagattaaaaaactcatcaatggcatcacaatactaaaaagcaaataaagcggttgccgtatatacatcttaagctcgatcactagttgaacaagtgtacttcttattgctgtcatcacctcacctcattcttttctatgtatatgtcttctaaacttttacctgtctgtttaacaatattgcttacagtatcattcataaggacttttcctctttttagcatcaccaactgatcacagttcctttcaacttcgtccatgtagtgtgaagaaacgatcgttgttgttcggtgccccactgaggatatcagtgaccaaagatcccgcctagctattggatcgagaccagtagttggttcatcaagtatcagtaaatctggagaatttaataatgcgactgctatatttacacgttgcttcattccaccggataaattacgataatactcgttagaaaatctctttgtttttgtttttattaataccgagtctattgattcatgctttgaataaaatgatccaaaaagttctagtatctccttaacttttgcgtctggataaaattcgttttcttgtaacacaactcccaactttcgtttaaaatccttatttggtttataacttaaagtccccgatgtcggcttttttaatccagctaaaatttctaagaaggtggttttaccagatccattatggccaaccaatccaataatttctccacttggaatgtcaatagaaacaccattcaaagctacattttttccgtatgcttttgttaaaccagtagtgctaagtttcaattatggtcactcctttcaaaaagtcgggtgaatccaaaattggtcaccagaacagcaaataaaaagtaagttttaaaatttagatatgaatgtgaacactacaacatgaagttgatgcacagcatgagcagctatcacaggatgaaattccacttgatgcagcactttctgacaaagtaattgcttcgtcaatttcgattaactcaacattatcaaataatttatcaatggctttctcgctgtcctgagcctcgtcatcaattaattctttatctttggtcttgattctttctaacataaagataagtttagtataataacaattaagtgagataacaagccattatggccattattatctcacttaattaaaaaacattttcatgaacggctttcagtaatgtcccgttattcattcaactcgtcagatgaactaatcagttgccaagccccgggttgcttgctctcttcgactgtaaattccttggattttaagttagcatccaatttggcctgaagattaccatcctcagacttccgaatcacaataatgcgatcttcatccggctgcttaacttcaattgcacctgatagtgaaaaagcatcgctggtattcctgaatctaagcaatttcagcaatgattggacaaccggccgctgagtagcctggtcaatttcagccattgagtagtaatgccgattgatatttcgaccttcctttgtcgcttccagcaacgccaaatcatttttcccggccaggagcccgacatagtaaaccatcggaataccgggggcaaacacctgaattgcccgagccatcaagtaggcatgatcattgtctcccaaggctgaatagtaggttgtgttaatttgataaatatctaaattatgataagccgaactggagtagacctttttaacgtttgccccaacttgatacaattcattcttggtatcatcaatctcatcatccgataaaatattcttggcatccaccacgccaatgccatcatgcgtatccagtgttgtaaactgtttcatcggacttgtctttaaccaattggccaatcgatcgccctttccagtatacaaactatatagcgttaccattggcaaagcaaaatcatagctaaaatagccatggtccgttaatttgcggacgatatgataattctcgtgaatctctggtaataacatcgcgccacttggctttgtaatatcattaatttcattcaataactcccaaatctccggttcaacaaagaaatcgttagtaccaatttttttaattgcgtacgcaaacgcatctaaacgaataatcgatgctccctgattcatcagaaaaaggagagttgctttaataaattctttggtaaccggcttggtgacatccagatcaatttgatcaccgccaaatgtattccatactggttcaacctccccatcgtcaaacgcaacctcttgaattggagcttggggctttcgtttatagatttgatcaatatctgcttgagtcagtcgatcttttggccaaaactgattccagcggataaacatatcacgatactgcgattgattatgatttttgacaaagtctttaaaataaatcgattttttcgaaaggtgattcaccatgaaatcaaacattaaataataattttgcgctaattcatggatatcatcccaatttccaaagctgggatcaactttgcgatagttagtcggcgcaaatccccgatcggcagatgatgggaaaaatggtaagatgtgaacgccaccaatggcacctttaaatttagtttctaagacctgccttaagtctttcaggttctttccgagactatccggatacgtaattaacatgacttgattcgttggtttcatttttatcgctcccgcaactgatcgaactcagtttaattaatttatttttagtcgatgtaagcctttacacaaatccatgttacacgattcacttgattatatcaatcgttggacagaaaaaggcttcattttcatcacttttgggttgttagctaaaacgcctaatgatcgtcataatattcaccgttgcgcgcatcatgcttgataggattgttatttgcacgcaaggatatatcatgttagtttaaaagtgatctttaagtctccaggaaaaatgatctaagcaaactgaatgatttatccgtaattaaggaagtggtcttagtgtcccaacaaaagaagcagaagaaagaaaaagatggccccatcaccttgatggccgaacatgttcgaagaatgatgattggcaatatttcagatcaatatcatggttcctcatggggaaatattgttcttttgatggtggcgctggtggttgtttacttaattcaaaaattaacggggcgttaaacgttaatcactaagagaggacatttctaataagctcaaaaatggcgcggttgtaattaaccacgtcatttatcatgtccttttttaaatataacagtcctaatcgtctattttttgaatgaattcaacaactctatcttattcagcaagtaagggcttgccatctttatcaacaagcaccgtaaccccaacgccaccaccaataccgctttgcgatacaattaaatactgaaccttagttttatgatcaacaagtacatcaacattttggccagtatcaattatttcatttattgctgtattaaatctatcagcatttacatctttttcctttttggacattttaactcttcacctttcgttaaacatttttaatttttaattacaaaataacagtggcaactattactattaataagatttttaaatctaatccttgcttgtgcctccttttttaaacgataactttaatgtacctacaaataaccagcaatgcaatacatcaggggtcttgattaactggacacccagtttgacacgtgtctcatatttgttacataattattgtagcttgctacgcgggggtttgatgtggaaatatcagataaattaagacattatcgaaaacaaaaaaatttgactcaaaaagaactggctgacaaacttcatctatcaagaaagacaatttccggctgggaaaatggccgtggttatccagacataaaaagtatcgctcagttaagtgatatttttggcgtctcaacagacgatctgttaaaagataacaacttgttagaacactacgatgagcagaataaacaaagtctaagagctagaaagatagtgaaagttacctattatctgaattttattttcatactttggatgtaagctagttcctgagacaacttttaagagagggtataataagtcaatcgtctcttaaaagaaaggaatttttacatgccaactcattacgacaaagaattcaaacaaaacattatcaacctctataaacaaggtgaatctgctgctcaacttgccagagaatatggcattggctattccaccgttcataagtggattcagtcccaaactcaaaacaagtcaggtaagactcctgatgagattaaagcaatggagaaacgcttagctgctttatccgaggagaacgaaatcttaaaaaaagccctcggcttccttgcgcagagataaccgatatctttgattatatccaacaagaaagccaaaattaccaggtaactaagatgtgtcgagtcctcggggtttcaagagcgcattactatcgctataaagcccacaagccctcaaaaaggagtctggaagataaagatctgaaacagcggattttccgcatcttcgttgaattcaaacaaagatatggcgtcatgaagattcaatatgaattaagtaaagaacttcaacccctgcagcgccgctgcagtcctcgccgagtctctcggctcatgaaggagatggatattcactcgattaccatcaagaagtggaaggccacctcttcctccaaacaagcgattcaacagcgtcccaatctgcttaagcaggatttctccaccactggcttaaatcagaaatggacaactgatattacttatattcagactaagcgtgatggttggtgttacttatcaaccatcatggatctgcactcccgtcggattatcgggtattccttttctaaaaaaatggataccaagctgatcatgaagacgcttgagagcgccgtccagaatcggacagttactgagggcctcatcattcacagtgacttaggtacgcagtacaccagcgataaatataacaaacgcttaaatgaactacatatccgccactcgtatagccgtaagggctgtccttatgacaacgccccaatggaatctttccatgcttcactcaaaaaggaatgtgtttatccaattccagtttttgaaaattacgaagcggcagcttcagtcctctttgaatatgttcattccttttacaataggaagagaattcatagttcactcagctaccaaacccccttacaagttgaaattgcaacgattgcgaaccagatggccgcctaatttaatgctttccatggttcaaataagttattaatcgaaattaatgatttatttgagctgtggaagctaaacgcggttcttgatctctcttaaaatctgtctcacgtattgactacaatccacttgctttctacggttacatttttggcttgttaaacgacgacaattcaattaccctgcttattttatttggaaacatgatcctatttttcgcaaattattctgactggaataggtttaagcaaaagaaacaattattaggcatgataatcgcttttatactgctaatatttttgaatgccggtatcattccaactaataatgaattctttcaattaattaaaggaagtgatcaggcagaagacttaggagtttttactggtgaggtaataattattattcttctttcgatctgcgtaactctagctatttgtttttacccacgaagcatcaagcgagaacgggattccaacaacactgaaaattaatacgcccgcttaacacaatcacgacaggcacattacgccccgcttagagctataaatgatgattttattaaaccgggatcaacaaagcatttccataaatgcaactttgttgatcccggtttctcgtttatttaatttcggctctttgtcaactgaggttgatatcagcttatatagcaaatccgaaaggatttgctttttcttttgcattaattgaattaagcaaataattccatttgaatcctagttcgataatggtcaaaa

SEQ ID NO: 666 - DNA, 11204 bp, Unknown
  Metagenome-assembled genome
tcttgggacatcgtttttacttctttctatctgaattattggctaattcaatagtagggcgatgccctatttatatgcaaaaaaagattgataccttacggtatcaaccccaaaaattttagaccctgattttttcaatcagcctattgacagcgcttacagaattagatatattagtttcgggtactaaataaataccttctaatcaattctctttctctcttaaagaactggtggcttttatccatcagtttttttgtgtataatggtattttgtgattaaccactagtgaaaataatgtgaaaggggagaatactttgaaaagtcacgaaacattaactttgattgaagaaattactagaaacgatggcagtaaatacatcgaaattagcaatatggttcaaaatggtcgggccgaattagcagccgatagaggctttattaagcaggtaagaatattgcagctcaatattccccattcacctcacgttgccaaatacgagcattatattaacgaaaattatacgatgccgactgaggatatggatcattttgaggaatgggaaaaaacacctgagatgcaaaaggagattgaaattattttgagagaaaaccatattggctaattaaattaaatgagattttagtttgcatgttctgagaaaatatgttataaatatatatgtcgtttttaagactttccatttttgctccgtagttcagtggtagaataattgactgttaatcaagaggtcgctggttcgaacccagccggagcagtagaagatttttaaatcttatcaaattttaaaaatctttttttatacattttttacttgtcacatccttagtattatggtataaatagtacatggcaattttgccaaaacaatatttttgctccgtagttcagtggtagaataattgactgttaatcaagaggtcgctggttcgaacccagccggagcagtaatagaatttctgattgaggttaaagtaaagtaattttgctttaatctctttttgtttatgatgaccgtttaaatgataaagtggtcggactagtgttttaagcgactgacaataaaaaccgttaattaaccgagctactgtaaatttaggtagcaagatcaattaacggtttttgactgtttcttggtatttttcattaattcaatgatccttatttaaagaagtggtcgggttcagatgttaatttctgacggtgttgcgataatttgtcgattaccactgtcatagaccaccagtgatttaggaaaactgttatcatatgggaacggtgaatcaaatgttgccaccaactcatttccctgaataaaatcataggagagtttaccatcattattaatgaggttaaaagtcactaaattagatagtggaaaaactccctgaagatcattgtcaataataaaccaaacattatctattgcctgatctggtaaagaagatacaatactaaaactcgcaaatcgtgaactgtttggatcaaacatattaaacaccttcaatcttaaatgtttttattgtcaataaactaacaaatattatcacccgttgcaagcaaatggctagccttcaaactcttggttatccatgattagtctggcaatgtgcttatcgtttcgttgattaactggtggtaattgtaggtaattgccataaatgttggtaagaatcgtatcaaagtcctttggaacggttatttgcgtatcctcaaagggtagtgccatcgtattctccaattggtcttgagatattatctctttatcgtaggcgtattgtgaggccaaattcttgaaatctgtgagagctaacttactattgaattgagtcatcacttgttggcgctgttttttgaattgtgaggcagctaatatttgttctggagataaggaactttgaagtcttctaatcggattatcaattacattataacgcagcttaagataaatccgactatccagcctgcgcatctggataatttgatgacgttggcgggaaggtgaagcaggaatcttatctagggggaaaatatccaagaatacgcctttacgtgcgttattaacgttgttcttctcttcgatgtatgtattcctgtccaaaattttggcatagcttagggcgtaattttcgtctgtccatggtgtttgtaaaaaatatgaatcattttggaattcagctgaacagatctgtaagaatttttcataatcatctcgcagcattccaacatccatatcatcatcccatggaataaagccatgatgacgaactgcacccaatagcgtgccgcccattgcgatgtatgggatttcgtactgctggacaatttgtttgaatcgtttgaaaatttttagctcgacttggtggattaacgaaattgttgtctctgacataatgatctcctaaatgatcttattagtttaaattataagctattattggaaaaaaagcccaaaaggatgtgcatacagttgctactaaggtacagacaatatataattagtgcagtatcgatattaataattaatggggaatggtgaggaaaatgagtaagacaaacgaggaattattgaaagaagcaattgatgtttatctatcttctttaaagtatttagataattttgtttctgaaccggcaactaagtacggattatcatttgagcaatatttgattttgcatacgattgccgaacgtgaccatgtatctttgatggatattgcaagtgaacgtaaagtaacgcgaagtgcaatttcacgtcaaattaaggtattacttcagcatgactatatttttcaaaagccagctgaaagtgaccgccgtcgattatacttacatctaacaccaagtggtgaagatgttgaaaagaatgtcaacgatctgataacggcaagattcgataattggattcaccgttatggggaagataaggtcaaagagattcttaattttataaaggatttttcatctcatgaaatgaataagcgcaatcctgaaactcaagggcagtcatagtcacgttttattcaccacgtctgcaagaggctgagacaaactgaggatttgtttcagtctttttttaacggttaagattaaaatggaacggcgttattttgatattacaaattaatttagcactgtttaaaagtgtaaaactatgattttttatatcaagtgattgatgtattgaaacgcaaaacaagggttgatgaaggcgacttcttgcatttttttggtaatcgttattttcaatctcaatccaaggataattaataattaaataaaaggagatgtttactaatgaactgggttccttattttcttgcgttgattcaagttgtattattagtgacgcttggagtatatttaattcggaaacgtaattcttcatttatcgggtggttagtaaatctaaatttattattttttttggcactactgttagaaactattgttctaacaaatagtgtgcttattggtacgatcgttggtgttttaattgttattcttgccattattattttcgttggtttgtcactaagctttatttttctatttgcgaacgcaattgttgtttggcggcgagagggacacagtttggcaagttcgttaacattaattactggtgttggggttattttagttgatgtgttattcttttttgatccaattaaggcgcctgaaccaattaaagtatttattaacgtgttgctttcgacgattattttttacatattgcttaccgtttggaatacattaacatcgatgtttatttatcgatggtattttccaaagaaaaataaagattacattatcgtgctgggggccggtttggttgatggttataaagtaggtcggttgcttggaaatcgaattaatacggcaatcagtttttatagtcagcaaattttcgaaacacaaaaacatcccaagcttattttttccggcggccagggtggtgacgaaaagctaccagaagctgaagcaatgcaaaaatatgcgattcaacatggtgcctcggcccaggacacgttaattgagaataagtcagtaaacacgtttcaaaatatgaaattttcaaaacaactgattaaaagcgatggcggtaatgatcaaagtaaggttgtttttgtaaccaataacttccatacgatgagagcaggaattttagcagaccgagttggcttaaaagcttatggtattggggcaccaacgcctttttactatttgccaaatgctgttattcgggaatatttggccttatttgtgatgcacaaacggtttcatattatcatgtttattctgatctttttaattgccgttttaaatggtgtgattacgtggataaattgatagtctaattaaattgcctggagaagaaggctcgcaaaaaaataattaaagttcaagcgaagaaccagggtaaacccagccagtggttagaccccagaatacaagccctttaacttgatattcccgattttgggatgttaagttagggggcttatattctggggtctgtttgttggttcacattttaactaagtaaaagttcaacgagatatcccgggttgagtattgagacaattcgatgacatggtcggaaggtacctgttatcccacgtcttttctcggtaacagtcgggcttacactaacagcgactggcaaaacgattattatcccaacctcattttttgtgcaattgcagttatgatctactcaagccgacctgttcttcatttgtaagttttctaaagcttgttgtaactactgtttaaagtaatgtccaaaatcatgtggtaaccatgacacgaaaagtgcaagttttcttcataacttattcacacaataagatgaaacttattgtagaatgtagatatagccaaagagctattaatgatttgaattctataacagaaaggatgattaccatgtttagcttaatttggacattgattatcggtggtgtgattggtgcacttgctggagcaattacaagtcgtgacatgccaatgggctggatcggcaacattgttggtggtttaattggcgcatggcttggacaggcgttattaggaacttggggacctcaactggccgaaattgcaatctttcctgctattgttggcgcagttattctggtacttgttgtctcactcattactcgtggtctggcaagctagtctttagaatgatcgagaggaggtttagttgtgagcagaattactaaactgctaatcatgattgtgagtattcttgggatggtccagacaatctggttgttaggagctgtgatgccaattgattatttatcaaaggcagtgcttgtgacgattcagacgccggaatcttggatcttgattagtgtgatcacgattagtaccattttgggaattggttggattatggcaatgctattaattgtgctggcccccaaaaaagctgatcaattagatttttattcgtctcatggaaaattaaccatttctaaaagggcagttgaaaagtctttgcaggaagcggttatggctggtggtttagtcacggatgttgacgcccacgttcacctacaacgtaagaaccgggtatcaaaggtcaaattatcagttgttgaaaagaataatcaagatctggttgaattaggagagcgacttcaagcaattgtggtcaatgaaatgaaaaacttaatggatgtccctgtaaaaaaagtaaaggtaaaaatgaagccctattcggagattgcgaacaagcaacgcggaaagccacgggtggtttaaggaggaaagcaatgaaatcaatgacgtacggcggtgcaattggcatgatctgcgggattgtttgggtatttggtaatttcagtggtgtattgctggtccttgcactaacggttctgggattaatggttggtgcagttgttggtaaatttggtggccttcggaatctcattagtcaattggtaagtgataattaacatgaattaatctcgaataatgcaacaccaaattacgcaactgtgaatcggagattagaaacgaatccaacaaaacttaattatttgaaagaaggtcattaaaaatggatgcaacgattacgaaaacggacttaacaagaaaattaacattcgaaaatggcgttattgaaaaaattgccggcctggtatgccgaaatgttgatggcattttatcattggatggcggaatgatcagcgagttgactgatcgtttttcaaaaacgactgatccgacaaaggggattgatgctgaagttggcgaaaagcaggttgcccttgatatggaagcaacaattgaatacggtgcggatgcgcgtcaaatatttgatgaaatttgcacaaaaacgcagcgggcaatcaaaaactacacgggcttggacgttgtcgaaattaatctgaatattaatgatgttctaactaaaaaagaatgggaacaacaaagcactcgaaaaaaagatgatattgccaacgaagtaacggatgaccgggtaaaataaaaatccaatatattttaggaggatgatcgtaatgactgaagaaaatagaaattctggtttaacgactgttttaacatatgaagatgatgtattgggaaaaattgctggtaatactgtgagagatgttgatggggtactgtcattagaaggaaacattcttgattcggtaaccgatcgttttagcgatgaaaccgaccccaccaagggcgttaaagttgatctggataacgatgaaaaagaagttaaactagcgatggaagcagtgttggagtacggtaaatcaattcctaatgtcttcaataagatcacgtcgaaattgaatcaagccgttactgaaatgacagatttgaagccaacagaaattaaaattaatattaaggatttacaaactcgtgatgaattcctgaaaaagaatcgcaagacggataagaagaaagataaataaagtgggcgataaacaatctaaggcaaaaaacgcttagcttggtaatagtcgtgactacaaaaatggaggctgggacaatagtcatttatcccagcctctgttcgtgtaaacacgattgttaccgagtgaaaacgtgcgccagcaagcagaccccggccatataagcccctaacttaacattccaaaatcaggaatatcaagttaggggcttatattctgggatctaatcgtttgttggcccattctggtttaattgccaaacattaagccatcgcttcgtcttcctctaattccaaccataatgctaatgcagttgggttgaaatcaggccaattggaaatatgtgtgtaaccacgtgcaagcaatgagctcggcttgcgttttttaagatcatcaaaaattgttagtgcaaatacattatcctcaagatccgaaattacggtgccaagcttatgttgccactcagcaacgagatcttggtatatcagcaatttacgcgcatttttaatcgtataatcaaccccttgctgacgcagagtttgtttatagtcctcatattcttgtagaacggcatctttagcgtgttcccattgctcattattgtacctaggcaatttattagtcataatgatcctccttagtacaaaaattacagcccaacacattgctatgtctgaccagtcgagctagtattttgtcttctgaagaccattaaacactaaatgttcacaatttgcaaaggtcaaaaattaatcaattactttagcaccaaggacatgttcaaaatggttgagtgcccattttttgcctgctggtgttaggccggccacaccatttttgtgaatcactaattggtaattaaggttgtaagcatcgaccgcagtatgcagcacacagatgtcagtgcagacgccaactaaatggagagtgtcaatatgacgttcccgtaagcgtagatcaaggtttgtgccagcgaaagcactgtaacgagttttatcatacatgtagactttatcttgatcttggttgactttgaaccaatctgccagatcgtcatagaattcccgtccccatgtatcacggacattatgtggcggaaataatttagtttccgggtgataaggatcgtttggtgtatgaacgtcagttggtagaataacccagtcatcgtctttaacaaatttgtcggctaactgaatgattcgaggctcaatgtcttgtccggcttttccgcaagttaatgcacctttatcggcaacaaaatcgtttgtataatcaataattaacagtgcagtatgtgatgtcataaaaaatcctcctaacagttaaaagtaaaaacaacttttattgtctataacctacacgtatttaatcaaaatatcaacttatttatccaatcatttcgaataaaagccggacaattttctgtcaaactaaaagatagttcagaaagtgggttgacattttaagtttgttacgtatactttatagttattaaacagagagctgatgttgctgaaagtcagcattcgaaatggcaattaattaattggctgcatccgttatctgcatgagaggcaattcatattcgaattgtggaattgggtggaaccgcgtttaatacataacgcccctggtactgtagttggtactgggggcgtttttttgacgaatttttaggaggaaattggaaatggaaaaaagtaaagcaccaaatcgtttgtcacgttcattaaaaagtcgacatattcaaatgattgccatcggcggcgcaattggaaccggcttgtttcttggttctggatcggcgattcatacatcgggaccatcgattattttgtcgtatctcattgtaggctgtttttgctttctgctgatgcggggcattggtgaattactcctttccgatacaagtaagcactcgtttctggactttgtaaaaatttatttaggagaccgctgggaatttgtgactggatggacatattggttctgctggattagtctggcaatggctgatttaactgcaaccggaatctatattaaatattggttcccagctgtcccacaatggattccgccactgattattttgctttgcttatttgcggccaatctcgtaaatgttggtttgttcggggaattagaatcctggttttctatgatcaaagttgttgcgattatcttattggtggtggttggatttggcttagcgatttttcaagtaaaaacagcaacctcaacagcttcattttcgcttttggtttctcacggcggctttttcccaactggttttcacggtttcctgatgtcatttcaaatggtcgtgtttgcttttgtggggattgaaatggttgggctaaccgctggtgaaacagatagcccagaggaaaatttgcccaaagcgattaacagtttaccaattcggattggccttttctacattggatcaatgattgcagttatgagtgtgtttccatggaataaaattacgaccactgccagtccgtttgttcaagtcttttcaggtgtaggaatcgttggagccgctggtattttgaatttcgttgttttaacagcggccgtttcggctactaatagttgcttgtttagcaccagccggacgatgtacgccttgagcatggggggaaatgcgtcgtcatttttaacgaagctcggtcgaaatggggttccaaatattgcgctcaatttttcaacggcctttttgctcattatcgttattttgaattattttattccagcaggtgtttttaatctagtctccagtgtttcaacgattaattttgtagtcgtctgggtagttttaattattgttcacattaaatatcgccgtaagcatcctaagggaaccaagacattttcgatgcccggatatccggttacggattatttaagcttagcattcttcatttttattcttggctttttattaatcagctcagccacgcggattgcaatgattatttcattaatttcgattggaataatgttaattatttatcaaattatttcaagaaaatcgtctttctcaaaatgaccgggttaagttgaaatcacttgtcattgaccttacactaatgagtaacgagtgtagaaaaatgtgaggaaagacaatgataaaaattcataaatcgccgcaatatacttggattgaggttgttgagccgaaagaatcagagttaagtgatgtgattgataactatcagttgccaagaaaatttaaaaactacatgctggataaacatgaacagccgcgagccaactacgatgatttaaccgactttggtgtgttggtaattcgagcattggccaatcattccggaaacaacacaaccaccgttcccatcttcattggttttgataaccgggtgctcatcacagtatgtcatggcctggaacaatcgcaattaattaaaattgcagacgactcaggggtttctgagataagtgaacatattttttcagctctacttgctattctgtcaccttattttgacaatcttgatgagattagtcagaaagctgagaagttggaaggaattcgcggtcgggggattagtaatcgcaacttggatgccttatcgatattgaaaacgaacttagtctacctacgatcagctacggcaggaaatctcattgcgcttcaagacttacagggaatcttgaaaggccgaagtaatttaatggccacaggcggaattaaagttaatcagcagattgccgacctgattgttgaatataagcagtgccaaacaatgttcgatgttgaaggtgatgtcgtgagcgaaaccgaatcggcatttggtaatattttgaataataaattgaatcaaacaatgcaatttttaactgtctggtcgttgattctggcaatcccaccaattatttcgggattttatgggatgaatgttaaattaccatttgcaggtcgaacagaagcgtggtttgatacgttaatattaacgttagtatttgtcttgggaatggttctctatttgaagattaaaaagcgcttttaaatgttgtctcagattaacgccaacttggctgaatctttggctgtctgttgattttgtttgtatatatataaaactctccgaggagcgcttcgcttttcctcgtaaccatcaatgaaaagaaccgtcttcctttgtataatataggtgaaggcggtttcattgtacatcgttatctttttggtgctaataag

SEQ ID NO: 667 - DNA, 21302 bp, Unknown
  Metagenome-assembled genome
cttgggacatcgtttttacttctttctatctgaattattggctaattcaatagtagggcgatgccctatttatatgcaaaaaaagattgataccttacggtatcaaccccaaaaattttagacccatagaattgaggctgagacagagttacttgtccggcctctttttttattgtcaattacgatggtggttgggcttaaaatcagcagtttaaatacgtcactatggttgaaagaaaataactttaaagatatacttaaattgagtaattatttatcattaggaatgtttttaagaaaaattaatttgaggaggcattattttgggcaatcattattctaacaaacgaaccttcttccgtaagtgctacaagctaatgtatgcggttacattcggactgctcattggcctgggagtgacgacgatagccacttcagctaattcaattatgggtcaaccactccccaatagtggcaattcaagtgccacaagtcgtcttctggaacaagggtcgaaagccttacctcaatgtttggatatggggcaaacacggatggctggttccaaagttaacgaaaaaggtgatctggattttgaatggggaagttgcccattaaccttggcggataagacgctgacggttcatccggggacaatggctagtgttgccttggatccaaataatcaagtgactcagttgcttcaaaccgatcaagtcacggcaattaaacttgaaaaaggggtcgtgcttccgaatgattcgtcgtggctgtttgttaatatgccaaatgttacttcgataacctttgataagggtattgatactaaaaatgtgacaaatatgatgacaatgtttatgggaaattccaaattggaatcgcttgatttatcaaatttcgacacgagtaacgtgaccaatatgggcggaatgtttgctaatgatcccgcactaacttcgttaaacattgccagttttgatacaagtaaggtgacattgtttggaatgcccgggtatacgggtgaaaacgggatgtttgccaatgatccaagcttaaagtcacttgatgtctcaaactttgataccagtagcgcgacaaatatggattacatgttttatggagactcagctcttgaatcactgaatgtttcgagctttgatactctgaatgtaacatcgatgctgatgatgtttgccaaggacagcaatttaaagacacttgatctttcaaattttgacacccggaaggccgcacaggtaacagatctgggtgtgataggaacaacctacatgctcggatacaagggtgatttaggtctcggatttgttgatgggacgctttcaaacctatggaaaattaaagttggacccgatatggttgttaagaataccccatacgctgatgtcgtaattggtttaccagctgcaccaggcacggttgagtatccgtttactgattctagctttccgggggcaaccttctataataacgggcctgattggcaggaagtggggaccagcacggatggtcataacccaactggtcaggtattaaatgcgtctgacttgaatacgcgatttgaaaccgcacggactggcaatgaaacctgggtttggcagcaggcaccagccattaagcaagcggtcacgttgacctacgttgatcaaaatggcaagcagattgccgaaccacataccattagtggctattcgggcacaagttatgatctttcggatgccaaatatcagttggtcattaaaggttatacgtttactaaggttgttggtgatttgaaggggacaatcggtactgatcctacgacgattaaatttgaatatacgggtggttcaactggtaatggtggttcatcctccggtggatcgacaattccagcaacaccattgggaccatcaacaacccatccgggaacgacaccgccaacgaagccggagacaccacctggcatcgctaaacttgcttttccgtttaaggtgtacgcgaaaacaactgtttataaatatcgaaatgttaacttcaaaaagtcacaacggattcataaatatgctaagcagccacgaatcaaggcacccgttttcactgtaaccaaggcagttaagaatgctcaaggacgttggcgttatcgggttgccggtggttatattaccgcaaacgaaaaaaatattggtttattatattggcaatcaggtaagtatcgtcgattgacggtgattaacccgaaaggcgtttatgagtatcgaagtcgtttattggcaaaacatttccgagggcaacatttgaagcgtggcacaactgtcagagtaaaaagggttactcatgatggcatgacaacgcggtatgttttgacgaacgggcattatattactggaaataagaaatttgtgtcattaaagtattaacagagtgaggcaaaaaacgcttagcttccagtgtagggggcttatccgaatattctggccttgaatatttggataagccccctacacggccggaagctgttttttggctcacgttttcactcggtaatagtcatgatgatacaaaacggggctgggcaaaagtaattttgtccagcccccgctgataatcttgaaataattgaaactaatctaaccagaaaaaggtaattggctttccagttgagctttttaagtggtaattgtagcgtattatccatatttaataagaatcatcggttgaattaataataggcacacttactttcttttactaaaaatattttaaaatgaacaactattactattttatctgtgggaaacacaatttttacatggtacaattttaactatgtggaacatgagaacgaatgtgtggactgattattttttgaacggtaaacatcaagaaatgatcaatccgctatttactacatagataccaaggggcatttcccatcggagttgcctaatctcaatcaaaggaatcgtaagtatgaatccaaattttactcctgtcaattttaatcggaatcggcatgtcaaattatggcgaacactgtactttacagtggggatcgtcatttttctcatgatcggtttttcgatatggcatgctgaccagaaacagcaacgcgaggcacgggaaaattatattaactcaaatgtaccaactttattcattcatggctggtctggtacgctgcgttcggaacggcatatggctgattacgctgaaactacgggtgccggtcaacgtcggatgattattcgggttcggccaaatggtcacatcgctgtcaaaggtaagatcgaaaaatggatgcataatcccattattttacttagaattgataataatcgggcaggggaattccaatacgcccgttggttgacgaacgtttgccggctcctaaaatcaaaataccacattgatcggctgaattttgtcggtcattcgatgggatcgtacgccacggtttattataatttgttgaatagcaatcggagcgatgttcccaggtcaaataagctttgcctgattgcgggtccctatgatggcattattgataatcggaaagccaatcaaccactgactggatcattggcgaaactttgggatgatcagcctaacgaaaatcgcttattgaaaaatggtcaacctaaaattattcatcccgaatatcaaacattattgcagttgcaaaaccggatgccgcgccagatcagaattctgaatatctatggtgacctaaatgatggctcccattctgatggcgtggtgacaaccacctcggcgttatcattggggtatctggtaagaggccatgttagctattatcagacatttaaggcgacgggcgctaacgcccaacacagcgaacttcataatggtaatctggcagttaatcgggcgctaactaatttcctttggggccgtcattacaatatgtcatctgatgagccaaaatataatccaatgcttgataagatgatgaacccaacagtgctgtttaatcatcaggaacattcgcagacaagtattgggattaggtaatccaaatactttattcagtatggccttggtcaatttattttggctgaggctttttgagtggtaggattcgtaaaaagatttcgagtgattggttgtttttatcatgcgggaacatgggatgattgatatcctgtgttagaacctaatcattatttttaagttcaatcgttttttgttacaaattcaaaaaaggttaaacacattatctaatttttgttataatggaggcatcaaatgatagggggtacattatgaaagcactcaagcacatttttgttgcatctgcattcgtttttagcgttggcgctgctacatatgctggtagttcgacagcccaagctaaggggacgacgacctttccaagtagtttgacaaatcataccttttacggcgcttattacagtaaggggcattatggcaaatataagtacacactaaagaattatgcgacggcttatcgatttggtaagaactcatataaatggggtcgttacaacagtaagactaagaaatacacatggaataaggcagttaaagttaaggtgaccaagaccaagcaatctagcacaacttggtacaaagcaactcaaactggcacgaaaaagccagctgttacttacttctcaccaactggaaccaacaaaattccaggaatgattgttaaacgcggtgcccattcaagcgtgccttatgggatgttctactagttaaacttgggcttattgctcataaatcgaggctgagacaaaagtaattttgtccagtctcgttttgtgtaatcacgattgttaccgagtggaaacgtgggccagcaagcaggccccggccataagccccctaacctaacattccaagatcgggaatatcttgtcgaacttgttacttggttaaaacgtgggccagcaagcagaccccggccatataagcctcctgacttaatattccaaaatcgggaatatcaagtcagggggcttatattctggggtctaaccgcttgctggcccactctattttgttactaaataatgtcatttttttattgtcagctgtcgtttatcatgtaataatatttttgtaatacacaaaatattgagaggttgtgggggaatgaagaataaattaagatggctgacattgctggttttagggactggcatgatcatcggtgagggtatcgctaatcctcagttggcatcggccaaagctaagccgagggtcatggtgcttgatcgcggcctggttagtggaacgtataaaattaaggcagctgccaaacatggttacgcctattctgccaagttgaaaaaacgtgagtggcagttagctgggttaacaaatcggacttttaaagcaactcatggcgagtttttgaacgttaatggggctctcaagacttactactatattaaagatacaaagaaacctaaacgggccggctgggttaactttaattatttaaagcagataaaggttggctcggatagtactaagaagtctaaaccaaccaagcaggaaaaaccgactagcacaaatgaccaaaattcaacgagtgattctgatcaagctcaaagtgcagctgcaactcaggcaaagctaaataagtattttactgccgatgaacaagcacaaatggcgcaattaaagcagcaagctgattcgaccggtaatgatactaagtcgatgtattcgcaaacgccgtcagtgaagggatcatttactcctggtcaactgagtgagggctatcttaattcaaccctgggatggattaactttttccgcggtcagtatggattgtcaccattgacagataattcagcttggaacacagaagcccagtatggtgcggccactttggcagccgccgatcaggggctttctcatggcttgaagggattctcaaagccggcatttatttcggatacggattggcagcggggcgctgatgcgactaatcaaagtaatttggggcagggcgttgtttctccgtatgataccatctcacaatacctcaatgattccggcaatgatattccaggacatcgtgaatggttattaggtggtattactcaggttggtattggccacgttggtgactacaatgatttgatggtctttaatttacatggtgacggtagctcagttccatccaagccgattgagtttcccaagcagggactatttccaattgatcttgcccaagatacccgttggtcattatcactgccaactcagtatcaaagcgggactcaagtgaaagttggcgtgaccgataatacgaccaacaagccagtcgatgtgacaaatattatcgcaacccatggtggctatggggagtttggtacttcaatcagttataagcccaatagcgatgatattaaatttggtcattcgtatacgatcacaatctctggggtgccggggatgactagtgattatacgtatacgacaaagttatttgatttggggattgcgccatccaattcttcatatacagaaacgctttgggaaggttaggtatcatcaataaaacaagccccttatttaccagcgttggtaaaataaggggcttgttctatttggtggatatagtcatcagcttatatcgatagattttaaacttcgatattttttggacacatataattaccttatatacgccactttttaattaatggcgttattatgcctttgcttaaatcaaaaatcaccgtttttttgatttaagcaaagatatctacggttgaaaaatcaaaaaacagggcttttttgatttttgaccagtcacgaatgcacgattcttggcaacattttgatcgatcggcgatgttgtcaatttgccaaacaccccccaaacgcattacaatcaatctagccaatttttaaaccggcacttaattttgaaaggattgaaaacacacatgaaacgcacattattgatcgtgggtgccatgctcgccttagttttaggcggatgcggtaaccaatcccaatccaagaacagttccagtacaagtgagtcaacttcagctaaaagttcttccagtaattccagcactagcagtaacagcagttcggcagcaagttcatccactgcctctgggtcatcagccgcggctcaccggtcagatgccaacacgaacacttaccttcgtttaagtaagtttaaccagcagttaactcagaaattgggttcaattaaattaccgaagaacgatggtttaagcgaacacaatggttatgtcaatgtccggtattctggtgatcaagccaattatcaaatctcatatagcgttggtgatcaggcccgggcattaaacgcgacggctttgaaaaatgaaaatccatatgctgttttgaccaggaagacttatgattcaaatgatcaggctgcgcaacaaattgaccaacatgatattgaaaatggcctgccaaaggtcaaccttgggtctaacattcatggcacaattgattcagccgctggaagtgaatatctaacttggaacgaaggccgttggaatttgacggttcatgctgatcgggtagctaacgaagatgcaacgcaactgggtaagcaaaccgttcaacttttagatagctacacattaccggtgccaaacactaaaggtgcgatcatgtttgattcacagattgttgatcgtcagcgtgatcaaaaaattgcttggcaagatggtaacagtgtttatacgctgcagacgcatagtccggaaactggtattcggatggctgccagcatttcttagttccttaacttttaaatgaatggttgtgcgaggctgagtcaaaagtaattttgctcagtctcttttactggggtactccagcgattaatgaatgaaaacgcgggttgaagggcgacttccagttttagaaaaaataatggattctcaagcagaccccggccatttgcggtatactacggtttatggattgatcagtttcgaaacggaggtttatatgagctatttagaattacatgatattaagaaatcgtattatctgggaagtgaggaattcccagttttaaccggaatcaacctgtcatttgaacaaggcgagtttgtctcgatccttggtgaatccggcggtggaaagaccactttgatgaacattatcggtggattggatagtaattataccggggatgttgtccttaacggtaaatcattacgtcatgatacgtccaaacaattggattcctatcgtcggcagaccattgggtttatctttcaaaactttaacttgattagccacctgaccgtctttcaaaatgtcatggtatcgctggaaatgaccaagctaagcaggaaaaaacaggaagatcgggctcgagagcttttggaacaagttgggttgaccgaccacatgaagaagttccccaatcaactttccggcggccaaaagcaacgggttgccattgcccgggcgttggcttctgatccggaaattatcattgccgatgaaccaaccggggctttggacagtaaaaatacccaggaaattcttggcttgctggatcaaatcgcttccaacggaaagttagtcatcacggttacccattctcaaacggtggcagattccggaacccggattgtccgattggctgacggtaaaattagtgaagacaccaaggttaaggacgcgtatgctgccagcaatgctaacgagctgccaacccatacattgcgatttggggcaactttgaagatggcgcttgagaatatgcggtataacttgaaacgaaacctgttaattgtgtttggcgcggcgatcgggatttttagtgtgattgtcatgctggggcttggtaacggggttcaaggatatattaaccacgaaatatattcgcaggttaatccgaatgcggtgcaggtcgcgaaaaatgtcggcgattcaacgacaagtctgaagaagatgaccatgtcgactaaggacaagaaccggctgaaagacattaagaatgtcaaaagtgtcaatgacggctactttgttcaaggtggcacgcagttgcggcgcggcaagaagacggcatcggtttcattcatgcaaactcataatgccacgatgctaaagaagagcatttccaagggtcaggcacccaagaataacgaaatcctgctgactaaggaaatcgcgcaaaagttaaataaaaagaattcaaattcgttgattggcaagaaactgaccttctaccaaaatacgctaaacaagcaaaagcggccggtggtattaagcaaaacattgacgattagtggaattgctaaagccaataccggttcaacgtcaattacgtacgataccatgaagtcgatttttaaatcgaaaaaggtcaatattgatccgaactttgtgaccatcgaaattgctggcggggttaacaatgttaaaccggttgaaaaccagatcaagacttacaagggtgccaaaaataaggcaacttatcagattactggggttggtggttttgtcaatacattgaatacctacattacgttggcggttaatgttctggcaaccattgctgggatctcattgttagtttcagcgatcatgattattgtggtactgtacatcagtgtttccgagcgaaccaaagagatcgggatcttgcgggcactgggtgcttcaaagggaagtattcgttacctgttcttctcggaagctttctttatcgggctgttctcctcaatcctggcaattctcttggcaatggtattggcgggagtcgccaatcatattgccaacggcgcgattaattacatgatcatgcaaatcacgccgggaaatatcctgttcgggttcctggtttctgtcatcatctcgttgttggcagcgttggcgccagcgggtaaggcggctagattagatccaatcgagagtttgagttacgaataataagtaaagtttatgaaaaacagttagatctttaaagggatcagtcgactatttgagtttgaatagttggctgatcccttttgcatttcttcctgatcactgaaattatatctgtcatgtaaaatgaccgagacattaattactaagtggatatggctaatctgttttaaagaataagataagcatggttatcgtttggacattacgcaaaacgtattaaaataataattaagtgtcaaaatgattgaccatgttatctaattgttataaattaactgcatgtaatgaattttgaaacctaaattgtggcattgaaatggctttcatgatattttcatttagcattatttagatatggttggttaaatccataattgtgatttagtcatcagccactaatattgaaagttaatattaatcaataattttaataagcaatttataaatatcagcgtcgccacttttataaaattcagttaattctttaaaactttcgatacagttggagaagattgaccggattcataaagaaacaatttataatgaccaatattcaataactaagagaggtgtccctattgaaaaagatcaagttggctgcagtgttcttgtctgtaagtctaggcgttggcacatttgtgatcccaagtccttatttatttggttcatttggagaacaaattgttaaggctgatgatagtccggtcgaggtgccgcaaagtgactttagttggggatatgacgaaataaatcacacggcaactttgaccaagacaagtattcattttggacaagatggcaatccggcaaacattattctgccaagtacggtgactaaggatggtgtactttacactgtcactgaacttggtgaaagcgcccttgtgaatcagggtagcctgacgggtgtcgtattgcccaaaaatcttacccgaattggtgccgatgcctttgcgtctactggtatcacaaatattgttctgcctgattcggtaacaacaattggtgatcgtgccttcgagtattcaaaattaacaagtttggtcattcccccaaatctcagaactatcggggaaaatgcttttacatcagcaacttctctgacatcggttgattttagtcaagcgacatcattgacgacgattgacgatggtgcatttgagtacaccccgattggcaagataacttttccgaagtcacttcagtcgattggaaaagatgcatttaggtcagctacgagcctggcatctattgattttagtcaagcaacatctttaacgacaattgatagtggcgcgtttgcatctaccccagtaagcagtatcgtcttaccgaaaaacctcaaatcacttggggatgatgcgtttttgagcgctgaaaaattaaccagtttaacacttaatccaaatttagaaacaattggcgcagaggcgtttttatatgatcatattagtagtttagatttaaccgtcgcacctaatttgatctcgattggtgcgggtgcctttgaatataattcaatcgcaaatccaataacggtaccggataaagtaacgacaattggaaacgttgcgtttgcaggcaatcaattaacaacagttaaagttcttggaaatccaagtgttggtgccgatgcgttcacttataaccgaattacaaaatttgatgcacctaatagttcgtttgctactaactcaacgatgaatcaatcggcttcagtgcagattgataaggcaaaattaacgatagacgatttgtttacgattaatatgaacggcagaaaaacgcaagatatagcgattagtgaggtaactaatggcgtgacctataattcgacgtctggcgtatttagtattccgacgggagtgaagcaattttcttttgattggacacttactgataaagatggtaccaacaaaatttactctgggcattatgatgttaccgttataccagaaaaggccactgctaaattgtctggtgggaccaagcaatatgatggtaaaaaggtcagcgagagtcatttcaaacccaagttgacccttctggattcctctgggaaagtcattgcgacattagatttatcgcttggccaatatgtcattggcaaggacggttcagcagttgggtcctacccaattacgttagaccaggctgaaatcaccaaattacaagcagcataccctaattatgacctcagcgccttgaagtcggttcagtcgacttacaccattacaccggctggtagtggtggtggcagtagttcctcatcgagttcctcgtcaagcagtacgggaaacgacggctcatcaagttcatcttcgtcatcaagttcaacgagtgatgggacgggaagcgacagcagttcaaccaccaaccccaatacaccggaaaccggattagaaccgggaaatgtggcggccaaggggacggttgtttacgcaatcaagaaaattggtttatataagaagacagacttttcgacagctactcgacgatcctggtatgttaagaagccaagaatctatcgaccgatgtttgttgtaaccggatatgcaaggtctaaaaatggcactttacgttataaagttcgtgacgttaaccatttgacggttaatcgtggtaaaaagggatacatcacagcaaacagtcactatattcggccggtctattatcagtcgacgcatcaaacagtcacggtgattaatccacgaggtgtgaatagttatcgtaaggctgatctaactggtaaaattcgtaattataagcagggaacggtccttaaagtgaagcgaattgttacccataatttgacaaccaggtatgtcttatcaaatggtcattacatcactggaaatcgtaagcttgtcaacatggggcgtcataagcagaccaagttggttcgtgcacgaacggccattaaccggtacagtgatgttaacctgaagaatcgaaacagtcactattctaagaaacaacagaaagtgttcaaagtgtatggttttgactattcacgaggaaatcgtgttagtcagcgaggcacactgcgataccgggtagcaggtggttatatcaccgcgaatgctaaatatgtcaaagtttatcgttaattatcataaaaaagcatgccgagacacagttgcttcgtgtcttgacatgctttttttatattagttgaacttgtacacaaaataatcaacatatgctgtgccatcatggccgattagtggggctgtggattgaacaaagcctgctgcttgaagggcagtaatccttgttcttgcaatattaattgccttggttgccatttggttggaattaaagaaatgattaatctcttttttgtatacttcaattaattctttaataacaggagtgttttcgtagtcacttcgaaggtctaatcgtagaatagccgtattatcaaagaagtcatcggcttttcgatcgaatacttcaactgttccgattcctaaattgtttttaagatcgataatcgaccagcgaacgaacccgtgggccacatattcttcctgccaatatttgatagcagccagcatcctctctgaacttggatagtggaaatcatcgccaccacaattatcactgttgaatagcggaactgaagcagggtcatcatatactttcaatagatctagtgcatcagaagtttgagtttgacgaaattgataattttgactaaaaaaggttgggcatctttcatatatatcattcatgtcgttcctcccttgaagttatcaatgagtgacaatgcagttacctacccaaatgatatctttttggaagcgttttttcaaacgtctagtaacctttaactgcttaaaaattatttgtccacaattgatcgtaacgctgcaattagtttctcgttatcgcccagcaagtgctgataactggctggatccaaattattttccgacacgcattggttcaagtcacgctcaatctgatcttgagctgctttccctttttcggttaattgaataatgagctgacgccggtctttttccggtcgcaggcgaaccagccacccggcggtttccatccgctttagcagggatgtcagggtattactggcgagatggagttccttgcccagatcatggagggttcgttgatcattttcccacaatgccagcaagaccagatattgcgtataagttagttgatagggcgctagtatctgctgataaaagcggccaaaaagtcggtttgcgttgtaaattgagaaacagagttgattgtttagcgccattttattttccattcgtcgtcaccttaattgattagttgttagattgattcaatcttattcgattgattgtgataaatcaactgacaaaagatagttgacaggcttatccaattgaactatattgaaataaatcgcatgcgatcaatcgtgtcagtttgagaaaaggttaggtgaaacagaatgaagacaatttatgaatttactgaaattgaaatgaatggccaaccgctgaaactccaagattatcaagacaaagtggtgttaattgttaatacagccagcaaatgtggcttagcacctcaattggaaggcttggaagcactatataaaaaatacaaagatgatggtttagttgttttggggttaccatccaaccagtttcaccaggaattggcaactgacaaagaagccagtgactattgccaacttcactatggtgtgacgttcccaatgacgaagcgggtagcagtcaacggtgatgatgaagatccgctgttttcctatcttaaagatgaatccggtcatggcaacattaaatggaactacacaaagtttctcgttggcaaagacggtcgattgattcatcgatatgcgccgattacgaagcctgagaagattgaggatgccattcaggcggcgctgaaataaagatttgcgacaattattatgtatggtcactgtttcttgcggtggccattttttaattctgcttttggccggtcatcactgcataattgccttagtttgttcttcaataaaacggcgattcttattaatatcggccttagtggctctaggaccaaatataagtgtaatcacaatttgttcataatagtaggtgatgaagcgacccagatcacggttggttcgatctaattcttcttgggtcatcgttccggcactagctttcattaatgccgttttaatttgtttgaagtattttttctcgaattgttgaaccttaattgcgtcccgataacgttgctgataaaaattaaatgtggcattaattcgaacgggtgtctcacatcctctaaaatatagtaataaattatccggcttggcagttaattcataggaagcaacttgacctagcgaaatccagggtcggtggctatttttcctggcggcttttaacggcgacaatagaaggttacgataaacgtggggcacgtattctttaatgcctaaataatttgcgatcattcgaacggttctgggaacttccaaaagtttcttattactcagctcatgctttatgagcgtttccggtgactctcttactgctaccagtccttgatatttatcgacaatcaaagtcttcgcctgctttgcctccagcggcactagcatgtacaccgtttcccaatggattggcgttcttgctggctgcttcttaatgtggctcaacttgaccttggtgacatcaaaaataccgtcattgtaaaattttcgggcggatgggttaattgtattcaataaattttccataaaatgcctcatttcttaaataactataacagtaatgagcaacttcattacttagcaaacataatagagccattaaatttatttgttaaacaaggcgatcataaaaataaccaatatatcgcaaacataatagttaatcacgcatagtgagaatttgactaaccaatcacgattagtgatattaacgcgaaaacggtttccagcaatgtggtatgatattgttgtgagatttgaaaatagggggactaactaatggcaaagcatcgcaaagaaaaagaccgattaattaacgaagcagttaaagaacaagttaaaaatatcgatattccttatgaaccaacttatagtaaagatggtaaatatacgttgtacagctttaacaatgatgaagcccttggaatttccagcaacgagacaccattaaccaatcaagaattattggatcagcttaatgccggaattactgctcggatgagatattccattgtcccgattcaagcgtatattgccgaagttaacggtgttcggatgaaattatacgcaccagacgaagaacgttcccaattcatgatgtatattccaccgaagtcaactgaacagcgagtcaaccaatacttactgttaatgattaatgatatgaaagcgcacgcggcagatcagccgggaaatgcggaatagttagttggtcctcgcaatcgaatgatcgaagggagattgtttaatatgagcgaatcagatcgaaaaccgaccccggatcaacgcgcccaagccaagaaaattgtcgaaaatgttgatatcccgtaccgggcatttccaattgctgacggcaaattcaccgtctttgtctacaatcacggccaagcatttgggatttacagccaagtggggccaattgataaagagaagttacgcgcacctttagatgatgcaattactaatttgcttcattataatttgcagacggaaagtgacgggtctgaaatgattgacggcaaaccgatgcggttatacgtgtcaaataatccaaagcaacaatttattttttacgggcaaccaggggcaacggctgaaacgttccagaattaccttgccgttgtcgttaaatattttattgcccgtaaacgtcagaatgagcatcatgaataagttgacgttaaaaacgtcttaagtacatttaaaacgttacaatgggataattaagtttgatcgaaaggggcgtgtgaattttgagtgaccaatctaataaaatgacacctgaacaacgccagaaagcggctgagtttattaaaggggtcaatattccgtaccgggtattttcaactgaagataaactgtttatggtgtttgtgtttgataatagcaaggccattgggatttttagcaatgatgggccaacggatcaggatgacttacgatcgcggttggatcaggcaatcaccaatgagctccactatcggttcaaacgctccggcgaccaggccgcaattgatggccataaaatggctctttatcctaagacggcaggtgccagtgaacggtttattttttatggacaacccggcctatcagaagatatggtgaaggcctactttgcggtggttgttcaacatttaacccggaaaaagtagcccagatttaacagattgaggagacagaattgtggcaaaacatcgaaaaaaacgtgaacgattaatttcgaccgaagcagcgaagatggctgaaggaatcggtatcccatatgatgccagccaaaccactgatgatgaatacacgttgtttgattttaatcacggccgggcatttggcattgccagtcatattgggcgagtgaatgggatgcagctgcggaaagaattggacaacggcattaccatcgcaatggggtatgaattaaagcatattgatccaactcgcacgtgggtcaatggtcaaaaaatgaagttgtcggctccagaagacgatcctgatcatttgttcatgttttacgtcactccggagacgtctcgggaagaaattcatgacttcttgattttgatgactaatgatttctatcagcgacagaaaaaagattaaatagatgttgaaggggctgggacaaaagtaattttgtcccagccccgttttgtgtaatcacgattattaccgagtggaaacgtgcgccaaaaggcaacttcctgccgcgtaaccgaattatccaaacattcaagcccagaatattcggataatccgattacgctctggaagttaaccgcctttcgtcccactctctttttagtcgtaaatcacttttggcgtgtggcccatcttttccagcaccttcactaagttctggtacgacattagaatggtggccgtgttaatgtttggatgagccgaaatctccggtagttgttgcaagtcggcatccagtaagaccttgacttcgtttttcgtgtcgtgcatgagggcgagtggcgtaaccattccggaaacaacgcccaataaactttctaattcttcttcactggcaaagtttaaccgactgcgggcaatttccaattgatcagctaatgacttgaagttgacccgtttacgatcggttaagtacaaatagaactgatcgcgcttcttttgcttcaataataagtttttcaccggtggtaagccgggtggggtattgggatcatccattgtccaaatggcgggatgatcgatgcgtcggtacctaatgtgtaagacgtttagtaaattgattgcttctcgctcggtcgccattttcaagtatatcaactcccaaaataatgattgaaattaatcatacgcttgtttgtgccatcggaaaactagcagtaagataaaatctaaaacggaggcgaataagatggatcttacttttgattgttacggtacgttattggatacgcggcccattcgaaattggttcttgaagattagtcagcaaaataacctggatggtcaagccgcttggcatcaatttgaatcgtgggaagatcgattaatgtacggggaaccaacgctaccttatttggtattattgaaacgaaatttagcctacattgatatgacattgaagacggggacgttattcagtgatcagcttccccaattaattgcggcctaccaagcacttgaaccttggccggaagttgtgaccaaccttcgtcaattgcggttggcgggtaaccgggttattttgatgtctaattcaacgccggaattaatgacggcgcaccttaaatcactcgggcaccaagttgatcaagtcattttgccggaacaaactggttgctacaaaccagatataaaattcttcaaatatgcagcccaacaagttagtcatgatcatatccacgtggcgatgggctactggtgggatgttatcccgtgccgtaaaatgggctggccggtggtgtggattaatcgaaatgggctcacggcattcgcagataatcaaccaactgcaacgttgcccaacctgactgacctgtcaaaatttgttgaacaattatctaaatcaaactaaattaagaagccttgaaaaatttattggacatttttcgaggctttttgtgttttaaaggaatgcctagaatagtgatccgacctatatttctatatgtcgtgtgtccatcaagaaatcgatttttaatgtttttcaaaataatttcatcaactcttccataataattgaaaaagtaccaggccttcctcctcgctttcatctaaaaaggatcacttaatcccggtgtagcaatgatttctgttcctaaaagtaccttgtttaattcttcgttctttctatatatagtagtatctcgtgacaacggccgttggatcaattcaattaaattaggatggattcaaacatggaaaacataaaacaagcacaacgtcagcgctacaccgaagcgtttgacttcttattggacggggaccatgaattggtcgtttacggcgtattgaagaaactccacattaccaagaccaatccatattatgacgatatggttcaagaagggcggattgctttcattaataagtatctgcaggcactaaatgcgggaaaaccagaaaaagagattttgccatttatttatcagggtgtgaagtgggcactgctggactatctacggaagcaactcaccacagtcgaacacgttcaagttccggaagacaatgtcgatccattggcagaactgatcgatccactgcataccgttgaaaacattgacacgggtgttttgattcggcgcttgggaaccgtttgtaccaaacaacaaatgcaatacatgatcttggcgtttgaatggggacttaccgttactgaaattgccaatcaattaaatgtcactcggccgacggtttatcagcttcgcaaggctgtaataaagaaaattgggaaattgttttaaaaaagtctttacactttgaccggttcatttcgttactagtatatgtaagggttggcgccaacagcttacaaagaaaatacagaggagaaagaaaatgcaaagagattggatgaaatcaagtgcgacttatacgttggttgacaaggatcacaagaaaggggttaagcattcttttagttatttggctaaagatgtcaaagctgaaacgattgcggcctttggcgagatcattgaatccttcacggaaggcaaaatcactgacgcaaccgtctcttcaactgaacacgttggggtacaagtacaatcagcaccaacagaagcacctaataccgaagcaacatctgcacaaggtgaaacagctccggttgaagcaccaaaggcataattaggtttatttaaaaattaaggtttaggaattttaggttggaaaaaacggttaatgctttggcagactcgtggttacagtctcctcggcatgagacgggcaatttacaggaggaatcattaatgcgtacacttgaattaatctttaaatcagcggatgataagacaaagaccatcagtattaactacgccagcggtaatttagttggtgcagatgttcaaaagaagatgcaacagattacggagctggggatgtttgataataacggggttaacccttaccagacaccgattgcggcgcagtaccgacggaccgaaatcgacaaattatacgacacccgtgcgaactagtttgtgcacaatatatcaaatgaaataatcgtgagaacctaggaattgtaacatccgaagggcaaaacagaaatgttttgctcttttttcattacagaaatgtttctaatataacaatcggataaattaaaagcgtataggttgcgaaccaaaaaattaggcgatacaatagcatatgtaaagttgattgggtatcaaattgtggttgttgttttatcgtaagtgcggtagaattaacagtgcagtttacatatacctagtgaactacaaatcatatatatatattggaggagactatataatgaaatcaagcttgaagaaatcattatttgtaggcttggcagctttaggcttcgttgccgttgctggttcagctaacgctcaaaccgcttcagcaaaaagctatgctaaggttacatcaaacaaagccttaaccggcgacg

SEQ ID NO: 668 - DNA, 50450 bp, Unknown
  Metagenome-assembled genome
ggtgaaacggaaaaggttaagctagccaccatcgactttagccaattgaggcggttcggccaaaatcccagttttcacaaggatcgacggtcccgaaaattttatatcgttacaaattagcttgtgtagaaatgaaaaggatattgaacatgaaatttgaagatcgcaaattatggcagggattaccaaaacattttttgctaaaaaaaaaaaaaaaaaaagctagtcgccacggtcatcaaaaggtggcttcgggtggctgttaattaccttgggcatgggaatcctgattaagcccaccccagagtatattggaaaaagtacccaggaaaaggttacgaaaccgattaaatcataagtagctctatttagggggctacacagtttaaaagttgctgatgcagttccgtattttttcatgaaaagtatgggtcaaacgttttaaccagaaagtgaagtccaattttggtggttccaagattggacttgttgagttaccgtggccctatgaacccgggcgatctcttttttactcccagaccctggataaccctgagtatctttcaaaacggggcccactggggtcgggttgaatttcagacggtaccattattgaaaaaacaactttttactgatgtcgatcaattgacgaggccgttgccaagaaacgaagctcctctattgaactattcactaataagcccgactggatctgtggcaaccccgtgaacttttacgagctactgttgtggaagggccgaagacgtaaccattgtgggcattattgttgattttgcgtatgggggcgttgggctttgaagcgaggcaggcaaccaattagttttaatggaagttcagttgctaagagtgggattgaagttctgatacaattcgaagacctttcaatacatggccggctgtcggtttcggcctgtgcaggttggtgaagtggtcgcgggatattattgaagtacaatcaatgtcaattcaggatctctgtttgtgatcgtattttccttcgcgtgtcaagaggcggggcgtggatgcgtgccgttatcctcagtcgtaatgagaaatttgctaaatcgtggctcgttatgtacaacgcgctatgcctttgtggcctgccgagcgcaaagcattgggttggcagggcaattaaaccgggggaacgtttatatacactaatgccggtcctgctggatatacggtgaatcgtttgcgatttactacttgatattaggcgaggcgtaaagcctgagctgtgcactccccgccaacgggttttggccgccatggtggaaggctacgtcgcattggactactgtctgagcagggaggtggccgggatagggaagtcggagtgtggttgttagtctgcgaggcgcatagtggggaaggttcttcgcgattagaggcgtggacgattagttaaatattttctagatattatgcggtaaaacatttcgtcgatgataggggagctttttaatggaatttacaaatagtttaaaaatagttgttgacgagcatacgaaaagccgtgttattaattatcgttgtcacacgttaacaacaccgtgatcaaatgatcaagaaaaacgttgttgacattgatatcaatctgtttattaatacgttgctgattcaaaaggaagcaacatggtagacctttgaaaactgaatcagtttcgacgacacaaatgtgagggtccttacgtatgtaagtgcaaaacatttgcgaagtcaattcgcttaataataaattgagcttcaattcttatattttatatgagagtttgatcctggctcaggatgaacgcggcggtgtgcctaatacatgcaagtcgacgcttggcccctgattgaaggtgcttgcacggacttgacgttgtaccagaggtggcggacgggtgagtaacaacgtgggtaacctgcccagaagtggggataacatttggaaacagatgctaatacgcataatagatagaccacatggttctattttgaagatggcctttgtctatcacttcgggatggacccgcggtgtattagctagttggtaaggtaacggcttaccaagcaatgatacatagccgaactgagaggttgatcggccacaatgggactgagacacggcccatactcctacgggaggcagcagtagggaatcttccacaatgggcgcaagcctgatggagcaacaccgcgtgagtgaagaagggtttcggctcgtaaaactctgttgttaaagaagaacgtatctaagagtaactgcttaggtagtgacggtatttaaccagaaagccacggctaactacgtgccagcagccgcggtaatacgtaggtggcaagcgtttccggatttattgggcgtaaggcgagcgcagcggttttttaagtctgatgtgaaagccttcggcttaaccgaagaagtgcatcggaaactgggaaacttgatgtgcagaagaggacagtggaactccatgtgtagcggtgaaatgcgtagatatatggaagaacaccagtggcgaaggcggctgtctggtctgtaactgacgctgaggctcgaaagcatgggtagcgaacggattagataccctggtagtccatgccgtaaacatgaatgctaagtgttggagggtttccgcccttcagtgctgcagctaacgcattaagcatttccgcctggggagtacgaccgcaaggttgaaactcaaaggaattgacggggcccgcacaagcggtggagcatgtggttaattcgaagcaacgcgaagaaccttaccaggtcttgacatctagcgccaatctcagagatgagacgttcccttcgggacgctaagacaggtggtgcatggttgtcgtcagctcgtgtcgtgagatgtgggttaggtatcccgcaacgagcgcaaccctatatcagttgccagcatttagttgggcactctggtgagactgccgtgaacaaaccggaggaaggttggggacgacgtcaaatcatcatgcccctttgacctgggctacacacgtctacaatggacggtacaacgagttgcgaactcgcgagggtaagctaatctcttaaagccgttctcagttcggactgtaggctgcaactcgcctacacgaagtcggatcgctagtaatcgcggatcagcatgccgcggtgatacttcccgggcccttgtacacacgcccgtcacaccatgagagtttgtaacacccaagtcggtggggtaacccttcgggagccagccgcctaaggtgggacagatgattagggtgaagtcgtaacaaggtagccgtaggagaacctgcggctggatcacctcctttctaaggaataaaacggaacttgcacgtttggcttgtcacatgaaactttgtttagttttgagaggtttactctcaacttaattaagaatgcttattgggcctatagctcagctggttagagcgcacgcctgataagcgtgaggtcgatgttcgagtccattaggcccatatatggggaattagctcagatgggagagcacctgctttgcaagcaggggtcaacggtcgatcccgttattctccattaccaaccgacaggttggtaagacttgcactgaaaaacaataatatcgaaatattttttttaaacaaccgagacaccgcgttatttgagttttttaatgaattacattacatcgcgtaatactcattaatctgtggcgacccgacgtggtcaaagcaaggttaagtataaagggcgcatggtgaatgccttggtactaggagccgatgaaggacgggactaacaccgatatgcttcggggagtggtaagtacactttgatccggagatttccgaatgggaaacccaactaacttagtcgttagttactacttagtgaatacatagctaagcagaggtagacgcagtgaactgaaactctaagtagctgcaggaagagaaagaaaatcgattccctgagtagcggcgagcgaaacgggaaaagcccaaaccaacgagcttgcttgttggggttgtaggactgaacatttagttaccaaagtaagacgtagtcgaaatagctgggaagctatatcgagagggtgataacccgtagacgaaacggcttactctcagttcagatcctgagtacggcggaacacgtgaaattccgtcggaatccgggaggaccatctcccaaggctaaatactccctagtgaccgatagtgaaccataccgtgaggaaaggtgaaaagcaccccggaaggggagtgaaatagttcctctgaaaccatgtgcctacaacagtgggagcccgttaatggtgaccgcgtgcctattgtagaatgaaccgcgagttacgattgcatgccaggttaaggtgggaaaaccggagccgtagcgaaagcgagtctgaaagggcgttgaagtatgttgttgtagacccgaaaccaggtgacctacccatgtccaggttgaaggtgcggtaaaacgcactggaggaccgaacccgtgtcagttgaaaatggctgggatgaggttgtgggtagcggtgaattccaaacgaacttagatagctggttcctccgaaatagctttagggctagcctcggaataagaatcatggaggtagagcactgtttggactaggggcccgtttgggttacgaattcagataaactccgaatgccattgatttatgtccgggagtcagacggtgattgataagatccatcgtcaaaaggggaacacccgatcaccagttaaggtcccaaaattatgctaagtggaaaaggatttggagttgcttagacaactaggatgttggctcagaagcccatcatttaaagagtgcgtaatagctcactagtcgagtgatcctgcccgaaaatgtaccggggctaagcatttaccgaaactgtggatcatccgtaaggatgcgtgataggagagcgttctaggcaatgaagtcagaccgtgaggacttggtggcgcttagaagtgagaatgccggtatggtagcgaaagacagtgagaatcttgtccaccgaatgactaaggtttcctggaaggctcgtcctcccagggtaagtcgggacctaagttgaggccgaaaggcgtagacatggataacaggttgatattcctgtaccgttaactgtgtttgaacgatggagggacgcaggaggctaagcaaacaactgttggatatgtctggccaagcagcaagtcttgattagagtgaaatgctttaatctatacggacaagttgtgatggggagcgaaatttaagtagcgaagttgccgatgtcacactgccgagaaaagcttctagtgaatgttaactgcccttaccgcaaaccgacacaggtagtcgaggagagaatcctaaggtgagcgagtgaactctcgttaaggactcggcaaaatgaccccgtaactcgggagaaggggtgctgcacgtcgtgcaccgcagtgataggcccaggcgactgtttatcaaaacacaggtttctgcaaaatcgtaagatgaagtataggggctgacgcctgcccggtgctggaaggttaaaggatgggttagcttcggctcgcgaagctcgaaattgaagccccagtaaacggcggccgtaactataacggtcctaaggtagcgaaattccttgtcgggtaagttccgacccgcacgaaggcgtaacgatctgggcactgtctcaacgagagactcggtgattgatatacctgtgaagaagcaggttacccgcgacaggacggaaagaccccatggagctttactgtagcttgatattgagtgtttgaaccgcttgtacagaataggtaggagccgtagagccgggacctgtttcggcggagcattagtgggatactaccctcgctgtatgaccactctaacccgcaccactcatcgtggtgggagacagtgtcaggtaggcagtttgactggggcggtcgcctcctaaaaagtaacggaggcgcccaaaggttccctcagaatggttgaatcattcgcagagtgtaaaggcacaagggagcttgagcgacgacacggtcgagcagggacgaaagtcgggcttagtgatccggtggtaccgtatggaagggccatcgctcaacggataaaagctaccctggggataacaggcttatctcccccaagagccacatcgacggggaggtttggcacctcgatgtcgctcatcgcatcctggggctgtagtcggtcccaagggttggctgttcgcccattaaagcggtacgcgagctgggttcagaacgtcgtgagacagttcgtccctatccgtcgcgggcgcaggaaatttgagagagctgtccttagtacggaggaccgggatggacataccgctggtgtaccagttgttccgccaggagcatagctgggtagctacgtatggatgagataaacgctgaaagcatctaagtgtgaaactcgcctcgagatgagatttcccatcttcctcggaagagtaagacccctcagagatgatgaggtagataggttggaatggaagtgcagtgatgtacggagcggaccaatactaatcggtcgaggacttaaccaagtagaaatggtgtttcaaggatatagaaaattaatactagctagttttgagagaacgaagttctttcagtaacaccaagtgtggtggcgatagccagaaggatacacctgttcccatgccgaacacagaagttaagcttctgcacgccaagagtagttgggggatcgccccctgcgagggtaggacgttgccacgctttatatttggaggattagctcagctgggagagcatctgccttacaagcaggaggtcacaggttcgatccctgtatcctccatattgagccgttagctcagttggtagagcatctgacttttaatcagagggtcggcagttcgagactgccacggctcattacaattgaatattattaacgcataatatttagtatgccgacttagctcagctggcagagcacctgtcttgtaaacagggggtcggaagttcgaatcttctagtcggcattcttgcggaagtagttcagtggtagaacatcaccttgccatggtgggggtcgcgggttcgaatcccgtcttccgcttattatgccggggtggcggaattggcagacgcacaggacttaaaatcctgcggtcagtgatgaccgtaccggttcgatcccggtcctcggcatattttgcacccatagcgcaattggatagagtgtctgactacgaatcagaaggttgtaggttcgactcctactgggtgcattagttcatttcgggaagtagctcagcttggtagagcacctggtttgggaccagggggtcgcaggttcgaatcctgtcttcccgattgatagaagtactatcattttttcatcgcggtgtagctcagctggctagagcgtccggttcatacccgggaggtcgagggttcgatcccccctgccgcgatataagtcttggacctttagctcagttggttagagcaaacggctcataaccgttcggtcgtaggttcgagtcctacaaggtccattgactcgtagagttatttttatagttttagcatggaggattacccaagtggctgaagggggcggtcttgaaaaccgctaggtgggtcaaaccacgcgagagttcgaatctctcatcctccttcttattatcgcgggatggagcagtctggtagctcgtcgggctcataacccgaaggtcgttggttcaaatccagctcccgcaattttggttcgttggtctagttggtttaggacgcctgcctgtcacgcaggagatcacgagttcgagtctcgtacggaccgcttttggctcggtagctcagtcggtagagcaatggattgaagctccatgtgtcggcagttcgattctgtcccgcgccactttttttatatgatttataatgcgggtgtagtttagtggtaaaaccacagccttccaagctgttgtcgcgagtccgattctcgtcacccgctttgttcatcaatgggcctatagctcagctggttagagcgcacgcctgataagcgtgaggtcgatggttcgagtccatttaggcccatattggagaagtactcaagtggctgaagaggcgcccctgctaagggtgtaggtcgcgtaagcggcgcgagagttcgaatctctccttctccgtatcaatgacccgttggtcaagtggttaagacaccgccctttcacggcggtaacatgggttcaaatcccgtacgggtcattcacataaacaatataatattatcgcgggatggagcagtctggtagctcgtcgggctcataacccgaaggtcgttggttcaaacccagctcccgcaattttggttcgttggtctagttggtttaggacgcctgcctgtcacgcaggagatcacgagttcgagtctcgtacggaccggtgcttacaagttacagaggtagcttgttttttttgcacttaacgtttacaattgtagtcgaacggtaagactcattgttaggaaaaacgagtcaaaaggggttatgatttttcgatagataattgaaaagggattgttagtgattcaaagtgattggtgtatctgagaaaaagttaacgcctgcgtcaactcgtagcaaaaggtgatgataacattttcaccttaagtttgagactaaatcactagggagtgattaaatgacaaagaaaaatgaatcaatgaatatggaacatctggattctgaaaatagaaatatgcatatgacagataagatggctcacagtcatgaagaaactgagcataaaaaaagcccaaatatgctggattcagccatgcaaaagcctgatgaccacatgaatcatgatatgcccaatatgaatgtgacgaataactcccatgatggaatgtcgggtcatcacatgatgatggacatggcggatctaaaccgtcgtttatggatttcaattattttgacgattccagttgtcttattatctccaatggctggcatgggtggctttaatattcattttagttggtcaccgttattgttggttatcattggttccattctttatttttatggtggtaaaccattcttttcaggggccaaaatggaagttcaaatgaaacaaccaggcatgatgtcgctaattactttaggaattacggttgcttatttttacagtatgtactccgttatcgcaaataatattttccatactacgccaatggttgatgagtttttctgggagctttcaacattaattgatattatgctgcttggacacattattgaaatgaaatcagttgatagtgctggttcagcggttgactctttagcaaagctgctgccttcaaaggcaaaagttattcgtcatggagaacccgttgaaattgacgttgctgagttaaagattggtgatgttgttcaggtccaagcgggtgaaaaaattccagcagatgggaaattaacgactggttctacaactgttaatgaatcacttgtaactggagaatctaaactcatttcaaaaggggtcaatgatgaggtgattggcggatcaatcaataacgatggcacatttgaattcaaagttgataaggttggtaacgatagctacttgaacaaggttatgaatctggtaatgaatgcctctaacgataagtcgcatacccaaacgcttgcggataaggttgcaggttatctcttttatgcagctttggctggggccatcattgggttggtagtctggatgggaatcagtggtgttaatgttgcgttgccaattgccgttacagttctcatcatcgcctgcccccatgcactcgggttagcgattccactggttgtttcacgatcgacagctttggcagctaagaatggactgctgatccgtgattcgaatgcactcgaacatactaacaaggtgaaatttgttctaatggataagacggggacgttaactgaaggtaattttaaacttaatatttatcgtagttatgatcctaaatatagtgatgatcaaatattgtcacttgctggtagtcttgaggaaacttcaagtcatccacttgcaaaaggggtgatggacgctatttcaacaaagaaaattaaaatcagcgaagcaacaaatgtccaacagatccctggatttggtgttaccggtgacgttgatggtgagcagtatcagttggtttcggttaaatactttgaaactcatcatatcgactttgacgaagctaagtttgaaaagttgatcgcagataaaaataactctattagttttctactaactcatcagcgagtgattggtgccattggtgaaggcgatgaaattaaagctaattcgaaaaaaatggtaacgttcttaaagcaacgtggtattcaaccagtcatgttgactggtgataaccgtgcgattgctaagagtgttgccgatcaacttggtatccagaattatcgatttgaattactaccggaggataagcaaaaaattgtcgccgaatatcaacaaaaaggccagacaatgtttattggcgatggcgtgaacgatgccccaagcttaagccgggcagacgttggggtggcaattggtgctggaactgacgtagcaattgattccgcagatattgttttagttagaagcgatccgaagaacgtgattgatctgttcggtctagcacaaaaaacagcaaccaagatgaaacagaatctttggtggggggccggatacaatattgtggcaattccattggctgcaggtattttggcgccagttggcattatgctgagtccaatggttggggctgtgttaatgtcattaagtaccgttgttgtttctgtgaatgcattaactttaaaggtgtaaaaatgaattcagttgttgatcgtgagtattcatccagatggtaaaaatagaacaaccattgcgtacattagttatcagtcagcgatattttcattgagttgaatgtttataaaattgattggttaaaaaataagtgtcactcggataaggattacagtaacgtaatcgggttatccaagtgacacttatttgtaaccaattattctgcttcttttttctcagcgggcgtgtagtaagcttcgtgtgagtaaaaacttggtgaatctcgatattctttaggaataaattcatgtgagctattcttccaaatttcaaagttggaataggaatcccatgttcctagaatcactcgttgattaatatctttatggtagtttaacgaatagatcgaatgcatcccaattggtaatccatcactcatcagcttatttagccgggcatcaaacactttttgctgatcaaagtttaaatctaatgtagaaaaactaataaagccttcccatttatcagtgccagtgtgtcctaagatatcataataaactggtgatttaaaaattgattctttgccagaataatctaacatcatcatttttccctgctgattcaaagcttggtaaataactaaatgccgatctggatatttgtctctaattgttgataatatttgctcatttccaaaagtaattgcaatctgttgtttcacgatgatccacctcctagactcactttaattatactttctttcatgccattcaccaaacatttacttttgataatgtgacacctatactagcaaatataagagatcgttttaaaaatcacttaactcattatcaaggagatgcttttttgaaattaacagtgttaggttttttaggcggatatcccgcaaatggtaacgggaccagtagctatttgctagaatcaggagatttcaaacttctgattgattgcggaagtgcagctttgctaagtttggaggaggttagcgatcctttgaaactgaacgcagtaattctaacccactaccatcatgatcacacggccgacgttggtgttttgcaatattattggcagcttcatgaaaaacgttatgctgaagcggtgttgccgatttatgggcatcagcttgatcaggagaattttgctggccttagctggccaaattcaacgaaagggattgcttatgatcctaaggaaacacttgatctgggaccattttccatcacctttttaaaaactcatcatcctgttgctgcatttgcattgcggatcgtggaaaagctgacaaagaaagttctggtttttactgccgatacagcttattttcctgagctgacagcctttgcaaaaagagctgatttattaatgaccgataccaacttttttgctgacaaaactggtcaaaaatggcatatgacctcaacggaatccggtaaactcgcaaaagattcagcagccaaacagttattgatcactcatttaccagctaacggtgattacaatcaattgcgcgcagaagttgaaaagtcggctggtgttcagatcccggtaacagttgctagccgtcacttaacaattgaggtataaaaacggttaattttgatgaaagtttgttatttgtaagtttattctgtgaaacttatgatttttataagttaatcctttataatttggttacaagctaaattactaggaggatgaaaatcatgacaattcaattcttaacaaccccaagttgcacttcttgccgaaaagccaaaaaatggctcgttgaacatggcattgaatttaaggaacgaaatatgtttgccaacccgttaacgcgagatgaattaaagcaaatcttaatgttatcggaaaccgggacggatggcttgatttccacccgctcatacgtttatgatcaatacaaggataagattaattcattaacgattggtgacttattaacattacttgctgcacatcctgaaatgattcgacggccaattatgattgatcataaccggcttcaaataggcttcaatgatgatgaaattcgttgcttcttaccaaggaaggttcgaaagagcgatcttgagcggatgattcgaaacgttcaataacaatgtgtttaattacttgttaatcaccatttttagccgtattatttacttggacaatattcatgttacaatgttagtattaatgaccctcagatattgaaaggggtggctaaatatggaaatggaacggatcaacgaaaatacaattcgtgtattaattggcaacgacgatcttgataaacgtgggattacagtccttgatttgttaggaaaccacaaacaaatcgaaagcttcttctatagtattcttgaagaagttgataaagatcatcaatttcagaataacgatgccgtcactttccaagttctgccaaatcaaaatgggcttgaactgttcattagtaaggatgttgatatgtccgataacgagatgctgcttgattcaagtaagagccatgataagcgcgatcgggtatcaaaatatattgatgaccatgctggtgataaaaaacacatgagtgatagtgataataagacggatgatgaaaacaaacggcctaatcggacaataattctcgaatttgatcaatttgatgattttatctctctagctaaggcattacggctggaagatggcacatctgatttgtatctatatcagggtaagtattacctggaacttgttctctacagcagcgatccagttgacatgattgtgagcgatgaggttgcgattgctaacgagtacgggaaaaagacaactgttaccgatgatgtgttacatgaatatggtgaacacttgatggaaaacagtgccttggaattaagtcggtattactttaagtaactcggttgtgattatccactggaatacttgtagttaattaacaaagaatcaaacaaaaagctttatcatcaaatagcctaataagggcactgatgataaagcttttttatttaatcttttagtaggtattggttcttggtcttaccgtagtcgtgtaatacgtcgatgattgaccattagttttctttgaggggtgaaatccacttgttttggaaacaatgtaaagaggccgattacgtgatgcttcaaaaattctgtacaggtaagccccaatcattcctagtgacaataggataacaccaaccattaagaagagtgagaagacagcgaaatgaacggtgttcattgttgttagtagtgagacaagcaggtatcccatgctaaagatgatcgaagccgaccccagccaatttgccatctggagaggaaatgaggagaacgaagtaaccccatccattgcgagacgaatcatctttgataatggatacttagaataaccggcaattcgttcttgacgttcatattcaaccttggtctgtttgaaaccaacccagctaaccattccacgaacatatggatctggttcgttcattttttgtaattcacggaccacctggcgatccattaagcgaaagtctcccgtgtccagaggaatattaacgctggttattttttgcagaattcggtaaaaaacagctgccgtcaatcttttaaaccaactttcaccgtctcgagagactcgtttaccatagacaacgttaaagccttcatgccatttgctaatcatgtcaacgatcactgccggcgggtcctgtaggtcagcatccattacgataacggcgtcaccacgggtatagcggatgccggctgtgattgctaattgatggccaaagtttcgtgagaactggactaatttgatattattgtggaacgctgaggcatcgctaattaattcagcgcttttatcttttgatccatcatccacgaaaataagttcaaattgttgcggttgattggtaataaacttttccagagtatcgattgtattttcaatgccttcagcttcattaaaaacaggcaggacaattgagataagttctgagctttctttcatgaaaaaacctcctttatttataaatagttgtcagatcatacagaacgccactagctcccatgccatccataccaccgtggctgttcttatgtttaacggttgttttctgggctgcttgattcggcttgtgctgtttattaccatcacttggcattttttgtttgccaccctgtggctttgttggcattttggaatttgactttttgccattgaattttgattcggcttgtttacttggcttttgagaagtcattgattttgaagtagaggctgattcaccggtagtgccgaactggccaaacccctgttgcatattttgagaacttgagctttgatacagacttattttgaccttagtcgcgtgtttcttaatccagttgacaattttggtgttaccagatcgaccagatgaatagtaatactttaactggcctgttttaacgagttgtttaaattgcttaagggtaattgccggatcagttccgttgaatccacccattgccatgactgctttaccggtcttaataatataaggcgctgcggtggatgaatcacttgtagcaaacagatatttggcgtttccctgatgtttttcaaggtatttgagcatttttgtattaacttgactggatcccataccgccactcatacctgacccttgcccagaagttagtagcgatggtcccgccgttggaatcattgcggattcggccgcgattgttggtgtaagcgaccaccaggttggggcaacaagaatcgtgatgattccagcaactgttagtggttttgccaatgaacggtaccctatcacaatcagtgtgatggcaataatcaagccggctgctaagattaaccatgtcaaccatggatagtagctgaagacgtaccatgattgaagggctgcggttgcaacaatggcgagtggtaataaatagaatttccagtcagtccgctgacttttcttaaataaactggtcaatgcagtgacaccaactccaaatagggcagcaattggtggtgccagcataatcatgtaatagggatgaaagaaactggcaacgctaaagaaaccgtaaacgggaactaaccagccagtccataaaacgagttgtttttgttgatgagttaggttataccaacgctttcgtctatcgcggaagaatgctagcgccccgattaaaccaattaaagcaaatggtaatagccagctaatttgtggtccaagtgacgattggaataatctaaatggtccaatcgtcccaatatcaaaggcaccaccgccaccaccaccagttcccattttaccgggaccacctttttttccagtgttaccacctggcatgccggtcatttttttaccgccaggagtaccttgttcctgttgggctccctgtttcatattcccgggggccttgccgccggtgggcataccacccttcttatttgagcttttactgttcataccgccgccaaacgtcccaccagtcccggttgtttggcctaagagccgctcggtaccattgtagccaaaagcgagttccattaaggagttggtttctgaaccaccgatatagggccgcttgctggcagatgtcatatcagttgaaagtggcagtgcgagtgtaaagacgagcagtgaaacagttgcaaatgttaatttcttaagcttttgttgccatttttcattggctgccagccaataaaataggtacattgcgggtaagatcatgaaagcttggagcattttgacgttaaaagcgatcccaattaaagcaaagctaatgagcaattgaaaaagtttttgactggtaattgctttttcgagcattaataaggccagtaacaagaagaaaatcaatgtagcatccatgttatttgttcgcgaatttgcgacaacaattggtgtcagtgtcattgccagagctgacaatcggccagctgttgttccgaaatatggttttaccagccgatatatcaggtagacagatccaattccgaagagaactgaggggagaacaacgctccatccgtggacgccaaaaattttcgcactgattgccataaaccacagtgcaacgggcggtttatcaacagtaatatagcctgcagggtcaaagctgccataccaaaaatttttaaaactttcggtcatgcttttaattgctgcagtatagaaagcattggctgagcctgctttccaaatttgccagccgtaaagaaaggctgccagaagtaaaatgaggcccaaaatccagtcaaatgttaagttacgatctcgcaaattttgggaacgaggggttgtatcatggttggttgccattctggcggacctcctttaatttttgtctatggaatacccaaaactttgaaagtaaaaagtttgtgggaacagttaaaattaagctaaacaatggaattaagttggtattcatttggctccaagagctcgctgcattggcgaatccgacacttattatccaggtaaacaaatatgtcgcatagtatttcataacgacagatttgaactgtgcatgggcattaaagacccagcggttattaagtgttaaaccgatcaatgacgtcacaccatatccaattgccattgcaaaagttgcgtttgttgctttgattaacagtaagtaaatgacatatgttagcccggtatttaacaaaccgattattccaaatttaaataattgctttgctgctttgattgctgttgcctcctttttggatattgaaatgagtttatccaaaagagcataaatcaagcttaaaaattttaaaatccctaaaattaaagattattagttgactggttttaaaaaaaacattattttatgaacagcagacaaaaggagaaaaaagttatgaaagaacttcacattttaatcattgaagatgatgtgccactggctaagagtctccagctgtttttaagcgaaattgctcagacaactgtttcaaatgatggttttgaaggtcaaatgctgggtgaagagggtatttatgatttggtagttcttgacttaatgctcccacaaattagcggatatgatattttaaaacattggcggacggaaaatcatttgagtatgcccgttcttatcttgacagccaaagacaccttggatgataaggtccatggttttgaacttggtgctgacgattatttaaccaaaccttttcatcgcgaggagttattgctgcgggttaaagcattactgaagcgtagtggtcatcttggcagtgataatcagttgacagttggcccgtttaccgttaatttaagtaatcggacagtggcagtaaaaacaacccccttagaattaaatggcaaggaatttgatttgcttgtatattttattcaaaatccagatacaattattaccaaggatcaaatttttgatcgtctttgggggtttgagtccgaaacagcaatttccgtggttgaagtttatatgagtaatttacgaaaaaaaattaagaaagcaacgtcattacagccaataaagaccttacggaatgttggctatatgtttgaaacggaggaacttgattgaagaaaggtgatccgcagcaaaaacaacagttatcactattcgtgaaagaattgattggttttgcgttactttttgcagtattgggattagttgtcaacttctttttccaccaatcaatatataagaatattgatcggggattagtcacacagaagcaagtggtattagataatcggaagcagcctcaatttcggcgaccaaatagcaattccaatccgactattggaagttcaccttccaatggtgatacgccttttcgaaccaacattttagtgtttaaccaaaaaggccaaattgtgaatgctcaaatgttaggaaatcggatctacaatttgtttattaatacgcgcttggataaggcacagattaataaggttcaggaaaccgccttaatgtcaacggataatacgtggcattactttaggtcgttgttgatcaaagtgcccgcaacaaataaaaacccattatatgctggtcgatatgtgctaattatggaaaacattgataccgatttattagcaattagcagctttaaaagatcgttattaattacattagttttcttttggatcgttgcgattggcattgcttattttttgtcgcggtcgagtatgaaaccaattctaaaatcttggaaacgacagcgtcagtttagtgcaaatgcagcccatgaattgcgaacaccgttgacggtgattcaaaatcagatggaatatttattgactcagcctaaagccagggtggtggatcaagttgaaccaatttcaacttcgctggatgaggttcgccatttacaaacgcttactaatcgattgctgatgttagctcgttcggatgccgacattattcaaattaatcggcaaagtacagacctaaaaccgtggttggaacatgcattgaaaccttatgttgaaattgcagcgagtcagcgcaaatcgctggttcaattaattaaggtgacaggtcatgggaacgtcgatagtgatttaattcgccagttattaatcattttgctggataacgcgattaaatataccccagaaggtggcacggtaaccgttagtgcggaacgagtccgggataaattaaaattggaggttcgagacacggggacagggattccagacgctgataaaggtcgggtgtttgaacgcttttatcgttcagataaatccagaaattccaaaacgggtggtaatgggctgggattagcaatcgccaagtggattgtaactcagcatcatggcacgattacggtcaaggataatcacccaaagggaaccgtattcgcggtgataattccgctgtaacccggatgtctagtagcgtggatagcctcgaaatttgccatttttttgatttcgaaggcgattttacttaaaaatcactgaagatccaacaatgtaaaagaaaaatagggtgagacaaaaggcggttaacttccagagtacaaccgaattatccgaatatgctccgggtggaatagtgggataattcagttgtatggcaggaagttgccttttatctcacgttttcgcttggtaatagtcgtgattacacaaaacgggactgggacaaaattacttttgtctcagccccgtttgagtttctaaatgattaaggcacatttgcgataattaattttatttatcgatgtaaaagttgttctagagtgtccatttttcaaaggcgtcttttttgatttccggaaacaattcgtaaagataatcaactggattttttaggctaaccttacttgaataaacaacttgagtgacgttttcgtaagtcaacattaacaattcttcaccatgctcgtcacggacttcgtagtaacgaatgcctaatcggattgcatgaaagattaatttttgagcggcatcagatagattggccattgctggcaataactttggattattgattcgatgggccttccattttttggcaacttcaaccccaaacgtcatcaagctatgatttttaatgtgtggtaaaagcatggccgatgcagtcaattcgggatgggtaaccacctcgctaaaatcgtccagtgcctgtaattgctctgaatgagcatggagcgatctggccattgagataaggtcatcaaaaatgtgcacggcttccgcttccttaaaagttggttgatcaggtgattccaaagcgacccgattgttattctcaaaagattgtttaagctgctcttgaatattctcctgattaaccggtttaactaacagatatattaaaaagaatttaataaaatacaaggcatggcgactaattccatttggagtgaagggggtgttatcaaggacccggaattctaaatatgaaattcccttggtttggtaatcttttaatttttcctgaccacgaagcctgacagggccataaaattcggcgggtgagtacaaatgtcggttattaattgccttggtaattccgtcgatatagtgatgcaagcttgaataaacagtcacattaacctggtcatcctggttgttaacatagccgtaaatactattgcgaatgcttcgaaccggatggactaattcagcaactggttttggaagatagcccatttcggcaattggactggcaccaaaaagataggttagcagccatcgatgaaggacaaaattttgagcgagttgaaagtaaagggcattcttaaactcaaccaaacttttaaattgatcctcatagtgggtatataagcgattgataacgggttcaggaacgctaaagttaacatgaacaccagtcacaatttttctttgaataccatatttatccgtgaggtagttacgatatttggcaaaagccggccgctcgaaatgattcttaataaatgaaatgtcatctgattctaacacgggtggcatactaagcggccagatgaactcatcttgacccattgatcgataaagaacggtttgtaatgtgtccaactgatccaaaaagccgccaatatttggattaggatcggttacaacttcgttcattgattcagaaaagtccgattgcaggtaaggatgatattttcttgagcctaagtttgcggggtaagggtgttggcttaatttgccattcttgtcgattcgatgttcctcgatttcaatgccaactaaactgtggtaaagctgttcagcgacgtcttcctgttttatgtatgttaataggtttttaagcatggttaaatctcctactcggaataatttactgataattataaacaatttcagactaattagtagcaattctgctttgcttatcaaaatatttcctttttctgatttggtttactggaaaaagcctgagtttttcgtaattagtatttggaaggtgattttatgttgattgcgatgtcggaaggtcaattagttcaggcagcgaaaatcagtagaacaaaagcaactcaattaaactttatttgtcccggttgtaaacagcgggttattttaaaatctggtaagtatcgaatcccacattttagtcatcaatctaaagtagcatgtgctggctttagcgaaaacgagagtcaaacccaccttgagggcaaattgtttttcaagcaggaagtggaagcaatgggcgaacaggcaatcttagaatttaacatgccagtcattaaccaacgtgctgatttattcattgcgggtaaaaacatcattttggagtatcagtgcagcccaatttcatttgaaagtatccagcagcgaacagctaattatcgacaactcggaaaagagactttttggattcttggtgatcgacaccgtaaacggctatttacaaacgaaatgattgcaaaatttgctcggtttcattcccggattggcttttacattattttttattcagcaaagaatcaccaattttggttacactatcagatccatgaagttgccggcaggttagacagccgggtagaattgtttgatcacttaggagaggtttttaagtttattaaacagttcgaatatctgactaatggcagaagtaaaaaatcaaaaaaccaaattctgatgcttaatcaattgaagcggattcagcagagtaatacgaggagaaatcgggcatatttagatatggtgacaatgtgttacatacaaggacgacgttttgttggctgcccaatgatctgtcataataaacaagcggaaggaagacccatttttaagaaatcaattttatgttggaaggtttgggtcatcttagcaattttcgaacgtcaaaatagtcaaatcagcaaccaacaattaaatcaaatatttaaagaatcagttcaaaagtatggttatgaaatggctcaggtccaaaattatgtgagattttttcaaatggaatttactagtttcattttgagcttgcggtctgcaggctacattatccataccgtttctggaattaaaatcataaacttcccgcggtggtttgaaacctatgatcagaaaaagaattatattatgacgaatgatcaattgttgtgataggctaatattaattgaattaaataaaggaggatattatggcaaaagcaaaagaattacctctcagaaaagatgtaccagttcaattaacgtgggatttaaccaccgtttacaaaaatgatgacgcatttgaaacagattttaacgagattgaaaaagagttagtccccgttaaaaagttagctggcagtttatcagaaggtgccggccaattattaaaagccacagagtttattttagctgtaaatcgtaaacttgaaaaagtttacgtgtatgcacaattaaaaaatgatcaagataccagtgacgataagtatcaggcgatgtttgcccggtgtgaatcccttgctgctcagtttggggcagccatggcttggtttgacccggagttactgcaactttccgaaaagacaatgagtaaatattaccaagatgaacctaagttgaaggcatttaaacgattatttgatcaaacttttgagaagcgcgatcatattctgggtaatgatgttgaggaagttttggccggtgctggtgatattttttcatctggtgaaaagacgtttggaattttggataatacagatttatcatttccggtcgtcaccgatgagaatggtaagcaggttaagctgtcgcagggtgtttatgcaatccttctggaatcagccgatcaaaacattcggaagcaggcattcgaaaaactatatgaggtctatgatcagtttcaacatacgctggctgccactttaacaacaaatgttaaaaatcataacttcaaggcaaaaatcagaaagtaccataatgccttacaagcggcactttcagcaaatgaagtaccaactgttgtgtatgacaatttaattaaagtggtaaatgaacatttggatttacttcatcgttatgttgctctaagaaagaaaatccttggtgttgatgaactgcacatgtatgatctttatacttccttgatagggaaaaaatcgccgcgttacacttttgatcagtcgaaacaaattgcacttgaggcgcttcaaattatgggaccagactatgtgagttacgtgaaagaagaatttgataatcgttgggttgacgtcgtcgagaatcaattcaaaagaagcggtggctattcttctggaacctatgataccaatccatttattcttttaaactggaaggataatctggataatttatacacgttaattcacgaaactgggcacagtatgcatagttactatgcacatcataatcagccttatcaaacgggcgattattcaatttttgttgctgaaattgcttcaacgactaatgagaacattttgacggattatttgctaaataagttcaaaaataatgacgaaatgaaaaaacaaattttaaactattatttggatggttttaaaggaaccgttttccgtcaaacacaatttgctgaatttgaacagtttatccatgaacaggatgcaagcggcagaccattaacagccaactttatgaatgattattatcttagtttaaatcaaaaatattatggtgatgcagtagtttctgacaggcaaatcggcttggagtggtcaagaatcccgcacttttattacaatttttatgtttatcaatacgcaactggatttgcagctgcttcaacgctagccgacaacatcgttaatggtgattcatcaaatgttgaaaaatatttgaactatttaaaatcaggtagctctgatattccaacaaatgttatgaaaaaagcgggtgttgatatgaccaaaccagaatacttggaaaaagcgtttgctatattcgaaaatcgattggatgagtttgagaaattgttttagagggagatgtggcgactatattaaatagtttgagcttgacttctcaatgaaaaattgcattctcgttgacttggattgttttaatccaactagtaactgatttaacaagttgttaagttgattatctttaagacatcagatttctttagatttgagcctacagtttgtaaagtcttatctctggttagttttgactgacattgaatagacagtgaaaggtgtgattgatccggatgaggaggcaaattgaggaaaagtttctcttgttagcagcctattattcacttatcacatggtttagctgggttaaccacaatccgtgctttaatggccaatggttctgacccacaagttaatgagttatgggatgtaagtgtacttagttggggcagctaaataccttgttggctatgctgttgcgtttagatccacttgctatttaggtgttttattttgactcaaggtaaaaatcgacatttttcagaatagatatgattgaatcaaacatcatcatttggcatacaaaaaagtctgaaaatcaggttagatcatccactgattttcagacttttaatattgagtttcaaggccattaatagttgatatgtaccaacttaaggcactcaaaacgataaggggtatttgataattctgggattggttttttcttgacgtgttaaagcttcaaagtgttttgctgaatgaatgcttcggtcacaaaaactaaatagtgattggtaatcataatctttaattaaaattccgctattgtcgacggccgagttaaataaaactgcggtggacggatctttgacagacatttcatgagccatttgttggtcagtatggaacatcttttttgcaagctgagaacggcggtcttcacggaacatgtcgcagtccaaaccgttttgttcagctaaccctaagaccaactcatcattgtaatcctctgcattgatgagaagttctcgttgtagatccatcaaaaaatgcctaccaaatctttttccttgaaacgatgcggctttagaatctaataccatgttaaatggaagctcgtggttaaagttggtgatttcgcgatgagctgccacatcgttcaaaatcttgatatttaacatggaaacaaaccgaaccgacacacttgtcttaagtttactggaaattttatcaattgttttttcggcgtcgtaacaatgtcgatttagcggatcaataaataaatatatttctagtaccatattgcccctccaatttttaatcgacaaattaatatactaattatttactcaactaagaataacaaatttcaggataaaaacaataattttgctcataaatggttgagcgatttttgggattgaatcattaatatgttaaaatggaatttgtgtgagcatggaaatatgctgtagtgattagcaatttacaactataatgttttaaaatgaaaaaagtatgttgaagaatgatacttttatccttattaaaatagttggcatcaaaacttgtgtcagctcttggacagattggaagtggtagcttggttgaagattgggatgactttttaattccttacaaacaagctgttgatgaattaaaagtaaagctgcggggaattagagcgcagttcttaaaaatagatggtcgtagtccaattgaatttgtaaccggtcgagtaaaaccggttgatagcattaaggagaaaatggttcgtcgccatatttccgaggatcgactcgaagaagatatggaagacattgccggactgcgaattatgtgtcagtttgttgaagatatttatcaggtggttgatttgctgcgtaagcgaaccgatattaatattctcgaggagcgtgattacgttcataataagaagccaagtggttatcgttcctatcatattatttttgaatatccagtccaaatgctttccggggagaaagttattttagctgaaattcaagtccgaacgttggcaatgaacttttgggcaacggttgaacattcattaaactacaaatatcaaggcgttttcccggatgatttaaaagctcgactacagcgttctgctgaagcggcattcaaacttgatgaggaaatgtctgaaattagggatgaattacaagaaacaaatcagaaatcttcggatggatctttaaggaagttgccagatgagaatagccatatacagtaacttaggggaagcatcaaatattgttgcaacttctttgaaaaagaaaatcgaagcatcaaaggccctcaaaattgatgggcttaacccagaaattgtcatttccgttggtggggatggcacgcttttgtcggcatttcatcattaccaggatattagcggtaaaattcgattagttgggatccacacaggtcatttgggattttataccgattggcgtgattacgaggttagcgagctggttgaaagccttgaacatgacaatggtcaaagtgtgacctatcctctcctggacattaaggtaaattatgcagggggcggtccagctgacattgggttggcactaaatgaatcgacgttaaaacaaatcaatggatcaatggttgcagacgtctacattaagaatcaattgtttgaaagcttccgaggtgatgggttatgtgtttcaacaccgagtggctcaactgcttacaataaatcagtcggtggggcgattattaatccatcgttaaatgcgattcaggtcgctgaaatttcatccattaataaccgagtatttcggacattaggctcacctttgattattgcccctgatgaatgggttaaaattatccccaagaataataatcggacagtcttgacttgcgatcatcaggtgatttcaacggccacaattgcatcagttgaatatcgaatttcccaacgtcgaattgcatttgcccagtatcgacatacacaattctggcgacgggtaagtaattcgtttattggcgaggttaatttggatgactaagttttcctggacatatgtaggtgatcagccaattaaggttcgaacttttgtgatggggcacggtgtcactcgaacacttttaaagaagatcaaataccatggtggtcaaacgctggttaatggtgaatccgcgtttactaatcgactgttaattaagaacgatgttgtgactgttgttttaccacctgagccggaaaatgatcatgtgcccgtgtcgaatgttccaattaatattattcatgaggacgataactttttggtggttaataaaccggctggcgtggcttcagtcccatctcatgatcgcttgaatgattcgttggttaatcgagtgaagggctattatttgcggcaccaataccaaaatcaaaaaattcatattgtgacccgattggacaaggatacaagtggattggttatttttgccaagcatcattttgctcattcggttttagataagcagttaaaagatcatctaattcaaaaaacttatttggcaattgttgcaggacaaatcgataatccgcattttgaagtttatctgccaatcggacgagcaactgattcatttgttaaacgacaggtagttgagggcggcaaaatgtcaattacggaggcgtggacggtcaaacagttggctaatcagactttgctgcgcattcagattcataccgggcgaacgcatcaaattcgtgttcatatgagtgcactaggacatccgctaattggcgattggctttacaatcctgatgatgagtcaatggcaagacaagcgcttcactgtgccaagctgagcttttatgatccatttgttggtaaatggatcaactgtgaggcacctttacctgttgacatggcatcgtacatcaatgcaaataaaagacaatgatttaaagcttccacaaaatccgattttggggttctgagatgggagctttttcaatttttgattatgatataatggattgcgtttatggaggacaaggcttgaaaaaaattgaatttggtcaaaaatttgttagtcagcatatttatctatttagatgtccgctttgtgatacgccatttgaaaaagttattgggttaagtctggtttgtcccaatggccatgcgtttgatttttcaaagaaaggcaccctctattttttaacgaaacaggcaaataatgaatatgatcgagaaatgttattagcacgtcaccgaatcttacaggccggtctgtttgatcaaattattcaagaaattagcggccatctcgatgacaagtcagagaccatcctggatgttgggtgtggagaagcaaccccgttgacaaggcttttgcagtcacgagtgtcccatgatattgccgttggatttgatatttctaaagatggcattcaactggcaacgcaacaaccggtggatgcgtttttctgtgttgccgatttggcacatctgccatttaatgaccatcgattttcgacgattattgacttattctcgccatccgcatatggtgaatttaatcgagttattcagccaggtggtaagttgattaaaattatccccaatagtgggtatttacgcgagttaagggagttgctctttggtcagcatcaaaaaaacagtacctactcaaatcagcaagtttatcagttgtttttaaagcactatcccaatgcgacaattaataaaattaattatcaatttgagattccagctgaattacgacatgatatgatgattatgactcccatgcattgggggaaggacaagtatccaaacgctgatcaactagttgatcgtctaacctcaatcacggttgatgtttcaatactaattaatcaattttaaaaaatggagaaaaaaatgactaaccacattgttttatttgaacctttaatgcctgcaaatacaggtaatattgctcggacctgcgcgggaaccgataccgtgttagatttaattgaaccacttggatttagtattgacgataagcatttaaaacgtgccggcttggattattgggataaagttcaaattaattatcatcaaaatttaccggcgtttttaaagacagttgagaatcctcagaatctatttttagtatcgaaatttgcaaatcaggattatacagatccagattattcggatcccaacgaagactattatttattgtttggcaaggaaacaacagggttgcctgagccatttatgcgtcgaaatccagaaaaagcaattcgaatcccacaagatgatgcgcatatccgtgccttaaatttatcgaacacatgcgcaattgttatttatgaagttcttcgtcagcaaaacttcaatgatctggagcgaacacatcggtatcctcatgacaagctaaaataattagcaaattaggattttcggaatttatgaggttcattattggttatttaggatgatgtgttaatttttttgaaagctaggaggtgttttatttaatggctgcacgcaagacaacacgcaggaggacgactcgtaagcgtggtcgacctcgaaagaaaacggcatcaaaccaatcttttttctctaaatatgcaattaatttaatcggtgtaatcgttgcgatccttgccatactagggctttttcatgctggaattttgggtattctcattattaatgttgtccgaatttttgttggaagtctttatccgttaggccttgggggttgcctaattgttgcgttatgggtagccggtttttctaaatttcctaaactgaagctgcgttatgtaactggtgctgggatggcattactgggagttttactttggttaacgttggctgaatatgtccagactgccgaaccggttaattttattagtgttaactggggaaagttaactgatgatattgcctccgcaaatgtgaactcaaatatcggtggcggcatcatttcagcagtcgttttttattgccttcatatccttgttggcaaaattggaacgggaattgttgccggcttaattgttattgggggagtattcgtcttatttaacatttcttttgcaaaagccttcttagcactccaccaagtaatgacctttttaaaggggcagatagtaactgttgctcataaaattaatcatattcgaaaccagcagcgaaaggatgacaccagttccataaagaagacgccggcaaagccaattgaaacgtctcaaaaagccgactcaatgccagaggatgatgccaaattttcaacatcatcaattacgatttcggggatgccagttaccaaggatgctgataaacaagcggttccccagaagaccgaatccgttaagaaggaaaaaccaacgggtgatattaaccttattgatgttcaagaagatgattcttataaattaccaagtcctgacttgttaactcaggtccctcaagaggatcaatctggagagctaaaatcaattgatcataacgctcaggtgcttcaaaagacgttgcatagttttggtgttaaagcagaaattaaacacgttagtttgggaccttcagttacaaagtatgagcttcatccagacataggcgtgaaggtgagtcggattgttaatctttctgatgatattgcactagcgttagccgccaaggatatccgaattgaagcgccaattccagggaaatcattgattggaattgaagttcctaataaaaaaattgcgacggtttcgtttaaggatgttgtggaacatcaaccagacaagcatggtcatctgctgcaggtgcctcttggcaaggatgtcaatggaaacgtgattactgctgatttaactaagatgccgcatttgttgattgcaggatcgaccggtagtgggaaatcagttgcaattaatggcattattaccagtatcttgttaaacgcgaagccaagtcaggttaaattgatgctcattgatcctaaaaaggtagagttgggtgtatataatggcattcctcatttgttgagtccggtcgtatcagagcctaagaaggctgctcgggcactacaaaaggtcgtttctgaaatggaaaaccgatatgaaatgtttgctaaatatggtcagcgaaagatcagtaattttaatgagtttgcggcaaagaacaaccgcgaaaatgatacaaaaattcaaccaatgccttatattgtggttattgtcgatgaattagctgatttgatgatgactgtttctaacgatgtcgaggcagctattatccgattggctcaaatgggtcgggcagctggaatccacatgatattagccactcagcgaccttctgttgacgttattaccggattaattaaggcaaatgtcccatcgcgaatggcgttcgctgtctctagtggtattgattcacgaacgattattgataccaatggggccgagaaattgcttggtcgtggtgatatgctatttttgccgattgattctaatacaccagttcgtgttcagggtgctttcatctctgatcaggatgtttcaagggtcgttaagtttattactgatcagcaaacagccgattatgatgaatctatgatggtgagtgacgaagaaattaaagctgaagaccaacaagcttctgaggatgatctatttccagatgcacttgattttgtcgtcgagcagcaaaaggccagcacttcattacttcaaagacattttcgaattggttataatcgggcggctcgactgatcgatgatttgcaacaacgtggttacattggcccccaagatggcagtcggccacgccaagtttataagaaagacatttaaacaagctaaatcaatttgttgtctgaaaccaaggatgtgctaagagattgttttatgtcctttcgaaagttttccctgacggattcagtttcaatattgacaacaataaaaaaggccaaagcaaagtattctttgcttcgacctcattcatccaatctgatttagacgaatgtcattacggctgatacaatcaatgttccaacggttgaaataatcattaaccagacaaatacgtaagttattttctgaaatcttgttttcttttttcgcgccaatatttgcaccactttctcaaagtattccataaacagtttaacgatcattatgattgattgcaacacgttttgtcaaaattaggaggaaagccgcatgcatgtatctttattgatgactaacattgcaatctttttgggtcaacttctggttttactaattgttgcgggtatcgtgatcagcattaagaagaaagtcctgacccaccgccaagttcgaatgacgccagtcgatttttggccaccaattcttttattatttattcatcaaattagtataaacggactgtcgaattcgttgttaccacaagtagtagtgatctggattggaattagtttgctgattttattctggcaaatcttttctaatcaagagcttacatataagaagttttttgtgatattttggcgattcggtgatctgatcgtgtttattagttggatcggtgttgtaatctatgtgatctatcagagtctataatgaaaaaatctccttttatcacgttattttggcatcaattttgattgtttttagttaaagaaatcccgtaaagtcaactttttataaacgttgatttttacgggttttttgatgccataatcttgagtacaaattgagttaaaggtggtgctatcaagatttatcaaaatatggggaatgtccaccactggttctgaagctggccactatgcggatttgaatccgaatgatatatttaattggcatgttataacattaattgaataaaaattgagggtgtgtggttgatagtggggaattgtggtagaatgtgattgcaagttgaaatttaagggggatgacgatattgttcatgggtgaatatcaacacaccattgataccaaaggacgactcatcatccctgcaaagttccgtcatgatcttggtaacaaattcgttatgacacgaggcatggacgggtgcttgttcggttatccgatgagcgaatggcaagaagtgcagagtaaaatcaatgtacttccggtcagcaaaaaagatgcccgatacttcacccgttttttcttttctgccgctgtcgaatgtgaatttgataagcagggtcggatcaatattcccggcatcttaagggattacgccaaaattcaaaagaaatgcgtggttgtcggagtttctaatcgatttgaaatctggagtgatattcgttggctagattttagtaccgatgcggaaaagaattttaacgaaattgcagagaatatgattgatttttaaactgaagcaaggtaaagagtggtgattagatggctagtttcaaacatgtgaccgtattacttaatgaagcagttcagggattaaatattgatccaagtggtacatatgttgacgcaacgctaggtggtgggggacataccacaaaaatattagaacaattacaaacggggcatctcttttcatttgatcaggatgaggttgcaattgcttacaatcaaaagcatttaagcaaatttattgatgatggtaaattgacgctcattcatgataattttcgaaatctaaaaggagctttagcagctcaaaatgtaaaagggatcgatggtattgtctacgatcttggcgtgtcatcgcctcaatttgatgatgccagccggggattcagctatcgattcgatgctcgccttgatatgcggatggaccaggataatccactcgatgcatggaaggttgtgaatgaatggccatatgaacaacttgttcgaatcttttatcgttatggagaagaaaaattctccaaacaaattgctcgtcatattgagcgccaacgagaagaccatccgattgatacaactaatgacttggttgcaattattaaagatgcgatcccggcagcagctaggcgtcatggcggtcatcctgctaaaaaagtgtttcaggcaattagaattgccgtaaacgatgaactttctgcgcttgaagcttcattagaacaggcgcttgagttattaactgttggtggccgaattagtgttattacatttcagtcacttgaagaccgattagttaaaacgatgtttcgtgaaaaaacgtcattgcctgaattgccgcctaatttaccaattattccagatggcgttaagcccaaattcaaaaatgtaactagaaagccaattacgccaagcgaagacgagttaactgaaaatcatcgcgctcacagcgcaaaattgagaattattgaacggactaaaatctagaaaaaggaagaatacataattatggaacaaaataatttggcacgtagttttgctcaagcggaacccaaaaaagttgtttcaacacctgatcaagtggtcacaaaaaaagtaagggtctctcaaagacttaatctttcagtttttgaaaagttactaatcgtttgtggaagtgcactattaactgtgctaatgttagtagttgtatcttccaagattgcattatctaattctcagcatcagttgcaacatttggatagtcagacagttaatgttcgcaacgataataccaatttaaagcaacagattggtgagcttcaaagcagcagtcgacttgataagattgccaagcagagtggaatgtcactttcgaatcacaatataaggaatgttactaaatgaaggattcatctgatcgggccacagataatttaaaatcacgaaaaaatcgaaaaaccgtcggtgtttggctgtttttcatttttattgtggtcttttttgttcttgtgtcgcgactcatgattattgcggttggcaagaatgttaagaatgtcaatttgaatagtgaggcccaaaagttgtatacccaaacccaaacattaaaggcgaagcggggaacaatttatgatgcaaatgggagcccaattgccgaggatacaagtacatattcactttatgcggttttggataagagtcaaattggaattaataataagcctttgtatgttacaaataaaacgaagacagcaaaaatccttgccaagtatttaccaattagtaaaaaaaaggcacttcaatttttaacacccaaaaaagggcatccatttcaggtggagtttggcagtgcgggtcagaacatttccttaattactaaaaagaagattgaaagtcagcatcttccaggaatcaattttatccagcaacaggcgagattatacccgaacggtgttttttcatctaatttaattggtgtggcaacgtctcaaaacaataaaaaaacgggtacaacaaatttagttggtcaaatgggaattgaaaaggcctttaaccgtcagttagcaggccaaaacggatataaggatgcccaatatgatgtctatggatataaattacctggtaaaaagcaaaaagaaaaaccagttaaaaatggggacaatatctatacaacaattgattcgcggattcaaactttacttgagagtgaaatgaattcagttcagtcccaggttcatgctgccggaatgaatgcagtgctgatggatgcaaaaaccggaaagattgtggctgcaacgcaacgaccaacttttaatgctgcaaccttgaatggcattggaaatgcttggactaatacattaactgccgacacttatgaaccaggatcaacgatgaaaatttttacattatctgccgcaattaactctggacattttcacgggaatgatacgtatcaatccgggcaatattcaattgatggcaaaattgttccagattgggatcctaatggttggggctatattacttataataaaggatttgcactttcaagtaacgtggcaatgtctcatttggaacaacaaatgggtcccaaaacttggaacaaatacattcataagtttggctttttaaagagcaccaacagtggtctgccgggcgaactttctggtcgaattcaatttaaatatccaattgaacaggccgatacctcgtttggtcaaggaattgaagtaactacaatgcagatgatgcaggcactaacagcagtttcaaacaacggtacaatgatgaaaccatatttcatttcaaagattactgatcctagttctggcaagattgttaagcaatatggtcagaaagttttaggccatccaatcagttcagcgacggctaagaaggttcgtgagcacatgcaggatgtcgtctataaaagctacggaattggtcaggactataagatgaaaggctaccgggtggctgctaaaactggaacggctcaggtaagtaacgggtatggtggttatgcatctggcgatgacagctatctttattcagttgctggaatggttcctgctaatcaccccaagtatgtgatgtttattacgatgaaacagcctaagctgacgggtaccaagactgctactcaattattggcagagatctttaagccggtaatgactcgagcacttcaaaatgcaaatacaaagcaggcaacggtcaaacgacaaatgccttcagttgtttataaaaccacaactgaggccaagcggattttagaagaaaagaactttgatgtggtatcaatcggaactggtgatacgattatcaaacaatcaccaagtgttggaaagtcaattcgtgaacaaaagcgagtcttcgttttgacaaatcatggttggaaaatgcctaggattattggttggtcaaaaaatgatgtggagacgttctgtcatttaactggcttgaagctggaatcaaccggtaaggggtatgctgacagtcagagtatcgcattttcaacgtcaattaaaaataaacaaatattaaaagtaaattttgaataatttaaggatggttaataagaatgatgggtaattgggtactacctttgctaagcagcttttttataacggcattattgatgccgagcttaattaaatacttccgtagcaaacatgaaggtcagatgattcgtgaagagggaccacgatggcatgaaaaaaaatctgggacaccaacaatgggtggcattttatttatatttgcaatcgtgatttccgatttaatatatggctggtttaaagacatattgaatccaaccttattgatcttattatttgtgctagtaacgtacggcttgattggaatgtgggatgacagtatcaagttgttcaaacgccaaaatgaaggcttgaaagcttggcaaaagttgctgggtcagatcgttgcggcagtcattttttcatgggtttatattcatgaaggttttccattaggaattaaaatgccgtttgggaatgattggcacattggcctatggtacattttatttatcgttttctggttagttggtttttcaaacgcagttaatttaactgatggactagatggcttagtttcgggcctgggtgtcatttcctttgcaacttatgcgattattgcagtggttcagcaccaagttgaagttgccatcttttgtatgtcggttgtcggtggattgcttgccttctttatttttaatcataagccagctaaaatatttatgggagatatgggatcgttagctttgggtggcgcattagcttgcgtttcgattttagtccatcatgaattttcactattgatggttgggattatttatgtgatggaaacagcaagtgttatgattcaggtggcatcatttaagttaactggtaaacgagtttttaaaatgacaccgatccatcatcactttgaaatgcttggctggtccgaatggaaaattgacctgacattttggtcgattgccctcattgcatcggtcatcagtattatgacgattatataagggttgggacgaaatgatgagttttgttgccaacctatttggctatttgaaattctgtaattttttacgaaattaagcgagttaaaataatgacatatattctatctaaaataaaccgaggtaatcatacaaatgaaaatgatcgatgactataagaataaaaaaattctggttcttggtgctggaaaaagtggcactcatgctgcagaattgctgcaggaacttggtgcgactgttgtattaaatgattctaagccggcgtctgagttgcctgaggtaaaggagcttacagatcatgggattaaaacaattacgggtaaccagacacctgatattttgaatgaacattttgatctgatgattaagaatcctgggatcccatacgataaccaagtggttgctgctgctgttcaacaggggatgccgatcattacggaagttgagttggcttcccaaattacggatgctgaaattatcggggttacaggaagtaatggaaaaacaacgacggttacgatgattaccaagattttgaaccaggaacgacctaaaggccgtgcttacgcggctggtaatattggtatttctgcgacccataccgcattgaaaacgactgctgatgatacaatggtcatggaattgtcgagtttcatgcttttgggaataaagacgttgcatccacacgtagctgttctgacaaacattttttccaatcatttggattatcataaaactcggaaaaattatgtaaatgccaagatgagaatcacaatgaatcagacagcggatgattattttgttgttaattttgattcggacgaatggcggcagctcagcaaacgcagccgtgccaaggttgttccatttgcgcgaaaaactgaaatcagccacggtgcatatgaaaaaaacggtaagctttattataacgatgaatttatcatgaatgccgacgatattaaagttccaggtaaacaaaacgttgagaacgcgttggccgcaattgccgttgcaaagattttagggaaatcaaatttagcaattacaaacgttttggaaacctttagtggtgttcgtcatcgagtccagtacgttctggaatctgagggtcggcgcttttataatgactcgaaagccactgacattgaagccaccgagatggcattagatggctttgatcgccccgttgtcctgctcgctggtgggctggatcgagggtatacgtttgaaaagcttattccccaatttaaaaaacatgttaaagcagctgtcttgtttggccaaactgcggatttgttggcggatgcgttaaaggatgccggtgttcaaaaaattactaaggttgataatttggatcaagctgtaccaactgcttatcaatatagtgatacgggtgacattgtgttgctttcgcctgcaaatgccagttgggatcaatttaaaacatttgaacaacgcggtgatgaatttatcaaggatgtcgaaaagttgacccacaagcaggaggaacggcaatgagacttattatttcaggtggcgggactggcggacatatttatcccgcattggcaatcgttgaagatttactcaagcaagaaccaaattctaaagtcctttacgttgggtccaaacggggattggagagctcaattgtccccaaacagggtcttgattttattgcgttagagatccaaggatttcggcgatcattatcgcttgaaaattttaaaacacttgcattgttctttaagagtgtccaccaatccaaaaaaattattaaagactttaaaccggatgttgtaatcggaaccgggggctacgtttctggtgcggttgtttacgcggcagctaaagcccatattccaacaatcattcatgaacaaaatagtgttgtggggctaactaacaagtttttaagtcgatatgttgataaaattgccattggatttcatgaagccaaagaccagtttcctgcccaaaaggttgttttcgccggtaacccacgtgcacaacaagttgctcacatgaaaagtgattttaaatggtcagagattggcttggcagataatgagcccacagcgctgatttttggtgggagtcagggtgctcctgcgattaataatgccgttgtctctgcgatgagtggttttaatcgacgtaaatatcaggttgtttttgtgactggtcaaaaacggtatgatgaagttatgcatcaattagccaagaataaaattaatgacaatattaaagttctaccttacatagacaatatgccaaaggttttaccaagagttgatttgattgttggtcgggctggcgcaacgagtattgctgaaatcactgcgttgggagttccatcagtattgattccaagtccttacgttactgccgatcatcaaactaaaaataccatgagccttgttaatcggggagctgcattaatgattaagcaggccgaccttgatggtgaaagtttattaaaagctgttgaccaattgatgcatgatcagcaggcacgtgagaaaatgtcagataattcaaaaaaacttggtgttattgattcagctgataagattttggagatggcacgggcgttaatgcattaaaaaagttatcgggggttagtaactttgggaaagaagaatgataataaaactaatatgacgccctggcagcaggcaagccagcatgttggtcaagatccggttactaaacagaaacgacattttttaaaagcgtaccagcgacataatttaaagaagatgtcaccactaattttgttagcgctgttgattattgcggttatggggttcttcatttcaccttacagccgggttagcagcgtgcgaattactggaaatgagattgtcagtattaaacagattaagcattattcaccaattaaaaaggggacaccgctgatttcggtttggggaaagacggaaaagatggccgcagagttaaaaaaacgcagtcaacggatgcaatcggttgaaattaaactccttcattttaatcaagtgacgataaaggttgctgaatatccaacaattggttacttatatggaaatggtggttaccagccgattttaaaaagcggtgtcattatcaaagataaagtgctaaacccacgggctggttttccaattttaaaaaaattccataatgccaagcgactccgacgaacagttcaacagtatcgccgaattgatccgccggttcgtgccagtattggcaccatcagctattcgcccacaaagagtaatcccgatcgagtcttcttgcatatgcacgatggtaatcgcgtgtatgcttcgattgatagttttggcgataaaatggactactatccaagtatcaattcaaagctcaaagttaaaagtattatcaacctggaagtcggggcttattcatatccgattacaaagaaatgattaactgagtaagtaaggctcatcgcttgctattcgcttcgatttaactttttccggtgttgtgattgtgttaaacttatgttatgttcagaaaatattctagatgtggaggttccttacatatatggataattcgggtttgtatgtgggacttgatataggaactacctcaataaaagtaattgttgcagaaaaagtaaaagggcaattgaacgttattggtgtggggaataagccttctaatggtttaagccgcggtgtgattgttgatattgatcaggcggctgaggcaattagaggtgccgtaagtcaagctcaagaaaaggcaagtattgaaattaaagatgttgttgttagtgtaccggcaaatatgctgcgaattgaaccgtgtaatggtttaattacccttgatgatcaatcaagagaaatcacggccgaagatgttcgtaatgttgcagcatctgctctgggcactagtctgccccaagaacgagaagtgattgatatccaaccggaagaatttatcgttgatggatttgacgggataaaggatccacggggaatggtgggcgtgcgacttgaaatgcgtggcaagctaatcagtggatcaaagggtatcatgcataatcttcaaaaggcagttgaaaaagctggcttgaatattgtatcaacagtattaaccccattggctgaaagtcatgtgatattaaatgatggtgaacaagattttgggacaattattgtggatcttggtggcggtcaaacgacggcttcggttattcatgatcatcaattaaaatatgcaacgactgactcagaaggtggcggctacattaccaaagacatttcaattgttttgaatacatcgatgcagagcgcggaaaaaattaagcgcgattacggttatgcagattctttgcaggcttcagctgataatgagtttccagttgaagtcgttggccaaacggagccgacatatattgatgaacggtatcttgcagagattatcgaggctcgtctcagccaaatctttgatcgaattaaagatcgtttaaatcaaattcaagcgttggatttacctggtggaattgttttaactggtggggtagctgcacttccgggaattgccgaattagccgctgaccaatttaacacaaatgtcagagtctatattcctgatcagatgggattgcgacatccatcatttacagctgcactttcactagtatcttattttgccgatttggcagacgttgatatgattgttagatcggccgttggtgccacattaaccaaggttcctaaactaacagattctcacgatacaccagaccctgtgtcagataaaccaaataaaccgaaacgacaaacacagaaaaagaaacgtggccaaggaatccggaatttctttagcgatttcttcgattaggcactttaacggaggtaaaaacaattatggaatattcattagactccaccgataatcacggtgcaaatataaaagtcatcggagtcggtggcggtggcagtaatgccgttaatacaatgatcagctcagatgtcaaaggcgtagaatttattgttgccaacactgatgtacaggctctggcaacttcgaaagcagaaaccagaatccaacttggtcccaaattaactcgaggcttaggggcaggttctaatccagatattggtgccaaagctgcagaagaaagtgaggaagctattaccgaggcacttgagggtgctgacatggttttcgttactgccggaatgggcggtggcactggtaatggtgcagcaccaatcgttgccaagattgctaaagatcagggcgcattaactgtaggcgttgttacccggccatttagttttgagggtcccaagcgtgcaaaatatgctgatgaaggggtgacacaacttaagcagaacgtcgatactttaattgtgatctcgaacaaccgacttttagaaatggttgataaaaagacaccaatgatggatgcctttaaagaagcagataatgtattacgccaaggtgttcaaggaatctcagatttaattacaagtccaggatacgttaaccttgactttgctgatgttaagactacaatgcaaaatcaagggtctgcccttatgggagttggaactgctaacggtgaaaatcgaacggcagaagcaactaagaaggcaatctcatcaccactattagaagtttcaattgatggtgctgaacaagtattactgaatattaccgggggtccggatctgtcattgtttgaagcccaagatgcttcggacattgtttcccaagccgcaaccagcgatgttaatattatctttggaacctcaattgatgagtctttgggtgatgaggttcgggtgacggttattgcaactggaatcgataagaagaaggctgaagaaggtcgactggcatccagaagaactcggagtgtccgaccacaacagccaactgcgcgtccgcaatcaactgatcgtaagacgacaaattctgatgataacagccaatcagcccacaatgatccactgggtaattgggacatcagaaagcaaccatcagcagctagaccagccgtttctgaagatgacgaatttagcgatgttgaaaagaaagattttgatccatttcaacctgatgttggttccgatgataagaagaaggaagatactgggaattctcaggatgatgtgccaccattcttcaaacatcgtcgtaaccatagatagttgattagcgtggccggtatttatcgattagggtgaatacgaaaggacacaacatgtcacaaaaatttaatttagccaatttcttcggaatggaaaccccaaagccgaatattgatactgagacagatgttgaaaaaccagctaagacaggcggtaatgtagtaccaatgagccgacaacaaatagaatccagtaagatcgtcgtatttgaaccagcaaattatacagatgttgagccaattgctcaaaaattgttggatgataatgcagttattatcaagctagacaaacttgatgttcgctcatccgctagaatggttgattttttgaatggtgtattatttgccattcatggctcaattaaccggttgggcgaaaatatttttatttgttcgccgaaaaatttccaggttaccaagtaaaatgattaggtttggcaattagcttagacaagtaaatttaaggagcagcatattggtatcgatagttttatttgtagtttggttattaaacaaaataatcagtatatatatgttggcgatcgtcgtttatgcattgatgagctggtttccaaatgcgtacggaacggctattggccgtttcttggctcggattgttgaaccatttgaacgcttatttgattttgcaacagtggggatgattagtttggccccggttgttgccttaattgtgctgtcactagttcagggtgggattacctaccttggcagattactactcggcgtttaaagtaagaagaggggtattaccgtggtggagtccaatgtttcccaacattatcgacctgatgaactgccttttttggaatcgattgataatttaagtggccgggtacagaatgaatatcggccgatccttactaattttttgaatccacgccaattatacattcttgagacaattgtaaatcggtatgatggtattacatttaaaacttttggtggttatccaaatgctgaaatgaagcgggcaattgcttttccagattacttcacgcccactgctgatgattttcaaataactgcgtttcagattgattacccaacaaaatttgccacgctatcgcatggtcaaattttgggttcaattatgggggctgggattgatcgggatgtgattggtgacattattagtgatggtttaacatggcaatttgtatgtgaaaatgaaatggctgattatttgcgtgcccaagttgatcgaatcggtaaaattaaaatcaagctaaaaaccatttcgccggaggaaataattgtcccaattgacgaaagtgagtctgccacaacaacagtatcatcgctgcgtgttgatgcgttaattagcgagggctttcatatttccaggcatcatgctaaagaattagtcgatggtggttttgtccgaattaattgggttcaaactgatcgtcctgatttggaattatcgattcaggatattatttctgtgcgtggccatggccgaattatcattaaggaaattgccggcgttactaaaaaaggtaaaattcggattgtgattaatgtgtataatcgaaataaataggaggattgattcattatggtattaagcccacaggatattcataataaagagttttcaacaaaattacgagggtataacgttgatgaagttaatgattttttagatcaaattattaaggattaccaaattattttggaagagaataaggatttaagatctcagttaagtgagtcaaaggataaactttcgtattttaatgatttaaaggactcactgaatcaatcaatcctagttgcccaagaagccgccgacaaggttaaaacaaattctaaaaaggaagctgaaattacaaatcgtgaggctcaaaaaaaggctgacgatattttgaatgctgctcatgaaaagtctaatcaaattctagaagaagcctcaaaacgagcaaagaagttggcaatcgagactgatgatttgaagaagaatacccgagtattccgacaacggcttcaagtaatgcttgaaagccaattggaagttattaaaggatccgactgggatcatttggttgaagatacaccgacgacaacttacgaagatattgaaaaagttgttggagaccttgacaatcctgtaagtgctggggtagaatcagaaaccaaacaggataataatgcggacatggttgagaatacacccgctaggaatgatgattcgttgcaggcagttgtcatttatcccgataaatcaaataaatagttttaatcgattagagaccagaaagttactaactgaaacaatagcgagctaaagatggtgaaagtttagcagtcaacagttaatgaaattgatcatctctagtacatatcgattattttaagagatagaattgagaaattctaaaattgggtggtaccacgaaaaagatttcgtcccttgcgacgagatctttttttgtatcatgagattcctagcgatcttagtgttattaatcctattaatatttcagagaagggaagttcaggaatgcgagtaaaagatactttaaacttaggaaaaacgaaatttaaaatgcgcggtaatcttcctgtaaaagaagtggaacgccaaaaagcatgggatgagaatcgtgtttatgaacaacgccaaaaattaaatcaaggcaaaccaacatttgtcttgcatgatggaccaccatatgcaaatggagacattcacatgggccatgcgatgaacaaaatttcaaaggatattattgttcgatataaatcaatgactgggttccgggcaccctatgttcccggctgggatactcatggtctaccaattgagcagaaattaactcaagcaggttacgatcggaaaaagatgtcaacaaatgattttcgtaaattgtgccatgattatgcgatgaaacaagttgagcgacaaaaggctgagtttaaacggctaggtgtatcgggtgattgggacgacccataccttactttaaagcctgaatttgaagctcaagaagttcgtgtctttggtgcatttgcaaaacgtggactcatttacaaaggcaagaagcccgtctactggtcatggtcttctgaatcggcgcttgctgaagccgaagttgaataccacgatgtgacttcaccatccgccttttatggggaaaaagtggttgacggtaaaggcgtccttgatgatgagaacacttacatggttgtttggacgacgacaccgtggaccattccagcttcagagggaattactgtggatgccggttttgactattctgttgttcagccagaaggtgacgatcgtaagtttgtgattgctactgagttggttgaaaaggatgaagggttgtttgactggaaaaatgttaaaacactcaagaccgtcaaaggcgaacaacttgaaggggtgctggctgaacatccatttgatcatagtaaaaaattattaacaatgttgggcgactttgtcacgttggatgccgggaccggattagtgcatactgcccctggttatggggatgatgactacaatatcggtaagaagtatggcttaccaatttttgcccctgtcgatgataaagggtatctaacagaagaagccggaaaagattttgcgggggtcttttacgatgatgctaacaaaatctcacttgacaagttaagatcagctaatttattacttgattacatgccgatcaaacatagttatccatttgactggcggactaaaaagccgattattttccgggcgacgccacagtggtttgcatcagttgacaaaattaaagatgatattttaaaagcaattgatgaagtgacattctacccaagttgggggaaggttcggcttgccaatatgattaaggatcgtggcgactgggtcatttctcgtcaacgggtttggggtgttccactaccaatcttctacggtgaagatggcgaagcgattatcactgaagaaacaattaaccatgttgcggatctatttgaaaagtatggatcagacgtttggtttgaacgtgatgccaaggatctgttgcctgacggatttaagagtgaacattctcccaatggtaactttactaaagaaaatgacattatggatgtttggtttgattctggttcttctcaccaaggggtccttgctgagcggccagaattaacttatccttctgatatgtatcttgaaggttcggaccagtaccgtggttggtttaattcaagcttgattaccagtgttgctgtttcaaatcatgcaccatataagtccattgtttcgcaaggatttacacttgatggcgaaggtcacaagatgagtaaatcattggggaatacgattgcaccaattgatattattaaaaaaatgggtgctgaaattgtccgactttgggtcacatcggttgacacttctgccgatgttcgtgtcagtacagagaactttgtcaaagtttcggattcctataaaaagatccgaaacacaatgcggttcttgttagctaacacaactgattttgatccaaagacaaatgcaattccatttgcagaactagaaagtcaagatcagtacatgactgttctattcaatcgattccttggcgaagcacgagattgttatgaaaagtacgatttcttaacgctttacaagaaattcctaggctttgtgacaagtgacctgtcagctttctatttggatatggctaaggacattgtttatatcgataaggaagatggtcataaacgtcgatcaatgcagacggtgatgtacaacattgtcacgtcgttaactaaattgatgacaccagttctaccgcatactgctgaagaaatttggggctttttgaaggagcctgaatcgtatgttcaactgactgatattcctgaacccaaacattttgataatgatgatgccattttaacaaaatggactaagtttatgggctatcgtgatgatgtcttgaaggtattggaagaagcacgggatgctaaggagatcggtaaagcttccgaagccgccttaaccatttacgcaacttccgaagttgctgatttattaaatgatctccatgttgacatggcaactgttttgctggtttctcaattagaggttaaggcgttcagtgatgcaccggctgacagtacgaaattcgatagtgatggccttgcattatcagttaagccggctgaaggcaagacatgtgaacgttgtcgactagttagaaaagatgttggctctgatccggattatccaacgttctgtaaatcatgtgccgatatcgtccgcagtgaatttcctgagacggttggtgctggattcgaagaaaagtaatttattaatttggtttttgctatgagatgatatggagactccagcttctttgtaggtgttgaatgaatgagataaagaatattttattcatattccttcaatttcgcttatattttatggaataccatttcaataaagtgattaaaccagtagaatgagactgtggcagttatgtcgacagtctcattttttggttgttcgtcaactgttgttggtgaattcaaatattaaagttctaatcatttcgtgattagggcttttttagtatgaatgcgcaaaacgtagagcacacgggttcggaaacgaaaaaaac

SEQ ID NO: 669 - DNA, 4521 bp, Unknown
  Metagenome-assembled genome
tttagcgcaccgatagacgtcgcaatggattacaccgacgggaccatcttcttacccgcgaattgataaacacgcccgaccattcatcttaaataacggcttgaagggttgatgatctgatgaaaagtgaggctgaccagtcttaccagccgttaaatagccaccaagactgccaagggttgtcatactatcgtgcaagatctgacccacagtcagttctgatctcgtctcgtagaccaaagccccaccgcaacgcatcaccacacaaaacggcagtggatcagtcaaccatccaaaagcttacttaacgtttcaccaccaattaaaatggcacttctgtacagttagtgaaggctgaaacaccccctccatgcagcattctgccgaattagcattcaatatcacataaacaaactcctcgacaaggctgcatcaatatccacaacgtcatcgcacttatctacagcatgccatgttgtccttggcgcagttgcacacttgtagaaggtgccgctctacaataatcaggtggccagtgtgtttcaacttacgagcttagatgcaaggtgtcgtacagagcaaaagcggtcgcagttcgctttcgagcactcagtgctgagccccgacctggcacataatggagcttgtagtttcattaacgagggtcctgcatatagccgtacgcttagagtatcaccgtttcgcctaataacgtccactcatcagaggttctccatccatcgttgaaagttttcatgaattatcacacacaccctccactacttgactcgccgtactcacctatttttcaacagcttcacatttcatcttgatgaacacctccggtgcaataatttctcaacgttaacccaatgcctgcccgctctttcgaatatcggcaccgtcaatccctttaatcaacttgggtcaaccaactatggcgatggaagcaagtgagtggggcacgataagccatctgcccttactcgtcagcccaggttgaaatccgacggtcctggttggtaatcattcgaatgattagcctttttctcaaggttagtagattggccaagttaacgtcaccctttacttaactataaaacacttgaatacttcggaagttgtttccgagtcatagaaggccaattgtagaataaatgcaattacatatttgcagttatgtccttaaatcgactctttcgaatttcactactctcaatatacgcattatctgatcataaatatctatcaaagcgcctcacttataattgtaaatcatcttcatgatttcacactcgtcgaatatcatattacattaaatctcctcagcactctcggtctaaatctttttatctggatttgaacaatgaacgttaagtccgtcggaacaagccacttttctttttttttcaactttggacagcgcatttaactttacccatgttgtatacacgctgttttgccattatcaactgtagcttaaacacatacccgacgaaacaactcttttctaaaagaatttggcattatcaatggcaccaaggtaagctgtcttggcacacgatatttttccgtaaacattgagaatacaaaaaaatcgaagctgcgtgagcagcgactcgataattaatacgccggcataactggtatgtccaggaaaatggccttgaaaaattcctcgtttaattgtgactttttggtacaaacgatcgttcaccggatatcttcaattcagtctctgactttatcctaacaaaattggaatatcgattgggaattagatccataattttagctcgcaatctagcatctaatacactcattgctttcttcctttcggttgcaaaactgatcaagtatcacgccagattaattcgactttcgaactaaattgtcaaaaaaatttggttgatttcacttcatccatgtccaaattttgaacatcccacatcataacctaaaatagtttgaaattcaaactattttggttaatggcgtaataaccgataaaactaagaatagaaaaacgccaaaataacggcgtttttcaagatcaaaacttttttatgaagattttatgaagaccactcaaaaatttaattacaattcattctttctaacacaattcagatattctgaattactttttctgttcattagaatttgcctggctgacatcagaatgcccggtattatcccataaagtctttgtcactggaatattcgccaagtcggttaagttactgggcaacaccaccgtattattctgaccatcagctaagtttttgaccgcctgaatccctaagtattgaatcaagcggtcatttaactcactatcattaattgattgattaaccaatccaatttgtttagcttgcgcggtagcaaccgtcgtaattcgatttgcctcagcctcggctgcaatcttaacttgttgcgcttgtgctttggcatcaatttcaatttgctgagcgcgaccttgggcaacggcaatggtttgctgcttttgtccctcggcctcagtaatcatcgcttctttatttcgactagcagtaattaatttattcattgattcttgaacttcagtacttggcgtaatttcaccaatattaattcggtcaaccacaacaccgtaattttctgaaatatcacgaacctctttaaataggttattgttgatcgtattcgtcccgttaagaacatcgttaagatccatgccaccgataattccccgtaaaattgactggcaatccagaatgacgctctcttcagaattctcatttttatacacgtaggcttcaacgtcgctgacatgatatttcaatgacacttcagctttaatcatagcattctctttggtaatcacttcaaacggcttcatctgcaacggcgtttgccgcagagaaaccgtttggcgaacacgataaacaactggaaaaacaatatgtaatcctggttgaagcgatttaacataattaccaaaccgttccatcactttcacttcaccagagtgaacaatcacgaccatacttaatattgccgcaatcaagacaatcaacaccaacactgtgataactgttgcgagcatatccaacatcttcctttcataaatcatcattaaatgatgcagctgaaattaatctaaggatcagcaaagatgcacaatcctcacaggtcttgaaaattgaggacattatccgcatcggtagggatgccactaatttcccttgccagtaaccggctcccaacgaccttttcaactcgagcaaattttgaatcttttaatttcccggtaatcgtataactaaacggcatcccatcgatttgagcaaaccctgtcttttgagccggaaccggaatcagccgaccgaccagctgctgatttaatgattcattaatattggtcattaaaacatttcacatcctttctaatctatgtaccttaggttaccagatttttcgttatgtttcaccgttagaatgaccaaatgaccactaagttaaaaagattaagagatgattttgatcactaaccactttttcacatctctcattagaatctcaatcaagttaatctgaccaataaaaaagttctgtcgaatcagttaaaaatcaactggtttgacagaactttattttgcaggttgtgaaaacaagtcactaaacaccttgtttttctaccccaatagtctcataaatcagtttaggcttttgggcttgtttggcaatttcgatgttgccatagagaagtgatttgatatcatcaaccttttttcgattactatagatagttaagagtggctcacccttttcaaccgaatcaccgattttcttattaagcatgattcccacggcgtaatccagcttatcgttggctttttgacgaccaccacctaataacatgctggcaacaccgatctcattggccacaatcttggagacaacccctgatgttttagcaggtaatgtaatccggtatttggcttgtggcaggatttcctcaggatcatcaattacccttgggtcgccgccttggtctttaatcattgctcgaaaacgttcaagtgcctgaccattgtgaataacatcttcgcataattgttggccctgctcaacggtcgcggccttattgcccataacagccatataaccaccaataacaacaattaacttttcaagatcggcaggtccatttcctttcagtaattcaattgattcttgaatttccagtgcattaccaatggctttacccaggggttgattcatatcagtaatcaaagccatgcactgcatgccaactcctttaccaattcctaccaaagcctctgccaattcacgagaatcagcaagtgtcttcatgaatgcaccagcgccggttttaacatcaatcactaagaaactgtttagtatcttttgagaagtaacctgataaaagctaacgaaaccatcatgagactagtgttgagcttacgctcacagttacgccataaacgatgataatttcccaaccaactaaatgaa

SEQ ID NO: 670 - DNA, 4339 bp, Unknown
  Metagenome-assembled genome
ttgggacatcgtttttacttctttctatctgaattattggctaattcaatagtagggcgatgccctatttatatgcaaaaaaagattgataccttacggtatcaaccccaaaaattttagacccttttaaattatgtcacttcacgacttaaaggacgttacttattttgatttaaacaatgagattaacatccctgttaacggtcagattccattacagaaagatcaagaggcccttcaagcctttttaaaagaaaatgtgaaaccaaatttagttaagtttgactcgctaaaggaccgatttaattttctaattaagaataattattacgaatccgacttcattaataaatatcattttgcttttattgaaaaattatatcaatatttgaatcatcaggatttccacttcaaatcatttatggcggcttacaagttttatgcccaatatgcgttaaaaaccaatgacaacgattcatatttagagaccttcattgatcgagtcgccaccaacgcactgtattttgccgatggtaacgaacaattagcaatggatcttgctgatgaaattattcatcaacgctaccaacccgcaacaccaacttttttgaacgctggtcgacaaaatcgtggcgaatttgtttcatgtttcttaatccaaactaccgatgacatgaatacaattggtcgaaccatcaattcagccttacaactttcccgaattggtggcggcgttggtattaatttatccaacctccgagctgctggtgatccgatcaaacatatcgaaggcgccgcttctggggttgttccagtaatgaaattattagaagacagcttctcctattcaaatcaacttggtcagcgtcagggtgcaggtgttgcatacctatcagtctttcaccctgatattatttctttcttgggcgccaagaaagaaaatgctgatgaaaagattcggttaaaaacattatcattgggagttactgtcccagataaattttatcaactgattaaagctgatgctgatatgtatcttttcagtccatacgatgttgaacgtgagtatggtgtgccattttcatacgttaacattactaaagaatatgacaaaatggttgccaatgaccatattaaaaaaaccaaattaaaagctcgagacctcgagacagaaatcagtaagcttcaacaagaatccgggtacccctacatcatcaatattgacactgctaaccgtgagaatccgattgcgggcaaaatcgttatgagcaatctttgttcagaaattttgcaagttcaaacaccgtcaactgttgatgatgaacaacattatatcaaactcggtaaagatatttcttgtaacctcggctcgacaaatatcaacaacatgatggccgcaaaaaattttggccactcaattgaagcaatggttcgggcgttaaccttcattactgaccattcaaatattgacgttgtaccgtcaattcagaagggtaatcgtgaatcccattcaatcggtcttggtgcgatgggacttcacagcttctttgctaaacatcacatgcattatggctcgccggaatcaatcgaatttacaagtgtttatttcatgctacttaattactggagcctagtcgcatctaacaagattgctaaggaacgtcaccagcaatttgacaattttgaaaatagtcgttacgctgacggcacgtattttgacaaatacctcgaaaattcatacgcaccaaagtccgacaaagtaaaatcattatttgcggacgacatgatcccaactaaagccgattgggaaaatttaaaagcagccgttatgaaggatggtctctatcaccaaaaccggcttgcagtggcacctaatgggtcgatttcttacatcaacgatacgacagccagccttcatcctattatcaatcgaattgaagaacgtcaggaatcaaaaattggcaatatttattaccctgctccttatctttcaaatgatacccttccttattatgaatcagcgtatgatatggatatgcgcaaagtcatcgatatttatgcggcagcccaagaacatgttgatcaaggaatggccatgacactcttcatgagatcaactattccagagggcctctatgaatggaagaacggccgaacagataaaatgaccactcgtgatttaaatattcttcgtaattacgctcatcgtaagggaattaagtcaatttactacattcgaacatttaccgacgaccaacaggaaattggctcaaatcaatgtgaaagttgtgttatttaaacatttttaataacaagtgcaacaaaaattaggttcattagaattaaggagaaacattatgactgagaactatcatgcaattaattggaacaaaattgatgatcaaattgataaggcaacttgggaaaaattaaccgaacaattctggctggacacccggattcccctttcaaatgatttatcagattggcgaactcttgaccaagatcaccagtgggtcgttggtcacgtctttggtggtctaactttactggacaccctgcaatcgcaggaaggaatggcttcgctaagaaaagatgttcaaacccaacacgagacagctgttttgaacaatattcaatttatggagtcagtccatgcgaaaagctattcatcaattttttcaacattaaatacccctgaacaaatcgatgaaatttttaattggagtgacactgaagaatttcttcaaaataaggcgcttaagatccgagacatttatgccaatgagccagaccctttgaagaagaaagtcgccagcgtttttttggaaaccttcttgttttattcaggcttctacacgccactttggtaccttggtcataacaagattcccaatgtagctgaaattattaaactcattttaagagatgaatctgtccacggcacctacattggttataaatttcaaattggttataaccagctttctgctgaaaaacaagaagacatgaagaactggatttatgacttcttgtataaattgtatggtaatgaagaaaaatacacccatttactttatgatcaaaccggctggacagatgatgtacttgtgtttatccgttataatgccaacaaggccttaatgaatctggggcaggatccactattcccagacaccgctgaagacgttaatccggtggttatgaacggcatttcaacatcaacggctaatcatgacttcttctcacaggtgggtaatggctacctgctaggcaacgttgagtcgatgtctaatgacgattacgacatttaaccgaattaatttccaatcattgtcatgttccagagatgaaaatctgtataagacttaaacgtacaaacaatctaagattagatccagttagaaactgacaaaagatcagcttctaactggatcttttttgttacactggagatgaagctaaagaccgtccatgcttctgagagactttgcgtccgaatgcaaagcgggataaaaggcgcttaacttccaaagtatattcggataatccgattacaaggccggaagttgacttttgtcccgcattttcgttcggtaataatcgtgtttacactaacagagactggtcaaaacgattgcttttccagtctccctttttagtaattgcgattgattaatccgataataaatatgcacgtaaagctagtcgcaggtcattcgaccaaatcattcggcctaacaccattaaacatggtcttcaaattgtccatcgaaattgttaccatattttttacggattcgctggtatgaaaggcagaatgtggcgtgagaataacgttcggcatcatcgacaatttaatgacatccgaatcagttattttcttcgttgaccgtgaatcctgcaggtcagctgactcattttccaacgcatcaattccagctccggcaatttcaccactctctaaagcaaaaatcaggtcactggtgttaacaatcgcaccacgagccgtattaatcaaaatggcgttatccttcatcatttcaaaaacttcatgattaaagaggtgctgattttctttagttgcaggcatatgcagactgataatatcgctttgctcgaaaattgttttcaaatcatcaacatattcaaattcaccattcgttgactttaagggatatttgtcataggcaattacccttgcaccaagtccgtaatgtctaaagtttcttagttttattcttgataatccttgttaaatcaacgttaaaaagaaaacacttgtcttcccccgaaagttccgacatagtgtaagtaccacccaacactaaagaactag

SEQ ID NO: 671 - DNA, 46677 bp, Unknown
  Metagenome-assembled genome
ttattagcaccaaaaagataacgatgtacaatgaaaccgccttcacctatattatacaaaggaagacggttcttttcattgatggttacgaggaaaagcgaagcgctcctcggagagttttatatgaaaactttaagtcgacgaaaaggtggctggcatctttaaacgtgacgacatcgggaccgacttcggccaaaacgatcgccgtcgcgtttttttgaatccctggaaaactgcggagaagctcaacttcagcggtatacatctctaaataggtgtcaatacggcgttcatattgggcaattgtgtcttcatcgacatctattaattttagctgttgatctaacataaaccggtgatgttcattaaaaaagccgttgagggcttcgacaatgagcggtactttgcgtttgagagatgtaaaaaccactttttcaaccgttgccggcgttaagacttcgccatttaccaacatatctaagagtgcgcggcccgacttaccaaaaatatcggcgatataagtggttagcttaatcccggcggtctgtaaaattttttgaacccaattctttttacaatttcgatccgccaccagatatttgcgggtccgcgttaagtcacgcaattcacgaatcgattcggacggaatgaagccagccggaatcaggtcgactcgtaacagaccagcgatccaacgggcgttaaccttatcagttttatggccggcgatccccttgatccgttgtgggttggctaaaatgagcggaaaccgatcttcgaggacatgccaaatcggctgccaataacccccgatactttccatcgccacgacttggcaatcgaatccagttaaccactcggctaactgggaaagtcctttttgagtggtttcaaaagttttgagttcctttttgggacgcgttgaagtcagcttaccatgtaaaaggcaagcaaccaccgtggcttgatggacatctaacccggcacaggaagtataaataacgttaactggttcagtcatagtgacccttcctctaataaattaagtatgggaaaggttatctgcttttgtaaatcagtatttttatattcatgcttaagcgcaatatttcggggtactcaaaaagcagacggatcagtttgtctctcgaggccttcgcatcggtacccattaaaagtcgacgaccactaatctttcacccatatcatacgggaagaaagattaatggtcgccgatttaaacttatatttttttcatcttccggggtgtgcaccagcacatggatgtatgtctcactctggatctaatcttagattgtttgataaatcattattgatatttggttttctataacagagattactgaataattttcaggttaatgagtcacttcatctgaatactgcattcaaactaccatcattaagattaaaccaagcttttggtaagcgactcttgaatcgctgcacccaaacgtttaatgccttcttcaatttgatcctcatgcatattggaataattcaaccggaatgttccaggggtcccctcatctccataaaatggttcaccgggaacaaaagcgacattattcttaatacaatcatcaaataaagcttgggtatcctcaattccaggtacctctacccagataaacatgccaccctctggctgactgcacttgacattacttgggaaatatttatgaatggcactcatcataagttgctctcgtttttgatataaatgacaaatggattgaatatgctcgtcaatattgaacatttcaaaatacttagcaacaatatactgagacaaattatcagtatgtaggtcagctgactgcttcatcatcgtatacttattaagaagctttgtatccgtgacaatccatcctaaccgcatcccgggtgccaagatttttgaaaatgttcccatataaataacatgtcctgatttatccagagatttaattgacggcaaattcttgccagcaaatcgaactgcaccgtacggattatcctcaagaaccataacatcatatttctcagctaattcaaccagcttttcgcgtcgggacaaagtcattgttcggccagttggattttggaaattaggaattgtgtagattagtttagtacttggattttcaatcaatgccctttccaacatatccattttcatgccatcttcatccatgtcaacaccaacaaaatgagccccgtaagacttaaagacatcaaccgcacaaagatacgttggcttctcaacaataacggtatctccccgatcaagaaagatttttccggtaaggtcaagtgtctgctgtgaaccggtggcaaccataacgtggtcagcatcagtattgattccttcaattttaacacgatcaacaatgacatcccgcaattcctgaattccctgggatgagccatattgaagcgcatcttttcccttctcttttaagacctgatcagttgcttgggtaatttgatcaactggaaaaagctccggagcgggtaatccaccagcaaatgatataattccaggcttcccggcaatttttaatatattgccaacgggatcaacatccgatttcggtacacggctagaaaagtgataattcataagcaacacgctccatttctaaaaaatatttcactgataattcacaattgaattaacattgaaaattataaattcattagtgtgtctcatcaatttataattaaagatactatataccgtcgtgacaaataagtaaaacaaatatttttaataatgacattaccatttctaatgtgttgtgtaaaaactttcctaacgttgaaacaaatatcaaacgtgacttcttatggtaacttatcaacttgcgaaaataagtacttaataaacttttggctggccaacggcaatacttcccgatctttcttaacgattccgatttttctggtaatgattggtttagttggtaagattttaatgtcataatcagtcttacggagaaccaattctggtaatatactgacacccaatccggattcaaccattgacataatagagtagtcatcatgaacacgaagtcttacctctggttggagccctgctttacgaaaggcttccatcggttcgctcaatatcccttcttccaactccaaaaaaggcatcgtgaccaagtcagacaatttgacataatctcgtttagccaacggactgttcataggtaggactgcccgcaattctccagtcttaataaattcagtatccatccccgttttgacatctggattaataaaaccaaaatcaacttcgccctgcctcacccattccggaattgttgtataatccccttgatgtaaaacaaatttaactttaggatacttttcttgaaacgccttaattaactttggtaaccagtgacatgaaatacttgaaatcgtcccaattcggataactcccgtttcgagtcctttaatttcatcgaccttttcctccattacttgatattgcaataaaatattctcgataaacgagaatatttttcgaccttccaatgttaaagtcgcaccatttctagaacggtccaaaagcttaattgccatttcatcttctaatgaagttatcatctgactaattgcagattgggtaaaccccaacgcattcgcagcttttgtaaagctacccaattcaacaaccttttgaaaagctagtaaccgattcatactcttattaccttccttaatacatgaattacaaaaattaattttacttatataataacttgttttaaagtatatgcaataagaaatggagtgattgacacatgaaaagttatattgttgatgcatttaccagcaaattatttcaaggtaatccagctgctgtttgtttactggatagttggcctaaagatgacctcatgcaaaagattgcgatggaaaataatttatcagagaccgctttttgcgttaaagaagtaaatggctatcggcttcgctggtttacacctggtggagaaattgatctttgtggtcatgcgactttagccactggttatgtaatcatgaattttgttgataaagatagtgaccacgttacttttcacacattaagcggcgatcttaccgttaccaaaaatgctgacttatatgaaatgaactttccatcatatgacttaaagcctgtgccagtcacaaaagaaatgactgacgctattggtgttaagccacttgccgcctatatgggacgtgatttggtctgtgttcttaatacacctgatcaagtcatcaatgccgccccagacttgaaaaaagtaaatcaactagatggcttattattgcatattacagctcctggtgaccaatatgatagtgtttcgcgctcctttgcccctaaactggctgttgatgaagacccggtttgtggtagtggccactgtcatctagtcccttattgggccaaacgactaggcaagaatcaaatcactgcttttcaagcttcaaaacgaagtggtgtcctctactgtgactaccagggggccagaacaatgataagtggaaaagcaacgctttattcaattggtgaggtttatgcataaacgtgctaatcagccggtttagataataacaacgggacagaaaactgtctttcatgactcgatcaaaaaaatcaggttgctaagtgttggaagaagctgggaccatatatgtcactatgaccagcttcttctagtttaatcatgatgattactgagtggaaaagcggggcaaaaagcaacttccagccatgtacggggctggaagttaaacgttttttgccccgctcttccttaaaattggaggaataaaaatgacaaaaatcagacctattcaaagcagcgataattcatatttggcacatattgttcaacaatctctaaaagcatatggattagatatcccgggaaccgcctattttgatcctgaactttctaatttaagtcaatactatcaatcaagtcccagccgtcaatacttcgttgctttatctaatgacggccatgttctgggcggtgatgggattgccgaatacgattctaaaaacaaaattgccgaattgcaaaagctatatttagtaaaagatgcccgtggcaatcatttaagttataaattactggacgcagcaattaaatttgcaaaacacgccggatatcatgcagtttatctggaaacccatcataatttaaaagtcgcgattcatgtttaccaaaaatacggattttctgaattaggtcatccattgaataatggagaacattcggcaatggatcgcttcttcatgatcaatctttaaaaaatgactcaatctgtaattaaactcagtaaatggagaactattttatgaaaaaactcggcattattggtggtatcggtcccgaagcaacggttaattactatttagatattattaagggttatcaaaaaagaattggcaccgataaacaattacctgagatcctcattaacagtattaatatgtatgatatgtttgatatgctcgatcaaggagagtatcaattagttgccgactatctttcacaagcagctaatcaactcaaacaatcaggtgcggatttcgggttgatgtgcggcaatacaccacacattgtcttcagcaccattcagaatcaatcaaagctgccattattaagtattgttcaaacctctcttgaccgcgcaaaagcattgggccttcataagttgggattattaggaactaagtttacaatgcagaatcactttttcagtcagccgtttataaatgccggtattcaaatttctcttccagattcccaatcacaagcgtttattcatcaaaaaattgttgatgaacttgaaaatggcattgtaaaaggtgaaaccaaaaagcaacttcttaaaatcattaacgcaatgattcaagagaaagatctcgacggaattattttaggttgcactgaattacccttaatcattaataaaacagatttatcagttgtcatccttgatattgcccaaatccacattgaatcggcaattgatcaaatcttatcttgaaacactgattagaaaataaatacgcattggtaagaaaatggctacattttcctgccaatgcgtatttgtcttagcctttagccaactgatatcgtcaatcatacaagaatcatcagtatctattatatttttcaaaaagtcattttgctctaataactaggcacaattttctaaacatttcgtttcaaaaatgccacaacatcgtcatacacatcatcgagataccctttggcatggcggctgcccggaaccattcgcgttgtgtaagggatctgatgatcagtcaatgcttgggcaagggttaacacgccacttgtcgggacaaattcgttcaacgagtttgccaaatacattggcccggtcttgtcagtgacccgatgatatggggttgcttcaacgtactgatccgttcggccattgaagtaattggtaacaaaccatttgtagaatggatcgttagctccagtttgattaatattagcactggcagttgaattaaagccactggtatccccctcggcagcgacgacgtcttcatgtttgccaagccagtcatcaatatccaaaatcccggaaagtgaagcaattgggatcccatatttaatgcccaattcaacaaccatgttaccaccagctgatgatccaaaggcgccaatatgatcatgatcaaatggcagatctgattttttaagccactcataaagatgatccatgtcttcaagtggtgccggatagtaggcttttggcgtgattcgataagccggcgtcacaaccaaaaatccttcaccaacaaaccgttccgacgaatcggcatccttggatttgtttcctcggaaccaaccgccaccatgaatgtcgattaaggctccccgggcttctttgagatcgccgtcatagtaaatatcggttacttgatgattaattggatcgtattcaacatctttttttattactaaatttgtcatcgtaaatctccctcgtgttcacttgcataatcatttacacctgcagtatctaccgttactttttgttagtcaattagttgcacttaggaaaaacgtcaggcatgaagacactaaagaacataaaaagccctactttgaaacataacaaaggagttgcaatttcaacggtgactacgagcacaaaatgggaaaaactaaaaaaccttctaaaaagttcggttcttttacaccgaaaaaagtggttgttctcaataatacccgcttcattcatacaaatatgctggtccgttatttattattttttagttcctgatattttttcaatgcaagagtaacttgaattaccccaacgatcgcaactgcaacacaaaaagctatttcccccttagtcatgtaactggatgataacaatagtcttaatcccccaatagatgtaagaccaacaccgactgtgccaagttggataggagaccactttttcaataactacctctccctttattgtttttatttctgttaagttaaattaatcatattttattacagttgtttatgatactccgtgtgcattagacaccaatacacatgagtgttatcaggatctagatcccaatgataaataaacaaaaggagcacccgaattactcgaatactcttcaaagttactgataacgattttcattaactggctcgacaactaattggacccttcactattaaactcagcatttagcttttcgaaattaattgttccaagcccacttgcctgattgtagattttgcctggttgtccagtatagtaaagattattattgttatcggcaccagccaaaacattaaatggactatcggtttcttgagcaaacttataaatctgtgggttccagaagccaattcgagttgatcggccgctattcataacggcatttgcgccggccatctgcggtgtcgtatagctggtcccgccacccattaaccaaagtttatatgggattcgaacgacccgtttatgctttttagtcatactgttaccggcaatgtaggttgcataccccgtttgcggatcggcatttcctgaaacatcagggaagttccgaccttggcgagttcccgttataaccttcggattcttgttaactaagaaatggcctttgccaatatattttaataattggattgcccgaaatgtattcacaccgggaacgcctaattgataacgtggtgtcggatttaatgccgagaagccgccggcaccaccgccagggaagaagccctttttcaaatcagacgcacttgcactatacgtgtcgccccaagcccgttcctggttcacgttaatcaacttctgatgcatgatttttgtatatggcagcgttgtcccccctaccatgacctgataaggtgaggttgaaacggcattggtttgagaagttcccggcacgtcatagggaccatgatcaccaccggctcgaaaaaccgtaattccctgagcggccgcttgctccaacattaagttgaacgcatgattatattgagacagattagcacttttatcttcccaaccgctcttggcttcttcaccaggagaaaagctggtgctaatctgattatcaacattatcggaaactgcctgcataaatgccgtataatgaccggatgcattggtcgttgccccacttggtgccaaatcgatataagcatcaatatcagcttttggtgcaacagaacttgcagattcaacgtctaatgttgtttcaacttgtgccatattaaaaacaaggttcgaaagcgcagtgacattctttggacttcccgccacgtaaactcggtggagacgactcgtatctgaattaacaccaacctgttgccaatatttttgaatattgctattacgaaaatcagtatgaacaattaaaccaattcgttgaccctggcctgccaagccttgattataaagtcgatttaattgatagcgattagcgaacttggcgggaccatattttttcgaaaaagaattaccggaaagcgttgtatcaggattggtgtcacttgtcaggatatcaacatggctggaaagtgatttggtatcaacagctggtttctttgccggctgttttttagttgtcttctttttggcagaattaggattggccgcgtaaatgccaataacggctacaacccgtttggataaataacccggtaattgatagctggtctttgatttattgacatattttgccttgaaagcccgattgacattgtttttggttccccgaaccttcaatgacagattgcccgcgtacgcattcgtcttgagatggtaattgcgcaagtactttttaaacgctgccacgtaagaaccggattgtccaaatttttgagcaaattcattcggtgtcaggtactgatgaaaattagcagaatcaggatttaccgtatcgtaaacataattagtcaaattggtttcactcgttggctttaatgcaacactgacaacggtaaaccggttatcaacttttttagctttagcattggcagtaaaaccggcccccagaaccagcaatccactcaatgttgcaatgataatttgttttcccctcaatttaatcactcttttctaccattattttgggtcaattataacagtcataaagattcggcggcctttaaacgctcctaagaattaatatcatcagtaaacatcacagattaggatttacgtttcattttagtgtctattctttgttggcaagaaattactttgcctaatcctgtatacttaaggtaacctcctgttctaaaaagcgatatttagcaagaaaatcggtttgacccagataacctgtttcagcgttaatcgatgtaggcaataaaacaacttatctgaagggacggtccacaatgaaacttcacaagcaaattgatttgatgacaaataagaaactacaacttatcctcaatttgtctgcaattcctgtttttatcctatttgtcttcatgttactgccattaagccccaaaacgagcttttcgtttgatggctttcaattattaatcctcatgatttttttgtttagctccctaatcattcatgagctaattcatgggctgttttataagctctttcatcctagcggtcatgtcaaatatggcttcaagggtgggatgctgtacgctaccaaccctggtactttatacccacgctggcaatttatgatcattgggatcatgccactactattaattaccggtattttatggctgttatccctggtaaatgtcttatcaggccccgaattcgttctgatcgctgcgattcatgcttctggatgtgtgggtgacttgtatctggaatccgtcttaattttttcacccattggtgcggtagttgaggataccagtaatgggattgacgtttatatccaatcttaaaatacattaattaccaccatctgcgccaacataggaaatgcatcccatcttcacaccataaatatagtagtgtccaaaaaaaccagttagcagactgaataagatcaggcttctaactggatttaatttaattaggacgactttgctcgttgaacttattataaagtttgccaaagttaattgttccaagtccggcagcctggttgtatagtttccccggctggccggtaaaatacagattgttgctatctggactatccaagacattaaagggcgaatcactttgctgagcaaattgataaatttgcgggttccaaaaaccaattgggattttccgcccactattcatgaccgcattggccgcagccatttgtggtgacgtataacttgtcccgccactcatgatccaatacttcttgaaaactgaatggattttacctgtctcaaaacttgcttcattgccagaaaaataggtggcatagcccgtctgaatgtcagcattccccgcaacatccggcaagttccggcctgtgccagttcctgtaataatgttgggatctttattaattgtgtatttagaagtcgtcgggtgatagtttagtaaggtaatcgccctaaaggtgttgattccagaaacgccttgttgatatcgcggtgttccattcaaagccgagaagccgcccccgctaccactaaaatgaccactttttatttcagcggaactcgcgccatcagtatttccccaagcgcgttctttagaaacagtgataaccttaccattaacaattttggtataaggaagggttgtcccacccacaataacttgataaggtgacgtcgaaaatgcatgattttcttttgaggaggctctctcactcgcgccgctgtcgccactagctctaaacaccgtaattccctgagcagcagcctgttccaacattaaattgaatgcatgattatactgagccattgtcaaactgtgatcatgccactgacttttaagttcaatggttggcgcaaagctggttgacagttgtttatcgatattatcggaaattgcctgcataaacgacatgtagtgcgcagttgcagaggtcgtaatatcatccccgttatcgccaatataacagtcaacatcggctttaggggcaacagaactcgccatttgaacatctaaagtcgcttcaatttgtggagacgtcatggctaggttcaaccgtctttggatatttttccggttgtcagccgtatagattctgtgaatccgaccaaggttattatcaacacctgcttgatgccaataaactttcaaatcacgattataaaaatcactgctggaaataatcccaatccgttgtccttgacccgccaatcctttgtcatagagctgatttagctgatattgattagcaaattttaatacaccatatttttttgaaaaacgattcccaaaactcgtaatatcgggtttattaccgttggctgcaattgaaccctcagtcgcgtcggcttgaaattgatcaacggctgccttctgatgggattttaatttagcggcctttttatggttgggcttggcctgatccaaccccataactgcaacaacctgtttagataaataaccgggcaatcggtaagttgtcttgcattcctgccctttttcctttacatatttcgcgttaaacgcccgattgacgttttggtgagtgccatagaccttcaaagacaagttgcctcggtaagcaaacgatttaacgtgatgtttcgctaaatacttttgaaaaccggtaatatagttgtcaggttgaccaaacttttcggcaaactcatccggcgttagatactgatgaaaacgagttgattttggatcaacagtgtcataaacatagttggttaaattaagttcactggttggtttaaagacgacattagcgattgttggatcttgattgacatcggcactggccgtgacatgacaccccaatacaagaaagcttaacccactaaggagcgtcactacaagttgttttcttttcaattgattcacctttcttaacatcgaaataataaaatgatttgtctaggttatcgttaatggattatcggccgacacccagcagccaggccaaaatgtacaatccccaaatatgaattggataaaagccgtagaaaaagcccttcatgctcttaccgagttgcccgttataagccgagagtggcagaacggccaacaccatcagccactggatattggttgtgaacaggccggtaaagttaaacccggttgagatcaatgccgcgcaagcaatcccaatcatttgccagccgcgatgacgacgcagcaggtacatcaccggtccaagatagagaaaaactgaattttcagctatcaaaggcgttggaatgcccaacattaaatacgatgaataagctgataaacttccctgcatgattcccataagcagtgcgccaaaaatcaatggcagtgcaatggccaatacaccagccagtgctttaagaaactgatgctgtttcaaaccatcactgactgtttgaatcccatacattgttaaaacgcctaaaaacaaatcacaaaaaatgttatttgcaagaatgacatcagttccaccaaacaaatggctaaccattaagtttccaattcccatcacccagaaaccaattaatagtcggaataaatatcttttttgattgtgggtatgagtaaagccctcaacacttaaaaacataaaaatcgttgcgaccggccggccaagcatatcgacccaagtcgggactccggctgttgcaaacatttcatgaacatgatcgataaacatcaacacaattcccagaacttttatatcaaagttggttaacccttttttcttaactttttctatcaacatcacttttcctccaaataattaagtgttctacgtgttcggttggtcgcttgagtagctaactgatttaataaagatatcgtacctaacataaattgtcaattatttctttggaataaatcaaaacaatttcggaaattattgttgcggcctaagaatagtttatgattcacaggaatgattttgggggtaacgatgaataatgatgcatgttaacgatttgatgtccaagccagttagtaaatgaaacacaacaatcgacaacttaatttccgaccaaaaaatggtttccggcgcaaattcatgcgttggaaaccatttttattcaaacgataattatcgatcatcttacttttataaacttgtctcaatctctttcaaaatttgatcagtcaaagatactaacgcaattttaggaaataatttcgtgaaaaacatttcatgaagttgttgatcacgatcggtaatcgcatcttcaaccacaatcaccttataaccatactgaaaagcatctaatgcggtggcataaatcccatttccggtcacaacccccgttaaaataatggtatcaatccctcttcgtctaagttgaagatcaagatcagttccaaaaaaagcacctggattatgtttagttactttaatgacgttatgactcgtttcatcatcggcaattgtcattaataacttggaataatcacttggataagtttttctttcatgctgaccaccttcaaagggacgtaaataaccaattgtggagggattaacgttcaccaacgcaattaatgccgccgtattctttaataccgcactaattttatttgatgctgccaacacgtcattgcctgaatgtggctgaaaggcatttcctactaaaatgccaccttgtaaatcaattgttaccaatgcggttttgctcaaatccaaatgcaccagtgtctctaccatctaaccgttcctttcttagttaagcctgttttagttgtttaaagttaaacagataattaattaaattcaaaacaataaacccactcgcaaatagaaataccatccgataatcaaaatatgccgcaattgttgaaccagccagtggtccaatgacggcaccaattgattgcatcatttgattataactgaagattcggccagttgctgattccggtgaaaatctcgctaaaatcacctgagcgctgggggctaaagcagaatcacttacgccaaccagtaacctaagaataattacctggacaatgttttgtgaaaagccttgaagcaaatacaaaatgaaagagactacgatgccacctaaaagaatgcggtgttgcccatatcgatctcccagccgacccagtatgggtgccgtaataatcatgacggcgcccggtgcggatgccacaattccactaataatcgtcacctgatcgggatttttaaccaattgacgcacatatagacttaaaaccggcatgattgatttatcagttaactgaatcaccaaagtcacaaataacatactgataattacttgaatattaggtaaatgatgaatcagatacaggaaccccatcttaacctgatccacttgaggaacaaatttctcacgaacaaaaaataaagtcagtaaaaatacaagcaacataataatcccagtcagccagaaagtcgcccgataaccgttttgattcacaataatgccaccaaaaaccggccccaataatgttccggataccattccggttgaaagcatccccagaacccggccagatttggctttcggggtaataatcgccattaaagccaccgagttactaacaaatcccgaaaaggcacccaataataatcgaagaaccaatagttgccaagtggccgtcacaaaccccatcaaaaatattgtaatggccatcccaagacttgcccgaagcagcattggctttcgccccctcgtatccgcaagttttccccaaagcggtgagaccagggcggtcattaaataggtactcgcaaaaatcacaccactttgtaaattcagctgggcacgactaaaattccccaaagtatccacaaataatgatagaaatggtgaaattaggctcccgccaattccagtcataaaagttccgaaccataaaataaccaaatttcgttgccaaagtggccgctcttcggttttatttctgtttacattcaacttggtttcctcttttccatagtttcaaatgttaaactacggatagtagattgtcaactattactattagtttgattacaattatgctaaaattatctttagggtatcgatgggagggttattgggtatgcaaaaacgaaatttaacaagtcaaaaagtggttgaaacgtacattgaattggcaggcgaaacatctttaaacgaagtcacttttccaagaatcgcagaaaggttagggataaaagcgccgtcgctttataactattttaaaaacttgactgatctcagagtccacacggctatttatctgcacaccaatttaaataaccgattaatggccgatttgattggtcaaaccggcaggcaggcgcttcgaacttatgcgttggactatcgccaatttgccaatgactatcagagcgtctatgaattattaaataccattccaagttttaataacgatgaacttgccagtattggtcggaaaaacaatcagattattgtcaaaatattaaatttttatcatcttagcgagaaagatttaattatcaaaaatcgggcatttcgtagtttattaaacggctacattatgctcaaacaacttggctattttcaaaagggcaacttgagcgatgatgacagtttttcggcagtgatcgatgaatttattaattcaatcaaagagaaataaaaaaatccaaggaacacgcggatattgagaaattccaatataactcgtgattcttggattttttaaacttagctacccttttcgtgagattagtttacccaacttatctgatgaatgtaaaggtaactattctccacctgaatcttactatgacattatcactactttttcggaccgttaatcctaaagccaaaatcaatatcgtctccagccggaatatgatactgaacttcaacgtcccggccccaactatcaatcccaccgacgccacgaacagcacctagaattgaaacgactgtccgacgtggcaccggtaattcttcgatatgggtcgcgttttccaattcttcggccgtatagggtaaacagctgaatgcaaatggctgatccaacttttcaaaactgagactaaatggtgtctttgattgatccgaattatctttggtggtctttcgagtaacggtcagcgcgttggtggccatgtgaacaccgcaatcctgtggaaccaaatacttggtaaccggcaaaccatcaatatgataagtccctggttgcccaccggccattcgatcgggatatgtttcaccagacaagccatcatattggaacccgctcgccaatgtcggcatcacgaatcgaatcccaaagactggcaaatcaggcagtttggcattgcccgtgtaatgagcatgaacatcaatattgccatttggcgtgatcgtatagctcacatcaactggtgtgctgggcgttgttaacgtttcataatgataaatgatttcgaccttatcagcgtattcattgtttgaatatttgttattggtcggtgcacctggaaatccaatcaattggtcgttgactttaacatcaatgctggttgcgtcgacaaacatatccgcgcccaaccactggacagacttcttggaaaaaccatttccccggtcattatcagtcgttgcccgccaaaaagttggcttcggttcacgatacagccattgtttcccgtttatttccaaagactccagaccgccgcgagaataactgaagatataatgaaaaccatcgccgccaaggcccaacgtcccatcgctataaataatttgtaactgtttatttgtgttggccatagtaatattttgcctcctgcattgctggtttttcggtccggtcggcaaacattaagccgtcaccggagaattcgtaatctgaaacccgatcatcaaaatcaccgccgtaacgcaggaccttttgaccagttacctcatctttaacttcaatcgcttgatcaatgaaatcccagatgaaaccaccggcatacatcggatattggtcaattaaatcaatataggacttcatgccaccaagtgaattgcccatgtcatgcatgtattcacaaagtaaaaacggttttttcggattatgatccaaataatctttgatctcatcaggtgacgcatacattcggctttcaacatctgaaatagtgtcctcataattccgatcatgaacaacaccttcatagtgaaccagccgagttgggtcaacttccttatagtaggcgttcatcgcttcaatatcgtcgccggcatatgattcattccccaatgaccagaacagaatactggtatgattcttgaacatttcataattatttttagctcgatccaggacaactgcccgccattgtggtagagatccaggcacattataagagggttcaacgtcccccaacttttgccaggatccatgtgactcgagattgttttcagccatcatataaatcccgttggtatcacacatctcataccacgggtcctgatcagggtaatgacaggtccgcaccgcgttaatgttattggctagaaatgtctgcatatccgctttcatatcagctaaggtaattgcccgaccagaatgacaatcccattcatgccggttaaccccgttaataatcaggcgtttgccattcaataagataaccttatctttgctaatctcaatccgccgaaaaccaaattgatatgggacgacttctaagagtgtgccatcctgtttagcaatttcaatggttaattgatacaaatatggattgtcatgatcccaaaggtgaacttttttaaatgaaacatctgaaattgacaatttctcagcgacagattgggttgtatggtagagctgctgaccgtcagcatcggtaatcgttatgtgagccgtcgtatctggatcatttactgtcagcttggcatccagactgaattgaccgttattaaagtcatcgtcaacggttggcttaattgataaatcttcaatatgggtctctggctgagcgactaacgagacgttacgaaaaattccgaagaagcggaacatatcctgatcctcaataaaggccgccgtactgcgtttaaagacctcaactgctaatttattagaaccatcctttaaataaggagttaaatcaaattcagacggcgtaaaactgtcttcggcatagcccaaaaaatggccgttcaaccaaacatacatggcttcttcgaccccttcaaatctgacccgaatttgtttgccggcaaggctgggattaactgtaaattctttaatataggaaccaactcgattatcttcgccttcactaaacatcccggcacccgtctgatcaggtcccattgaataggcaggtcgacgataaatgcggccttcccaaggataaaaggtgttaatgtagtgaaatttatcgtatccagcaaattcaatatgacctggcactttaatcgtgtcaaagtggctgctgtcataatctgctttgtaaaaatcaactggccgactcatgggattttttgagaatgcaaactcccaatcaccatttagactttgaacaaatgaactttgatcattagtgatttcagctttactttgataaaacttgtgatcactatgggctggtagttcgccaatccgaaatttttctggatcgtccaaccacttaatatctggtttcattaatcaaatcacactcctcacaaatcaattacatgaagcttaccatattcaatgtaagcgtttttatagtaactgtcaataaaaattgggacaacataactaaacatttttcatgttttagtaaaagaagtcatcattacattataactacttgtatcactgctattacattacgactcactttttcattcccaatcattaatgtcattgaatattaatatttttgaaatggaggtctatgatagctgaatcaataatcgttatggatgtaatattacaaaatcattgatatagactggttgtcgcaaaggaataaatagcttagtttatatgttgaaccaattttaaaaacatttaatttcaactaaaaaagaacattaaaattttacataaaagtgaggaccaacatgataaaacaaaagattgctgcctgtttggcaaccattggcattagcttcggaatcttgggtgccacaaccatcacttcccacgctgcttccctctccattcccgatatctctgaatggcagggaaagatcaccaatcttcaagcgcaaaatttaaagaatcaggtttcatttgtcattaaccgccgccaatatggcagcagttacgtcgataagtacgctaccaataacaccgcattatacgttaaatacggaattccgtttggtgaatacgattatgccatgttcaccagcgctgccagtgctaaaaccgaagccttgaacttctataaccgttccaataaaaatgctaaattttatgtcttagatttcgaacaaaataatgcaggtggcgcttctaaagcggctgttaatgcttggtacaatgaaatgcgatcgctgactaataaaaaattagtcttctattcataccaatcatttgcaacaacttatgccggcagtatccgcaataaatttgatgcccaatggatcgctaattattccgctcaaccaaccatcacaaccgatctttggcaatatacgaataaacattacttggcagcgcttggtaagtatctggatgacagtaaagtgatgacgacttcccaccccgtttcctggtggaccggtgacagttcaacggcaacggctttacaggcatcatccattgtgaaaacgcctaagtattaccacgctcttaacagcagcgaacaaatcaccgttagtcggaaagtgtatctgtacgattccaagacattttcaaaggctaatcgaaccaaaacgttatcagccggtcaaaatttaaaggttaaatcagtaacaaagcggccaaccggttcatactacttcacaaccacagatggtcaatacgttacagccaaccgctcatacgttaacgaataggaggcgtcacacaaatgactttaaagaaacgattcattgcttcaacccttgccgttgctggaacagccgctttagcttttagtggttacgcaatgaccaatgaaccaattttccacgccaataccggaattagttcagcccagcaaacacctgcaccgcaatctttatcggtggccggcaaccaattaacagcgtcggtaactagcagcgaccccaaggactacaaactcgattacaatgatcaaaacaacgctaaacacgcgacgtttgaaatgcaaacttattcggatgataaagatgcagccaatgcactcaactattttggagatcaggccggtaccaaagataccttaaagaatgggaaagctgccacctcgcaaggaaccctcggccacgtttatacgcactggaatcaaggtaactggtcaattacgacagtcaccccatctcaagcagccggtggtcaggatccgtcgacttttgccagtcaggttgccagtgaaatcaaccagcatccccttcccagcaaagagcttaatcatggtgccattgtgctatattcaaccaatgaatctgaaatggtcaatactgttaaatggcaaagtaacaaacacgtttatcaggttgccagtgatcagtaccaaactgcaattcaactaagcagtcaatccaattaggaggaaaatcccatgcgacacaagaaattagctggtctagcagttggattactacttgttgttggcggtctcagtggctgtcattccaatagccaaagccaagaccaacatgctggcggttcaaagatttccaatgcttcaaagacagacatgcaaaattcaagcacttcttcaaccagttccagtagtcagtcgactcagagcaacgctcaatcgtcatcagcaactaataatcaatcaagtacaagcaacaattcaggtacttcaaatcaggcagcaggtagttcacgcattgacagcttaaatcatgagctgattcaaaagctgggaaacgtgacactgccaaccagtgatggtttaacaactcataacggtaaattaaacgtccgttattccggtaatcaagctaattatcaaattctttacagtgttggcaatcatgcgctcgatctcaacgcaactcaagtcaccaagcagaccccttacgcgagttttcagaaaaagacttacggctcaacatcagccgctgcaggcgcaatcgattatacaaagcccagccaaaataagggtttacctaaagtgaaactatctaataaggtaaccggctacgaaaatgccggtggtggtcaacactaccttctttggaatgaggacaactggtcactcgccgttcacggaagtgttgtcaatcacaccgatccaaaaccaacggctgttcagaccgttaaactcttggagagctataagttacctgtccctaacagttacggggccattcagtttaacgttcatgctgcaaaagatcatttgcgtgatcaatcgatttcgtggcaagacggccaaactgtttataccttgaaaggaaccgatattaataccgcgattaccatggcagcaagtgttaagtaataatgatcagttttttacaggacatcaaattagttgaaatttttaaatgttccgcaaaaaactgggacaataatcaaagcccttgattatcgcgtttcagttcgatataaaacccgtaaaattagttttgtccactaattttacgggtttttgccgaacaattattatttttgtaattaaatctaatcttcgcttcaacaagggcatttattttcttataagaattattaaactttttccagtgcttcccaaagaccttcaagatatgtgatacccagagcccgatcatataaaccataacctggccgaccatcttcgccaaaaatattccgaccatgatcaggacgaatgtagccattataatcagtatcatggagagctttcataatttcgtacatgtcaagtgacccttctgatgatggatgagctgattcatgaaacgcattttttgcgatatatttgatgtttcgaacatgcataaatggcactcgatcttttggaacaaattcccggataatggtaggcaagtcatttccctgattctcaccaaggcttcctgtacaaatcgtaaaaccgttaaatcgtgactcataaagctgttcaatttttatcatatcttcacgatttttaaaaattcgtggaaggccaaataatggctttggcggatcatctggatgaattgccattcggacattgtacttctcgcaggttggcataattgcatccagaaaatacttgaaattttcccgaagtttatcagccgatacatctttatatgccgcaaacaattcttttaaagctgctaaccgttctggttcccatcctggcaaagtaaatccacgcgaaccagagttcatctcattcaatagttcttctggatcctttggcaacttactttcatcatacatcatggcattggaaccatctaccaattgatgatgtaaatcagttcgcagccaatcaaatatcggcatgaaattatagcaaatgaccttaattcctgccttagatagatttttgatcgtttgaatgtaattagcaatgtacatgtccctgcttggtagaccgatcttaatatcatcatgaatattaaccgactcaataatttcaagcttaagaccagcatcaatcacttgtttctttagtgcatcaattttatcttgaggccaagcatccccgaccggcacgtcatataatgcaccaacaacttgttttgtctgcggaatttgtcggatttctgctaatgagatcggatcatcattagctccaaaccagcgaaaccccatttttaaatttgtcatatttcctccttagatagtttaaactcaaataacatgatatccataagttcatattttagttcgtttttcaataaatatcacaacatcaaaataatatttcatgttttccaatcattaatagtcaagttagtcaattgtcatgtttaatgatgaatcagttatcaattcaagcggcaagtgttcaaaagatcaataactttttcaaatattgatttcatactgtccttaatttgtcataaacacttaataaatgatcaccgtttattatattatcatatcgatattataaaaagcataagaaaagaggtcctcatgcaaaatttaatgaactcaattaacccacctgctaaaaggttttattcagatcgaattctggataccaccaagatcaagctaagtcacattagccgtcagtggaaaaccagtcaaattaattgggacaccgtatacggattaatgccactggcaacaaacagccaccgaaatttgattattgataaatatcagggattggtagccgttaaagactcccctaaagcgctaattgaacgacagctagacagtcgaaaattacttcaaacttctcgaatgatccggacaattgccaattatttgggaattaaagaatatatcccccacgtttactgcaagctcatgttggcgccattaaaagcaagcgttaaaaacggcaattgcccttggatttctttgacccaagttgtttcatatgagcctaccccaaagaaggacgaaattgttttacatttcaaagggtgtggcaccccagttaaaatcaatgtctcatggcatttcttcagccaacgtaatcaggaagcaattaaagttcggaaatttgaaaataaatacttacagcagcttaaatacgcattgtcaaaatcagaaaatgacttgatgatgcaacatgaaatagattgcctgaataaccactttcatcaatttgtgtccttttataatgagcagctaattagagatattctagtgggctatggcgttgaccgcgataatattgaacagccattcgttgaacacttggctaagaagttgatgcaataacaattaatagtgatggatatttcagcaatcaattcactttagtgcggttgattggtcttactttcagattgataaatcggtaataaaacatcatcaattaacaattccaacttgtgctcagttaaaggctggttagtaaaaaggtgaaatcttagccaatcaaatggcagcaatttaatttcttcaggcagatctgtttttatgatctcgcctcttttttttgctcgttcgaggacatgatcaagggcattaagatcgatcgcatttccctcactaatcaattgttgaatcgttgtattttgcttttgagttgcttcccctaacagttcggcaattcggaagtccctaaatgcttgcatactaataataaaccgatgcagtagttgcaataaatcctcacgtaacgaatgaccagtcaaagttaattcatccgttcgaccatgattttctgtttttatcttatcttgaatcgcggcaatcgccagagaaaatggtgtctgccatcggcgataaataactgatttactggttttagccaaatctgccacatcggcgaaatttaaatttacaaatcctttatttttcaggagttgtaaagttgcttgataaatcgcttgttcgaggtcggcgccacggcgacgtttttgaaccataatgtttagtctccttttataagataccgaaagtaccttattgcattttctatcttcagagagtattatatcaattatcgaattaagatactaatagtttcttatttaggaggaaaatataatgaataaagaaattccaagatctacaatcatcattgcctgggttgtcgtctttggtgcaatggccccattactagattcaacaatgatcaacattgccattaataagttggttaacagttttaatagttccgtcacaacagttcaatggacgattacctgctatgtcttggcaactggaattgccgttccattttcaagttggttgctaaacaagtttgatggcaaacatgtctttatgtttagtgaagttttattcggtatcggatctattttagccgcagtttcacctaacatccaatttctaattggtgcccgcctcatccaaggatttgccggtggcttaattatgccactgctaaccacgcttctggttcaaactgctggagccgccgttatgggacaaatgatggcaacggtcggcttacccatgatcttgggtcctctgattggacctgttatcggtgggattatcatcaagtttttatcttggcagtggattttttggattaacgtgccagttaccttgacatcgcttggcttaattatttggaaaatgcctaactaccctgctcaaaataaatccgccaaattagacctgattgggacattgctcctgatcggatccagcagcagtattatttatggcatggttaaggcagctcataaggccagttttagcaactcgtcaacactcagctttttggcagcgggcgtttcactattaattatctacattatttggggtgcaattcgtggcgaaaaagccgtcatcccgcttaatttgtttaaacacgggtcctttaacggttcaatcattggcttgtttattgccggaaccgttcttaatggtgccatgttattgctgccactctttttccaaaacgtgcgtcatatgagtgtcttgatggcctcactggcattaattccccaaggagtgggaatgttgatttcacggccattaaccggtagattgactgattcaatcggtgcaaaatatgtcgttcttgtcagtgtctttattgcttttcttggtaccatccccttctactggatcacccaaagcaccccctattggattatcgccgttgtgctgctggttcgtggaattggtgccggtggtattttaacaccattgatggccgactcttataccggaatgaaaatcgaacaaatttcaagcgccacaattggttcccgaattctccaaaatatcggaagcgcctttggctcagcgctagtcacaactgtcgtaaccgccttttcagcttcacacgttaagactttccaacaccaattaaaaacgggtgacatcaaaccggcatcaggccaattagccacttttatccatcaacacttggttaatattcggctcgactcatttcaacagggatttttaatgatctccctggcagctttgttgatcattttgccaaccctactgctttctaacaaaatgaaattaaaaaaataacccaaaaacggttaccgagctactgaagtagtcaagagtctcgtctgaggggaggatgattcaatcatgaaaaatgatcttttggcaatcatgcatggctggtacattgcccttgctgttgttttatggctcacgtttgttacaatttttgtttcaaagagatatctcagcagctccccagtcagttgggcaaaattgtatttaacacccattctatttatcgtttttggcattgagaaaatcatccgctttcaacatttggcagccactttgattattttcctagtgattattttgctcgctagttttctaggcgcccatttggcctacaaattccaagcctttttctcggaggataatcaaattaaaatgattggtggcaaatacgcgattagcttaatgattatgaatgtcatcgtgatgctgcttattaatttccacggttgggtaaatccacaaagttatgagacttggtcatacacactaacctatgccattacctcggcaattgttaaagggctcttgattggccaatctgttaatatgtggtggcatttgaaggtactaccgaagagatgatgttatttatcgactaacaaataggctatatcatgatgccggaataatagatcaagctgcacgcttaagccaaacggatcccataaaatcagcaattaatactggttttatgggatttgtcctattgatatacaacagtctaattatcaaagtcaattagactaccaccagtaacatcacaagtctctgaaatagtaaattcaaaaacaattaccaactaatagcactaatgagatgacaccaattatttgatgactctcaaatacttcgaattaccagtatataaccaccagtaacttgacatcttaaagcatcctttttaggtagctatgacttaacttaaacgactaagtatggtatcttaaaattaaatatatttataaacgcgatgacgttcgcgaaacaattaattttaatttgatgacgtctactgtaggccctgtggcttgcagtaggcgtcttttttaattcaagaggaggtaaagcaatgactcaaacatctttagaagggctgtcaagtcaggcagtcgaacatcgaattaaatcagacggttataacgaaattcctatcgccagcttcaatttcttccaatcagttcttagccgattatgggaaccttccgcatggattttagagctggcacttttaatggaattgtttttgggaaaagatattcaggcttctttcattgttttaatgttattattcgctgccatcaacggcacaatccaagaataccgtgccagcaaagtattaaattccttgtcaacagctttaaaacccttagtaaccgttaaacgaaacggccaatggcttaaacgaccatcgcgtgaattggtggctggggacgtcattaatttaaagtctggaaatattattccggctgatgtgacaatcttagataaatcaatttatgtcaacgaaagcagtattactggtgaatcaatgccggttaccagaacgaaaggatccgaagcattttcaggcactgaaattatcagcggtaattgtttagcattggttatcagaacaggtattagaagccgggccggaagaacctctcaattaactatccagtcaaaagcacccggtcagcttcagatcttgttaggccgagttatcaaaagtttagccattttagacgtcatcttaattatgattttgctactttttgctttaattcggaaagaaaacctcatttcattattgccgtttttcgcaatgttaattattgcgacaattccaattgcaatgccatcaagcttttcagttgcgaacgctattgaagcaaacgtcttaagtaaaaaatcaatcttagtccgagatttaaccggcattcaggaagcggccaacgtcaacttattattaatggataaaacaggtactcttacgaataaccaaacggtagtagaagggtttcacaactttagttcatactcaaaagaagaaattgatcagttggccttaactgccgttgatactacgcaaccaagccaacttgacgacgcgctcttaaccaccctttcacctgcctgtcatttgtcggtgaaagcttttcaaccatttaatccgaatgtgggctattcaacagcaacggttaacgtcaatcaccagaaaagacaagttaaactcggctcattaaagattatttcacaagaaaccaatcagataattgatgagtcaaaagtccatggtcatactgtcgctctgagcttggatcggcaattacttggattttacatcttaaaagatcaaattcgtcctgacagtgtcactgcggtgcaaaagtttaaccgtcgtggcataaaagtaatcatcctaaccggagataatcacaaatctgccgaacaaacttcacaccaaattggtcttaccggaaagattattacaaaagaagcaattaacgcgattaaaatgaagaccaatatcgcagccatttcggaagtgttacccgaaaataaattagacgttatcaaaaagtttcaaaaactggggtacacagtcggtatgattggcgatggtattaacgacgcgcccgctttaaaacaagccaatctgggaattgcagttaatacagcaaccgatattgcaaagaaagccgcaaaaataatcttgatgaaagaccggctattatcagttgttgacattgtcgatagcggtcatcgggtctatcaaagaatgatgacttggacaattaccaaactggtgagaaccgccgaactaactttattgctaacgctcggatatattttctttcgtttcatgcccctttcactaaatgaattagttttaattgccatcttaaatgatttggtaaccctggtactgggaactgataacacaacgattacctatcatcctgaaaattggaattttaaaaagatgattggtcaagcaagtatcctcactattggttggacagccagcgcactttttatattgaccattttgataaaaaatacaacgattagcaaagcaagtacactcctatttgtgtttttaattgccagtgctatgctaaccattttgatgactcgaacaactcggccattttggttaagtttacccagtttcgcggtttgcttctcaattatatttaatctaataattgtttcagctctcgcagtattaggattaggcatccccaaaatttctattctatcgattatcaacatgttattaattaccctatcgatatcgctcatcttggacatgattcatgtgtggataaataaatacgtccataaaaaggttgatcacaattaaaaaggctcactaactcagacaaatttgaccatattttaattgccagacctgtcagattaccgcttaatatagaatggaccttttctaaaaacgaaaaaaaattgaaggaaagataacataacaattagccctactcatcaatccccaacaattgaaacgggctcatatatcgggttttcataataatatctgaaatttcttccggactgtctggattaccttctgctaaccagactttaatcacgctcattaatcctgaaacaatgatttcatgggaaaagttattgggaatttgtttggtcatccgcatctcacccttaagccgaaaaagatcagcatcaataattttggttagcagctctttgaccttttcttcaagtcggttatcaccattggaacccagtaacactcggatcatatcaaattcagacgcaatgtactgaataattttatcaacaaccggatacgtatgtggcttacccgatgatacatcttgatatttcattgtatccgctaaattatccttcattaagttcttgatatgtgccaaaatttcattttcaaaatggtcaaccatcataaacttatcttgataatgagaatagaaggtacttcgattaatgttcgcatacttagttatatcgctaactgtcatgcgatcaattccttttgattctgtaagaaaaataaatgcttgtttgattttacgttcagtattggcaattttttgatgagtcgccattggacacatctcctttatgttacagtcatcatacccgagtttaagcgttaaatcaacaggtagttgttttaaccttaaaatccaagttaattcatttaatgacgagtttcatgatgtgttttttttagcttaactttttaataactattagcgcacgcgtagagacttgagtccgaatacccgttcctgttcaaatcaacacttttaagatttttgatggttgttcttatttccagtaaaggttatattacattataagcaacagagtgttgaatacaatcaataagagagagggacacatcatggcatacattgacgtgattcatgaatcaaaaatttacggttcgggtgaacaagaagtccgggcaaatgatgatgttaactttgaaattagcaagggtgaattaaccgtcattgtcggctcttcaggggcaggaaaatcgactttacttaatatccttggcggcatggacacgccaacaaagggccaggtcatcattaatagtaaagatatttcgaactactccagtcggcaaatgacgactttccgacggttatcaattgggtttgtcttccaattctataatctcattcccaacctaactgctttggaaaacgttgaattagcttcacaaatttcgccggactcactcgacgttaaagaggttatgacagatgtggggttaaaacaacgcatgaataactttcccgcgcagctatccggtggcgaacaacaacgggtggcaatcgctcgggcaatcgccaagaatccagatttactattatgtgatgaacccactggtgccttggactataaaaccgggaaaagtatcctgaccttgttacaacgcttcagtcatcaaacgaagaaaaacgtcatcatcgtcacgcataatggcatgattaaaccgatggccgatcatgttatcgaaattggtgacggtaagattaaacaggacgttctcaacccaaacccgaccccaattgaacaaatcgaatggtaggtgaattaacacaatgaaatcaattttatggcgaaatatctttcgcgagtttcgtttctcattcgcgcgatttatctcaattgccacattgctgggactcggggttttcgtactaattggcttaaaagtaactggcccggatatgcggatgaccggtaacaattattacacttcccataaaatggctgatgccatgattaacagtaataccggcatcaccaaagccgatcagtcttatatgcgaaccctaccacatattaagaaaattgaatttggaacggccaaggacgcggtcattaaaggatcagataaaagcatccgagttgggtcaaaaactaatcaattatcaattaacaaagtggtctctggcaggctaccaaaatccaacaatgaaattgcgcttagcaaccatgaaaaatctaaatacaaagttggtcaaactctccgactcgtcaacaacaagggtaacgccaatatttccggattaaaacatgcttcttacaagattgtcggtttcgtcacttccagcgattatttaatgaaagaaaacctcggcgctacttcggctggaactggtcaattgtcaacttttggagttgttaacaaaagtgcatttaccagcagccggccaacgatcgctcgtatcagttataataatgttcatggtaaaagctataccaatcaatatgagaaacaagttcaatcaaatgtagataatgttgagagccggttaaacaatcgcgccaaacaacgtcaatcaaaacttaaaactgatgctgctgataaactcaacgacgccgaaacaaagctaactgctcaacaaacaaaacttaatcgaagtaagcggcagctcgcaacagcaacaagtcagttaaaatcagcaacagcccaactcaatcagctccggaatagtggccaagcttcaagcacgcaactatccccccaacaagctcaactaacggctcaggccaaacagcttaacgctaaccgtcagcaaattatggctaatcaggcgaaaattaatcaagcgaaagaccggatagctgatcagaaaaaatcactggctgatctgcccaacattacctaccagattcaaagccgaaatgactacaactccggctacaatcagtttggtgaagacgccaaacgaattgatattttatccaacactttcccaattattttcttcgccgtagccattctggtcagtttaacgaccatgtcacgaatggccgaagaaaaacgacaggaaattggtacgcaacgagctttaggttatagcaagtttgatacgatgaagctgtttttaatctacggcaccttatcaggtcttttaggatcgactctgggggcatggctgggaaccagcttcttaccaaagaaaatttttggtgcttacgcggccaactttgtcattcctaattttcaaacaccaccgtcaccattttggatttgtctttccgtgatcatttctctcatttgcacaattgttccaaccgcttgggtcgccatcagaatgcttaaggatcagccggcaacactgatgcttcctaagccgccaaagtccggctcaaaagttctccttgaacgattaccatttatctggaaacatctgtccttcaattataaggttacaattcgaaaccttgctcgttataaaggccgcatgttaatgactatcctcggggtcctcggatgtacggcgttattaatcactggttttgggattcgggactccttaaacgggattgtgcagacccaatataaggatatcattcactatgatgtcatcggggtttacaattctcacgcttcaaaagaaagccaacaagattatcgaaaagctgctgacaatctttcaggcattaagcacgaaactgatatttattacgaaacggtctctgccaggccaaaggggatgaccaacaatcaaagtgtttcaatgattgtcccgaaatcagctcaaggctttgacaagtttgttactctgagaaatttaaacaccaagaagaaaataaaactttccaacaacggtgcaatcattacccagaaaatggcaactttggctaacctaaaagtcggcgatcatctaaccgtcaaaacaactaacggtgaaaagcatcaagttaggattacggggatcactgaaatgtatgccggccacacgttatacatgaatcagcaatactaccgcaaagcctttaatcaaagtgctgactacaatgcgaaaatgctcatgttaaatgaccgctcggcaaaaaatattgatcaggtctctcgaaaactaacccggcagaatgcctcaattaccgctgttcaatcggatgacgcaaaaacaaccattaataatattttagccggtctaaaccacttggtgatgattattattggcgctgcttcaatgctggcgttcgtggttctgttcaccttgaccaacatcaacgtttctgaacggattcgtgagttatcaacgattaaggttcttggcttttatccaatggaagtcgtcatgtacatttatcgagaaacatttattcttagtctccttggtgtcttggccggtttcgtcggtggtgcctggctgcacaattacatcatgcagacgctgccgccggaaaccgcaatggctgatttgacgctattatggactaactttacaacatctggagtcatgacactgattttctcaattatcgttatggcgatcatggtgcgtaagatcaatcgagtggatatgttaggcgctttgaagtcaattgcttaatacggcatcaaaaaacttaacacacgtctttaaagtaaagttaagaagcccaacatttcggaatgattcgaaatgttgggcttcttatttttaccagatagttgtttcctgcagagtctttttggcttctgatgtagtaaattcaaaaaacgactaatcaataatgctaataaatgacatcagttatttgatgactctcaaatatttcaaattaccagtaatataaccaccagcaacctgatatcttaaagcaccttttttatccattcgattagcttgtgagtactcccaacgcttaactttaaaggattttttagccttcttggtatagtgacgagctttctttgtcaaattaacatcacggtagacattaattgcgcctttaactttgaccatccttgccatcttagacttaccagcaatcaccagttttcgattggctgtaatgtatcgaccgttagttaaaacaaacctcgttgtcaaattgtggtcgacaattttcttaacttttaatacagttccttgtttatagttgttcgtttttccagttaagtttctatttcggtagacattaactcccttgggattaataaccgtaatggttcgatacttattttgataataaaccggcaaagcatacttagtattcgctgtaatatatccagttctaccggcggtaacagatttatgattaacatcacggactttgtatcgcaaattaccatttgtcgatcgactgtaatccgttacaacaaacattggtcgattaatccgcggctttttaacataaccagcaagtcgttgtgacttcttgaaggtggcatttcggtaaagataaatctttttaaccgagtaaacaacttcacctttttttgcaatgttgggtccggttggcgtcactggtgttgccggaacaatcggcgttgcaggcgttgccggtgttgtcggtgtcagtggtgttgctggaatcgttggcgtgatgataccgccaccgccaccggtgccaccaccagtactggtcttttgatacaggtaaacaaaggtctgatcatgatcaccaaatttagttggcatcgtctgattatctttaataccaacgtatttataagtctcgccctgatacgttaacgttgctggagctttcggtgccgtgtaatcggtgccagcatcccctttggaaacagttgaactttggacatcaataccattggcgtcctgatacttgacggtgatggctggttgtgcggttggcacattttgatcatagacgaaggtaattgtttgattatcgttatccaaggtcacttgagccggtttacgaaccgtgtagccattaatatcgggcgctttaatcacgtcaccggccttccctttggcagtgtagccatgacccaaatctttaccatctttatcaaccgttttaacggtataatttaacgctgttgcaactttgttatagacataagtgaccgtaattggctcactacctaaaacgcctgttgcatttttaggtagtttaccagtatccagttgataagtctgattattattagtcaacgtttcaatccggtatggtgaaactgaagcatcatatggatcattcaccttaccattaattgttttatcaggcgcaaaggattgattattctcgtcaacatatttaacactgaccggttgagccacttcgggttctttcttcgtactgaatgtataagtcacggatggcacatcggctgaatcgctataagtaccactagatgggctacttaccgagatattattaaatccatatcgatcccttaactgattaatgatcgcttgaatgttctggttctgagcggaactcacgtcggcgagattaaacgagttggcaccactaagcgctaagttccatttgctgtcaatatttccagaaagcgtttcctgttggtaaatgtaattgccagcatcaccatttttaaagttgacattcacattgccgacagcatcagaaaattgataaggctgaataatatacccttgataagtaaagtaaggattaccgaaaagcggatcttcccacgttgccgtcatataaccatgattaattgtgttgttctggcttaaatttgtccacgttagctggttctttgccggatcactataaagaccgccatcggcagtacttttgtaagcctaggcatagttattaaaattattattactatccccagcagcataatatggtcgaactggaatgttatcaccatcaacatttttaatcacaaatgaaggcattgtataacttttaatattagaatttaacgtgatcgttggtagcttgtaggattgaaatgcaaacgtgaggctgtctcccaacgatgtcttggacgattccaacggtgaagcatcagtaatgtgattataacttaaagaagtgtacacatctaactttttcccagcaagtggtttaatgtcataaagatcatcatgttgaaaattagcagatgttaaatcttttagattagtcagtgcgctaatatctgacacatttccttttggaaacattccccaaacagtgaggcttgcatccatatccggtgttactcgaacgtcttgaagattagtcgcgtattgcatcccttcaagacttcgtgtaaaccgaacctgatcataatatgtccgatttgtgtgctgctcgtcaacatccagccacaattttgtctcttgtgtttttaaaatatcttttgtcagatcattagccgacgaaagatttaaatcgtaaacgagcaattgttgaaaattcttatcaggcagccattcatcgacgtaaggattccccgttttggaatcagttccctttgcgtcggctggaatttgactcgcgtaatccgcgcttacccagtttggattcacaattgttttcaaccaagcatcatgttcagcagctgttccccccttccaatttccagatgcatcagtataactgttagcagttgccccgtatacttggcttgaatttgaactaaacaacaggccaaataaaaatactgttagtagtccaagcactaccccgataaacgaacgtaataccttagttcgacgacatctcatctctattatcctcccctaaactcataatcatataaacttaaaaaatcgataaaatcataattaatttattaactttagtttaacgcattacgcgtaaccaacaaagtaaagtgaatcatacgcatggcatatatttattcaactttaacgataggcattgataatagacaaacggcaatttgaaaccgatctcacttaactcggctttaagtaaaagtaatttctgacattctgcaggttaaataaaaaacaattctaacgttaataattcatgactattcgccaatccataacaattaaattggcttcatcaaaaaacatccaactaatttcaaaatccacgcacattttgtcaaattgtatgcaataataagtttgggaggccgaagaaatggataaactaaatcgaaaactacggaagcattttgaatcgctattaaccaattatttactcgaagaaacactgcaagccgactttgggcgaatgcaccaatcagttggcagcccacaactcgtctcacaacttattcaaagccgggaacaacccgttaaacggatggtcaagagaatgagtgacgaacgactcgtgaatcaactgaaacaaattcaatcactatcagtggaaatcgaacaggatttacggattcatagttagtatttgtccttcaccttcaagcttttaacgcaagaaacggaggagacccatgaaagaaagcaagcaccaagaccctcaaccaacttttgaccaatacttctgtggtttattgattgttgtcgttatcgttttagtcatcacttcaagtgccttcttttaagaattaatcaattcactaaaaaaacagtgagtgcaaaagatctgttagacagattgtttgtagtcactatttttttgcacccatttaattttcacaggcatgtccgactttaatgatcagtcttaaattggctctttttaaactgtttatcgccctttctgattttttctattagatatggatttgacaccattcgcatggtttccatcatctcatcataatcatttttggagataacgacgacattatcatcagagttctgactagtcacaattaacggttctgaatcttggttgacctgctttaaataactttttaacccttgacgaaaatttgaataagttacggcttccatcagcaccccgcctttcacgattgattgtacagcaaagcggatcggtttgtgatgactttgcttctttaagtttacaaacgaccatttatttacttctctgtttacgctacataacagatagtacaaaaaatggttgctaaaatttttcgacttgattaaagatccagtcgaaaaatttgtaacaactattttatcaattaagcttcaatagacggttataaaatttattttaatccttcaaaaggaccctttagcttcgatatagcaaacaacagtttaatcttcatgtcgtctgcgatctcttaccagccaaccaaaggccatggcaattgctgccagaacgaatccgaatacggttaagctcatgctggatttatctccggtctgtggtaacatagcagccttgttagcgtctgttgattgagaatttaatgtccgctgttcattggctgtttgcccgaattgatcattattaccatccaaacctgatatttgaccattttggcccacattattcacaccgttaccattgacactattagcttgtgactgactcgtcgctgtcccggaagctgttaacgtttttggcgaagatgtgctcgtcgcactcaatttaccagttgtttgtgatccacttggggtatttggatcacctggcgtatttgatttgcctggggtacttgctttacccggcgtattggtcttgcctggtgtgttcgttttacccggtatattggtcttgcccggcgtattcactttacctgggatattagttttgcctggtgtatttggcatgtttggcgtgttcggtgtgttcggtgtacttggtgtgttcggtgtgtttggtgtgttcggtgtgtttggtgtgtttggcgtgtttggtgtattcggtgtattcggtgtatttggtgtgtttggtgtaactggggtgccgggagtatctgttcccggtgtacttggttttggtgctaccggctgatttaacgtcattgttggtgcttgaaccattatggccgatgattgataatccggtttgaccgcagtgccactctggtaagtcggcccatccacattatcttttttcgtcatcgtcggcgctgacattgttgtatccgtgccatatacagatactgacgttaatttcgtggttggtgccacaaaattcttaaccccggttgctttaatcggtgccgatgttggaactacctgactgtaatctgtaaccggcagataatagaacatgattgaagtattctgtgatggatcaccggccgcttttattccgttgtccaacattgcttgttcaaagtttgcattgctaaacgtgtagatttgcgctgtttccgtatttttcgtttgatgggtgtaccaatcttctttttcattcaagaagctcaaaatatttgtggcctgaaaaacgccatacccggccagataatatgtttttccattagtcgtataagttggttgtaattcaaaactgacgttttccccactaacggcacggacccactggtgattagcaaagatctcctgaatgttttttcccgccacaatatgcgtttgaccattatcagctgcctgatagtcatggcggctaagagcctgactcaactgaaaactagcgttgtcttgaaaattggaatttaaaacatcctgccaattatcagctactatcacacttgtagtcaattcttggctcatcttgtcattgtatgcatgttctcttggacttgatccatcggtacttaaataatttggatcatgcaacgtggttaccgcttgttcattttgtttgggatcagcggctatatttgccagtgtcttgattaactgttgatattgagcggaaaagccattcgtcccttccaagctgttcttgagattgtcggcacctttagtgacactggcaacatctgcgggatcacccgtactgattttatcttcagcatcagtaacagttgcgttgtaagcattgaccgcgtcgagataggcgttaaccaaggacgcataactggcttttgaaacatctttggcaaccttcgagtttgcatagtcggcatctgaatagttggcttcggttgtgccaacctgagcattagtgtatgtcttgccataatcaacggctgtggtcgtcgtgttaaacgatgtcgtcgtcccattgatcgcatcaatatactgatagtccttttgggttaaatcatcgccggccgtgtggagttgcggataaaagaatgcccagcggccatcgttcttagcttgggaaatcaaatcattccacgtgtcaacagccttttgttgatcaccggcgaactggttgatctgcgcaattttggtctgaagattccgggcgacagtgccaatctcttgaactgcctgatactgatcaatatttttttgcatgattgcggcattttgagctggtgtggtcgtgttactcgttccagttgaagcaaaatcattttgtaatttagtgataccagcttgaaattggttccaggcactattagaatcactgggatcgtaaccgggtgccgcgttttgagcggtctgaccagttttagtggcataatcattcaaggctgtttgataatttgccagcgacgttgtgtaggcatcattgacagtcttaaactgtttaacctgatttgacaaagcagtttgagcatctgtaacagcagtctggccgccggttaaatccgttcccgtgacttcggcagacccagtgttgatattattaactatctgattgtacttatccgcagcggcctgccaatctgcaactttagctgccagatcggttaaggctgccttaatattattgtaagccgcattggcagcttcgtattgtttataagcattattctgggaagctgccttgacgatttcatttttaaagttggtaaaatccttttgcgatggattcatcgttggatccgtcggggtggccgtatctgaattagtcccaagtagcgttatcttttgattaggatccgtggttgtggcattataaacggtcacattggtattgtaagcagttaaggcatcgtcataagcggttttataattatccaacgtatgaccggtggcatctgatccgctaattgctttttgaacggcatcagtatcgccggcattggcactgtcaactgcttgtttgattgcagcgttcagctgatcagcagccgttttcaattgttgctgagccgcattcaatgcttcagctgtcgcgtaattagcttgaccatttttaatctgaaccaaaatggagttcacttgatcagtgtaggcatcgaccagcttattatagttggctaacgtggctgcttcatctttattgccaactttaacactctggacggcactgggctggggctgattaggcatgtttttgagcgctgcttcatagacagccacaacatcgtcagtggtgatttttgttccagtaaaatcactggaagacttcgcaagatcatttaatgccgtattaactttggtcagccagtcattatctccgggtttagggtcttttaatagggcttgaagagcagcggcactttgattggccttttcagctaaatcattggcgtgatcagttttatccttagccgtttcatagtcgttttccgccgttttttgaggatcagtgtttgcagccttagtggcaggttgatcaattgcagtcgcatcagttttatttatcgccgttttagaaacaactgcttgcttagcgctcacagttgcagtgctcttggcatccacgttggaactagttgtagtagttggtgttgcctcagttgttgccgcttgatccgtatttttaacgggttcagcctgagcagctgattgaggactggatacctttgctgatccctcagaagtcgacgttgactgagtttgagcagtcgtttgtgcaggcacttgtgccgttgaagtactggttggggtaacggtcttagctgctggtgaaatctcagtatctgccgatttagaaaccgtttttgaaccagtagatgttggtgtcacaactggttgggctgatgactgcccggccccttgagttttgacattctgctctgatacctttgtggctgtggcctgctcagtcggcgccggagttgaactcgccgctgttgcttgctgatcaaccggtgcagtcgttgattggtcagcttgtggcgttaccgatgaattgtcttggctgctaccggctggtgtggtcgacttagcagtttgggtttgggcagctgtagttgtttgggtagaatcagtttgtgccgcttgtgtcgtttgcggactgccggctaacataaagcccaaacttgcggctgccagactggcaaagacccaacgtttcccatccttatacattttatagtgaagtttaatttcctgattgttttccttaaacattattatttcccccaatatattgatacgataacccgaacagatatcatcactaattacctggcttcccccaccagtcattaagtggttaattgactctaatctgttctacaaattgctttaaaggctcagccatactttcttgcatcttaactctgcggtgacagccaaccacgcaaagctaaaatgagtaacaatgaggtagacactctcaactaccagttaccatttagttctaaataaatgtctatgctcattacaactgacacatcgatagtagcactattttaaagaaaaagtacataattctgcaacaaaccggtatttaatcaagatgactaaaccggttatctcatttcacgtgctttgatacataacattgtcaagtacttattccttaattttataataacagagttaactaaatgagcggaaatttaacgcctgatgagccacaaaaacaccctaacctttactttttctttaactttgtcaagttgtcatcacttatcatatccaacagtttatgcttatacaggcactttttatgagactcccgtttgctaccaatcttatcttgtggaagcccaatttccgttgaatttgtaagcaaaaaactgccgcaaacctttttacttgattaaagatcaaataaaagggttcacgacagtcatcttatagattaaagttatttcaaaaaacatcggacacctaagagggactgcaaaagataatcttatattaaatacatcttccgaatctctgcttgctgctcaggggtcacgcgcagccccttctcaatgaaggtatccaaattgccgaactctctgtggatttcatcaaacgcagcttcaaggtacgttgcatctacgccactatcatatttaacctgcaaaatcttatcccgactaatcccattctttttcatgcgggcaattcgagcatcgtttcgatcacgcaagaaatcatttgacgcaacgtaatcttgaataatcgtatcaccatcaacccctaggacgtgcattaataaagccgttccaacaccagttcgatctttacctgaagcacaatgatatagaagagccctaccaactggtttatttaacacggccataaagaattgatgataagcatatcgcgcttggggcaccgatacataagttcgatagtgttcccgaatatgttccggcgtaattggaaaatgaaagttgctcattgtccccaacggttgatcaatgtacgttaccccaggcattttgggatccttggctgattcaacttcatctgctcgtcgcaaatcaaagtcaaccgcaacgtgataatcacgaactaaagtctcaatatcagtcgtcgttaaatgatttaaacgagctgatcgaattaatgtatgcggtttgatgattcgaccatcttgagtttcaaagccgccaaggtcacggacgttgaaaccaccttcaagatgaatttcatgatcctgaatccgtttcaagggtgtcaccgttaatttttcagatgtcaccgttgtttcttcaacagttgactccgggaatgtggatgaggctgctgaaatatgattatttttcataaaatcactcctcgtattattagatatcgcaaatgatcaacaatgcttgcttaacgtcttgacgccaaaccaacacctctcaattaatgatcttgaagttaaaataattttggtcactcacaacttccaatgtaacaccattatgctaccaatgttttcttttggtttggcaaaaaattggtaaaagttacgtaaatgataaaccggttttctccttattaacaaatgagccctgccgattacaatatgagtcggagctttcatttcttttcaaaattgatagatttgaattttgccttaaaggctcatttaaggttaggctggtataaataatattgaaaatgaaccgctatcgctttagcggctcaataaactttcggaaaggttcgggtgatcgcagaattattatgagtaaaaagagaattgaatggattgacattgcaaaagcatacggcatcatcgcggtcgtgatcggccatgcactggcaagtggcacaacaacccacattatttactggtggcatatgccattattcttcatcattggcgggttcttcttaaaaccgattgatgccgctaaactaactgaatggaaaaggttctttaataaacgaattcaccgagatttactagtctattttatagccggcattggcctaatcaccttgtatagtattttgtacaatgaagattggcagtacctggtcaatcatttatcacgtttaatggttggtggtcgcgccttaaatctctacacaagtactttctggttcatcaacgtctacttgatttcaattgtagcaatcacattattaatttcaacggttaaatcacgttggctgcaatttgcaattgtttctggtggcctgtttctaagtacctgctacgataaatttgattggctgaccttttacaatttcaaaatgatgccgtggaatttagacatcgtgttaatcgcggcattcttcacctacattggctacctattcttacacactgactatagttggattgaaaagccacgaccaattacgctgttggtaacgggaatgggaatcttaatcgccggctatatcaatggtaacttcaactttaagttctcgatgaagtcacatatgatcgacgcctcattgccaaaaatcctgttattagccatgattccactcatcttttcatttggggtatttggcttgtcatatttaacatcccggctttccggcagcttcatcttagcaaccattggccaacatacaatgatcatcatgtacttgcataacgcattgttggatatcgcatcgatggcgggaatcaccaacgtggctactcaagtgatcatcgccgtaattgtgccgatgttaattacgcggataaagcaaccagtaatgcagaatcggagcttgtatttgagctgaatttgcaccaataatttgaaaaaatatgatagtcaaaagtttcgtatcttaaataaacatccatcaaatcaatccgaataatcgggttgacttgatggatgttttagtctaaatcgatgtttacatttctagtgaactactcggtcataaatgaccgagcttctggatcaaagggctgctaagcgcctttcgatcttagaaaacgtttaagcgatgcaacggctaacgccgctgagatcaattagatcttaatgactgtttcgcacccgttttgcacgctcagggtgatacgccaacagtaactcttggagccttaaggacggctaggttctgccccgcc

SEQ ID NO: 672 - DNA, 77294 bp, Unknown
  Metagenome-assembled genome
gggacatcgtttttacttctttctatctgaattattggctaattcaatagtagggcgatgccctatttatatgcaaaaaaagattgataccttacggtatcaaccccaaaaattttagacccttaatttcttggaatagattactatacgaatttactaatcgattttcacgaaagacacgggacaatttccctcgtccaacccgcaattacaacttgtacaaagtaaataaaacgtcataacgccttatgctctaaatatccacagacagcttttacatttctaagacaatttaatttccgtcgccgatcgataattcaaatctcggaagccaatatcttttcgatagtagaactggctcaaatctatttgggcaagctcatcatttaccttcttttgagcagccttcaaagtttccgcatgatcaactatcgtaaagattcggccacccgaactgtataacctaccattttcttcaatcacgccagcatagaaagcatttgccggcaactctggtaacaagatgtgttgctttggcgaagtcggataacctggtgctgctacaacaactcccaagtaaaagtcacccttttgccacttcatatccggcaacttatggttaatcaaatccgtagtaacttgataaaaatcgctctttaattgtggcagtaaaacctgagtctccggatctcccaaacgaacattatattcaatcactttcggccccgcttcggtaaacatgcagccaatataaatcaccccggcaaattccaagccttctttagtcaagccattcattgtcggatcaacaattgcatcaattgtttcttgttgaatcgcagatgtaatatggggaactggcgagtatgcccccatgccaccagtattgggtcccgtttcgccttcgttaatttttttgtgatcctgtgaaattgggaaaataacccgttgcttgccaccaacgaacaacatcaacgaaaattcctcaccggtcagaaattcttctaccagaacttcacctgatttatccaaagctttcttgattgtcggttttaaatccgctgaattcttaacaattgtgacccctttaccagctgctaacccgttttctttgattaccaacggcaacttttgatcactggcataccgaaccgcttgatcataatcactaaacgtttcgaaatcagctgtggggatcccattacgtctcataaaacgtttagcaaacgtcttatcactttccaaacatgccgaagcctgaccgggtccgaatacccgcagaccggcctgctcaaaatgatcaacaattcccattgaaagtggcacttctggtccgacaaacgttaaatctatctgatgtttttttgcaaaatcaattaatttgtcaaattcaagctcgtcaatggcaacactaataatctgatccttagccatccctggattgccaggtgcacaataaacctgatcgacttgtgggcttttggtaaaagttgctgcaattgcatgttcgcgggcaccggatccaataacgaggacgtttgccatagtaaaaatctccttctagttgtgtttagtaacagttatgtatttgtcgggacaaacgtcataacccgctatcccgacgatttgtttttcgatttaactcaaatatttagaaccaggaatattctttggcctggctacctagctgaaacgtgtgaaagaagacagatcccggccatataagctacccaatcaaatattcagaaccagaatattcgattgggtagcttatattctgggatctaaccgtcttctttcacactctggttctagtgcctaaaatgcctaaccccggttgtcactatcgcgatgccatacttatccgccatcgcaattgaatccttatcccggatactgcctcccggttggataattgccttaatgtcatgttgggccgcatacttgacacaatcatccattgggaagaaggcatccgacgccataatggcattctcatagccatcctttggcattgccttttgaattgcgatcttcgccgaatcaatccgatttggttgacccatcccgactcccaacgtcttcgtatcagtcgtcacaatcaccgcattactcttcacaaatttaacgacgtgctggccaaattgaagggctttaagctgcttttcagttggttgcgttttggtcactactttaaagtctggaatttggtcaatctcatgatcagattcttgaatcaacatcccgccactaaccgaaatggtttcaaatcggtcaggttgatcacgatgactcagatcagcttgcaatagccgaatattctttttcttggctaaaattttataagcctcatcactaaacgatggtgcaatgataatttcaagaaaaattttatgcatcttctcagctgtcttggcatcgacttcgcgattcaccgcaataatgccgccaaagattgacattgggtcagactcataggcttcatcccaagccttttcgatcgtgtcagccgttccgacgccacacggattcatatgtttcatggcaacaacacacggttcatcaaattcactaaccatattcaaggccgcattggcatccttaatattgttaaacgacaactccttgccatgaagctgtttggtaatcactgacagttttgaaggaatcggtttccggtaaaaggcggccttttgatgactattttcaccgtaacgtaatgactgctgcttttcatatgtgagcgttaatttctctgggaattcttcttctgttaaataattggaaattaaagcatcgtaagcggcagtgtgtcgaaacactttagctgccaaatgtttgcgaaaatcggcgtcatctgtgtgggctttcaaagcatcaattaccggctgataatcggcaggatcaacaaccgttaaaacaccggcaaaatttttagccgcagctcgcaacatcgacggcccaccaatatcaatttgctcaattgcttgcgcttcagtcgtttctggtttctcaatcgtttgtttaaatgggtaaagattaacagctatcaaatcaatcggagtaatgtcagcatccttaagttgtttcatatgatcgggattatcgcgtttggctaaaataccggcgtgaatttttggatgaagtgtcttaacccgaccgtccaacatctctggaaatccagttacctcttcaaccccggtaactgcaactccggcatcctccaaggcttttttagtgccaccagtggaaacaatttcaaaatccaattctttcaactgttttgcaaaatcaaccaggttacttttatcagaaacacttaaaagagctcttcttgacattaaatttctcctctttctaatagttgttcgacgacctctggatataacttgtgttcagtcgcatgaattcgttgctctaaatccgttaatttatcatccttacgaattgggacttcacgctgcgcaatgacctttcccgagtcaatgccggaatcaacccagtgaatggtgaccccagtggcatcaacaccagcctcatacgcatcttcaatcccatgacgtccaggaaacttgggtaataaagctggatgaatattaataatcttaccttcatattttgctaataacgttggcccgataattctcatataaccagccaataaaataaaatcaatgcttgcggcagccagttgttgggcaatcactttttctgctgctgccttatccggataatccttaaaattaatcacaaaggtgggaatggcttgcctttgcgctcgctgtaacacatgaacattttggtgatcacatactaataacttaacattgagcggtaattgtttagctttaaacgaatcaaccaaagcagtaaaattcgtcccttcaccggaggcaaaaatcgcaatattcttaacgtttgcttgcataactaatcctttcgaatgatgaccttttgagaacctgagataaccttgccgacttggtaaacggtctccccagcatttgcgagagccgcttttacctgatcaacgttgtcgggatgaactgccagtaccatgcccaagccaagattaaaggtatgcttcaaatcatcaaatgacaaattgccaatcttttgaagattagtcatgattgctgggattttccaagtattcaagtgaaattcagctgataaacctgctggcagaattcgcgcaacgttttcgggtaacccaccgccggtaatgtgggcaacggagccgatcaatccctgctcaatcagtggtagcagtgattttacataaatcctggttggtcgtaacaattcatgagctaagtccaaatccaggccgggtaacttgtccgttaactgatagtcatgctgtttaaataaaatgtcgcggaccaaactaaacccattggaatgaagcccatttgacgctaatcccaataaaacgtcgccttgatgcacatcacttgatttaagcaatttcgattgatcagcaatgccaaccgcaaagccggctaaatcatagtgaccatgcgtatacatatcaggcatttcggctgtttcaccaccgactaatttagcaccggcctgctcgacccctgccacaaccccggtcaggatttctttggcttgcgtttgatccagatgaccaataccaagataatccaagaaaaacagtggcttggcaccttgcgccaacacatcattgacacacatggcaaccaggtcaatcccaatggttcgatgcaggttcgccttaatcgcaatcaataattttgtcccaacaccatccgtgccggaaaccaataccggctgctgatattgaccgagtgccaacggaaacaaaccgccaaacgatcccaaggcatcatttttggataaatttttaatttcatcaactaacttgtagccggcattaatatcgacaccggcctttttgtaggcatccattaaattaacctcatctcattttttgtagctgagcctgatcacgatcatattctgcttcataatcataaagtggtgttgggtacttgccatcaaaataggcgacacacaaacccttgtttggcgcgtcagtttgaagatcaactgcgtcaattaaactttgaacactcaaaaatccgagtgagtcacagccaaacatttcccgcatctcttcaatcgtcttattagccgcgattaattcgcgaacatgctgaatatcgatcccgtaaaaacaagggtagcgtagcggtggtgatgcaatccgtaaatgaaccgaagctgctccggcatcccgcaatagtttaacaatccggcggctggttgtgccccgcacaattgagtcatcaaccagaaccacgtttttgccacggacaacgcccttaacagctgataacttcatattaacgccctgttcacgcaactcttgagttggttcaataaatgtcctggcagaatactgattcttcactaaccccatttcataaggcagaccggaagcttctgcataacccatcgcggccgaaagagatgagtttggcacaccaatcaccatatcggcatcgggcgccggttgttcttgggccagcatttcgcccatccgcttacgggctgaatgaacgttcaccccataaatatcggaatcaggacgggcaaaatagataaactccatcgagcaaattgataactgggtatcggtcgtatattggtcaatcgtaataccggaatcatcaattttgatcagctgccccggttgaacatcaaatttgaacgtcgcccccacggcgtccagtgcacatgtctcactgcagacaacatacgccccgtttggcaattggccgacaaccagtggccggaagccgtttggatcaagggcagcatacaaacgatccttagtaatgaccaaataagcaaacccacccttaatcgtgtttaaagcttccttcatttggtcatccaaattatttgcccgacttaaccgaatcaggtgcatcaggttttcactatcagaactggaatggtagatggcaccccgatcctccaaattctttcgaatcgaaattgcgttggtcaaattaccgttatgagccaaagcaaactgcgtatcgctaaaattaaaggggagtggttgaatattttctaatagattactaccggcagttgaataacgaacatggccaatggcagccgttccggtcatgtcagcgaccgcgttgggagagtcaaacacatcagttaacaggccaaaaccacgtttggtccgtagttgcccatcttcattgactgtgattccagcgccttcctgaccacgatgctgtaaagcaaacaagccaatgtaggtcagtttggcggcatctggagtaccccagacaccaaagatcccacattcttcatttaaactttttacttcagcctgcatgctaaagctcccttccaaatatcacgagctgcatcaacatcgatatcaaaatatccgtcagttgcttggacaaacagatgattatcatcaaccactttaccaagtcgtgtggcattctcgccaacaagggcttcaaattcagcctgcttttgcttcggtacggaaacgacaaaccgggattgcgtctctgagaagaattgattaacggttaaatcacttgatagatcaacgccgagctggttgccaaatgtactttcagcaattgaagcgattaaaccaccctccgaaatatcatgggcactgttaagcagttccttttgaatcgcctgagtggttaattgttgaatatgggcttcataatccaagtcaaaatcaaacaactttcctgagatctttccggtttgcattttttgaatctgtgagccgttaaaatcatcatgtgtttgaccaaggacatagattaaatcaccagcttgcttaaagtcttgagttgtaacgtgcttaagacctttaatcaagccaaccatgccaaccatgggtgttggataaattggcacattatcgtattcgttatttaaagaaacgttaccagagataacgggtgcttcaaacttttcgcaagcttcgctcatcccgataactgcttggtccaactcataaaattgatccggtttttctggattaccaaaatttaaacagtcggtaatgccaagtggtacggcaccagaggcaacaatattccgagccgcttcggcaaccgccatttgaccgccaattcgaggattcaaatataagtaacgaccattaacatcggtcgtgatggcaagtgccttatcataatggcgaacccgaacaacagcggcatcggatccgggtgcaaccacggtattggtttgaacctgcgtatcataagtttcgtaaatactttcttttgaagcaatcgttaattgcgccaataattgtttaagggtttccgtcgggttggtaatttgcgggctaaattgcttttgatcaacattttttaaatgctctggaacagctgattcacgatgataaaccggtgcttgagaagcaagtgagtcaaccggcacgtcagcaaccaatttaccgtgatggcgcagttgatattggtggccttcagtaacatggccgataacgaccgcgtcaatgccatgatcagcaaacacgttaagaacttcggcttcatggccggccttaacacataacagcatccgttcttgtgattcagagagcatcaattcaaaagccgacatcccggtctcacgttgtggaaccaagtcaaggtcaaggaccattccgtttccaccagcttttgaacccatctcagcagaggaagaaaccaacccggcagcacccatatcttgaataccaactaaagcttttgcatgattattgatcacatcaagacaggcttccataacgagtttttcttcaaacgggtcaccaacttgaacggcagaccgttgactttcatgttctgaatcaaattggaaagaagcaaatgaagcgccgttaatcccatctcgaccagtcttatggccgacgtagacaatactgttaccaacgccggcagcagcgccaacttcaatcttgtcaagatccatcaaacccacgcacatgacattaactaatggattgtgttcataggcatcatcaaacgctgtgtcaccgcctacggttggcaccccaatacaattaccataggcactgattccggcaacaatttgagagatgaaatatttatcctgatcagttttgggctcactaaaccttaagctatccaaactggcaattggtcgggcacccatcgaaaaaatgtctcgaagaatcccaccaaccccggtcgttgcgccttggaaaggttcaactgcggagggatgattgtgactttcagccttaaaaactaccccttggttatcgccaatatcaataataccggcaccttcacccggtcccttaaccacatgtttgcctttagtgaagaacttttttagaaccggcttggagttcttgtaggaacaatgttcactccacattcccgaaaacaaaccgacttcagtataattcggcaaacgatgtaaaacgtcatctttaattaaccggtattcatgatcggtcaaacccattgctcgatataacttttgatcacggatttgttccggcgtagcttcggttgtttgttcaattactttatccatgagcgactacctctcgatttgccacattgttaacgatcgattgaaaaatgccaatgccatcactagatcccagaacagtttcaacagctcgttccggatgaggcatcattcccaaaacattgccggctcggttagtaatcccagcaatattagcgacactaccattcggattattctgataacgaaacacaatttgattgttggcaactaagtcccgtagtgtttcttgatcacaataataattaccatcaccatgagcaatcggtaaatgaatcacttgaccggcgttaaactgggaactaaatactgaatcagcgttattaacaactaatggttcagttttacaaatgaattttgcggaaacatttttttgcaggctgccagggagtaaccctgcttcggttaaaatttgaaatccgttgcaaattcccagaaccggcttaccacttttagcaaacttttgaagcgcaggcacgattggtgaaaaacgggcaatcgcgccactacgtaaataatcaccgtaagaaaaaccaccaggaattagaacggcatcaaaccccgtcaacgaactttctttataagaaactaattcgacatcttctttgataatatcttgaatggcgtaataaagatccatttcgcagtttgatcctggaaaggcaaggatagcaaatttcattgagcagcctccgtttcagcaatttcgtaatgataattttccatattataattagccagcaacttgtcacagatctcgttaatttcctgatcaagatcagcttttgatttgccatcagccaccgttagttcaaagtacttacctagtttgacattattaatgtcgttgtaccccagccgggtcaaggcactatgaacggcctgggcttcagggttcaaaattgattttttataagtcacatatacttttaccagcgtcattagttaacaccttccactttttcgaggcgaccaagaatttccttgtaaacaggaaccaaagcgcctaatccctttcggaaaacatccttatcgagtgacttcttagtatctcggtcaattaaccgacagctgtctggggaaatttcatcagctaaaatcaactgattgtccgaatcaatcccaaattcaactttaaaatcaaccaaatcaacattcatttctgagaagatttctttaagccgatcattgactttaagtgcaatggcccgcatttgattcatttggtcttcggtagcaacatgaagcgcttctgcttgaaaatcattgataaacggatcgtctaattcgtcgctcttatagaagaactcagtcaacggtttttcaaatttcatgagatgcttaactgcaaatttcttctcgaaactaccggaagctaagtttcgaacaacggtttcgagtggaataatcttaacccgttttaccaactggttgtttgaatccaattgcttaataaaatgattctgaatcccatggttagctaaatcggcgaaaattaaagccgaaatttcacaattagtttggcctttacctgccatttcaacttttttcttaccattaaacgcggtcacttgatccatgtaatgaacccacataatatcggggtcgttggttgtgaacatttctttggctttgcctttatacaacaaatctttcttttcaatatctgcaagttcagtcattttaattttctccttttagcatatcagtggatttcagcaattgatcaatatcattacccaggacggtgacgtggcccatcttacgttgtggtcgaatttcagctttcccataatcatggaaatgccattccggatgctcagacagaagctgccgggcaagtgttagatcagttcccagcaagttacgcattacagctggtttttcttgggtgatttgtggaattggtaagccacaaatacttcgaatatgtgcctcaaactgtgagatgttgcaggcttcgatcgtataatgaccggagttatgtggtcgtggtgccaactcgttaaccattaagtcatggtcatcaatcacaaataattcaattcccaataccccatataggtctaacttattggcaataatttcagcatagtcatgtgctttttgatgaatggtttgagaaaatcgaccgggcgcaatggttgtgtgaagaatatggttcttatgccgattctccacgagcggaaacgtaatgaccttgccattaacgtcgcgggtaaccatgacagacgcttcggcgataaatttttgacgggcttccaaaatacattcggctttcgtataaagttcagcggccgggtcaatatcagccggaccgttaatatccatttgaccgtgaccgtcataaccaccggaaacggtctttaggatagcgggatacccaacttcaccaaccgctttaaccaacgattcacgatcattaacagcggcaaaattagtcaccgggataccacaacttcgaataaagttcttttcattgagccgctcaccagtgatgtggagaagattgacgccttggggtaactcagtgacttgtttggcctttaaaagtgattgttcatcaacattttcgaattcgtaggtcaacacatcacttcgctgtgctaatttcattaatgagtcaacgtcatcatattcagcaacaatttggaaatcagcaacttgcccagccggagcctgtggggtgggatccaaaatgccaacatgataccccattgacttggcaattaacgccatcatctgacctaattgaccaccgccaacaatgccaattgtggcaggtggcaaaaccgtcttaatcaaattgttgctcactgtttttggcctccactctttgatcatgcttaaagtcggttaatttattttgaatggtttgatcattcgttgccagaatctgagcagctaacaaggccgcatttttggcacccgagtccccaatactgacagttgcgaccggcgcgccatatggcatttgaacaattgagagtaatgaatcaacaccatttaatgttcgggttttgattggaacaccgatgacaggcaacgttgtattggcagcaatcattccgggcaaatgagcagcacccccggcaccggcaatgatgacttttaagcccttatttcttgcggaacggccaaatgcctgcaactcatccggcatccggtgggccgagataacatgcttctcataagggataccgaacttttcaaggacctcacatgtcaacttcatagttggccaatcggaaattgatcccatcgcaacaccgacaacgtttgccatctaaaccactcaccttttcaatttatattgtgtctaaataatacttaacgatgattaaaatgtcaataccattgttcgtgttttactggtaattttagcataattaatgaaaaagtatcgtaaaaattcggtaaaacgttaaattttgcttcctgaccaccaacaaaattcgttataacgtcgttaattttgtaaattcaaccaatttgcgaacaattatcaaaaaacacgtcataatatttgccaatcccgatcatgatgactgattaaacagtcacccttttcttgccaatcatattcattgtttctaaatggcggcaactttaaattttccaggatttgccgtgataacatcagccctttcgtaatcccgatcagttgcaaataacatgtgaagtgtaaaacaccaccttatttactcgcattgctcatcacaagccaagctttccacactggctttgatttagtatgttaaaatttaggtgattcggttcaccagaacaattcattaggaggaaacaatcatatgaaatttcgaacacttggtaaaaccggcttttcaattagtgaagtttcattagggacttggcagttgggtggcaagtggggtacaccattcaatcaacaggacgcggacgacactttgcaagctgcttatgatcatggcgttaatttctttgacactgccgatggctatcaaggcggaaaaagtgagcgggcagttggtcggtttgtcaaaacccatcccgacgttcatttcaccaccaaaatcggtcgtaaagaagaaccactaacttctgaccatttcagtccagataatttaacccgttacgttgatgactcgctaaccaatatgggggttgattcgctggatctcgtgttgctccactgtcccccaatgagtgtttattacatgccagataccttctttaccctcgatgaattaaaaaaagagggcaaaatcaagaactacggtgtcagtgtggagcgggtcgaagaagccattaaggcaatgtcatatgatatttctgcggttgaaattattttcaatatgttcagattgcgaccagctgatttgttcttcgatttagctaagaaaaataatattgggattttagccagagtgcctttagcaagcgggctgctgaccggaaagtttaccgccgatacaagatttgccccggaagatcatcgaacaaccaaccggaatggccagttatttgacaagggtgagactttctctggtgttgattacttaaccggtgtcaaggcggcaaatgagctgaagcagcgacttggaaccgataatctggctgcaacggcattaagattcatcttaatgtacgatgcggtttcggcagtcattccaggagcaagtaatccaacccaaattgatagaaatacaacagcagcggatttaccggcattaacggccgaacaaatgcaaattgtaaaagatgtgtacgataagtacattaagaacccggtagcgtatttgtggtaaaaaataagagtgcgtccaataggcgtttaactcccagaatataaatagaccaccccattattccttattctggaatggtggggtggtctatttatatggccgggagttgcctatttgaccacgtttcgacttggttgcctaatagtggccgggagttgcctgtttgaccacgtttatgctcggtagcctaatagtaccccccaaattattaaatattaaccaattagtcacatggccaagagctgtctatttgatcacgttcatactcggaagccaaaaaagcctcagcaacattgaatgcacccattagatcaagcattcaatgtcactgagactttttatttatcaatattaaatttaatggtcttgattgccgggttaaagattatccttcaaaatctggcgagttgaaagccaaaataaaattgcttggactgcgtgatactgcatcaccgttgccttggacgccgacttcaaatcaatactggtgacttttgttgaacctattcgcttttgagctgcctgttcattaaacattcgggcgaagttatcatagccctcctggggtgacgcatccacgagaatccagtttaatccctgcttaatttcagacaacgtaaaaacattcttcaaaagatcaacaacgattgcccctgctaattgcttacgttcatagcccttcgtttccggcgaatcaaggatctgacccttaaaatagttgtgaatcatcgtcttagtaacggtttcaccaatgatcggttcaacataggaattcgtaatatcaagtagttgatcaaggtggaggctaaatccgggcagttcatcccataagggtaacttagcaattgatttttggttactggtcactttaaaaatctcccctatcaactaatcaatttgaacagcaatgccaatcaagccgggaccagtatgcacgcccaatgctggtgaaacattgcctgtatagattttctgctcaggaaaccgattcttaagctcggccgtgacttgtttcatcagcgaatcgtcgtttccctgcgcaacgcccatccgaaaatgatcacttttctgcgcatgagtcactgctaaatccagtagttttccgatggctttcttttcagaacgggtcttggcgatcggataatagatcccctgtggattgcacgagataatcggtttaatattcaacgctgagccaatcaaaccagctactttaccgattctaccaccaattctaagatgctttagtgttgggatgtagaagtagacccggcttttaatgacggattcttcaacccgggtcacgatttcattataagccacttggttgtgaatgagttcctcggcgtaggcggcaaccaaaccactaccaattccaatatttttcgaatcaatcacggtcatcttaataccgtcactctcctcggctgcttgcttaaagactcgattggtgattgataaaccactcgaaattgtaacggcgatgatttgctgataaccacggtttgttaatttttcaatcgattttttgacaattccaacgcttggactagccgttttaggaatctgattatgtgcgatcatttgataaacttcttctggttgaatcgtttctcgatcaagatattcttgaccatttgctgtcacaatcagtggcacaacttcaatgttttcattagcagtaatttcagttggtacatctgaggctgaatcaacgagtaaggcaatttttgttggcattataaatttctcccatacatgtagttttaatatctacatatgtggtattataaaccacagtttccggttgtcaatatcatggcctttaaatgaacattttcacgtgaagaacacctgcttaataagtccctaaacaatgttgacaacttggcctttagccatgattgcttcatcgtgagaaatcgtaattacaattgcatgttttgaaaccgaactcagcaaattcacaacgccctcacgcaatgccggaaaaatatttgcggttggctcatcaagaaagaagaccgaagcagtcggcttactgagggttgtaaataatttcagtaactgccactcccctgtcgataggtttctgatttcccggttcattagcaaatttatgttaaacagatcggattggaaaacattcctaaattcttcgtcctgtagtactcttgccatctggtttaaagacataactgatttaatataattaaccaccgttgtctctggaacaggaatgtcttgtaacataaagccaagcttatttttccgaaaatcacgtaagttaattttggataatggcaaatcattgattttaagcttgccacaatatgtaggttggtaaataccgcttaacgtataaagaaatgtcgattttccaacaccattatcgccagtaatcgtgtatagatgattaggtaaaaaagtaaaggttagtggacgcgaatatagcaatttattaacattatgctgaaaaggcttgatattgaaattagtcacgtttattgagttaactgtctttatttgataatcgccatttttttcatcagcaatgtttaagatagccgatactcgctttaatgacacttgataggtctgaaccgttaaacttgcgccgagcaaattgtcgattgcacttaagagctgagagaaatactgaataattacgataaaaagtcccactgtgatttgcttatgaagcacagccataccaccagcaaaaataaacgtaatttgaaaaatgagttgaatcgcaatttgtgacgtcgataaaccataattgacccaaaagctcgattttgtccttctaaataaatgattttgtttcctgattaagcgccccaactcacttttaaagctttctcttcctttaataccaagataacgaatcattagatggttttttgaagagaagtactcgttttgcgcattcttaaccgatagcgatgttctgtaaatcttactcttaaagaaaaaatagattgccaagtaaatcggaatgaagacggcaataaaaagaaaaattgctttgttcgaaaaaaagatgaatccacacacagcaattccagtgataatgttactggtaagaaaaacccatgtccgactataaaatgaaacaatctcattgacatcatcattaatacgcgaatttaatgtcgttaaatcccaagctagaacgtgtaacgtatcccggccaaacaaatgagaaataattgatcggttaagatcaaaaatacattcttgggattttaagaattgaaccttacttgtgaaatatgaaaaaaataaccggcagccggaaaagacagtcaatatcacaaaataatccaggaaccgcgatctgtctgcctggtaggcaagactgtccacaagttttccttcaaaaaaagttccggcagttgtcataatcgtaatcaaactagaaaaagccattaacacgatgaacgcacctaaatatcttttgaagacttttgttaatacaggattcattcaatcattcacctcttaatcattgaattattaacataataactcaccccacctttattaggaacccccttattaaattaatactattttcatttttattgatagcaaagaagatcccggggcaatttaattttatgattaaattgccccgggatctttggctgttgctcattcaactgtcacgagaatctcaatcctcgtcctcatcttcgtccaatccctctcgtggtgtcttccccaagagtgcctgcagcatcgcgatattatgattgtcgttccccaatagcgttgtcaaatgctgagctaatactggccgatcctctttttccgccaattttattgcccgagttacaaatagattctgtgtattataatcatgaaccaagtcattgattaaccattccgcagactgatatttgttctgaccattttcagtcaacatggcatattcagcaaattctttttgaattgttggtgttatcaaattttcatcaattaacgccgttcccaaagcatcccgttgctgatacgcctgcttcagcaaccccttaaagctgccttttaattcgttggcattaatcccctttacataccatttcatttgttgcagcttgtcagctaaaacgactaggttggcaacaatgtgtcctgtcatcgcgcctgccgttggcgtatgatgatcgatatccgcttgcttaacctcagcttgataacgtttttctggtgtttcagttgtcataatggcacctcactctttcttattttgtcttcacagatttaacttcataacccaaatcagtcaccgtattggctaattgatctgctgaaatttgttcggcatcaaagtccgcctttaccttagcggcgttaaacaagactttgacagtcgctacaccagtttggttttccaatgcgctttgaatcttggtcatacatgacgggcatgataatgcatctaattgtaaaattgctttactcattttaaatacctccatttgttgacttgactttcatttactaagataagccatacagattaacttttacttgatctgcgtcaagttttgacttcttttgtcgataattaatcagtcgcatcgcattaaaaatcacgacaaggatacttgcctcatgaacaaacatcccgcttgccatgtaaacaaacccaagaaccaggccaatcagcagcatgaccaccgttgcaatggcaataaaaatattttcttttgtattgttaacggtcttcttagacaagccataggcatgaatcaactcgtcgaagcctgatgacattaacacaacatcagacgtctcaaccgctacgtcggtaccacttcccattgcgatgccgatgtcggccgtcaccaacgacggactgtcattaatcccgtcacccacaaaagctactttatggcctgcttgttgcgcctgtttcacataggtgaccttttgttctggtaagagctcggcatgaacctcatcaatgccaatctggtcagcaactgcttgggccgtcagttggttatcaccagttaacatcaccgtttttttaatgcctaactttttcagctgttgcaaactttcacgaacaccagcccgaacaacatctgaaataccaaggatcaactgaacgtgaccatcaatggcaatcaggactgaagaacgtccgtgttgctgcatactttttagatcagtccgttgggtttggctgagttcaatttgatttgacttcatcaattcacgattaccaattaagacacgatgctgattaacaactgctgaaatgccacgccctttgatgacgtcacttgatgccggttgcatcttatcgaatgaaacacctgtcgcccttgcaaaattgacaattgctttagccaaaggatgatcggattggttctcaacggccgctgcataggctaaatcagctgactgatcgccataactttggacttgagtcactgctgtcttcccttcggttaatgtgccggttttatcaaacatcaccgtatccacgttcgcaaaagtattcatcacttcgccacccttgattaaaacaccgtgtttggcaccattaccaattccggcaacgtttgaaacgggcgcgccaatgaccaaagcaccggggcatcccagcaccaacacagtaattgccaagcgaaaatcagtggttaacagccccacagccaaggcaataatcaagactgccggtgtataataagttgcaaatttgtcaataaacttttcagccggtgactttgtatcctgggcatcttcgaccaactcgacaatcttgccaaatgtggtatcatcaccaaccttattagcttgaactttaatcgtcccgttatccacaaaagtgccagaatagacgggatcaccaacatttttggttaccaatttagattcaccagtgatactggcctcatttaaatggcctgacccttcagtaattttcccgtcgaccggaatttgggcaccagtttttactagaacggtatctccaacgtcaacaaaatccacatctgtctcttcggcttgaccatcatcattaataaccaatgccgttgttggcgccatctgagttaaatccttaattgaatgccgtgttttggccaatgtcttgtcttcaagaaatgttccgaaaagaaaaaggaatgtgacaattgccgattcattgtattcgccaatcataaatgcgccaataacggcaatgctaaccaacagctcaatgctaatcgttttaaatcgcagtgctgaagccgcccgcagaataattggaaccgccgaaataattgacgcactaataaacgccaatgtataaattgtgttcgaagcaaaagcctttcctaataatccaatcccgattagaatagcagtcaataacgtcacttggttaatatgttgattaataaatcgttgcattttcatgtttgtttacccccgtcttttgattacagccttagtttatctggaaattgataataaataattgatgtaaatcaagattctcaaataaagttattttttaagctgatttactttcatttaacggggcagaaccgatatactgaaatcaacaagtgatacgaggaggatttataatgaaaattatcgtcattggcgctaccggccgtgttggcgctcaagtcgttaccaaactggcaagtgacaaggaaaatgaagtatttgccggtgcccgaacacccgaaaacgttccaagtgcttcaaatgtgaaggcattcaagattgaccttcacgatacaaaggacacaatcttatctgaactaccggatgccgacgcgctgatttttaccgccggatcaggtggtaaagatttactccaagtcgatttaaatggtgccgttaaagtaatgattgaagctgctaaaaaggggatcgatcgttttgtcatgctaagctctcgtgactcactaaccccagattcatttagtggtccgaatccatcaccactggctaactacctcattgccaagcattttgcggatctctggttaattaaagcaaccaactttgattacacaattttgcaacccaccgcactaactgaaaaacctggaagtggcaaagtcacccttggctcatatagcagtaacgagaacagcatcagcaacgttgccgctgtgttggctgcgatcgtccaagatgacagcacgattggtaaaatcattgaaatgagcgacggtgacatggcggttgatgatgcattaaagaacttaatataaaatcgctaaattaacttaatcagtcataaacggttcatttattaagcagccagacagaactagcttcttgataatcatcggttactgatcatcgtgtccggccggttgattaatcagattccaatccaatactagccagaactaaatataacaaaaacagctatttattcgaatgatagatagctgtttttgttatgtttgtgataatttctaacatggggcggttacttgtaaaaatatttttaataattcatttgaatattagatgagttgtttttaggcatttgtgatcggtttcatcttaaaaccgtattaaaattcgctaagaatcagcttaacatcgactagacgaagaatcttgtcaatgttagaatttatgacattaaagcaagaaggaagcgaatgttatgaatactgcaaacacctcatttatgattctgtccagtatcttggtcttattcatgacacccggcctcgcctttttctatggtgggctagtgtcaaagcgaaacgttgttaacaccatgttgtcggtttttattatgactggtgtcgcaatcgtcctctgggtaatggttggttacagcctgtcatttgaaggtaacattggtggtgtcattggaacactatctaatttctttatgaacggcgtcaaattgggtgccctcacagcaacaaagattccaaccggtatcttctctatttttgaaatgatgtttgctattattactccggcattgttcgtcggcgccgttgttggtcgaattaagtttaacttcttattagtcttcttaattctctggtcaatcctgatttactatccaatggttcatctggtttggagtcccaatggtcttttagccggtctgggaactttagactttgctggtggaaccgttgttcatattaatgccgggattactgcgtttgtcttgtcagccttcttaggcaagcgaatccactatggtgatattcctcacacccactacaatttgccatgggttttgcttggggccacgattctttggatcggttggtatggctttaacgccggttcagcattaggtgttgataacatcgccgcacaggcaacgatcacaacaaccatgtcaactgggactgccatggtaacttggatgatcttggatatgattatttcaggaaagccaacgttagtgggggtttgtaccggaacgctttgtggcttggttgggattaccccagcctgtggatttgtaaccatcgcaggctcattctggattggcatgttttcaacattcgccagctacttctttgttaactatttaaaggatcgaatcggtgttgatgatgcccttgatgcctttggctgccacggtgtcagcggaatcgtcggtagtatttttactggcttgtttgcaaccaaagcagttaaccccatcgtcgctcataacggcctcttctacggtggcggctttcatcaacttggtgtccaaattattgcgactctagcaacaattatcttcgtttctattgcagcagcaatcattattaaagttatgagtttggtaatgccaatgcgagttgatcgtaaagaagaagagcttggcctcgatcaaggtgaacacggtgaggaagctgactatactgttcaaatgagtgatgatttaaatgaataccgttctgacctgaatctttactccaaggagtttagaggccagatggcccaacttcaacaccctaaagcacctcatgaataaatgatttcattttaagaactaacaatgcttttgaatttaggtagcgtatactaaattcaaaagcatttttttattgaggtgataagatgacgtattcacgatcagaacacattgaattagttaatatgtgtatgatttataacgaagaaacgaaggaagtcttagttgaagacaaaacagacgttgcctggaagttcggccacacctttcctggaggccatgttgagaaaaatgagagtttggctgatgccatggttcgagaggtctttgaagaaaccgggttaaaaatcagtcaccttgaatcctgcggtaccgttgagtggttcaacgatgatcccagttaccggcgaataggctttctctatcgaactactcatttttcgggtcaactgactcaaagtaacgaaggaaagatttattggtttccgttaaaggaactaaccgaagccaacaccgccgaaagttttatgcagtttctcaaaatttttaccgatccccacaccgtagacgccacttcgccagtaatgaacggctcattaacgataatccgcaagtaagacacccgatacaaatcatattataattgacttagtcaagatgattggtaggaggtgttgacaatgatggaaaagattatcattatcttcaacggaaccgctggtaattctaataatgaagagattgcaaatcgagcgaaaaactatctggaaaagcacggtaaaatcgccacgcttagcaaaacaaattctgaacaagatgcaattaatcaggcagctcaagcagttgatatctacgattacttggttacaatcggtggtgacggatcaattaataccgtttgtgccgggttcttaaaagccgataaaacgattcctttaggtatcattcccggcggtaccgttaataattttgccagagccctaaaaattcctttggataccgataaggcaattgagaacttactaaccgggacacccaaaaacgttgatcttggtcatattgaccgtcaaccgattatcagcagtttaactttaggccgattagcagatatttctcgaaatgttaagcaagccgaaaagaagaagtttggtcgaatcgtctatttatttaaagggatcaaggaattatttaccaatcgatcgtacaagctcaagataaccgctaacggtaaaaccgagacactccgagcacaaattctgctcatcacaaccaccaattcagttggcggttatgttgagttcaatccacaagcggcgtatgacgatgattatctacatgtttttttattaaaaaagtttacacttcctaaaatattaacttacgggtcattctttttatctggaaatttaaaacaggcccgcggggttaaatattttaaaaccaaggaggtcaaaattgagaatctatcatcacgggatattaaaacccgaattgatggtgatccagcaatggcattaccaattactgttcagacaatcccagactttttaaaggttattatgcccgacaaataacgatgaaaaccgttcttcgtatttaataagttggcataggcaaaggccgaacgggtggtccctgccacataaacaagcccaaccaatattcctgaatttgggaatgttggttgggcttgtttatatcctggaaactaaccgcctgttaaatgcactctgttttttatactttctttttaagccagaaatactttttcaagtagtcgttcaattcttttttattaagttttccaccatccggtaggtagtcaatttcattcaaccatttaacaatatcttcatgctccggatcgtctggatcatttaaggattcaagcatcatcagccaaccgccgacaccgccagagtcctctggcggcaaacttccttgaccactaatgactttgggatagccaaccgcatagtcatcgagcaacctgatcagttcaatcgtatgttcccaattgtcaccaagatcataaatatattcaaatcctcggtaattttgtaaatacttatcaatcttgttggataatcgccgtaccttaacttgctttatccctttaattggagattgatttttcatttcttcatacaaggaatcttcaggaatcgtgatattctgctgccgaattaaaaattcgtacaagtgagcatcatcccaccccattacagtttgaatcgtatcatgcagctgcttaaatgtaatatcagatgggatatccaccgttcgtaccacatccggcatctcaccatccatcggtaatgtaattttaatccgatagccctttgtctcttttatttttaatggcattaattgttctccttgaattgatcggttaattgtcctttagtataccaaattatttgtcattaaggataataaggttctgctttagctatcaagaacacattaagagatgttgcttctcaaatcataatattgcagtcaaaaaagcactacgccaaattcaactttgtcgtagtgcttccttagtaactaattatttttaaatcttaaataatcgttagccactcactttttaaaggtggacaacaatcattgattatttttcagggtcagttgcaactaatccaccagccaagttacccaaatctggtttatcggccttaacgattaattgttcgttaacaaacgccatttcaccgatgtggctcatttcacggccgtaacctgacagtttaatgccaccaaatggcaattcaggtaaggttgccataaagttattaacgaataccattccagtttcaatttgtgacgcaacttcggcaccatgatcgggatcgccagcaaagacgattccaccaagtccataaggtgaatcattagcaatatcaattgcttcttgttcactatgaaccttataaacactggcaattgagccaaataactcagtcttatatgccggattatccttatcaatgtcagtaaggatggttggcatgaagaattgtccaggcaagtcaattggcttattgccataaacaacctttgcgccatgagcaatggcatcatcaagttgactttgaagcttattcttagccttctcagtattcatcggtgccaatgtcgttgcaggatccattggatcgccaggttttacggcagcaaacttagccttcaagttatcaacgaattcgtcataaacattatccatgacaataaatcgttttgatgacgtacatacctgcccatcgttatataaccgtgcccgccaggcaatatcattaacctggtccatatccgcgtcgcccaaaacaacaaacggatccataccaccaagttccatagtgttcttctttaagttcttaccagcggcttctgcaacagctgttccaccacgttcggaaccagttaaagcaacgccttggattcggggatcttcgattgcttcagttacttgatcgtaagaaaggaaaagattggtaagcgatccctttggtgcaccggcttcagcaacaacatcggcaaacatttgggcagatgttggtgtattagcagcatgctttaaaatcatcgggttgccaaccataaagttaggtgcaaaaacacgcataatctgatagtatggaaaattccatggctcaaccatcataatcacaccggttgaatgatgttgaatttcagcatcaccggttgcaatggtatcaactttttctgatttaaggatatcagcaccatgatcggcaaaccaatctgcaataatggcaaccaattcaacttctccttgagactcacgataaagtttccccatatcaacagtacaagcttttgataattcatctgaatgctctctcaactttgcagcaacgttatgaaggatcttggcacgttcagcgatatcctgcttcttcatctttttatacagatcatgagcagttgcgatagtgtcttttaattgatcatcggttgcatacggatattccttaacaactttattgttataagggttaacagttcgatatgccatccaaatggcctcctctattatctgaatcgatatcttcaaaacatttctaatgactaaccatttctggggccccaggtaatggttatgacaagaacaagttcttcggcgatatcttatcgtcaaataaagaatatcattcactgaaaacgaatacaatcatacggcttgtgatgttcatcataatcaatttagccaacgctgaccgcatatttccgtgaaaatcgtttacatttcacaatgatcattcatgcatgaattggggtcttttgtgtatctttaatcataaagaccagtcccattgcaatgatctctagaatcaaaaaggtcaagaaaacaccgttaaagttccgatctcctaaaacaacggtagccaaaacaattgctgttgatcccaacacttgccgaaaagtagcaataattgatgatccatgtggaatcaggtcgttagaaagtgagttagcccctagtgttgttgccggcatcatcgcaaaggcatttcccgattcaataatcatggagcaaacaaccgctatccagatattcttaaaccctgaacaaattaacaatagtaaccagccaataatgaataaaccaaaaccaaccataatgactggcttaaagccaattcgatcagctaatcgaccactccgccgatttaaccatgataataaagccgctgccggaactaatgcaaggccggaccacaagggggttaagccaagaatttgttgataataaagcggcatgacaatcgtgaccgtgatcagtgacatatatgaaagtgatgttaatgcaaccccgagatcgaaatttaaaattgataagatatcaagatgaagtaatggctgagacattcgtagttgccgacggacaaacaaataaagcagaattagtgaaacaaccagaattccccaattgacgtaacttgttgctgtcatatgagaaatttcattaataaagtacagcagaccaataattcccaatgacataaatactgaaacaaaatcgaatttagttgattttattttcaatggactcacaacagtttttaatgccaaaagaaaaacaactgttaaaacaactaagaagaagccaaaaatagcttgccaattcatgacttgcagtaacaccccagaaataatcggccccaccgccaatgctgaacccatcaccaagccaacggttcccataactgttccacgctgactttgtggtgtgatttccaaaataatcgattgataagaaggaaatagtaccccgacactaaatccttccattaaccgaccaaccatcataatcggaaaattcggtgcaaaaataatgatcaaagtcccgatgacaaaattaatcaacaagctaatatatagtggcttaaaatggaagttatccatcaaccacggtgataacggcataactactgacataattaacataaatccagttgtcagccaggcaaccgtgctagctggtaaattaaagtatttcataaatgtcgggtatgccgtcgatagcgacgactgactaatcgacattgtaaatgttccaagtagcaaagtggtcacaaaccacttacgacttttttcagttaaggccatttttaaaatcccctagttccatatagtatgatatattgctgatttgtaaggacttcaaaaaaatccacatctggcaacaatcaacctcgaaaaaattttttgtacaaattcctaaaaaacaggaccgaaagttagacttccgatcctgttttttaaagacacataactgcgttttaacgatcatccagtgcccaacataacatgcgtattaatcattaagggttaattagtattccggcttcaattcattaaattaagcataattcaacggttcacatattcagcctatctaacaaccattacagaaattggtgaatacttagccatgtatgcggcctgagacccaaagtacttacgaacacctttttttgaaagtgaaccaacaatcagtaaatccgccttaactgctggaataatttccttaacgataacttcgccaggatcaccttcctcaataaccgtatctacctttttaacgccggctcgaagtgccaaatcacggtattgtttaatatgttcagctaattctgaacgttcaccatggacatagtccttactaagtgcttgataaacattcatttcttcatgttcaagaattgaacaaattacaagcgatgcgcccgacaaacgcgcttcagaaatcgcatatcgaaatgctaactgggcatcaggtgaatcatcaacacccactaaaattcgatgaaattttgtatgtggtgaattttcattgtccatttgatgtatccctcctgtaaacttcaaatttaatcactaatcttctttgctttcatcatagtgctcttccgtagattcaaaacgctttggcattttgtttctgctttgatataaatcataaatcgtccaaataagaagtgcaacaattgcagcaataagaacataagcaatcgtatgagctaatgataccgtacttgcagaaggattggcaccaaagaaactagtaatgttgtctggaagacctttcatgttcaagaaagtcagagcaagaaccgaaacccatccaagaactttaacccacattgtgttcttgaatcgatcacccatttccttagcattatcagtcatcatcaataatggcaacattgagaatggtaaagcaaaggctaagaagacctgcgagttattcattaacgtatttaacgcctcatgttgctgaattggtgattgtttgcttgtcattgcaacacagatcagaacaggaataactgaaatcaatcgggtaaccaaacgacgaagccataatggcatcttcatgtgaatgaaaccttccatgataacttgtccggttaaggtaccggtaatcgttgaattttgacctgaagccaacaaggcaacggcaaataataccgaaagaacccctgatttagcaacggcaatcaaaacgccgttacttaacatggaagaatttgacaaagcttggaacaagccaaagaatgaaggatccttaacagcacctgtcttaaatacggcaacacccataatcaataagagtgagttaaccacaaaggcaaacgatagttgaatatttgaatcccaagttgagaaccgaactgtacgagcaacgtcatcttgatcactatgatcaacttttcgagtttgtgaaacagcggagtgcaggtacaagttatgaggcataacagtggcaccaataattcccaaagcgccggttaatggtgtatcaccattaacatgatcagtgctcgagaaagtttgaccagttggaatcaatcccttgaagatcgcaccaaaatcaggtcctgataaagcaacttcataaacgaagacaaataaaataactaaaatcaaacaaacaacaattgcttcaatttttctaaaaccaactttagtcaataatagcaaaagcaaaacatcaaacacggtgataaacacagcgtagaccagtggaatatggaatagcaaatatagtgcaatcgcggcaccaataacttccgcgatatcagttgccatgatggccaactcagttagaatccacagaacaattcctaaagttttacttgttcgtgctcgaattgcttgtgccaaatccatttgactcacaatgcccagtttagccgccatgtactgtagtaacattgcaattaaactcgacattaagataaccgacatcagtaggtattcaaaattttgaccaccggtgattgatgttgaccaatttcctggatccatgtatcccacagcaactaacgcaccaggccccgaatacataaataatgttctccaaaagcccttaccttttgggacagtgattgacccattaatttcttccaaagaagggccatttgcataatgaatcaaatgttgtttctttggacgtttatcttttaccatttttcactagtacctcctcttaaattcatatccaatgttaccataatttattcctaagtaaatatgattttaggcaaccctaaatttagtctcaggaaacgtaaaaacaagttttgtgatacgtcaacaatgaaagcggttattatattagcagaatttttttaaacttttttcttatttttagtcaatatttcgaattagattgatttttttcaaaaattcgtcaaccacttttaagtcatcttttgaaaattcatccgcgaatccgattaattgctgatccattttttgatgataatggttatggatatcattaatttttaacccattatctgttaattccacatacgtatcctttttattcgttgggcgatgtttctttaaaatcaatgcatcatcagagagtttattaataatttttgagactgctccctgagtcaatgggacgtgatcagcaatatcagaaatccgaatattcgttgctgtaccaatgatttgtagaatatgtaaatcattaatgttcaacttattggcaatcatttcagacttcaaatcagcatttttaattctgctcagaatctgctcgtcaacatcatgactgcgaaatgtctctaattcatctttaattgcatctactaaaacttttttcttcattttattcattcctcggaatatttattgacaattttcagttgcctgctatactcattatattccatggaatataaaattaaaagagcaaagccattttacaagaaagaagaatcttgcttatgaaaactatccttatttttgaccatccttatacgcttgctgccagccacaaccaacctcattttcgaagttatagtgcggctgttgcacaaaaggtcattgatcacctccatcagaaaaatattaacgttgatatcatcgatctccaccaagacaagtttgatcccgtcatgcatgccgaagatttgaataattggcgaaccaaaagatccctaaattcccaagttgatcactattttaatcaacttctccaagcagaccagatcatttttgttttcccaatctggtgggaattaatgccagctatgactaaaggatttatcgacaaagtcctcagtaagaaccgcttgcagtcctcaaatccaagggttgttctgcccaagaatcccaagattacaattctaacaattgccggaactccaacctttctttacaaagtaaagtatggcaatccggttctcaaagcactttatcgcggcacttttaaaaagattggcctaaaaaatgttcactggcataatttcaacgccgaggacgaatctgctaacaaacgtgcagctgatttggaacacatcagtaaatttctttaacattttgcccttcaaagattagttacgagaaaaaagttacttttctactaaaaaagttataatttaggtgaaatatttttagtgggagagactcaatttgaatttagcaaaacgtattaaccaaatttgcttgaccatcatcgtgggattaatcatgagcctgctaatgaccagtcccatcaatgccaatcaatcacaacctaaatttagcggcactaaaattaaactttcaggaacatccaacacctacgaccttggtggcattcaaactaaagataatcggtatatcaaacagaaccgactcatccgatccgatgccctgggcaccctttccagccatgacaagtggcggttaactcaacagcatcacctaatcgttgaccttgatttccgatcagccggcgaggcacgccagcaaccggataagaaaattcctcatgtcacttaccaccgccttagtgtcatgcccgaccccaactttggtgtccatactcaacgacaatatgctaaccagttagctttaaaacaccccaataacatgacgcttttttaccagaaaatggttaccaatgaacacagcatcaaggcctatcaggcaatgtttaaacgcctgctgcagcaaaatcacggtgccgttctttaccactgtacttacgggaaagatcggaccggcattgcaacgatgttaattctctcgagtttgggtgtcagaaaaaccaccatcatgaaaaactatctccaatcaaatcaagcattaaagaagacaacccataaagaaatcattgcgatgaaaaaagtgactcacaacagaaatgctttggcgaacctcaaaagatccagaaccgcccgccgttcgtacctggctgcggcctatacggcaattgatcaaaagtatggatctatcaaacattatttaaagataaaaatgagactaaccaaaacggacattcagaagcttaggagattgtatttaacaaaataaagcggtgaggtgagcaatcggttagctctcaaaatacaaacaaacagagtgggccggcaagcggttagacctcagaatataagcctcctaatttgatattcccgattttggaatatcaagttaggaggcttatatggccggggtctgcttgctggtccatgttttaactaagtaacaagttcagcgagatattctgaatttgaatatttggataattcagttacgcggcagaaagttgtcttttggcggctctttccatactctagtgaaattttgatgatgatttttaaacttcaaactgaaaacgaaataacctggcaagttcaaacaattttcacctgatttaattttgagttatcacttcaccatggaaagagcccttttggcgcacgttttctgcggtaataatcgtgattacacaaatggggctgggacaaaagtaattttgtcccagccccatactacctgttagattatcgtttcaatctataatgcttgcggtccaaaaagccggataggatgatatttttctcaaccgtttatttcccgttggaattgctgaatatcatcagataaaaaatcattttcaaccaggtgaggtacctacaaagctttaatttttcaacatttgtttaatctttgccaatcgcaactggcaatgtggcatatacaccatatccgatagccacagttgcttcccacttaatcattacgttctatttttaaactcactgtgtggcttccctatttgtatccaatctatttttggaataaatttggttaatcttgtcaatcaacttcgtattatgattgaatttagcaaaagcataagcgtcgtttaatgcctcgcgaatcattttaaagtcagtcttttgagcaatcaagttcaaggccaattgatactgagcccgtgcaacataaaaagtaacgtgttgcttcgaactcacctcaattaaagcccttagcaacgcatcactggtcactaaatcctgctgtgtagcataaaaatggcccgtataaaataacatcgtcaagaccttccacgtcgtgtcaatatcagcatacgatgccttctttaatcgttcaggcattttcgaaaagtaaaaggtcgctttatcgacgtttcccgcatgttcataagaaatccccataccaacatatgccaattgagaataaatggtactatgactttcatcatacccattcaaaatttggtcaaaacaaaaaatagcttcatcaatgtttgcgtcacttaaagccaataaatagcccttgataaataaatattccatttttgtatgatcaatttccattttatcaattgaaattgcctgtaagatctgttgtgcttcatcgtactcagtcgtaattaaatcgaattctgcttttcgcaaatcttcacgaacttgtgcatccccctcagcagcgcttggaaagatatcacttaaagataggcctaatcgttgacatagttgtgttaaaattttggttgaaatcattttgccgttgttctcaaatttactaatcgttgcctgagtacaaattcccttggcaagctcgctttgagaatatcctaatttttttcttcgctgaacaaacttttcaatattcattgtctgagctccttcgcacttgaccagtttttcaaattcgaatactcgttatatgctcattatagcaaatttctatatataaaaatatattaacatttggaatagtttaagcttgtcacaattgcccaaaagaaaggttgggacaatagtcattttgcccagcctctgttagtatatacacgattgttgccaaacaaaaaaacgggatgaaaggcaacttccggccgtgtaaccgaattatccaactattccgttcagaatattcagataatccggttacactccggtagttaagcgccttttattccgctctgtttagccctacacctatattttgtcacatgataaaccagtagttcaaaatgaccaatactcgtcacaattttttaatcaaaattaagcatatcttataattttcgatctgggttcagcacgttattgggatcaaacgtcaatttaactttcttctgtaaagccaccaagttctgacccaactgtggtaatacccacttctctttcaaatcgccaataccatgttccgcggaaattgtcccgccaattgattgaacatatttaaagatttgattaatcgcgtcattaacatcatcaggcgtctggtccaactcctttgacaccgcaaagtttggatgaaaattaccatcacctgcatgaccacccaaaaacgccgtcacgttggatgaaaactttagattttcaacgaactctgctaaatcaggtaattttgagagtggcacagctacgtcttcaacaattaatcgcccgtaagctgcttcggcttgatagtagtcttgacgaattttgatgattttcttagcataatcaggatcatcagtaacattaactcttaacgcccctgaactctttaagatctttttaagcgcatccaaagccccggccggtgcaacatccagttggaaaatcaatagcgattcagccccaccttgaccaagatctgaatgttccaaacgatccaatgcttcaatcgaagtcttattaagggcctccatcattgaaggatacaaaccacttccggaaatattctgaacccctacacttagttgcttcatgttggcaaacgttgcaaggccggttacgggattaccaaatggaaccggcagtaatttaacagtcgcttcgacaataatccccagcgttccctctgaaccgacaaacaagtcggttaaatcatatggcgcgttgttcttgaatgttttaccacctgtctcaacgaccgtgccatcagccaaaacaactttcaacccaattactgactgttttgtcgtgccgtactttagtgaactcatgccaccagcgttagtcgcgatattgccgccaactgaactaattggctttgaaccaggatcaggcgaaaagaaatacccttgttttcgagcttcattatccaaatcagaattaattacccctgcttgaaccacggcatattgattaggaatattgatttccaaaattttattcagctgattcaagtcaataattaagccatttttttcagctgctgacccattcacaattgaagttgctgcagcccgcgcagtcactggaattcgatgcgcgttagcaaacctgacagctgcttgaacatcggcagtgctttgagcttcaacaactgccaacggctgattgacagcctcaattgcttcagtgtatttatcgccactaaatttttgaacctcttgtgcgtcggtaataatccgaccatctggaattgttaattcgtcaataactgttgccatttcttatctcgtcctttcataaataaaaagtcctttatcaaactatttacagtttgataaaggacgacgttgccgtggtaccaccttactgaatgcatttgcacccactcattgtgtgataacgcgcagctcgcgaagttaatgattatttttattaattatccataaagaccatattcgctaaattccccattgcatctttcagccacccaatgcttctctgaaataggaaaaacagctactcatctttatttaatataattttattatgaatatttcatgaaaaaatgtcaaatacttctatgactcttttttggataaatgtctttattcatagcaatttccctaggagttataggaaaagtccagattttaaaaaccgtttatgaaaaaagtcgttgacaaattaaaaaatgttgagtatagtttggacaacaaattacggaggtgtcgtttatgacttattttatgtttaatgcaatcaataactgttgtcgaacaacgcgtttttggcgatgttcggcctgttagcattgacattttttaagggataacgacctaaaaaattcaatgcccattcagggcttgaattgaccaagggcgcgagaattcattacgaattttcgcgccctttttctatctaaaatttagcaataatcaaaaagagggaaaaatcatgataatcaaatctgtctcacaattaattggtaacacaccgttaatcgacttacaaattaacgttcccaaccatagccatatttatgccaagcttgagatgtttaatcccggcggtagcattaaagatcggcttggccagtatttaatccaagatggttttaaccgcggcaaaattaatgatcaaacgaccattattgaaccaaccgctggtaataccgggatcggtgttgcgctagcagcccagcagtatcatttaaaaactattctggtcgttccagagaaatttagttacgagaaacaaaccctgatgaaagcgctcggtgcccaattaattaacacgccatccgccgaaggaattaaaggcgccattaaaaaagctcgtgaagttgaagcgaatacgccaaacagttttgtcccaatgcaatttgagaaccccgccaatccagccacctactatcacacattggcaccagagttgcttgcagatcttgacagaccaatcgatgcctttgttgctggtgccggtagtggtggcacatttgccggcattgcaaagtatcttaaggaacatcattcacagacgcaaacaattgttgttgaaccagagggatcaattctaaatggtggtcccgcccattcacatcgaacggaaggcattggtgtcgaatttgtaccaccattttttaaaagcgtcgaaattgaccaaacattaacgatttcagatgacgatgctttcaaacaagttcgtcaaatggctgaaacccaaggtctatttatcggcagttccagtggtgcagctttagcagccagtttaaagatcgcgaaaggattgcctgagaacagtaccattgtgacagtttttcccgatagtagcgagcgttacatgagtgagcacatttatagtccgaacgaacaatctacagaaatggtttcacgttgacaagcaatttaccacaaaaatcacctgcttctcaattcaaatacaacaataaaaatagcgaggtaactgatatggaatttgatactaaattattacacggtggcattagtgaagacaaagtaaccggagccacttcaatcccgatttacatggcatcaacctttcaccaacaaaaaattggtcaaaacaagtatgaatattcacgttctggtaaccccacccgtgaagctgttgaaaaattaattgccgatcttgaaggcggcacggcaggatttgccttcgcttctggatcagctgccatcgacaccgttttttccctgttctctgccggcgatcattttgtggttggcaacgacgtctatggtggtactttccgtctgattgatgccgtcttaaaacgatttggcatgacatttacagttgttgatacccgtgatctcaatgcagttgaagcagccattacaccagcaaccaaagcaatttatttggagacgccaaccaatccactactgcgggtcacagatatcaaagcggttgcggacattgctaaagcgcacaacatcctcagtatcattgataacacctttgcttctccctatgtccaacggccccttgaatttggtgtcgacattgttttacacagtgcatccaagtacttgggaggccatagtgatgtcatcgccggtttagtcgtaacaaaggatgctgaattagccgaaaaagttggctatttgcaaaacgccatcggtggtatcttggcccctcaagaaagttggctgcttcaacgggggatgaagaccctctcactaagaatgcgagcccatttagcaaatgccgaagccatctttcactacttagccaatcaaccgctagtcagtaaaatttacttcccaggtgatccggagaatccggattatgacgttgccagaaaacaaatgaatgggtttggtgctatgatctcatttgaattacaaccaggactcgatcccaaagccttcgtcgaagaactccaggtcatcacattagcggaaagccttggggctcttgaaagtctcattgagattccagcattaatgacccacggctcaattcctcgcgatatccgtttaaaaaatggcattcaggacgagttaattcgcctttcagtgggcgttgaagatcaaaaagatttgttaaccgatttggaacgtggattccagaacctgcaagggagcaaaaataatgtttcaaacagcacggtccattctgaagcgtgatccggcagcccatagtctaatcgaaattctattgacatatcctggtatccacgccctgttctggtatcgaattgcccactttttagctgaccgacatcattacaccttggcaagtttgatcagccaattcagtacccgacgaaccggaattgcaattgcaccggaatccaaaattggcaagcgagtctttatcgatcatggtattggcgtcgttattggtgccacagcggttattgaagacgacgtcacgattttacacggcgtgacccttggcgctcgacgaccggttaacggccgccggcatccccacatcaaacgtggtgcttttattggcgcaaatgcccaacttctaggtaccattactatcggtgaggccagcaggatcggcgccggtgcggtcgtgttgtcagacgttccggcgaatgcaaccgcagtgggaaatcctgccaaaatcattaataaagcagttcccaaaattatcaatgtcaccttcaatcagcagtctaaatagctgattaaaagccccatataatcggtattttcatcacaactaccgatttatatggggtttttcattgatggtgcttaatgattaactggcaacaactcccaacattgccattagttggccggcctgccacacattaatctttaaccctttaatgttttccggcgtaatgattaacgtttcaaacttagctttcgacaagtcaacaccctttaatttcgtatcaagaaaatcaatttcgttgatctggctgccgtcaaattctaacgcttttttgacagtgacagcttgaaagctggtttcatttaggtttgaattaacaaagcgactattttcaattttagtttcactaaaatttgcatactataggttggaatattccattcgagaatttttaatccgggttccgattgaaaaatcagcacccattaattgagaattaataaattggcagttagcaaaatagctttcgtgaaatgttgcattcaataagttaacgcctttaaatgtcacatatccccaatcaccacgatcaaagttggtctggtcaaattgacaatggtcaaataccacatcattaatccgaatcagttcattagaaaccgtcatatgacaattcacataactattttcgggttcgacgtcatccaagctgagcgtctggtcattaatcgttgtcatctacctatctcctatctgcccaatcgacggcgctttcttattgccacaatattcttcaaactaaattccatcatgaaaatagcgaccacaatcaaagccccaccaattaacaggttgcttgttagcggatcaaatcccattaaaaccgaaaagagacttccaaacagtgattctgtcatcaagatcaggccagaagaggttgaatccgtgaacttttggccgactacctgcattgtttgagcaccaaatgacgcaaataccgctaaaatcaggaccggccaaattgaaacggaccagttaatacttgaataatcaccccgttcaaagataagtgaccatattagactggcaactccttgaacaattcccaacataaaagcaactgtgaatggattagattcagctgctttactgctaaaataaacaatttgggcagcaaagacaaatgcgctcagcaatgtcaacgtatcaccaatcttgaaattaaatccggtctgaattgtgtttgttaaaaacagggtgccaacaaaacaaattgcaatggctaaataacttttaccagccggtcgttggtgcaagaaaagccaaacaataaacgggatcatgaccacgtacgttgccgttaaaaatgcgctcttactgggcgttgtgtaatttagaccaatggtttgaatttggtaaccaaggaaattaataattccggcgatcaatccaatccggaaatcatcccgggtcatttgccgaatgattcggtggaaaaagacgaatattaaaagggcataaatgaacccccgaatggcattcatcatccccgccgtcatatgtccttcataagcctgtttaataaatgtataggttgttccccaaatcatggcggtgagcagcagcatgatattagcctgccatctagctagtttcattttttaaagcccctcttcattaaattttgcaaaacaaaagccagcaacctgcttgggttaccagctttctttttgatccgatatcgtgtttgaaagccatcttcaatgatagcataaccatgtcacatttaaacgcgatgccgataaaccatcttgctaacgaagacgtaaatgacagcagcaatcagcattgaaataaaggttgctcccacgctgtcagctaatacaggaacacgtttaatcaatgcataggcgatgaccgcaatcaaccaagagccgatcgcaacccagttaatcccaccggtataccaatacttacctgtccgtgaggcaaaatgatcgatccgatagtcctgtttggcaaccaaataaaagtcgacaagaaaaattgcgatttccggccccaagaacattccgatgccgtccaaaaaagcggtaaaaacatccaagaacgtcgcataaaagattggaataaaggtaacgaagaccgccacaaccgttaccgatacgatactcaccgttaaagaaagtcgtttggtcatgttagtcaacgcagaaccggccgacatgagattaaccgcgttggccgttgtacttgtaataataatgaccagcatggctaacacaccaaggcccagtttactggcaatcgttgaaggatccgagttattcgcatcaaaatgattcaacgtaatcgccgtagcaatcgttgaaatgactccgatcatcgcaaaccaaatcaaacccaggtttgcgccaaaaaacggtgcccaagttgagctggttttctttttagcaaagcgggtaaaatcacttgtcgctgtcacccatgctaaattaaaggctgccaagacatcaacggcctggcccggactcatttttaaattaaccggtggccgccaggaaataatttctgagagcgaaacatgctgaaaaacaacgatcgattcccaaataaccaaaataaaaactaaaacaatcccaacccgttcaataatttgaaccgaccgctcacccattgagatacttaataaatgaagaatgctcatcacgataatccctaagatcaaccctttaaggccacctggtttgccataaaccggccaccctaaaacatcatgaagaatgtaactaattgacgttgcggcaatgaaagtattcacggctgcccagccaatgaattgaacaacattaatgagggatggcaagaaactccccttcaatccaaatgaggcccgggttaacgccattgccggtaagccggtttgataacccatatatccagataatgccaataaaatataggtcaccacaccaacaataattagggtcgttgaagctgtcgcaaatccacaggccgcaataaccccaccaacataccaagtcccgttgttcgcattggcgccaacccaagtcgcaaacatatcccagtatgattggtgtcgatggtctttaggaattgattcaaccctgccaaaacttttatccgccattcgtttttctccttactgtttagtcatcaaaatttttcacaaaaaatgcccttcactcaacgcgagtaaagggcacatttacccagactatcactgggaacagaacaatgttcattaatggcttccttaacagactcgctggactatttaaaggacataaatttacttgtcattatacgggagatggcgccaaattgcaatttgagttgaatttcaagaatgattattttgttatcggacaactggtagcattgtttacccgattgcgatttctgccaacagtgacataaagaacaactttttgatggcgcctcatatcctgattgaaaccaccatccatttaaaaaatatgtcacaaaaaaagcgcccgagaaggcgctttttagaatcacttaattgcttaatcagttaaatttttgatttattgagccaagtagccaccatcaacaacaaactctgcaccggttgcaaacttcgattcattagatgccaagtagacgcacatccaagcaatatcatctggctcaccaatatggcccattggtgtcttggttcgtttcgacatttctttttcagcatccaagtcttgaaccaatggtgtcttgatgtagcctggatgaacagtgtttactcgaacatcatagtccttcagagcacaatccaaagcagctgatttggacataatccgaacggcacctttagaagcattgtaagcacccaagttaggatcaccaacaaagccttcaattgatgacatattaataattgatgcgcccaaccctttattcttcattcgctggatacctaaacgggttccaaagaagacagcgtcaaggtttacagccagtaatttacgccattcctcagtcgttgtgttttcaacactcttaccaattgccatcccagcattattgactaatgtcgttactgggccaaatagcttctctgtttcatcccaaagatcaacccaactttgttcctgtgttgcatcacatttaacaaaacgaacttgatctggcgtaccaatttctttagcagatttttcaccaacatcggcatgacgaccggtaataaccactttagcgccttcatcaacgaaccgacgtgcgattcctaaaccaattcctaaagtaccaccggtaacaattgcaactttaccttttaaacgatctgtcataataataacccgctttctatatataaattaataattccttctacatgtgaattgtatcacttattccattttatgaaaaggctttcgttttttaaatgagcatgtgttcacccccctaccagcactaaaggatcgtgaataatcgaattatttccaccatttaatttttgattttatttgataatcgttttgcttttatttatcacaacagactgttgttaatgattcgccgccatccgtttatgcattccataacaggggatgggaaatcagtatgactattcaatatgcgacaatcggaaataagaatcagtttaactaccatgaataaccacaaaaataatcatttaactaccagtaaactaattccaaatcaaattgagcaaattaaaaccaaagctgctaaaaattcacttattcattcttatttccaagcactgccaattatcacagctgtccaattattaaagttagcagaccagtatcccaaaaattgataattattttgaaactctcaacggcctatttcctgttatgccagcaaataagatcatttatgccatcgactctatagatggtttcaacataacagttgacaaatattaaaaagtcgactactattatcattaaattttaatgctaatccgattagggaaaagctctgaagagaagagtaactgatttaacaagattcaaagagaatccggttggtgaaaaaggatatcttaacaatcagcgaatatgaactctgaatagtgcaattaagttaacgcttggttgtcggctgtgaccgttaactcacagggtatcaattatgagaatttggaataattggcactttcagaggtattgcttgcgagagtaatacgaattcagggtggtacagcgaagcattcgcccctccgtcagattatttctgatgtgtggggacgaatgcttttttatttgctggaccgctctaagggattttattattcagcagtgactgttaagatagtaactgtaattaataaattttaaggagatatgatatcttatggcaaaagttgaaagttttacattagatcacacaaaggtaaaggcaccttacgttcgtctcatcactgaagaaactggaaaaaagggcgacgtcatttctaattacgacttacgacttgttcaaccaaacaccaatgccattcctactgcagggttgcatacgattgaacatctcttagccggattacttagagatcgtcttgacggggttatcgattgctcaccatttggctgccgaaccggttttcatttaattacttggggtgaacacagcaccactgaagtcgcaaaggctttgaaggggtcactcgaggcaattgccaacgacatcgaatggaaagacgttcaagggactgacaagtatagttgcggtaattatcgtgaccattcattgttctctgctaaagagtggagcaaagaaatcttgtcacaagggatctctgatcaacctttcgaacgccacgttatctagtttctgaaatgatccattaatactgctttttatggacgctacaatctgacaaagattgcagcgtctttttctttaagctttcccaaatgattagcgaaaatcagacactctcattaacaattgcgcacttaaatcaaggaggatttaacaactatgacaacaacaattattgggttcccacgcattggccatcaccgtgaattaaaatttgccactgagcattattggaaaaataagattaaccaggaagaattacaacaaacagcttacgaaatcagaaaaaatcactggcaggctcaaaaagatgccggcattgatctaattccagtaggtgacttttcattctttgatggtgttttggacactgccaacctattaaacattatcccttcccgttataaagatcttcacttatccgaattggacgaatactttgctcaagcccggggctatcaaaatggttctgaaaccgtgaaggctctcccaatgaaaaagtggtttaacaccaactatcactacattgttcctgaattttcaaaagaaactaacgttaaattagttggcaataaattgtttaatgaaattaacgaagcccttgaacaagggatcaatgccaaggctgttgttatcggtccttacacccttttgaagctaagtcggtttattgaagacactaagccccgagattatgttgaggcgttggttgaagcttacaaacaaattattgaccgcttgagccaaaagggcgttaagtggcttcaaatcgatgaacccgctttaagtttcgacgttgactctgttgaaaaacaactctttgacgacttatatgacggcattcttgccgagaaacgatcaacgaagattcttttgcaaaactattttggcgatattcgtgatatttataatgatgtcacttcaaagaactttgatggcatcggtttggatttcgttgaaggcaagtacaacaatgagctgttaaaacaaaatgggttcccgaatgataaaatcctattcgccggagttgtaaacggtaaaaacatttggcgtaatcattacgaaaataccattaactttttaaaccagctcaatacaaaagccccggttgtattaagcagttccacatcccttctgcatgtcccatacactgcagaagacgagacaaaactgcctggcgatgtaaaacaacatcttgcttttgccttacaaaaactggatgagattaaagaactcgataatatttatcatgatgaagcggatggtaaaattgctttaacgaaaaacgacaacctgtttcaaagcgttaaacatccagtcaaccccgttgttcatcaacgaattgccagtttaagtcaggctgattatacccgtttgccagaacgcagcgaacgtgaaaaaattcagaaaaaagaattcaatttaccagttttaccaacaacaacaattggctcattcccacaaactaaagatgttcgtcaaaatcgttcaaaacttcgcaaaggtgaaattacccgtgaacaatacgacaaatttaacgaagataagattgttcgtatcctcagaaagcaagaggaaatcggtttggatgtccttgttcacggtgaatatgaacgaaacgacatggttgaatacttcggtgaaaagcttgacggtttcgtctttacgcaaaacggttgggttcaatcatacggtacccgaggggttaaaccaccaatcatctggggcgatatctctcgaaccgcaccaatcaccgtaaaagcttctgtctttgcgaaaaaccacactgataaattaatcaaaggcatgctgaccggtccggttacgatttttaactggtcattcccacgtgaggatgtttcacctaaagaatcagtcacccagattgctttagcccttcaagatgaagtcctggatcttgaaaaacacgacatcaaaattatccaaatcgatgaaccggctttgcgagaaaacttaccgttgcgtaaatccaactggtattctgaatacctcgactgggcagttccagccttccggttagtccacagtaaggttcaagcaagcacccagattcatactcatatgtgctacagtgaatttggcgatatcatcaaggcgattgatgcactggatgccgacgtcatttcatttgaagcttcccgtgccgactttaccttaattgatcaacttgttgctgcaaacttccagactgaagttggacccggtgtttacgatattcactcaccacgaattccatctgaaaaagaagtcgaggacttgatcaaacaactcgttcataaactaccaattgacaagatttggattaatccggattgtggcttaaagacgcgaactgaagaagaatcctttaagagtctacaaaatattgttgatgcaacgaagaaagttagaagtgagataaatgagcctaacagcgttatttaaaaataaaactgtcttttccctggaagtcttcccgcctaagaaagactcgcccaaagaagcaattttaccaacccttcaacagctccaatcaattaatccggattttatctcggttacattaggggctggtggatctgaccactataccggtaccgttcagattgctgatttaattcaaaaccagctgaacatcccggcagtcgcccacgtccccggattgtaccaaacccgcgaacaggttttaaacctactggataatctctcagaaattaatgttaaaaacattttagcccttcgcggtgataaaattcccggaaaacaaccagttggtgactttaatcacgccaatgatctggtagcctttgttcatcaaaatcgaccagactttagcattgccagtgcttgttacccaaattgtcacgctgaggccactgggtttgttgatgatattgcccatttaagaaccaaagtcgatgctggcgccgatcacctgattagtcaactatttttcgataatcaagctttttatgatttccaggaaaaggctgaaattgccgggattcacgtcccaatcgaagccggcatcatgccttgtaccaacaagaaacaaattgaacgaattactcaaattacaggggttccactacctaagaagttcagtgctattttagatcgttatcagaacagtagggaagcaatgcgggatgccggaattgcgttcgctgttgatcaaattatcgatcttgtttctgaaggcgttgacggaattcacctttataccatgaatcatgccgacattgccgaacgaatctggaatgcgactaaatcagtatttgatgctgctaatgcaagaacccggacaactataaagcaccgctcttaaaaaacagagtgggccagcaagcggttagaccccagaatataagcctcctaacttgatattactgattttggaatattaagttagggggcttatatggccggggtatgcttgctggtccacgttttaactaaataaaaagttcaacaagatattccgagtttgaatattgagataattcggtgacacggctggaagttgccctttggcgcacatttccactcggtaataatcgtgattacacaaataaggactggataaaattacttttatccagcctcctttttgcgccctcaacattgcaacgaaataaccgatagtcatacggcttaccaccggtcatgccaaatacactgcgaaaattaaaaatagtaatgcaatgatgcctaaaataatagccattgcccggttattctcacgacttctaaaagcgtaataccccaggaaaattgcaaacaataacgaaatcagcatgatccaaaatcccatttgacatccccctcatttcaattacgcgacttattccaacgtttatttagcataattagttatcaactccagcctatccaatcattaatgattaatcaacctcaaataaatatgacggtcatgttgtctgcaaccgtctgtcgtatcccttatttgtcattggtttattagatagaaccaatagaagtgtaaataattgcaaatgcttttggaaccgattacaattcacttgcagtagtggaagaatgtttgatttaatcttatagggggatttaattatgacaacagcatttgcaagcccatcgacttatgttcaaggtaaagatttattgaagaccgcttcgaaatatatcaaaccatttggtgatcatggcattttgctaaccgacgatatcgtttggggattagtcggcaaacgattctacacttacttaacagatgatggtttgaaaattgaacacgttcagtttggtggtgaaagttcaccggaagaaatcgaccggatcaaagcaattgccgctgaaaacgacgcccaatttatcatctcattgggcggtggtaagactaacgatacgaccaaagcagttggcgaacaattaaaaattccaatcgtgattacaccaacgctggcttcaaatgattcaccatgtacccggctcagtgttatttactcagaaaatggcagtttcttaaaatatatgttctatgataagaatcccgatttggttctggttgatacttcagttatcgcgggggcacccgttaaattcctcgtcgatggtattgctgacgcattatcaaccaacgttgaagctcagaccgttcgccgagcacggcaaacaacattgctgccactgaatacccaacaaactcaagccgggttggcattggccgaaaaatgtgaatcattattgttcagatacgctgaacaggcagttgcagctgccggtgatcacaccgtaacccctgcattggaccacattgtcgaggctaacattttactcagtggtgttggtgccgaaagttccggtttagctgcggctcacagcttccaaaacggattaaccgccctctctggtgacgttcacaaaatgtcacatggccaaaaggttgcttatggtaccctattgaacctggttttggaaggtgccagtgacgagcgcttgatcaagttcttaacgtttgaacatcactttggcttgccaacaactttaaaggaccttcatctggaaaacgcaaccgacgatgaccttcgcaaagttgccgaattaactactcaaaagggcgaaaccattcacaacatgggctttaatgtaactgctgatgatgtcttcaatgggatcaaggctgttgataccttctcaagaaactattttggcgaaaattaaaagtgtgtgaaactattttttaggccaatatgtaacctaaataaaatgattacgccttctaacttatgactttaattgtctcgtgatcatcaaaatattttcctaaacattagtcgttctttacttaattttaatcggtaagggacgatttcttgttctaaaattataaactgcttgacatcactagcatgccctttccgttttccgtgaaaacgcattcttttagtaaattaagttcaccctgcgtacattgtattcattttaaataatgataaatagattgctaacaaattgaatttatccgtataaaataagtgtttatagtttcacaagcaattcacttgtgtatttgacatttgttatatttatggtaatatagatatgtaagtaaatgaggtgaaagcctatccagttcaccaatcattgtcacgtggatataaagggggaaaagttgctatgttgaatttatatgttgcaccaagtagcgcttcaagtcgaaaggcccgtaaatggttaatcgacaatgggatcgaattcaaagaacgaaatatttcaagaatcccattaactgctgatgaaattaagcaaatccttcgtttaactgaaaatggaactgaggatattatttctacccgttcgaatgttttccgtaaattacacgtcaatgttgaggacttaactgttactcagttaatcaatttgatggttaaataccctgatttgattcgtcgaccattaatttttaacgacgaacaactgcaagtcggctttagtgaagaagatattcgtagcttcctaccacgaaaagtccgtgaagatagtctaagagagttaatgcaaaagattagttgaagagaagttgtttttcagcagaacattcaatttaccgtttattcaagttaattatttcatgttaaaataaaaaaacgaagctgatgcaaaagtaattttgcccggcttcgttttttatttacgaaaaaagttgtgtcagaatatttaaacgtctagagataaacggctttggtcacgttaattgccaatccccgtcctctcaaaatcattttgtagccgttgcgtcattctttttaagggtgatttcaaaaataagccgactaacagtgaaaaaatcagcataaacgttaatatgaagaaatctacgactaccgtttcaatattgggaccggcaatcgcttcccggaagccactcacactataggtaaaaggaaacatcggttgcaaaattctaaaaatcaatggattcagctggactgggtacattgccccacttcctgctaattgcagtgccaccatcatcactgccagtgccttgccgagattgccaaagatagctaccatcgtaaaaacaatcattgaaaacgttagtgatgacaaaacgccagtaatcgtcatcaaaaacaaatttacaacgtggacatgcaggattaagacagttgacagcacaataattcctgtctgaatcaacgataaggtgagaaacgttagtagtttgccgatgtattcctgccgagttgttagtaagcgatagcggcgagctcgtggtgcagttgtgcgcaagaccgataccaacatggcacaccccacccaaattgataaagcgatataagttggtgaaaaagctgccccaaaggtgcccatttgataaatattctcattcttcatcttaaatggactagccaacgaactccccattaatttaggattgttttgtaaaatcgtaatgaccgatgcaatattatgatcatcagttaattttagctgattgctggcagctaatatcatacttttgtactgaagcaattgattttccaactttttggaggaactgccgatcaattgattaccttgaataaccgtatttaacgattgcgcgtttaaatgtcgaaccttttcaacatccgacaaaatattagcggatcgatctgaataggaaagcaggttattactaatgccggtcaggtcactgttagtcttgtgattatactttgctaacgttaaactcaggctgcctgttatgtggtacacattacttaacaattgctgctttaaattcgtattgatacgatcagcttgatttaactgatcttttagatgagttacctgctgctttacagttaccagcgtttgcttaactgtttttaacgagccaattaattcagcaacattttgagaatgcatattttgattaaccgcagttaaaaatgtgataagtggcttcatttgacagcttaaaagatcagtttgaatatcaattttagtgaccaaggcattcaatttatcatgattcatattcttagtaagatgattcagttcactaatcagtccccttagttgaagggccgttacttgaacatttcttaaattggcatcaccgttgctgaatgattgttgtagggaactttttgttaatttaagcaattttttgttgccactccgagcaacaccgtcaatatcaacgctttgagaagccgaaataactggtttaagctcagaaaaaactgttgcaagtccattggaagtatcagtgatttcgccaagagaattggttgccaaccccaatgtatcaccaagattgataattaaatcttttagattcagcaactgattttgatgatccccagcttgtttaccgacaaaattgatgtatgaaaagactgttttattaacttcatatgtaaagcgttccttaacaacattcaccaatgtcgtggccgcattttcggtgatctttgttcccatcggactgttcttcgtgttcgctgtataaataatttgagccttctggggattggttgatgcaatactgcttaactttttagaaaagttctttggaatctcaatttctgcatagtatttgcccgtccgcaaattttgcgcggcctgattcgccgatataaaccgccaaccaatttgatgattcttttttaaattactaacaatcgtatttccaaaattaacagattttcctcgcaatgctgcaccttgatctttattcacaatagcaaccggaatattatcaacctcacttgtcgtataaggattccaaattgctttgacattaaccagcgtgtacaaacatggcaaaaagcataaagccaccacagtaattagagccgcccgatggtgaaaaattgcgtgaatatcacgttgataaacgctcatgatatttctaaggatggtcatagatacacctcgatgtgattttaatggacagttctaaaattaatgagattccaatgttaaacaaactaaaactagaatcccattattactcagtaatccgttattcgaaaaagtagtcgtgattggcacaaatgccattttatctcaccattgctctttgttcataactattgccaagtcaaaatgtgtaacaaaagatcatttgcaacctttcaagcaacaacattcgaattattacttgatccctaaaactaattatcttctgtcccactgccccaaataatatatttattattctaaaaaccacatggcccctcagcctgagcacattagagcagtaaaaaaggcttcacgctctcccaaatgtgccttataataagtgtaacgcgctcattaatcattaacaactgaaattatacaggagattaagtaaaattgaaaagaatcattattaaagtcatgattgctagtttaacagtactttgcagtgccaccaccttgcttgttgtaacaccctcctcatttgcaaattccacttatgtttcagggactcatcaacttacaaccgcctcctaccgggcagtaagtggttatctttatcgttctccaaaattaatcaccaaattacataatgccgataattaccccctgacaactttttatgcatcaaagtcagtcaacatcacgcgatcaaacggtaatcgggctgtttactattacgttaaaaatggtaatggaaaaattcatggttggatctggcgcggttacttggttcgtgtcattaacatcactcagcaacgccaacagattaatcacttggtttcactcatcgattcgatgaccaccagcaatcataatcgggttgtgtcaatcttgaagaaaatcaaggtccacgatccactcagcaccttatcaaaagagattcaaaccatctcccagtcaattaataacggtcttgatctaaccaaactgagccaaatcacctcaattatcaagtcagatggccaaacgatgaacactattttccaaaatggattagataaattatatacaggtattgtcgtgatccatcacttcaacaatcgtgcctttgctctggcccagggtttacttaacctaatccattaaatgcctgttagaaaaggaacggaatttcatgcaaactattttcacactgctaaggcaggacttacataatatctttcatagccgtcccgttttaattacattacttgctttctgtattattccggccgtttatgcacttttaaacattcaagcttcttgggatccttattccaaagttaataccagccggatgccaattgctgttgttaataacgatgaaggcagcactattaacggtaaaagtgtaaatgttggcacacaaattgttcaggaattgaagaagaatcatcgaattcactggatatttatcaacgattggcaaggaaatgacggtttggatcaaggtaaatattattctttaattgaaattccggatgatttttcaagtcggttggcaaccttagttacaagcagtcctcaaaaaccaaatatcatttataagtcaaatgagaaattaaacgcggcagcaaccaaaatcaccggccaagctgaggatacactggcccaagaaatcaaaagtaattttaccagagtcagtactaaagaagcacttaagcaaatgaatgccgtgggtgacaaaattgatacccacaaaccacagattttgcaaattcggacatccctactcgacgcgattcatacaatcaatcgaacccaaaggtatctccaaagggttaatggcgattccaaagatacgcaaatttatttaaaaacaattaaagacgatctaccaaaggttgccaaacaaatcaatgaacttcaagcaatcgtgaatcatggaaaatcattgagtatcgctacaaaacaaactttaaactccgcccgtaacaatttatccaatgggttaaactcgttacattcacaaactgaccgactgcaaaccgcactttcagacctccaatcactcaattcaaatggtgagtccccaattgccactggcgagcttaaccaggtacaaaatttgaacaatgcaatgatcaatcaaattaataacggcctaaaagttctggatgttatcaataatctcctgccaaataatcgttcaacaacgcttattaaattattagccagtatcaaaggagacattcacgctcagcaaaaaaatattgaccaactaaaaagcttggccaacagttccaaatcaagtcggctgattcgccagctaattaatcgctcatcccaaattggtaaccgtatcgagtcaactatcactaatgcttcagctgaatttgatgcgaccaccagtcagaacctagatagcatggaaaatacactcaatacgggtttagcaaatgacaataatgttttatcggcaacgaagacattaattccagagcttaaagccttggctaatgctggcaattccgtcagtcagctttcagtttcacgaattaattcgatgaataaccggctgaacaatcttcaagataagctaaacggattaaatcaccaaaccggttttattaatgaaaagaatctgactcggttagttaatgctttgggtgaaagccctcaagtgtccaacttactttcatccccaatctcactaaaaacaactaatctgtatcgactcggaaaattcggttatggtgtgacaccattttatacggttctctcaatgtggattggtgttttattattaacaacaatcatggcatggaaatatcgaactaatcagggtaaacgcttaacccctaacatggttcaaggctactgtggcaaattattactctatttatgtatgacattgggtcagacgaccgtaaccctgtttggtgaaattgttcttttagatatccatccaggaagctttctttcaatgattgcctttgcttatttgattacatttgtattcacaatcgttatatacacgcttgtttttatgttcggcaatattggtaaggtgattagcgtcctattgatgattttacaaatttttggaacaggtggaatttatccattggagaccatcccttcacaattggcagccctagcaccatttttacctttcacatacgcaattcaagggcttcgagaagcaattgcaggtccaaactgggcaacattcagtcacgatattctgatgctgatatgcttggcaattacatttatagtaattgccccactgagacggatctttaaaagaccaattgacaagttggaaaaaggaatgaaaaacagtcgattatagtttacagatgatcatttaatgatattctgatccctcaatttactgattgtttttcgtttcaataaatcgtaaacttgacctaattcaagaaagagggcagttagttatgtgtaccagcgtcaattttttatctacaacgggcgattattttctcgccagaactatggattttgactttaaccttgacggccgaccagttgtaattccgcgtcatcaacactttaacagcgacgctcacgatgccggctatgacaccaagttagcttttgtgggtgctggtaaaaatattggaagttacattttagttgacggcgtaaatgaaagggggctgagtggtgccgccctttactttagtgatgaagcccaatactcagatcaacctcaatctcataaaactaatttagcttcccatgaagtcttaaattggattctgggtaatgctgaaagttgtgcggacctcgctaatcaattaggtgacctgaacgtcgttaattcgcccattaaattgctgggtcaaacagttccattacactggattgtcgctgaccgttcgggtgactgccgcgttttggaaattaaagcggacggcattcattatatgaccgatccagttggcgtcatgactaattctcccgattttacgtggcatctgcaaaaccttagtaactatacggaattacaaccaactccccaccccgatcgcaactataacgggtatcagatttcatcatttggccctggaagcggcacacttgggatgcctggtgattacacatcagtttctcgatttattcggactgtctttatgcgccaatatacagagggggtctccagtaaaaacgctatcaatgcattaagtcacattctcaattcggttgaaattcccaagggcgttaaactaaaggcaaacggtcaatcagactatacacaatatcgtggttatatggatatgagcaacttaacttactatatgcagccttatgatgatcaaagcatttcaaaagtcactatgactgaagccttgatgaataagtccgttccaacggaatttcccatcaaccatagtcaacaatatcaagaattaaattaaactaaaaagtgtcagatcttcgctttaactgaaaggcggttgacaagtctaatgaaagatattttcagcctgttttggaatatgaatggatgggtcttctttttacttttattggcaattgctgactattttgatcttccagaacacatcaagttgattctaaccaaatttaaaaaccaccagcctggtaaccgaacctaataaaaagaggctgagacaatagtcgttttgaccagtctctgttagtgtaaacacgattattatcaagtaaaaacgcgggacaaaaggcaagttccggccgtgtaaccggattatccgaatattctgatcttgaatatttggataattcggttacactctggaagttaagcgccttttgtcccgctctgcttttatagtcatgccccttattaaattaaggtgaatgaagttggaaaacacatctgtattgcccacttctttttataaaatcatcgttaatcacaaccaaaatacgagagaaacgtaactttctgccgtgcaaccaaatcagcagactgtatataccggatattttctttgccaatcgacttgaattcagaaaaggagccgcctgacacctcataatcagcttacttggctcttgttaaactcaccgtcagaacattgtcctttgttgtattgtaatccgccaatatgccattcacaacatccgccgcgtgcccatggctggaagttgagcggtggtacgtattgatccacgttcccagtgcatctagcccaaactcaaagccttcaaatacctgcatgtaggttgatgactgaggaaccggcgtcacaatggttatttttgtgacccgttgattgtcaatttgcattgttaggtgaatttcatcggtatcaaaaaatacttgttccccgttttcagcgttctttggcaactggtaatctgccagccgcatattctcattgtaaactcgagatacataactgtatgttcccaggtcattggtacctaattcttgtgccatcaaaataacccccttttgacagtcattataagggatgacaatcaaaaagaggttatttttgttttactatttaactattaactacaacccaaattacgataacaattattgaaaccactcatagcgtaaaagacgatgatcctgcttatagcagctcttcttcggacatatccttcacgttttctttaataatttcatgtaaccgttcaaataagattccttcacgaagaccactggtagagaatgtgattcgatcagaatccaagaaattcatcaacagaataactggaattaggccaccaacaataatatcagcccggtctttgctgatacccggaacttcctttcgttcttctaaatttttactaataatccgctggaatgtgtcgttaacatcactgcttcgaagttggtaaccgtggatatcatccgtgtccaataaattgttaaatcgtcgattaatcttagctaacgtccgattactgccacctaaaccaataatcggcaaattcaatccattgcgcaaccaccaaacatttgaataaattttattaacaaagataactgctttaaaaagttcagcggccgatacttcattagacagatcaaatttagaggacaacgttactgatccaatcggaatactaatcagattgctgactttgccattttgaaccaaaatgatttcagcactggcaccgccagtatcaataatgacaccattcgttgccggcagcgtttcgctgaccccaacgtaatcataataggcttcctgtgatccggaaataacgttaagctcaattccaatttcactcttcaccttttttaggaattgtttctgattggctgcctgtcgaacagccgcggtcgcaactgctttaatcttcagattatcaagctttgaataaacttctttaaattccctcaaagctttaatcgtccgttcaattgcatccggctgaagaatcttctcaacacccatattttcagaaagtcgcacgtattctttcatttgagtcatcgtttgataggtgccatccccaccaaccttactaattgtcattctaactgaattggaacctaaatcgattacggcaaaattttccatcactggttttcccctctatcttggtcttcctcatcaaatggatctggttgattctgtgggctcatcattggctcaaattgtttatcattcttttggcggggtactgcttgctgtgcattcaccattttagttgcctgagcagcaaagtactcctgtgaattgagaggtgcatggcctcgacgatccactcgtttgtacgacccatcatcaatcatggttcttgttttgacgttatcatcccacattgtctgataaatgtcgagaactcgttgggtaaggtctggttgaagaactgggaataattgttcaacccgtcggttcaaattccgagtcattaaatcagcggatgataagtaaacttgttggtccccatcaaagtcaaacatataaatccgactgtgctccaagaaacgaccaacgattgaatgaaccgtaatagtatcactaattcctggaatcccggttctaagacaacaaattccccgaacaatcagatcaattttgacgccggcgtgcgaagcttcatacatcttggcgatcatgtccttatctgaaagtgaattcatcttcattcgaacgtaaacgggccgaccttctttagcgtacttgatggcatggtttaacttgtcattaataaagtcgcgaataccgtgtggtgaaatatgcagttggtggaaaaacggcggttgagaataacctgataacatattgaaaatattagtaacatcaatgccgatatcattattacatgttagtaaccccaaatcggtataaaaatgagccgtgacatcgttatagttaccggttcccatgtgaatgtaccgttggataccattctgttcacgtcgaacaaccagtgacagcttagagtgagtctttaagccaactaaaccatagatgacgtggcaccccatcttctcaagggttctcgcccagtgaacattattttcctcatcaaaccgagctttgacttccaccaaaaccgtcacttgtttaccattttgggccgcccgaccaagatacttaatgatgggcgaatcaccggaaactcggtataacgtcatcttaatcgccaagacttctttatcaatcgaagcttgtcgaataaattcaacgaccgaatcgaacttatcgtatggatgttgcatcaaccaatcatgcttcttgatggcatcaaaaatattatgatccgaattgagttccttagcttgataagctttaaatggtgggtattttaaatcatcgtggccgacaaccgcactcgccagcttgtttaagaaggtcaaatcaatcggaccatttacctcataaacagaatcctcgtcaatcttaagttccttaaccaaacgctttcgaagcttaccactaatgttggagtcaacttccagtcgaataacgtgaccatgttctcgcagttttaattgctgctgaacttttttcaataagtcagaagtatcctcttcggccacatcaagatccatatcgcgagtcgcccggaacgttgagacttcttcaatatcgtaattaacaaatagctgattggcaaattgtttgataatttcttccagtaagataaaatcattagaacctcccggcagtttaacaactctcggaaaaatgcttggtacctgcaacgttgcatataatgatttgtcattgtccttaccagttaatctaagtgataaatttaatgaatcattactaatgaatggaaaaggccgtgaactatcatcggccataggcgttaaaaccggatataattcatcatggaaatagcccctgataaactgatattgtcgctctgttaaatcctcaacgttgagcagatggatgcccacctgattaattgctggtaaaatcattcggttcaatgtcgtatactgtttatttatctgatcatgagctttacggttaacctcttttaattgttcaataggaatcaaaccagatgcatcgggctgctgatatttaacttcaaccagcttaaccagcgatgctacccgaaccatgtaccattcgtcaaggttactctgtgtaattcctaaaaacttgacccgttccaataacggattgcttttatcccgggcttcctctaaaacccgatcattaaagtccaaccaactaagttcccgattggtaaagaacttagggtcgtaatagtcaacttttgtcttcatttctctttcacactcctctgctttaacattgcgcgatacccaaatgcttcttggaagaattgacttttcgaattaaatatccaattttcatacgctaaattagcattactaaaaacagaaataataatgttgggttctttaatcgaaactgaaattcgcttgatcttttgctgccgatcatcatccaacgcatctgccaacctaagaatggcagctaatttggcaattaatcgccgattagtagcagaaatatgctgaaagtgactgagatcttcacttggcgtcgttgaactatgatacctcgcaactgcagctactaagcgcctttctgtatctgaaagaccagtaatatcagagtggctgataatatattccgaatgtaaataatgttcatgaataccaatataattaccaacatcgtgcagaattgaagcaacttgcagtaacaaacgttcgcgattccccagttgatgtaatggctttaattggtcaaatagatgcaatgcaaatctggtaaccaacctttgatgaactggctcaacattataatgatcggccagattatttgccataataattgtttgctgagtaaagtcacgcttggaataaccatgggccactgcttcactattaaccaaaccgtcaacaattcccgaatctgagaatccaatttcatccgcgtgagttagcctaatcactcgacgaatcagcaatagttccggcagtactaatggtacgtattcttcatcagcttgtagccgctcaattaaatattgatcggaaacatccactaaatcatccaccaacctattaaatgcatcaattgataatgaattttctgaatctttttcatagttatcaaccaatcgtttaagaggtaatgtccccagcagaatgatcttgcttggttgttttttatcaataccacttgccggattatcactataaaaatcatttagcttactatcaatatagtcatttaacaagccaattgaatttggagctgtttcacgtaaactttgcagatcttcggcaatcttaattggccccaaagcaaaattagtcgaggaaatgaacttaccatcatcaaactgtgttacagaagtatttcctgaagtaattcctactaagaagactgtttcatgtttcattttctttttcttgcgcatgtcgatctggatatcctgatttcgataaaatgcttcttcactcatcgataaccagcggatagttaagcctgtatgcaggaacaactgatccgcaataaaatcggcgttaaatgcttgtgatagtgcctcactgccaaacagcttataatcagtaacgccatagtcacttaaaatctgaataaatcccgttaaagcttccgagacccggtcaacggattcgtacttaaccggcttatcctggtagacatcgtcccctaaattaatgtctttttgaacccgctccaacggctttaaattcttgagatttacaatcaatagctccagcccagagacattaaccataatcaccccgaaatattttgctgccataaaaatcctctctcttcttcttgactttgaggtttctaaccattcgataacaaaacatttacttgttaccgttagtatacaataattctcagtgggaaggttcaccctaatatagttagatacgtaaaaatttaaccatattactgaaaaatcattgaaaatttttttgataattgaaaatcaggaaatcattttatcagctacctgttagccgcccttcaatgaccagcgtattttgacatcccatcatttgacagcactgctttagcggttgaaaatagactcgtaccaaattttaaatgaaagaagtggcaattaatggcagaactaaatgcagcaaatgccggcacttacaaatttgacaacgattttgaaattaaccgcttaggatatggcaccatgcaattaactggagaaggtacttggggtccttacagtaatcctgaccaagccgccagtgtgatcaaacacgcggctgaacttggcattaatttctttgatacggctgattcctatggcccatggtttgctgaccgttacttagctgccggtttgaaacaagtttcaaaccgaagccaaattttcatttcagataaggttggtcaaactcgtcaaggcccaaacgtctggacaccgcttggtgaatccagctacctgcgtcaacaagtcgaagtttcaatgatgactttgggcattgatcatgaagatttactatttctccatcggatcgatcccaactactctgtcgccgatcaggttggtgaattagttaagatgcaggacgagggtaaaatcaagcatattgggctcagtcaagtaacggttgatcaaataaaagaagctcaaaaatacgccaaaattgatgcaattgaaaacttgtacaatgttgctaatcataaagacgatgacgtggttgattatgccgaagcacaacacatggcgtttgttccatggttcccattaaacaccggtaaattaatcggtgctgacagtcctcttagtacaatcgctaagaaatataacgtttccgaagctcaaattgctttggcatggttactcaaacgctcaccaaatattttaccaattccaggaaccagttccattaaacatttggaagataacgtggcggcagctaacgttaaattaagtgacgaagacttcgacaaactgagtaagctaagccactaatttatccagattcagtcggtgctcaatttaaaaccttataaaaaaggatttccaagatgcaatgactgcattttgggaatccctttttatttctcagataatttactttttgcatgcggccgccaagcacaggtgccggcagttttaagtgaattgaccatgatataatctagtaatcatggcaaaaaaggaattggttagactgatcaataattatcgctccgaatgcgtttgccaaagaaccgcgataaatgatcccgaataagtttcagaacacattaaaagtcacgattaatgaaaatctgttcatgtttgcattcattaatggcaataatcggggcgtgccacgcaaagcaactacatataaaatcaataaaaaatttctctttaaattttttattattatacgcgctgatgtctattcaggcaacgtaaattttactaaattattaatcacaagccgaaaactataattgctagtttagaattgttataatctagatagaatgttaatcacgtctggaggaactactaatgagtaaactatcaaattatatgcgtttaattggtgtccttgccgttggtgggattgcgctcattcttgaattcgttttaagattgcctttctattcccaaatcgtcatttccacacttggcttgtttatcgcattactcatgtttattgatatggttaagacactacgatccggaaaatttggtgtcgatttattggcaattaccgctgttattgccaccatcgccgtcggtgagtactgggccggcttaattgttctactgatgttaactggtggggacgccttggaagattacgctgccaacaaggccaactcagaactccaatcactacttgaaaattcacctcagtccgcccatttaatcacaggtgataacctcaaagcagttcagatcgatcaagttagtgttggtgatcggctggttgttaagccaggcgaagtcatcccagttgacggcacgcttacccgtgggaacacaaccgttgacgaagcatcgttaaccggtgaatccaggccaattgacaaagccgtcggtgagacagttatgtccggtgcgattaatggtgataattcgtttgaaatgatcgctgataaaacagctgatgacagccaatatcaaaacatcattcgtttggtcaagcaagccgaaagtacgcctgctcacttcgtgcgaatggcggaccgttacgccgtgccattcactctattagcctatgcaattgcaggtgtggcatggtatgtcgccggagatccaattcggtttgctgaagtgctggtcgtggcatctccctgcccactgattctagcggcaccaatcgcgttagtttcaggaatgagtcgagcaagccgaaatggtattattgttaagagcggtacaattatcgaaaaacttgccactgcaaaaacatttgctttcgataaaaccggaaccattaccaaaggtcatctcactgttgatcaagtttatgcaacgaatggttatacccaaaaagaagtccttgctttggcggctggagccgaacagcaatccagccatattttagcccgttccctggtggcagcaattcccgaaaacatcccgacggctaccaacgtggttgaaacaactgctcaaggtgttacagcaactatcgataacaagaccgtcaaagttggtaaaccgtcttttatttcgaaaaaaccaatcaaagcaattgatcaaacaaccgtttacgtttcggtcaatgatcactatattggttacgtttcgttttctgacgaattgcgaccagaagccaaaaaggtcatggatcaattacatgaccaaggcgccaaacaaattatgatgatttcgggcgaccgaaaatcaatcgctcatgaaattgcgcaacgagttggtattgacaaagtttacggcgaccgtttacctgaagaaaagatctccgttattgaaaaaattgaaaaccaatttcgacccgtcgtcatggttggtgatggtgtcaatgatgcgccgtcattggccatggccgacgttgggatcgcaatgggtgctcacggtgctaccgcagccagtgagtcggcagatgccgttgtgctaaaagataacttggggttggttagtaaagcagtcgaaatctctaacgatacgatgaacgtggcgaaacaatcagtcttaattggaattgcgatctgtacgatcttaatgttaattgccagctttggcgttattccggcaattatcggtgcgctcttccaggaagttgtcgacactattacaattctatgggcattaaaagccagagttgaccaataaaaaaatcagaaataaagactaaacaactcgtagccgacaagtcaaattaggactgttggttgcgagctgtttgtccatgttacaaatctaaattgcttctaacttagcctgacgctacttcataatccgcaataaattccggataataaaaaggattaaaatttaagctttactacacaaactgatgttcgtataatataaaacataagcacttttcaaaagaagttcagagggggacttacgatgcagcaaccaaagactaaacgtaattacgggcttgccatcttggcacaaatggacaagcaaaaactaccactaacctacttaagccgttatggtgttaacaatcaacggaaaatggcggactttttcttcggaatgggtgacatttcagaatatcaacaaatctatcgagatcttttagatcgtgaaagtcaaacaagcaatgctgattaattagttgctatcacatctatacgataaggagatcattatggcaaattttaatgtaattaaaggcgatattactaaagtgcatgttgacgcaattgtaaacgcggctaataccgcattagccggcggcggtggtgtcgatggcgctatccatcgggctgccggttctcaattagatgaagcatgtcgaaaactaaacggctgcccgacaggagaagcaaaagtaacgcctggttttaatttaccagctaaatttatcattcatacacctggaccaatttggcatggtggaaaccacaatgaagcccaactgttacgtaactgttatgtgaacagtctaaaacgggcagttgagaatcattgtctaacagttgcattcccttcaatcagcaccggcatctatgattttccacttaatcaggccgcaaaaattgcaactgaggctattaagaattttaacatgccattggatgtcaccatggtttgctttgattcagaaacttaccaggcttatctgcaggcgaagtgagagccacatcatttatctcacaccatttaaagtgcaaacaaccctttctactaggtactaggcaggattacaataaccgtgtaagacaagggcagataaattccagcatttaattggattacccaaaacgggggctagacaaaattatttttgccttagcccccgttttgtaattaaaaaggattgccatattaaactgccaactaacaagacggttttcaccgataaaccacatttaagtctactcaatcatcaagattcgaactggttgttagttatatgagttggttttcgaacgctcattcgaccatccagaatctcatatgtttgatcggcaaaatccattagtcttgtatcatgggtgacgattacaaccgccttattatgtctctctgctagttctttaaacattttgccgacctcgattactcgcgcactatccaaggcagccgtcggctcgtctgcaagcacaatttccggattagcgtataaggctctggcaattgcaactcgttgagtctgaccaccggaaagctgacctgggtacttattaactaaactttctatacctagctcatttaaaagattttcaagttcctcatgacccaggtttccgttcggcttaatctttcttacaaattcaaattgttctttcaccctaagataaggcacgagagaatacgattgaagaacaaaccccacttgatttagccgcaatttgtcccgctgctttttatttaattcgctaacgggttttccttcaacaataacttctccagaactgggagtttgcaatcctcccgcaatcgtcaaaaatgtgctttttccggagccggatggaccaacaaccacaattaagtcgcctttggcagctgaaaagttaatatcatggagaacatggacttttgcagttcccgttccaaaatacttattaatatttttcaattcaattactgacatgattaacctccaatcacctgaaccggatcaactgtcgcaatcttccgagccggaattgcggcaccgacaactcccataaacaaaagtccaaccgaaatcatactcaacatgggaacattaaaggcaatcggcactccaattgggatcattctggaagtcaaaagcgtcagagcggcgccaataataattcccgcagccattaagataagtgattgacccataatcgttctaaccaacgcagcggccggaattccctgtgctcgtaaaaccgcataggtcggtaatgcctgaaccgtcaagatatagaggaaaaccgcaatgatgattaatgaaataatcattaagaatccaatcataaaatcaaaagtggtattttgtgccgaataacctggtagttttgaaataaaatatgcaattgaatatttttttaactgcgaattgtttgcgttgtagtttgcgttcttggaagcaatcgcacttccaaaggcatttgtattttccattccccgcagctgtttccatgcagataaggttccgtaaatcactggtgctacgttgagttttgcatcttttgtaaaaccaacgatttgatatttgttagaaagtgaattcagttgaattttatctccaattcgatacccatctgatttgaactgatcatcaaccacgacttgacgattattatgaattttatgacccgaagctatttccaaatttttagcaataaattggtcatttttaataccaacaaatgaagatgattctttagggttaccttggtgcttagcgacaaccggtgcttgcccaataaccgcttcacggtcggtaagattggcatcctttgcctgacgatcagtaataagcgactggctcaaattaacgttggcatctttattcaaaaccatgcttttagcaccccaggaatcaattgcttgcgtattctcaccagcaagccccgttgagagtcctgacaaaataaaaattaaatacgtaatcagaacgatcatcgcaataattaaactgtatcgtaatttttcatgaaagatctcttttaacgctaaatacattagcccatctcctctccattcagcagttcaaggacttctttcaatcgtttcatagtctgaactttccgctcgggatttaataaaattgttttgataacctgatgacttaatatcatcgctgcccactgacggctatctaattctgaaaccggttgggaatgatcttcaccaattagcgactcatttttatccaaatgcatcttaatcaattcttgataccggctatttacaacgccgtcaacaaaagtagcgacttggtttaaataaaattggggatcaaacgaatcgttactaactttctgattaatagcggcgtgaatgtcatgcattgcaacgccgtacaaatatctgtaagaatcagccaaatcatcaaaatacttataaaatgccccacgtgcaattcccgccattttaacaatcggcgcaacttgtgccttagccaatggctgattactaaattccaccaaaagcgctttacgaattttggcttgcttttcagtttttaaatttaaaaaagttgttgataccatcgtatttcctcctagtgacatcctgtcatttgataaataatacctcattagtgacacggtgtcaaaaatgaagtaaaaaaaagagactgggcaaaataattattgtcctccaagtctcttctttctaaataaacaatcggtttaaaaaataaattttagtaagcagttgttgatcgaagtaattctggattacggtttgttagcagcataccatggccacttcgatcaaagatgacactttcaaattctctaccagaatggaatcgtgtatatttaatatctctcggcttcaaactaccccgacccgctagcttgcgtgctggtaatgtttgaattgaatcatcggaaaccaagtataggcgaccattatgtggattataccccattgactgctcatgagtgccagtgctctttttgaggagttgcttagtcaaactgactttaactgatcgatttccaatcactgcccgataaattttaactttaccaccagagataccccaccagtatgcatgacctgaattatcaaatgtgagattatgacctgccggcaccatggcaccacgattattcatatgaaatttaatgactttattcggctttaacgatgttgaactgactctttggatagttgaccaagcagtcggcttcatatcaggacgatctcgccaagtccaaattgagtggtgtttacgatcataggctagagattgcccatgaccaacttcaaacattggtccgacttttatcccagccatccgcttgggtgccaaggcaccttgaattgctgacagacttgaactgttcaacttgtgcatgtcaaaacggaccacaaatccccggccatgattttgatgcggcgcgtataaaacaaataaataattacctgcaaacgtcgctgcttgtggatttgtcatatcccaatcagtcttaccaagtgcctcatgattattaggcaataaatatttggtttctagtgtccatttagcgccacttacactatgaatcgaatctttacctgttggattatttgaccagttgtaatccgaacctactttgacaaagtgaacttgccgattgttcaccgtgcgtaagcttgagccggaatactgataaatcgcgttactcttttgaacgtatgtagccgcattaactgttgcaacagtcattaatcccaacgacaagccagtcagcacccctaccaacagtttgttaaatttcatatctaattccctccaattgatgccgatatgcatcacaagataactttattgtactgcattttcttagaactacgacgtctttttcaaacaaatcaaagcaattacatttgctgtgaacacaatcccagttaataagactaacctaataagcatgatttgcctgtaaaacttcaggacaatgattgactagtaaattgcctttagcagtgccatcatatgcgattccctcgaattcacgtttgggaccaaattgggtccattcaaaggatccatttgttaaatgaccatgcccctttaacttcttagcagggaaactggcaactgaagcatctgacaacaataacagccgcttgcgaatcgggttataccccatactttgaattcgcgtaccaggccaatggcgtagtttctgataagtcaatttaaatttaacggaacggtgatgaattttgcctttgaaaacatacgcgcaccatcctggaaacgaccaaaaataagcgtttccctttttatcaaatgttaaatcatggccaccaggaacggttaaaccgtggctgctaagtcgaaatcgaatagcgaagtcaggtcgcaaacttttcgaattaatgtgttggatatacccccaattgctaaccggaatccgcggagcccgctctttatcacgccacatgtataaaccatgatttttccaattgtatgccaatgactggccatgtcccgtagtaaaaattggcccagctttaatacatttatgaatttgcttttgaatatacgaaaattttccgtgatttttaacgtaggcatcccgtaattcctttgggtgaagtcgcacaccaatggaatcaaggtttgcgatattgaaccgaacaattcgtcctttattgcgcaggttggtcgggcaatatacgatatacatatattttttgccatccatggcaattgattggggattcccccaatgctgactatttttgccgggatacggtaaaatatatcgcgttgtgaatgtcactttctttccgcgctgcgactgaatcttatgttcaattccgacatgatgaacatgatagtaacgtttaggcactctaacataatgcaccttatgattattaagatagcgcatatgtcgtcggtgatagataagccctgacgatttttgatgataaacatgatatttagcttgagcaaccggcgcccccagcgtcattgccaaaacaaagcataagagagttttaacccatctcatgcaatcccctcccttgataacaattcgattcttgttaaatcgttaaaattaaactgcagattcaattctagctttttaaggcgtaaaaacaagtggaaaaaggttatgtccgacagaaagatactttttaccactgattttaacctgtttcttaaatcactcgcacatttgaattttaaacattcggtttcttttctgttgtattggaaattttttatcacatggtttaatttaatactcatcgtgattacatcaaaaaagaccagacaaatttataattgtcatagtctcccgtacatcaactattaaaatcagttactaaaaatgctaactggcgttacaattgctattctactcacttgataatgaatcaagcattcggatattttttaatttatagtgggtaatcacgccaacaattaagctaaacaggatggttaacagcgatgaccaaatgtaacctggataatgaatggttagcggaaagaggattgcaccggtttgcgccttaatcataatgaaatgatgtaagacaatgccgattacccaaccaaataaaattcctgcaagagtcaaaattacattttcccgagcaacgtaagccgtcacttcgcgatcgtaaaatcccagaaccttaacggtcgagagttctcgcattcgctcagaaatattgacatttgtgaggttatagagcaccaccaaccctaaagcagccgaaagcccaatgaaaatcaagactaccgaactcagtcccaccgttcccattgaattactggaatagcgcggataagtcacattcaagacacccgattgttttaaaaggtccttgctcagcttttgtcgctgcgctgacttagtgtgcttgaccttaattaatcgtgacgttggctgataattagttcccgttattttttgataatatttaggcgttaagtagaggtaatggccagcgtaatttttcacaataccggaaactaacactttaacagcgcggttaccaatttttaccgataatttggttcctttccgggcattcatatcagtagcaagtttttcagtaagaataaccccatggttagtcaacctttccgtttcggaattatccgggttaataagcgaaatatattgattcagatgtctcgttgttttgggtgcaaccatcgtaacagtagcgtttcgtttgatcccttttgttggcgaaaccgttactgatttgaccattgctactttttgagcggttatatttttatcatggatggcgataccaggatccgctaatgtcacaataccttgataatgttgaacttgcgtaaattgatcaggaatcaagtcattcacagaatcccgaatgccaaagcccgccagcattagtcctgtacaaccggcaatgccgacaattgtcataatcattcggcccttgtagcggaacaagtttcgataacttaccttttgattgaaattaaggcgattccataatggcttaactcgttcaagtaaaattcgcttaccagctttaggtgcccgctcacgcattaactcagttggcttctcacgtaaattaataatcagaacaactgctgaactcccaagggtagcaatcaatccggcaaagattgcctcaattagataaatccacggaaaaacacctacataatgggttagattattattactaagcatcccaaaaataaacttcggtaatgtcagcgttccagcaagcccaccaatgactgacccgagtagtccggctaataacgagtaaacgatgtatttcatagaaataacacccttcgtataaccaagtgcccgcatcaatccaatttctcgtcgattcttttcaatcattcgcgaaattgtcgtaaaagtgattaaaacggcaatgaataagaagaaaccgggaaagataaccgcgattgccgcaatactttttgactcatcaaaataatcttgatacccaacgttggtcgttctgtcattatacatataagttgcttccggcgtttttatcagttgactgcgcatttcccgcaacttttcagagctaacctgaatcttcttaattgccgactttacccgcggcgttcgataagcttgggggacttgggttaattctttggcctgcatttgtaaggatcttaactgcaaattgattttagccaacgctggtacaatcacttcactccgacgttgctttggccgacgacgaaacattttttcgagttgttcctgatcctgctgcacccgatcgttatagcgaccggtgccagctgccaatccctttgtgtcattgaatttgatagcaattaaagccgcttctttttgactgaaagcctggtttaagacatacgcaaaatagtcaacctgaccactaccaagattagttgtcccacgatccgttgaactcacaaacaagggtgaattaataaaaccgacgatccgatactctcgaccctttaatcctgccgtctttggcaaatggtaatcttggccgatccggtaaccatctttcttagccttcgtgtctaacacaatctcagtttgcgtttttggaaagtgtccggataccagttccagtcgattcaatttagcgtttttcataaacgaataaacaacggcaacctcgttttgtgactttttaacggttaccatatgacttggttcagctatctgaacgtttgggtcattctgaacaacttggagatcccttttcgtgagccccaatgttgaacttatcgtcatatcacttaattggtgctgatcaaagtagtgatccgctgacttatccaaactaggtcccgtagcccgaatcccaacgtaaagcaatgaccccaacataataatcaggacaatcgaaataaactttccccatgaatatgtaatttctcgtaaagtggcttttaaataggttgaattcaagttagtcacctaccattcaatctgctcaaccggttctggagactcatttaacgtaatctcttgaacctgggcatccttaatatgaatcactttgtctgccattggcgcaatcattgaattgtgtgtcacaatgataaccgtcatcccggcttgacgcgcagtatcctgcagtagcttcaaaatctgcttaccagtttcgtaatccaaagcgccagttggctcatcacataacagcactttagggtttttggctaacgcccgcgcaatcgcgacccgttgctgctcaccaccagacagttgggccggaaaattatcaattcggccagccagtccaacttggcttagcgttttcaccacatcttttgcatttggtgcaacttgactggcaagttcaacgttttccttggcggttagattaggaattaagttatagaattgaaacacaaagccgaccgttgaccgtcgatattcagttaactgacggtcgttaaactgagcaatatcttgaccatcaatcaagatttttccttcacttggtttgtccattccgccaagaatatttaacaccgttgattttccagctcctgacgcgccaagaatgacaaccagctccccttgatcaatgtcaaaactaatatcgtggttggccacaattgtattagttcccatttcataacgtttcgtttcgttacgaacactaatgaatgccattaaaatccctctttcatttttagacaacaaataattcgtgtttgtgaaccagttaatcattcttattaatgagaagtcttcatgttaatatcaatatgaagtccggcttatttttatttacgtgccatcatctcagctctggttctcaattaagtataacgtgaactactcggccatgaatgaccgagcttctgggaacacaaagtagtatttaggatatgatatcggtatgccgaaaacctaacttacagaactccgctcttttaccatggctagttcctaaccg
